United States Patent 6,812,339 (POLYMORPHISMS IN KNOWN GENES ASSOCIATED WITH HUMAN DISEASE, METHODS OF DETECTION AND USES THEREOF) - sequence listing, part 54

SEQ ID NO: 15384 - DNA, 18391 bp, Human
aaatgtgtcttcctctgggaggccttccctgattgattcccatgtctggatcggttcagtacccccagaccactacatgcctttctctgtgagcacttgtcatgctgacttgtgatccatggatctcagttagccagaatccagcacagcctgacacttagcaggtgctcagtttatggaacgaacgaacgaatgaacatctgttcatatacactatagctctgcagacaccatgattatcttgttctccattgtaccctcagcacccagtccagtgcttaggctgtagtagtaagacagtaatgatttattaattgattgaaagagggcgtcccaagaaagggacttgcgtctatgttgcgacgacatctttattgcaagggcaagaagcacatcccagacctttttgaaaacatcagggatggaggtgggaggcaaggcaagatggaggaaatttctaggagtacagatatttagctgtcatggtgggtttccctcttcaactatcgtttcagttttctagggtttttttttttttttatggagtttctctcgtttcccaggttgaagtgcaatggcatgatctcggctcactgcaaccttcgcctcccaggttcaagcgattctcctaccccagcctccgactagctgagattacaggcgcccgccacctcgcccagctaatttttgtatttttagtagagacggtgtttcaccatgttggccaagctggtctcgaactcctgacctcaagtgatctacctggctccgcctcccaaagtgccgggattacaggcatgagccaccgtgcccggccttctagggattcttaacctggggctcataggtggggcttcaaaagatccatgaatcctccgactctttaatcaagcacccgtgtcagtagctgtatgtgcatttttctggaagaggatcatggctttcaatgagtgtcaaaaggctgagactgctcgagacctcaccgtccaatacggtagccattagtcccgtgtggctctttaagtttagatttaaattaaaatttcagtgcctcacttacactaagctacacatcaagtgctcaacagccactacctacaggccagaccagatagagggcatttccatcattgcagaaagtttgatgggacagatatctgtattggtagcattaccaactgaatacaggtaagattggatccaactagtgcttttgtaaaatgagttaccaacatttagaaataaaacataaaaatctaaaatcctgattgatttcatttgggaaacaggactatctatcagcgtggggcctgcgttcccctggcagctggaacgcacagtaccgctccctttagagggactcttggtcatatagaagttccccgcttgaccctccttgacgactgacagtacgaccctcgtttctaggggacttcgcccgtcttggtctccttccaggctcgcgtttgtaaccagactccaaattttactaaatggggttgaattgggtttgagagcacatcttagagcagggtctagggctgagattcggggtctcagttggaagttgaggaagggcaacgtctccttccttacagttttcccggaactgtaggaagtcagagggaattttatcctgcacatctgttgcttgacaaagaacttcccaatcctcctccgagccctccagtccctagcccagttcgcccgggcccgcccctagcaacaagatcgcggggaggggccgaggcgaaacacgagccccgcgcccaccaccccagctggcgacgtggctccgcggccccggcttcccccggcagctcagcgaccaatgggcgcgcgagcggggccgcccgcagcttcccagcccgaggcccaggcgcgcccctctgctccggctcggggcgggcactggcggagggactggccagtcccctcctccgcgccggccccaaccctgtcgctgccgccgcgctccgagtccccattcccgagctgccgctgttgtcgctcgctcagcgtctccctctcggccgccctctcctcgggacgatggcgcgcggtggccgcggccgccgcctggggttagccctggggctgctgctggcgctggtgctggcgccgcgggttctgcgggccaagcccacggtgcgcaaagagcgcgtggtgcggcccgactcggagctgggcgagcggccccctgaggacaaccagagcttccagtacgaccacgaggccttcctgggcaaggaggactccaagaccttcgaccagctcaccccggacgagagcaaggagaggctagggtgaggccgcggccagggccccgtggggggcggcgcaggtgtccgagggccgcctgggcgagagccacgcgggataccaccgccaaagcgaaagcgaaatcgcgcgcgcggcctcgaggatggggccctgcccaactcggcgctggggctcaggctaacttgctggagggccccgggaccccagcttggagatcgccgccgccgcgccccggccggggtggtttctcgcggggaggcgagaacgtggcagcggccgcgggagccaggacggcgagggcccgccccctcccccaggttgcatcagaagggaggggagagtgcacaaaagaagagtttgtccacagtggcctgttagtgccatgagttcctccccactctctcgcagtttctctctgatcccccactcccggggagaagggcttgagacactcgctaagaaaatctcagggatgaacataaatggataaaagatgaaggggcaggcgagcgacaggcttgcttcctggtctcggccgcagtggtcttgccttttgcctaatcgccctgtaaatctatcgtaaggagtctgggcgcggtgactcacgcctgtaatcccagcactttgggaggccgaggcggggggaggggtggggagatcacctgaggtcaggagttcgagaccagcctgaccaaacggcgaaatcccgtctctactaaaaatacaaaaattagccgggcgtcgtggcacacgcctgtaatcccagctacttgggaggctgaggcaggggaatcgcttgaacccgggaggcggaggtagcagtgggccgagattgcgccactgcactccagccggggctagagtgagactccatctcaaaaataataaaaataaaaataaaataaaatctagtgtagggatacaaaaatccggttgaaaagggacacgcagtttccgattggaaacacgagggagcaggaatggaaacggttcgcctgaaacgtttctgttggcagcagatgtctgcagaagcactcagttctttggcaactgatttgtttggggggcaaaaagctggagggttctcttggtggtggaggattttgacttgggctgttaaaggcagttgagtcaggaaccaaacccgggaaacaaaacttcggcgcattttagtacaccctccccgggtcccctgaggaaacacttgggcactgtgcggaggtatctggtggtccttgcacagaggacccagcaggcagcctggtcccagatggaggcagggctggggaagaaaccagcagtcctgcctattgggcaccaggtctcagatctccctgaacctgattcctgggggtggaggatcttcatgttctgccacatgaaagagaacacagccatccctgtgctcctgggggcctccaaaggccaaagtgtttcattggaatatgaggataaattatacctattgtgtaggtgcaccatttgcctgctctgataaaaagacctttgaacttcaaagtcacctccaaacaattaccttttatcttgcagagtactttctcttctcagttaggacttaacaataggggccattgatgagttcagtctattgtattgctttgaggcacttggagactgatttatcctggagccctgagtggcagccacattgtcactggagaggaggcagggagaggttttgggatttggaaaactttataaggtgtggtcatgcagcttccagttaatgccttcattgtgacagttcagcctagtagtgagaaaaagtgacggtgaagttggtctggatttgatccttgtatcaacaccttgacttcattcatttattcatgcaacaaacatttgaatggctactgtgtaccaggccccagtttagataactggcaggtacaaagatgaaaccttatgctctgggcgtcgaagtgcttgtaagcaaatgtggaggagagaagcacagacaaactagccattatgcacaattgctgcaatgatggcctataaaacctactgtgagcacattcaggagaaggagccgccaaggctgcaggttagagagaggggattggggctgtcacctgatcagagtttgtaggatgacttggaggttgccaggtgtacagcaggggaaggccttcctgaagagaaaacagcccatttctaaagggtttgaaaagcgttctggggcatgaggggtggtgagtctgcaaaggggcagggaagggaagtgagaggtgagaatggaggggaaaccaagggcagagcaggaaggaccttggtgagatggacatgagatgttatcctgtacattgtcaaaatgtcataatccccaaaactcattgggaaagtcaggctggcaggagggcagtacacagagaacataatcaaggcacagactagaccagtggcagggagaggaggtgaatgccaaaggggcttggtctctccggattccaggaggggatgaatctagacaccagtgggaggcagaactggcagctcttgctcttgactcaatgagggggagaagagagaggtaggaatcaaggggacatccgggtctctggccttagccaccagatgggtgatggatgcaccattcacttgtaggttaaatgtggggtagaggcggggtaggaggtgctggaaattatgggtcctgtttgggatggggctgagtgtgagaagctgcccctctgtccaaagcttctgtttcagtggtcccctccaagattgggctgaggaggaatgagtgtggctggatctaggcaactttgtcaccatcacctgtcagtcctgaaaatgtgacagctctaaggcccctaaagacacctggaccagaggttgcaaagtgggaacccgtaggctgcatgcattcataaatatgcgacacagtgtaaattacttgcccacgtttaaagtttgaatggtttcacatacagacccccatatctggcttctcttgacacctttattcccatgtgtcagtcatcgtctgcagcagagtcggccagccctatttggcggctagcagggtacctccaagtggccataggtcccatcaaaaggttttgctcattctgttacctgttggtgttgagaacaaatgatgatggagttggtctgggtttgctccttgcatcaacaccttaacttcattcatttattcatgcaacaaacacccgaatggctactgtgtagcagctaccatcagccactgatctagattattgtctttagtgaggaaaagcatgcattctctcctttattcctcacaacattccttgtgaagtaggtgttcagtttacagatggggaaactcagagagtcaagacacttgcccaagatcacgcagataatggggaccagaggcaggacggggatccaggtgttctgatgaaagtgctaggcttcatctccatcctagctgcctttcccaggatctcccttgacattgttaaagagaaggttaagatcttatttattcttacaacaaatatttattgagtccctaatatttgtcaggctgagctatgtcctagatgtttatttggcatagattagatgctgtcctttccacaaaagaggattgtagagtctgatgtcattaccctgagattatgtttcccagttggcgttgggtaacccactggcatgtctccactgtgtccccaggatcagagcagtgcttggcacataactgggctcaacactgcacaatgttaaaagaattctgctgtgtctggctatgatttcctgggggaagaagcctgaagacacttgaagtttcatgttttagtcttttttttttttttttaaagacagggtcttgatttgttgcccaggcttgtttacagtggtacagtcatagctcacactgcagcctcgacctcctgggctcaggcaatcctcccacctcagcctcctgagtagctggagctacaggcatgcatcaccattcctggctaatttttttattttgagacggagtcttgccctgtcgcccaggctggagtgcagtggcgtgatctcggctcactgcaagctcagcttcccaggttcacgccattctcctgcttcagcctcccgagtagctgggactacaggcacccgccaccacacctggctaatttttttgtatttttagtagagacggggtttcaccgtgttagccaggatggtctggatctcctgacctcatgatccacctgcctcggcctcccaaagttctgggaccacaggcgtgagccaccatgcccggccattcctggctaatttttaaattttttgtagagtcaggatctcactatgttgcccaggctactctcaaactcttggcctcctacctcagtcctcccacctcagcctcctgaagcactgggatcacagatccagcctatcttttaggattgagacctgttaaacttgcaaatgaaggggtactttcaagctgttggtgatgtttacaccttcctgagaaagaggagcttgggttcttgggttcaggtaggaggtggagacattgattattcactcctccccttctcgtgtacaccctcccccacctaaaaaaaagttataggagattttctctgtcaaactatcaaactgatgaatttgtttcccattttttattaattaaagattaattgccactcagaatgtctgttgacaagaaagttttaccactgaagctgttagaattccagcccaaaacaaagaaagaaatctagagttagcctgtatgacctcctcccagataaatggactacaagggtgaaacttttttaaacactggggatagcttggaggtgtttttgaagttccccactgggatgctgtcctggtttgggaccatctggtctagagatgacaaaagtgggttcccagcctgaagtttgctctgggctagcatttagggtacctcagtggagttcagtgggaaatttgtgaaacctaggccagctgtggagctggtataggagtctttaccctaagagcagagggtttaaggttcctagagcggatcagctggtcaagttttgtgaatagattctatgatgtcaaggctccttcagccctgacatttgtgctgtgtccaccatctggtgtcttcttgctttacgtttcaagtctttgtatccatggtggtgggatttaaaaaaaaaaactcacttatcttttgatttacatacagtttccactttttgccttggacctaagccagaagacatgagttctcaccccagttttaccaaatactggctgtgtaatcttagaagttattccatttctctgggcctcagtttccgttactccaaaatgagggtgctggactacagcagggaagattaataggtttcatcttacagatcagctctgatccgttgataatggccatcaccagagcacagtgctgagaattctgagagcacctctaggtttatcaggacagaggggcacgatccattagcagtgtctgccatcagcactggttgggggaaagcacatcaaccttggaaggataaacttgaagattccttccagcctccttggatcattgattctgttgtagttgtatgtgcattttggattgtgcaggtgtttgatcttttgctggaccagcatcacacaagccttgataatataacagccttgtgcctgtgtgtgggtttctttttttttttttttgtactgcaggaagattgttgatcgaatcgacaatgatggggatggctttgtcactactgaggagctgaaaacctggatcaaacgggtgcagaaaagatacatctttgataatgtcgccaaagtctggaaggattatgatagggacaaggatgataaaatttcctgggaagaatacaaacaagccacctatggttactacctaggtaagaggtgctgcaggagcgatgacacagtgggggcccaggtcacaagctttttgtagactctctcttctcttatcatatccactcccttcagggagatgtcacagcctcctaagtagaacctgcttgtataacaccctcctctgtaaactcagaatgtactgagttgcttacactgaatgaagttacaggtgggagggaagggctgtgagggctaataaaaaaaatcccttagattgagaccccatctcaacttcgtctcagatgcacacacggagaagaaagcagaaaggaagtgtgtctgtggtatattttcaaaatgctgcctaattctggatagcaaggattgagtgggccggagcagtcagggaaggcttcctggtgtgggtggtttggaaactggagccttggagaatggatttatatttggagaaggtgggtcaactggaggggcaaagatgcagcaatgcatgcagtaatgggaagggtttagatccaagacaaacaagatcgggagaaggaaggagaaatgagattacagaggcacggggtgcagacctgctgggtgcatggtgaggttggcaaagaaacaggcccaaggagaaccaaagatgcactcacgcggccagaatcggggagatcttgaaagccaggcacggcgttgagacaagatgttttgggtaccaaagagcctctgtatgttccagatctaagaatgagatgatgaaagtagagttctgcaaagagaagtatggcagtaatatagtctaaagcctgcgctcttaaccacttgcagtaattcccctaatatgccatgaggcctagattatggggtggcttgaagggactgatattagaggcattctgacatagaatgttttaaagaactcagtaggtcgggaccttttttccctatatgtaccatttgagcatgcaggatgagtgatctggcaggaaacgcctttcttgaccgcacggtttaaaaacatttctgcatacatacatcctgcaggaaaccccgcagagtttcatgattcttcagatcatcacacctttaaaaagatgctgccacgtgatgagagaagattcaaagctgcagacctcaatggtgacctgacagctactcgggaggagttcactgcctttctgcatcctgaagagtttgaacatatgaaggaaattgtggttttggtaagataagtgaagagtctgggctgggaagagaccagggagaaaactgcctccaaatcttgtctcttccaaagagagaagatttttcagcctgaagggaattggagaaggactctgaagtagagtttgttggaatccccgtctacccagaaaattagtcaggtcaggctggctgctgtaacagatagcccccagttgtagccatttaacactagcaaagcttgttccagccagatggacctcctgggctgttctctgagcacagttgggtacccagttctcctctaagcactcctgcttgtgctctgccatcttgtagcttcaaagtcatcctggcaacacccagctggctgacaaaggaaaagagagggaatgagaagatacagtctttgtttactcttccggccagggaatgacacatccccttcacgtatgttccactggtccctcctagatatgaagaggctgggaaatacagtttagatacgtgcctagaaagagtaaatggggcccaggcacagtggctcacgcctgtaatcccagcactttgggaggccgaggcaggcggatcatgaggtcaggagtttgaaaccagcctggccaatatgttgaaatgctgtctctactaaagatacaaaaaaaattagccaggcatggtggcatgtgcctgtaatcccagctacttgggaggctgaggcaggagaatcgcttaaacccaggaggcggaggttgcagtgagccgagatcgtgccattgcactccagcctgggcgacagggtgagactccttctcaaaaaaaaaaaaaagaaagagcaaatggcttaagtgagcaactagctagtctctgccccatttttcaattttaagggacttggaaaaagactcagaaatggaatgaattggattgttaaaactgtatggaaatgtaaagtaaaaattatggctggaagagatgctacccttagcgggtgggtctttggagggtgggtggatcaggccctaggctttgaggaatgactatgcttgtaaggcctcagaatgtagttgctttccgtagtgtcttgttgggtcccaaatgtcttcattttccatgacaattaaataaatgccatcacctgttttcctgggcagatgcaccaacccagttccaactgtttcaatcctgggaaacagatggctagagcttttgtttacacgagctgtggatggttttagttatccaggtggtggaagggtccactcatgcttcatcctcctgactgccatgactgtaaggactgggcagtggctccaagaatcatttctctttaccactcaacattcatgtagtgttagctaatgtggcagaggacagtgcaggtggtgaatgatcccgagtagactacgagcctttgggagtggctctctgctctcaggttggctctttggtttgacccaggatgcctctgagttgctgtgccaatgaacagtaaactcatttaattattgacccaatcaaaaaatactgaataagaggtcaagtatactaaatacagagcacaatacatcaaaaagtcagatatacttttattttttagttgcccactgtttcacatttctcttgacaccaactcagtattcatagtcctgttagcactagagtctattcttgtggtcatctaatccagtggttctcacactgggtttctcgcatgttccccagtgggtgttttggctggatggtggagttagttggcctggcagggcctcctgatatcgtcagagcacctctggggttacaggtacatcttgcttgctttgaagaaagcattctgctctggaaactggggtgggggattaggaacagaaactattgcctgttttttacagataaaaaactagttcccagggaagtaaggcgatgagccagaagtcaccaagcattcagccgtaaaagctggacaaatgaggacaatagaattctcagacttcttagagcacatggccatcttgcattctgttttaccttttgcttcctaggaaaccctggaggacatcgacaagaacggggatgggtttgtggatcaggatgagtatattggtgagtactgacctagagtcttgctcagctgtcctgactgggccacatgaccccacccacacgtctggctactttccccagacgtctcttttagcaacagctgcaagtctatacgtcactcctgggagcttccagcctgcttgtcccatcagccctagtgatgtagtatcagggaagtattattaggcctcattcagtggagaagagatgaaaaggctggccctacacaaggctggccaacagttggccccatgactctgagaggtgcccttcatcacactgcctagttttacctttgcaaaaggacattggagatcccatagatttacagtgaagatagaggagacagtgtcagggcaaagcctctaaaactggactgggtcaatggagcctagaaactctgagtagatgcagctgtgattaacagaactgtttatgtgtctgagcactttgcagaaaggcattcttcttagaaagataaatgctttacagagtgcacaattgcccaataatatgctcattttgtgcccctcgtttcccatcctttggatgggagtcctatagtgtcaaattaatgtatttgggtctgaacccaccattgctggttagagcccttcctggtagccccaaatcccccccagcccaaccccccgctagaaaggactagagcaggcaacaaggacaattccatttgatcctcaccacctgctatggcacatggctccagctgcaggctcccttctcatggcagctcttttcccaagtctcaataaagtaaaagctggaaaatcatttggtttaggtgttgacctatgaaaagagaaatgaaatatgtataatttttgtacagatttttaatcaaagccattaattacctttaaatgtaaaactcagagcctgagttgctgtctctggttttgtggttgtattactttgccatcccagacacgagaacaagtgccttcagcaatgaagagcagactttcctctaatcattagaaattatgtttgatcatgagccaaacactgttccttgtgtgtcattggtaacagacaaggtagctctcgccacagtaattaaagtgatcttggtggcactaccctgatagaataacatatgctgacagctccctcatcagagcaagcagttgagccttcctcttgctgggtccacgtgcgagggtcacgttcggaggcgcagacctcttactgtggcactggggatgaaatgagactgacagcaaagactgcatgatcaaaacaaacaatgtagtgcttttgattgaaagtgtgcgctctgcccagccctccggaactgtgcattgaaatggtgcaaagtcagaggcagaactctttgagtggctttgcctaaaagaagcatcccattctttacagtgaatagggagagggaggtggaggcgttgcgcttgaaaatcgaatacctagtgactcacaggcagaggaaacccaatgtattgactcgtcatttcacttctcggggaggcttctcttcaagcggcaccaagtggaaagtgtgtggtggggggtggtagtaggaagagcactggaattaggaaccctaccttcaccaattagctgtgtgaccctggggtaatcatgtaatggcttcaaacctcagcttcctcatctgtaaaatgggggaaaaaaaagtgagcccatttttacaggattcgatgaagctcgaattagctaatacatattacaactctttctcaaaaacaatgtagacatgtcagttaggggtctaccttgtagtcaagggtcttgtctttttttttccttcacttactacctgcttcattcaccacctgacatttccaagctctgcttccgtgacagagaaactgcctgcagggtatctctcttttccaagagctactgacacacacacaatgcaaaaacgtttcctttttcttttccttgccattttgtacaatggggataatgacccatcttgtagaattgttataaggatgaaatataatgacaagtgaaagccctttggaaatgatataaacaatagtactaaacacagtggctaagactctgggttgaaagcagagtgaccatgttcctgtgcagcctccagctcatatgagctgtgggtcattgggtaagactttacctcattgttttcatctgtaaaatgggaattataacagcactcactttgtaaggctgttatgtgaaaatcaaatgaaaactgtgtgtagaacactttatacagtatctggaccatagtgttcaatgttagtcattattattagttttcgcttatgtagtgccagtttgggttgtagagggcttttacatcaaaatggcacatttgatcataatagccccatgatttataaattatcatctccattttacagacaaggaaacttcaggctcagtcactgaactaagtcaaaagccgggatttatcttttggcttctaaactcagttctttctactccaccacatggccttcatcatgaataaattactgcatcattatccccaagaagctgcctaccagctgtttgagttaggtctctggattggttgtcgcctttcctaaagctcaggaggtcaagtttgttttatgggggtgggggaggtttaccttcccactttcctttgtaaccaacaataaccttcccttctagcggatatgttttcccatgaggagaatggccctgagccagactgggttttatcagaacgggagcagtttaacgaattccgggatctgaacaaggacgggaagttagacaaagatgagattcgccactggatcctccctcaagattatgatcacgcacaggctgaggccaggcatctggtatatgaatcagacaaaaacaaggtatttcccattcttctggaatcactgattgaagggagacagtttacataagatcggttttgtttgctttttcggcgatagcattgacccatgtggccatgtctttattgacttttccttcttgtcctacagtggagacctgtaaacttgagctaataccgtgataacccacagtaaaattattaggccccaactttcctggaaagtcagctgtgagccacagacttacattaagtcacatttcctaagattgcagaactttgtgggcaggacacgatttaagaagtataccccgtgttgccctaggatcagcttatttatccattcattgtcaccaaatacttatcaaacatctgtgaggtgtcaggaacaaggaagcccatcccattaaagcccagacatcctcaggcaagctcaggtttctggctttaatgcctagtacttcggtatctattgataaacatccaaataaacaaatcaatacatttagaaaaatgtcctgcctattccccactttgctgattgcccccaaattctcaggttatgccaacagtcagtttaggcagcgaggctgtaagaggaaagtggcattcttgagggcctattttgggaagaccaacactgcttgtgggcacaaatggattctagcttctgaattactcggggacttccctgacacgttagcacggtttttatagcaagaggctgttccgatttggagttttgcaatgcagtcatggtagatgaaggaggtgcccagtagcttctggattactaaatatagtattttaaatgttgtacatcagtgaaatgacatgaacatcatacggaactagtacagttaccagagcttccatgacagtgctctttgatctcttctataggatgagaagctaactaaagaggaaatattggagaactggaacatgtttgttggaagccaagctaccaattacggggaagatctcacaaaaaatcatgatgagctttgatagacactcaccagaatatggcagactgtcataggcattctgttattgtcttggattgttgctacaattgtctaatttacagcagttgtgatcccacaaaaagcaagtttatacctcagattggggtataaaaattgtttttcgctcagtatttactggaaaatggacatcactagtctttcagtaagatttctctcaaaacacgtgaaaaccttggtaaattgcaattctttctggggatatattggtacaacatgacttaaaacttttttttttctattaaaacttaaaggggaacaaaacttgaaaaagccctgttcttcagaaggtgagtgggttgagggaggcagtaatatgaagtgactgctgtgtattttaactaccagattttttatatttgccactgttaaatagttggaaaggggaaattctgattaagcgaaagtggtatcatcctaggtaagcttatttcagaacaagtctaatatttcagattctttcttttcgactttatactctgagttattacttactgtaagtggtgtatatgaaacctccatgcattttccagtatggatctgctaatatgcacagtaaatccatgtctttgtttgtttttctattaaaaagcaatcaagaaagataatgtgaaaaagaaaggaatttagaggtagggaaaagatgaatgtcagacatttgaagaactatagtaaaatgataaacactaaatatacttgagaaaactttcttaatatgccaatgaggtaggcctgatctttgaaatagtgaataggaatacaatgcatttcctcagtgatcactgattagaatgagttggtgggatccttgggaagccaaacggagcggagttctggatcatgtcccatccagtccagtgaatccacgacccgcagacctgcccccccgcaacagcttataccatggaatgaggacaaggtgatactctgagctgtggactgaactggcagacacaacctgtacagattgaaatttcaccttgtaaggaggaagtgaatgaaataaaggatccccctaaggattttctactgtgtcctgtggtgtttgacttcacagatgctatttgtgacattattcatatagcataaaacagtggggttggatcccatgaataacattataaaggttctggggttttttttcatccaattactagaatgttcagaatagactcatatttactaatttaataaatgtatgtacttaatgcctttacttttctaggtcattttaactataaaatcttcctgaaaaaggttgcacctggaaaatctggacttcttccctgggcctatgaggcgctgtaggaggaggcctatgggatctggcccctaccagcagtagcatcatctccttaccactgtccctttcataccgcctatagtctggccccagagactttctagtcctcagacacaccaaggtcattcccaggttgggccctttgcacttgctgccccctcacattcagaatacccatctctcacgccctcgggtaacacatggtacttcctcaggggggctttccagaccccactatttaaagtaatcccaactcgaatctcggtttcacatccccattttattttcttcttggcatgcattactatttgtattcatttccatgccttctgtccaaattgccacaaagtgggggatttacagtgacagaaacttacacggttctggaggccagggtctgaagtcaaggtgtcagcagggctgctctgcctctgaaggcactagggaaaatgcctccttgcttcttccagcttctggtgactccttggagttccttagcttgtggctacatcactccactgcgtcatctctgcctctgtcttcacaaggccttcctctcctttctctgtgtctccccttggtgtgtcttttataagcacacttgtcatttgatttagagcccacttggattatctaagatggtctcatcttgaggtgcataattacatcatccctttttccaagtaagatcacattcacaggttctgggggttagcaggtggatatatcttttggtggggggccttcattcaagctaacctactacaccacttgacattatattgtttggacattgcttgtctctcccaagctagaatataaaccatgagaccagcagtctcgttttctgatttactgctgtttcccgggactgcgaacagtagagtctattagcaataaatgctcaggaattatttgctgaatgaatgagaggctgatggctttaatcaaagggaatatctctcagggaaaaaaattctgtaaaaaatattaaaatagctaacaattgctaaatgggaactttgagcgatttgcccaagattccacaatgattaaatggcaaggcaagacatcaactccaggtgttcctggctccaaagttctcttccatttagctttaagttttgctgctccaaatctcaaaatttcatatgttttctctttatttctttgctcatccacagcatatgattatgtggtaaggaaatgagaataactccgctttactagaaataagcatatggctttttttttaaagcaatgagaagctgttttttaaaaaatgagaaaataatattgtgtaacctaattataagcataacaatttaaaaggtgatgacattatttttcacctccaaaaaggaatatagttgatttattattatatgtagtaagacattaaatatatttggagcattaactttttcctttcaagtcagtgcacattggaagactaaccctgaacgatactagagcttctggggctgaatttaacactaaagaatgaaaaccttagctaggggcaaaactgttaacatggtgatttgtaaaaccttagatttctaataaggtctgactgtttcaaggaaaacatattttgtttctaggtaacatttcaagtctgattatgaacaaatgctacaaaattgatctgtaatgggaaatactgtaatgtcacaaagcattatttaatgcttaatgtgactgaaagcattaatt

SEQ ID NO: 15385 - DNA, 24205 bp, Human
ccctccatatccagcggatatttttctcgttctgagaagtgcaagaaacttgcaggaccaggaagacaaaggatttggatacaggctgggtgggaggacgggactgggttacaccgagaacccctctgagacccccagccttgacggcatgtttgtcgcaggcgcccctgtgctgggcgctagctgcggggctctgcggaggaaaaaaactgtacgatccaggcttctcctcgccttcctgtgggttttgccgtcaggctccagaaaacagtggggcttcccatctctgcgtgctgactacccacgcgcaggaacgcgccacgcaggtggcgtcgcggtgcaaatagcagaggggcgctgagccccgcaggctgcagggagacggggtcctcgggggacgcacggcgaagccccattcctcgttcttatggaaggggacaccgaggctggggtggctgagggcttgcccaagctcacagagccagataagaacgtcccttttctgctccagcgcccccactaccgtgggcgcctccttttccaactccccaaacccttagaaaggaatccctttgtctctgctcctcccgaggggagaggggctggggctgtgtctgactccgggcgaacgccaggtgttggtaaatttgggagaagctgggaagggagttaatgaggtgagaatgaagtgaaggagaaaaaaagcggagatagctgctccgcgggctgcgggcgggcggggcagcctctcctccgcggcccgagggcgccgcctggaggccagaggcaacaccgcgccagccccgcgagcttccccgcttcgctaaggcggggctgcccagtcccagcccgcatgcttccactcccaccctccaaagtggagcggctaaagacggacttggagactcggaatcctcactgtacaaagagccctaccatcccgtttcccatcctccccttcccacaccgagaaagcagggccccgagcaagccccatttcctgatttcgccggacacccggcttgccgctccctagctgaaccccacctctgtgcctcagtttcctcatctgtgagatgaggcagcgatagtgcctatctcacggggtgctgggaggagcagatgcgatcgtgttagggaactttttttgtttgtctgtttgtttgagacggagtttcgctcttgtcgcccaggctagagtgcagtggcgcaatctccgctcgctgcaacctccgcctcccgggttcaagcggttctcctgcctcagcctcccgagtagctgggattacaggcgcccgccaccacgcccggctaattttttgtattcgtagtagagacggggttttgccatgttgggcaggctggtctcgagctcctgacctcaggtgacccgcccgcctcgacctcccaaagtgctgggattacaggcgtgagccaccctgcccggccagggaacgttctttataaaagcggaattgtgcccgaattgccccagcttactgaggaggtaaactgaaacacgtttgggaaggagaattgccgaggccctattaactaatgctcaatattgcagggataagccccagctccgggtcctcgactctgctgcctcgcctggactcctgattcctcattcctctcctttccgtcccaggtctgcgtctgtccgggtttccccctctgtctccgtggctctcagccttgtcctctgagcgtccttctccctctcgctgtgtctgcccggtctctcctggggtctccggttctgccgcctcctgtccctccttccggctgccccggccagaggggctcgaaggcgcgttggggcccggggccacgctgggagacacgccttcggccgcgcctaattcgagccaggcgcgggacgcgtcccccggccgggaggagcgggaggggacgcccgccgcgctcggcctccccgggccccgacccctcctttgtaatttgaataaaacgcctcccccgcccgcgcgccgccttaacccgccgcctccgctctccccggctgcaggcggcgtgcaggaccagcggcggccgtgcaggcggaggacttcggcgcggctcctcctgggtgtgaccccgggcgcgcccgccgcgcgacgatgagggcgcggccgcaggtctgcgaggcgctgctcttcgccctggcgctccagaccggcgtgtgctatggcatcaagtggctgtgagtagggaccccgcgtccacgcgcacaggccggggactggggcggcggagggcgttttggggtcccctggatggggcgagcgcaccaagacccgggagcctaagctggcttggcggtcgtgggcaagtcatccctcagcctctgtttcctcctctgtaaaatgtccctgcctcccgcaggcttgcgaaaagggagtgagacgggcgtggaccacaatggaagcgcctggtcctgtgcagctgacggtggcgcaagggccacggagtttctggccacctccgcaggggcagatggaaaaagacattctgttcagggggcgcaatccagagcggccagcccaggagcggtccttgtccgtcagtctccttgaccctagcgggagttccgctgagacactcctgacccctccacctgggcgaccttgggaaagtgtcactctacttcttggggcctccttgtcctcctctgtcacaggagggtgagactccccacctccctcaaatcagatgagaagaggctcctgaaaggacctcagaagctgtcagatgccactgtgcacatgtgcagggcattcctttagatagaaattattcacgcaggggtaggagggagagagaggcttggtgccgagctgaagggagtgcctgctcagggggctgggggtggtgaagagaggagtaaacaccagccccttcccggaggagctgcgctctaagttgagagagataagcccaggctgtaaataactccacaagtgtccaagtgcccgaggagaaaccagagcgggaatctggaggcctagaggaaggaagcccacctggtggggacacagatgtgagacaccgggaagcttttccggggctgtgcctctggtgactgaagcgctgccgggagttggctggttcgggcaatggagaggacgctgtgggcagaggggctccctgagagggaaagtccaggacaggacaagggtctggaatctggggccagggcagggagcctgcagataagacagcagggggcaggttgtgggggctggggagggcgctgcaaagggtttgtgaattagttggaagacagggtgatagtggctgcgccgccagcaaacagtctggaggtcactggccctgccccttctcaggccaagttattgattaattgacgattcgaggagggaaccccgtcttcctgcctttcttgtttacaagaagcctggtctcagcaatctcccagccctgggcactagcttttcccagctgtccctgaggagttctgtgagaaaccagccaccttccttttgcaatggggtacccagcactgttccagctggcagggacctccgatcagcgagtccaagctctctcatccaccgccaccattttacagataaggatactaaggtccagggaaggagaggattggctgaaggagcgtcagaggccttgcagtgggcttgggtgtcatttgccgcccataagagtcctgtggggtcactgccatcatccctgctccacagtgggaacaccgagaccctgcaaagggcatgatgcacgcaagcccccacgctggcctgtggtgggatggacggctggctaaacctgacgtccatgtcctctgtccccactgcaaagtcaggctgccacagaaatgggtacaactcattgtgtgccttaaataagcccccaggctcttgggggagatggacatatagaaatacaaagtggactatggtctgtgtcctagcagagggagcatggcagcccagaggaggagtgatcagttctatctaagggagatgcataggccaggattggaaggacagggaggatttggatggtcagagacggagtgcaaagcaggcgtcctaggcgggaggcacagcacgagcagaagcctggaggccgaacagcgcatgcggggagacctggagaaaccaggcaccacaagagcctactcctaagtgccccagacgctgctccgagagcttgggtcatgtaagttagatcatactgcactcctatgagaaactgatagtctagcaataggggattaaagtcttgctagagtttaagatagagggggaggtgggaaaaggggtggagtttaagaataacaacgatctgtgtatgcatgtgtatatatagatacacgtgtgtaggccacgtgcatatatctatgtatatgtacatatatgtctacacacacatggcctcactttgtgctaggcgccgttctaagtgccttatgtatattgttccatttaaatatcccaaccaccctgtgaggtgggtgctgctattacccccgttgcacagaagaggaaacagagactggggcacacagagatgggggactctacctagcagggtgtcacagctcagaggtagtagaggcaggatttgagttaagctgcctagctctgtggactgttgggcacagggagccccagcacagctgggagcagggaagtgttcagtgaggctggaaagccggggactcacccaggagcctccgctggcctgggctttggagagtgagctggagatgaaaggggcacttggcacaggaactgaaagccaacatggcccagtggcctggaatgctcacctggtgggtgcctgggacgcaggctgagctggtgggatgggggctggggagaggggatcagaacctggctgcccatagaggcacctgcccagaaataacctggggatccttccctaccttacctccacccaggccaggcaccagaagactcccagcccctcaagtattcggggtcccaggtctgggctgtccacccccttcttggctttcctgggtagggggagggtttgaggggagtcccactctcctgtgaaccacggaagcggtggggtgagaggaaaggcccaggccggttgggaacatccataaaggccgcccccttccctgggcagtcccacacctgccactcccacggaggtggggccaggaggctctagagggccatggcgctgcagagtagggtggaaggagcgccagactgggactgcaaggcccagcctgagttctgcaggtcaatcgctttagcttctctgagcctcagtttcctcagctctaagatagaggtagaaggagccctacctcaggatgcaggaggcctggggtctagcttgtctctgcctctgattggctgcgtacagatctgggcaagccctgccctttccgggcctcagtttccccacttgcacagtgggagttcatgatgctgtggcagctgccgtttggtttcttggttgagaagcatcagaccaaggcctgttagggctttacctttgcaagatgggctgcacaggtgggtcagcatgtgtgaggccaaggggacaggcttccatctctgaggtctgggcagtcaggtgtgaaggggacccagtgtcatttccaggcaggactggatctgcaggctcaaggcccttcatcagcctccatttctctatctatacagtgaggacaagggctggactagtccctcttcactctggagtcctgggacaaagcccaggagggagagaacaggaggactctcaggctgtggggccccaggggcttcttcttcctgaacgggcagctgcagccccaagctgggatggctggtgaagaaggggcacttccgaggttcctagacctctccccggttcctagacctggtgcctaattgaagagttaattgaggagtcgtggagggagagcttccccaaggttgccccaggggagtagacggaagcctggggagaggctgggcttgcctgggtggcctagagcctggggtcctgctccatcctccctgccacatgggcaccagcatgaggtggggcccaggaaagcccaaagagacacggggaaaggagggacaaaggtctggttgggagaacaggatctcctcgactcaattgttctcccacctcagggtcagcagggtccacagatgcagaagcatggggattccagggcaagactgagtccctaagccagcccgcagccctcatcagcatcctcctcatcccagaagcacagatgtgggcatcagggtctctctcatcgccatctgttgacctcaccccatctctctccctgggtgggcagctgccaggctacattctgggtggcgctgatgggggcaccttctgaggccctctgagcccagctctgccgaagcctcacctggaaatggtctggcaataccactcagcaccgtgggcggccgagctgcagaactgcagagagggaacttggggcccaggtcacttaaaggagcctgaacctggctgccaggtctctggcctagaattcatcatgtgacctgacccctgtgcctagagggagagggatgctgtgaagtgcaggtccaggaaggaagcccttctttgaaggtgccttacacaggcgggtcccctagagcggcctgagggtagggttgctggcgccaccaggaaaatacctcagtgaagtcatttggcagcttgtgttaccaatgtcaaagcctgcattgttcttaagcattgagcagtatggatggggaaattgaggtggagcaaggggcagtgacttgcccaaggtctcacagggagagagctgctgagccagagcttgaacccaggtctctgccccagccagtcccagcaaggcccccaactcctgaatgagaggaggccttgccaccccggtagggccctgagctcgggcctcgcctgtgaactctgcattccctcctgtcctttcttccaccctctcccccaggcccccacccccagataaaccgaaatgtttccaattaggggtctgttggagtgaagcgagcaagatgtccacaaggagaactcccccacctcccatcctaatccttgattacctccccaagggggatttatttggaaacggtcattaccactaattaccagatgaccgcatggccctcctcgggagtggaatctgctgcctcccgcctgtgatctctgcctgcagcccctgtgggcgggtggcctccctagtacgcatggcagcctgctcctgtcccagcgtcagcctccaaggcgggcccctgggccttcacactgctctgggcccaccagggcctctggatctgtttctcatttacccttgggccgcctggggagtctgagcctcgtctggaaggtgctctgacagcaccttctccctgagccttctggggaggatggaaagactgagacccagggtagctccagggctcaccccagggtcccagcctaggagacccaggcaccaggagcaccaggctcccttcctttagagctgcagcacccagcactcacaagctgtctgcactgagctccccaggaagaggctcagcccccatcgtcccaccccgtggcttgagccggagcccagggaaagacacaggaggctgccttcactgcctgaacgcccaccatgtgccatgagcctgctgctaggccatgcgctgatgtgctgtcgcccacgttgtccttctcatttgaaaatggaggaagctggctcagaaggagcgggaagaaagttgggcgagggcaagcggcagagcaggctcaggacgggctgggtggggaccgctcagagcaaagcagagtggggacccagagagaagtgaccccagtgcctgcagggactgacagcctcaccaagaaggatgacggggcctgctggcgggtgctggacaagcacagcccctaaagcagggctgatcatcccctccgggctgccctctgaggtgtgaagtgggaggctctgtcaaccgggaagggacatgcccatatggagctgtttaccccatgacggcactgcacgcagggacagggtttgctgggtggaggtggaagagctgttgacaaccgggaaacacactgaggtgatgacgtttgcctctgtgtggtcagagcccacccaggaagtaaggcagggttcagcaacaggttccccaagaaggtgaggccagggcaggccagaacagttccatttaggtcaagaaaccgcgtctgagggatgctgtgtggcccaccctgtgccggatgctggcatctagacacaccagacatttcccgactcatagtttagggggtggcagtgaggggagactgccctggacaccacagttgatcttacacagggcgagtcacgccgccctaaccacagacaccaggccctgctttctgggtctctgggaaggtttctatctttgggggttatagggtgggtgggacatggcagagcgtgagaggcaggaggaaatgaaagaacctattgagtacttaccgtagcacatatcattcagccttggcaggaccctgagaggtcctcacgttgtagttgatgcccagagaggggcaatagtttgcccaagtttgcacagcacatagaggacagagcttgagtgagaacccaggccttctcactccgtctggtccaatacttgctgggcaacaagcgggggacttagcttcatctatgaattttttgtttgtttgttttgttttttgagatggagcctcactctatcgccaggctggagtgcagtgtcacaatcttggctcactgcaatctctgcctcccaggtcctgcctcagcctctcaagtaactgggactacaggcgcgcaccaccacgcccagctaattttttgtattttagtagagacggggtttcaccatattggccagaatggtcttgatcttctgacctcatgatttgcccgcctcagcctcccaaattgctgggattacacatctatgaatgttttaaacactttgcctacgttctgttatttaagtctcaccatagccttttttttttttaagtagacaaggtttcactgtgtcacccagactggagtgcagcagtgtaatcatagttcactgtaacctcaaacccccgggctcaagtgatcctctcaagtagttcagactataggcatgcaccacaacacccggctaatttttttactttttggtagagacggctctcactatgttgcccagggtggtcttaaactcctggcctcaaaggatcctcctactttggcctcagagtagctgagatcatagacatgagcaacaacccccagcctcatcatagccttttgaagtagtaattatttctattttattttattttaatttattttattttatttttttgagacagagtctcgttctatcgcccaggctggagtgcagtggtgcaatctcggctcactgaaacctctgcctcctgggttcaagcaattctgcctcagcctcctgagcagctgggattacaggcatgcgccaccatgcctggctaatttttgtattttttgagtagatacagggtttcaccacgttaaccaggctggtgtcaaactcctgacctcagatgatctgcccgccttggcctcccaaagtgctgggatattacaggtgtaagccaccgcgcctggccttatcatttctttgtaacagatgaggaacatgaagcccagagaggttggataacttacctaggtcacacagctggtgtccaaggcttgtgctcttcctggggctaggccaggagtgagaacagctgggtcattgatttataatgattggtagctttatccagccattagactagggcatccttgaggaaaggatctatgtcatattcattaccaaatgagtctgggaagagttggtgcttagtaaatacttcttccacaagcagatcaagttcattcatgtccagaagcagggggaaaggcattcctggcatcaggaaaagcttgggcaaaggcatggtggcaagacagttcctttcagagaagtcaagaacctggtgtagctggatgtcaggatgaggatgggaggctggcgagagctgggaggccaggctttgaggggccctgaatgtcaagcagcagcccttggccttgactaggcaggtccagggaggctgcccacaggtaggaaaagaccaccaaggtggtaactgtagtagcttccatcactgaccactgaccacagagtgtcagccctgggcagaacgtgtgacacacattgtctgatttaagccctcagttaatactgggaggttgatgggagaggagaggttaagtgacttgctcaaggtcgcaaggggagtgatatagcctggagtctacccaagcctgtgcagtgcccttggcaatgggctgcctccctcagaactcagcccaggggttctgggatctctaccttgccaggtctcagccctgaccctgggtgaggaccgctgggtccacagcaggcggggcactcagcacttctggctgcagaatggccccctcttggttccctgtcgctcctgggtctctgctgggttgctgaaggccagctgactctgggttccagacggcctctgctgtgggtgggggcactgagagtgagtccatgtggagtcctttagggttgtggggtccttaagtgctgccgatgcaggctgccctcagagaaggcctaggagaacggcagatcgaggaggggcctggtcctagagtcttggaacccaggtgcccagagctgggatctgggaggctcttgggtcctctaacatcaccagggttcatagggacccaccaggctaacgtttcccaaagcacggacgaggtggatgaagtcagcagcctcaagcaaagggctctgtgctcactgtactcaatagactccctgagttgaattttaacaccaagcctgttgctttgctgcaggacttctcaggacctttaaaacgtaaatgtgcatcctgactctccaagcagggacatagtacatcgtgttccccacatggatcccttttgtcagagtgtctcactggagcccattctgggaaatacggtttataagtacaaacactgaggcccaaagaggggcaatgaattatctaagatcacacaacaagttaatggccaagtctgaattagatactaaatttttcaagttccaggtcatcacaaaactgagtggctctttaatcctttattaggaattccttgcatggatatgggactttacaacataataaatgggtttagtaatcacatgaaacaatgatggaaaactcctacctcatgtagcgcatctagaaaggcttcagttaatagtatgtataattattgtgatcataagaatctagcatttctcatggtttctggcacgtagctgctcagtgttgaatgaatgttgaataaagactaataattcacagctgtgtgagaactaaatcaggtggtggaggtgagctttgtgaactgtacagctgttttgttagtataattatcctaaagcttaggtaggatggggttgtgatcctatgttatgaatagggcctgaggcccagagagggacggtgatgtgcccaaggtcacatggggtgtgagggggatccactgctctgccagctgacagtttgggagccttttttggaaggagccaggaaaccaggaggcaaagtccattgagggaaaggctggggccagaagggcgggtggaggccatgtggcccctgacaaccctgtctctccttccatcggtcatggcctttccatggtgtgcagggcgctgtccaagacaccatcggccctggcactgaaccagacgcaacactgcaagcagctggagggtctggtgtctgcacaggtgcagctgtgccgcagcaacctggagctcatgcacacggtggtgcacgccgcccgcgaggtcatgaaggcctgtcgccgggcctttgccgacatgcgctggaactgctcctccattgagctcgcccccaactatttgcttgacctggagagaggtaggagctggcgaggctgctgaatgcatgtgggtgcgggtgaaggaattcaggcatcaatctgtgtgtgtttagatggagggatgggttcatgggtgggtggatgatggattcatggatgaatgacgggtggatacaggcatggatggatggggtatgggtggatgaattaatcataaatatgggtgtgcaggcatgaattcacaaacgagtaaacacagatgagtggcgatatcatcacaggggagcctggacagcacatgtacctgtgtgcccccatgcatgaatgaaggaatgacccaaggctgtggcctgctgtacgtgaggccacatgtcagggaggctcctgggaggggagtctagaaacaataatgctatagagcccacccgcagggcagacaggtgtgccacaggtaacactgaaccagactgcagaaactgttgcaccatgcgcaaagcagtgtggggacagaacatctcgaagacttcctgcaggaggtggcttctggtggggggagtctgggggacccatgtacaatagggaggcttttgacagacagaagcgccccagtaggtgtaatctctcccctgcactatgataacttttcttgtgggtcctaaacagtagcagctaatgtttgacaaacattcttttcttactgaattatttgaactccagaggcagcctgtgaggtagctgttatcacccgtattctacagttaaggaaactgaggctggagaagggaaagtggcttgctagttaagagacagagccatggctcggaccgatggccagggccccgcagctgaggctcctgagtgccgtattcgtttcccagggctgctgtccaatgggccacaactggctgcttgcaaacaacagatgtgtattgtctcaaagttctggaggccggaagtctgaaatcgaggtgtcagcagggccgtgctccccctgaaggtgctagggaggatccttcctggcccgtccctagctcctggtggcggcccgccatccttggcattctttagcttgcagctgtgtcactgcggtctctgcctctgtcatcacagggcaagctccctctttgtgtgtctgtgtatccgaaattcccctttcttataaggacaccagccactggcctagggcccaccctgatccggtatgacctcgtctcagccccattacatctgcaaagaccccacttcgtcataagattatgctcacaggtacaggggtcaggacttgaacacatccttcggggggacacaggtccacgcatagcaggtcctttgtgcatttgtctggcgcatcaggagctcagagcctgggcctcactactgtaaagcatcccctaatgccagtgcagggcaagtgggtggaagcctagagctgtgagtgtgagtaggaggacgtgggtgagggcatgcctgtgggtgtggggtcctgagtgtggctgtcagctggtatattcagaaggaattggggaagcaggggtgacatctcaatggccctagtgccgacccctgctggcgtcaccttggttacagcagggtgtgggcgaaggtggaggacctctgacctgggcagggtcctagccctggatcagcgtcggctgaccttcccctcccaccctcagggacccgggagtcggccttcgtgtatgcgctgtcggccgccgccatcagccacgccatcgcccgggcctgcacctccggcgacctgcccggctgctcctgcggccccgtcccaggtgagccacccgggcccgggaaccgctggggaggatgtgcggacaacctcagctacgggctcctcatgggggccaagttttccgatgctcctatgaaggtgaaaaaaacaggatcccaagccaataaactgatgcgtctacacaacagtgaagtggggagacaggtaaccacccaccccacccacccccagatagttgtgcttgtgccattggccagaaaagggccacccagcttgccccagtggtggggggtgcggggggacgggccctgactggcccacacctgatgtgcctcgcaccatcctcatcctcagcccttccctcgccagctgcttggggcttgtgtcgctttcctcctccaaggcgtccactggggtttgggttgtccaagcagagggagcactgaactaggagtcaggagctctgagttctggccttggctctggcactaaactcgcttagggactttgggaaagtcagtgcctctccagcctcagctgttcccatctatgaaatggtgggggtgacctggtgctgagtccccatctgtcatgttcctcaagctgtccctccctccagggcgtggagagggctgtggtcaacagaagcctatgctaaggggtcatctgcttggatttaacggggactcccacccacaccaaccgaagctgctagaacagtttcctccggcattcattattatcaggttttcattcattcctcacctcactgcccaaaagactggggtgagtggacctgtcagtgaatgaactttctaccaatctgtgttgcagacactgtgtttggtgctccatacctttctgttctgtggtcacagaacaactcgggcaggccctgttgtcccctttttacagatagggaaaggaccgtgaatggcagggatggccacttggccagagctgcatgtgcagatggcatctcatcagctcctccctgcaccctttagccccattttacagaggcactaagtgaggctgaaagcacttcagcggctcagccccacggcacaatagagcccaggactgtgggactcccaagtccaggggcttcagtggcctcacctgttctcaagggtcttccttgtgtgaggattctagggtgtccaggccatccttggacagttagggaaactgaagccaaatcatactgtgggtctatagcagagcctggccagggactcaggactcctgcctcctggccctgctgacctgtcccctacccctgctcatgaaacccagtgggagcccttcgccagcggccagcacgcccaccaccatggccacgcccaccaccatggccacgcccaccatcatggccaggccagctgggcgccacatgctgccagggccacagccctcctctccccaccatgcagcccaaagagggtcctccgcctcagggcaaatcaggcccgtccctgaggccatctgcaaaaggggccagtgtccctgcaaggtgcagggctgcgtgaggattaaatgagatcacaaacgtgtttaatacaccaggaagctccaagcccctttccccagcttatgctgagcagcagaacctagttcacctgccctcgatggctcaccagtgcctcggtgccctgcagtcctgctgacttcatccctgtgacctccacagacaattccagattgggtacccaaacacactccctgggtcctcacttcctggcactggtgaggggaaggagtcctgggaccttggccagctcccccactaactcacttgtcttgggcaagtcctgcccactctgtgcctcagtttccccatgtctctgatgcaggggatgggcccaggttcccatgactcttgcaggtctctgtacaggagaggcaggagggtaggcctgggcagaggaatccaagtcttgtgttgaaagaagggtttaaaaggcagaactggaaggcccgtagaaggcatctaacttctgcccctcaggtatgaatagggaaactgagggccagggaagctggtgggcccgagtcctttttgaagccagggcaagagtctccccaagcctctgagcccaagggggctccaccatagttattacttaaatggatttttcaaaaccaatattgatttaacttttatggttcacaaaacccttttgtgtgtgtgatctcatttcatccttacagctctctgcaaggcaggaattatgtgctcgccttgcacgaaagaagacagaggccctgagtggcgatgtggcttgctgagggtggcctggcaggagcactggcagtggggggaaagtcagccaggcggcggggaggtgccccctgcacttacccctgcctcttctccccttcctaccctcctcccttccttccttctcttcttttctgccttttttccagcaagcatttagtgagagaaaaagcatgaaacaattaaaagccaccacttttggaatcagcctcagatctgggttcaaattcaagctccatgattttctatctgcacccttgggcatgagacttagcctctctgagctattgtttcttctttttaaaatgggggaagtaaggatacctcccttgggccgttgtggtgatcaatctccattatgtgttagagcgcttggtatacagcaggtgctaaacaatggcatccctatccctgaaaatgcctttcttcctgcccctcagctgtgccccccacggttgcaggaaggcccacaccacctccaagctttaaagcaaaaagctctatcacttcagactccagcaggcagtgactccctgagagcacccagccatgggtgggtggggctggggtcccgggtcaggccagggaggggactctggccacccagctgacgccttcccctgtccgcaggctctgcgcgcctctctggaaatgaagtgtaagtgccatggggtgtctggctcctgctccatccgcacctgctggaaggggctgcaggagctgcaggatgtggctgctgacctcaagacccgatacctgtcggccaccaaggtagtgcaccgacccatgggcacccgcaagcacctggtgcccaaggacctggatatccggcctgtgaaggactcggaactcgtctatctgcagagctcacctgacttctgcatgaagaatgagaaggtgggctcccacgggacacaagacaggtgaggcctgctgccaccttggtgggaaagggtcaccggtgttgcacatactgttccccagctcagggtcacgcacacagcagggactcaggtggcatgtggggaatggagaccctgctcagttgagagagttggccccaggactgctaagtggagatgccagggttctagggtcccctgcagagctgctgggagcgcctgttctgcactgcacctggcaggggccagtgaatgtaggctgatggggggcccctgctccaccttccccagctggggagacagatgggaagagacaatgacgctactgggggacaggacaggaacgaggctgcccaacgtaagataggtgctcagaaaatgtttgtcagatgaacagatgacgggtaaaggccatacagcctgctcgttgcacagcaaagggactgaggtgccaggggagatggggacagcctacactgtgtgagggagagtgatgtctgcctgcattccgtgcagcaacactgcccctgtgtcctcgcccctgtgagccctctccccgcacgcccccatctcctcctggggaccccaggcctggaaccctaccacagccccagtcacagctgctgcagcaggctcaggacaggagagtgagggagccaggggtgactgcagacctaccgtgtgatgggtggggctggtgaggactgcacaagcagcatttcccaaagacggtgctggcgaaagctggtcccgatctcctacgagagaaagagctctgtcgtcacatgcatttgggaaattctctggcgattcacaaggcactagaacatatgaaaggctctgaggaatctgcagtaaaggatctgtttaagccagtgtttcccagaggtgtttggccatggaactcttttattaaggagcccctaatagcattccacaaaactcgtgttctcggggttaaaagaatattgcaccagagagtgggtgtctgggaacgtgtctggcacatagttggtgcacagccagcgttgacttcctccgcagcccacgttcctgtctccaggagagggagggggtgggctggggggctgcatccccacaggccagggcagcaggctctgtgaggaggcccaggctcccatctggaggccagattgagggggtcggcagagggaagatggaaccaggtcaggccagggagacaggaaggagccagaggctgggctgaggtagatggggatgggggagttagaggaggattctagaacatggagggctgcaggaggcccacggaggacccgagagtgaagaaagggtcttcctggatccatatgtggctctgtgtgtgtcagggagggcacagcttcccaacagggggacttgagcacatccctcactgatctgaagctcagcctcgtcttccgcacagtggggagggcaccccaccgctcacagggttgtcgagtgatctccaagcgcacttacctagcatctcccctctcccctcccctcccgggcagtctcccctcccccgtgccctcaggctgccaggcccctctctcccagctgcccctcactcctcatgaggaggccccgccctcagcaccacttaccctcctggcttccttcgcagcccccacaggtttcctgccttgcggctcccggtccttccctagggggacccttgcaggcatctgtattagttggcttttgctgcagtaacaaacacccccaatttctcagtagttcataaccacaagcatttcttgtgcccattacatgagactgcatgtcagctgtgtctctgcctggctctggcaggtgctggtgggaggtccccaagggctcaggtcgtgacagaaaagcctggtgtgaagggagcccagagggtccctgatccagcctggacatcaaggaaggcttcctagaggaggggaaatttaagattgatgatgaggttgggggttgggtgtaagtgagcctggtgaactgtgaaaggcgtgtgcatgcggggtatctctagaggctgcctccctctctgcggaagatgccttgcagcctcctcaaatctaacctggggaaaccaaggcctaatctgcagacaatattccaaaccctagccctcttgtcatatttcttccagaggcctgcacctctgaaacccacccccacccacagtctgagccaccctgtaccctgggagccaggcatccaacggcccttccctgggcctatggccccactggccccaatcctggtcccaggcacccgggccttgtctggatctgacactggaggccaagttttcagacaatgcatgtcagggatccagaaatttaaaaaagaactctgcctccttcctacccttcagggtagagtgctcagccagagccttcaggagaaggctgagggggaactcatggatgccaagtggctaaacaaagcccaaaaaggttcagtgacctgccttaagtcacacagccactaagtggcagagctggggcttgaacccaggtctgtccagctctggggcaggtgttctgggaactgctggcagcccccacttgctggtcaccggctgactctccccaggcgctcccctccttctgcccatggccccttccggctcaggcctggcctctcccccagcactgatcagcctcctccgggcctccagccctccccttccatctgctctcactgttctgagggcaggcctcgtcttctgcctttgcccaggctgttccctctaccccagcactccttccctcctctgcacggcggagtcttgcttatccttcatgaatggcctagatggcctttcctcttccaggaggccctgctgaactctcacagaccttgtactcaccacgggcaaggcccctctcccttctgtgtctgtttccccatcagtaaatatgaggattgcattcggtcatctctaggactttcccatcttggacattctgggattcctcggcccacatgtggggaccctttgtccctgtcagtgccccagccccctgctgctctgtccccaactacatctcatgaaaacactccctgtctagcctcagcccagctagaggagccaccagtctgaacagatgatttgtcactagacagaagaactgagagcagtggaaggatgtttgcattttatagggaccttcaatgtcttcgcatcccacatttgggaagaaatgcagcccctgctggctcccatgccccaccctttagggtagggagagcaagtcagggccttagttttagtccccaagtttaagcctctgccctttgctgagcctgttttcatctgcataatggacgtaatcattccactgacccaagggccctacaggcctccactaagataagacactggagggagagcctgacccacaggaggcacatggccaacagacccctattcctccacgagcagcgtgtctgatgcccagtgggggttcgagtatttcagcatttatcctaggattctaaaaatcaaatgatcttgacatctctcataatatttaattaaagattaaatatggctgtgtgtggtggcacacgcctgtaatcccagctactcgggaggctgaggcaagagaatcgcttgaacccaggaggcagaggttgcagtgagctgagattgcaccactgcactccagcctgggcaacagagcgagactctgtaaaaggttacacataaagataggcttattagattggttggagggtccttccagtatttagaagtagaagaaatagaaaaaagctatctccaagacaacaaaacaaggctgggcacagcagctcatgcctgtaatcctagcactttggaaggctgaggtgggaggattgcttgagcctaggagttcaagaccagcctgagcaatatagtgggattccatcgctacaaaaataaaaaattagccggacatggtggtgtgtgcctgtagtcccagctactcaggaggccagggtgggaggagcacttgagccgggggcctgggtggtggggaaggcgggggtcaaggctgcagggagccatgatcacaaccactgcactccagcctgggcaacagagtgagaccccatctcaaaaaaataaaagaaaacagccccatcattttggtaaccccttattagaaatatagggaaaagttagaagtacctttaggtaagaggattatttaaaattccccaaagatcaagacagcttctaagaagggctgagtcggtggccatgggagacgctgccggctgcctggctgggagtcatggggtgttggtggggtggtgaccaaggcatgcactgacctccttcctgcccccacaataggcagtgcaacaagacatccaacggaagcgacagctgcgaccttatgtgctgcgggcgtggctacaacccctacacagaccgcgtggtcgagcggtgccactgtaagtaccactggtgctgctacgtcacctgccgcaggtgtgagcgtaccgtggagcgctatgtctgcaagtgaggccctgccctccgccccacgcaggagcgaggactctgctcaaggaccctcagcaactggggccaggggcctggagacactccatggagctctgcttgtgaattccagatgccaggcatgggaggcggcttgtgctttgccttcacttggaagccaccaggaacagaaggtctggccaccctggaaggagggcaggacatcaaaggaaaccgacaagattaaaaataacttggcagcctgaggctctggagtgcccacaggctggtgtaaggagcggggcttgggatcggtgagactgatacagacttgacctttcagggccacagagaccagcctccgggaaggggtctgcccgccttcttcagaatgttctgcgggaccccctggcccaccctggggtctgagcctgctgggcccaccacatggaatcactagcttgggttgtaaatgttttcttttgttttttgctttttcttcctttgggatgtggaagctacagaaatatttataaaacatagctttttctttggggtggcacttctcaattcctctttatatattttatatatataaatatatatgtatatatataatgatctctattttaaaactagctttttaagcagctgtatgaaataaatgctgagtgagccccagcccgcccctgcagttcccggcctcgtcaagtgaactcggcagaccctggggctggcagagggagctctccagtttccaggcaaggcggcttccgattgatgtcccttctccccccgcgctccccccacaccaggccctggccctgatctccctgtaagagctcttggtcaagggcgaggacagacgtcttgaaacataaacccagctggcagcatcttttttcctcagggacacacacgcaggcgcagctcaaagcctggccgtgttgtcaggcctgcctgctaagctggcttcaagggaaaacactccctgggcagctgggatgcagacttcggggaggtggtgcagatccaggctctagctagccctggtgggttttctgcgtgaccctggggagggctctctgccagctgcagtttccccatttgtaaaatgggagtggtggggaggaaggctgaaggttgggaaaggcctcgtgcctggaggctggcagcattggacgtgttgagaagtggttggattctggttctgttttgaagggggagccaacaggatttgttctctttttgcatgtggggtgtaaggggaaggaggcccaagaatgactgccggggttttggctggagcactgggaaggctgaaggggccgaatgccgacatgggggtggggagaggcctggggttcagatttgggcccgtggggattgtgatacagtttacgctcctagtggaaatactgagtggccgggcagatatccgggtctggagtgctggggagcggccagggctggagatccacatttgggtgtcatcgctaagggagtgtgtgggatagaagagtaaagaggaccaaggcctggggcactcctgccttggaggctggggagatgaagctcagagaagacacaggagacagaaggaacagccagggaggcaggagggaggtcggcggtcctggctgttgccaagtgaagacagggtgccaaggggaacaggatcaccgcaggcacatcactgtccctctgagcttccgtgtcacctccctcatggaggcagcaccagtaaccaagagatgagtaagtggggtatccccagtgcctggccagggcaggtggccccgaaacagaagcagtggttcatcacctggatcttgctgtggctggggtgtaagaggatgttataatccaaatctctgcatgcaccagagagactcggacttagtaccagtgctcttccctccccgagccggctgaggactgagacaccacctggaggggctggggcagagcggggccttgcacaggatttggagaagtgaagccacatccttgggggtgggatggcatggatgacccctcaggggctggacccatcctgagtgggaagaagggggccttctgtggccatcctcgaggccctgcctgaaagcttgcagtggggacagccagagccacagcgtcaccagctgcaaggaacctcaagataagtcttctggtgtgttttgcagatgaggaaattcagagatgggaagggccttcctgtggtcacagagctgataaggggctgggaacggggggaggtggagccttcccgggtggggcccctgccagcccctctgttgaaaacccccagcctccctggaaggagcccctggaatgtgcgctctccaggcccagggcttccctgcttcatagctctcagcgacctcctagcccacaaaaccaatccccagtccctagcctggaacacaaggcctgtcccccaggcgattcttccaacagcatttcctgcaactcccagctgctcagcctgcctgccctctgggcatctgctgttctccctcgccaagagtgctgttttccctgctggaatcccacacaaccctcacagccctctccacaaaaccttccccagtgccctaggtggaagggatctccccctcttcaggcaccccacaaccctctgaacatttaaagcagccatcaccctccttctcaagctgccagccaatgccctcttctgcaaaagccaggtaaatggctccctcctccaggaagccctccccaactaccctcagcctgg

SEQ ID NO: 15386 - DNA, 14621 bp, Human
actgcaaactccacctcccaggttcaagagattctcccgcctcagcctcctgagtagctgggattacaggcacatgacaccacagctggctaattttcatatttttattagagatggggtttcaccattttggccacgctgatcttgaactgctgacctcaggtgatccacccacctcggccttccaaagtgctgggattacaggcgtgagccaccgcgcccagcctagaatttatctttaaaagcaatatacagttgaggcaggaggaagcacatgagaaccacgacagccaccccaaagagatggacaccatgccaaggctggaagcttttgttaataatcagacctgtcctaaaaaagaatgcggggctgcctctgaaggaggtaagctctctcttcttagaggtgcctcggtgcttgcctttttgggatactgagaagagggcttctgcctggggctgcagacaggaacccctgacctctgagatgccttgcagctcagagtctttaatacatttattccagaatccttcgactctgagattttaacatgttaagattccttagctggattcaaagactccttgggggctttgagtggaagtaatctctgattccttgaccctgaatcacagagtctgaagcttttgggatctgagatttcccacagtccttgtactcaaaagactctgagctgcagaagcctacccagacagagaggtttgtcaccaccaccaggcttccccacaaccactaacagagggcagggacccaggtgattgactcatttgctgggtactgggatttttttgctccccaggatccaggcaagcacctagaagaaagaagatactcaatgcattcattcatgactgaatgaatgaagagtccctaccctgtcccttcctctccatactgcgtccatccaatagctatcattaaactactaaagaggacttttcggagggtagggagcctcggctgatcagaaattgagccactgtcgcccagattatttagggtttcctaaataatctgcctcactgaatcactgaattccctactaacaggtacataccccacagatggacatcgcacagggcaaggactttgttcagctctcagctgtatcctcagcacctagaacagtaatgaataccctagcttaacttggaggtcaaggagctatcagtttgcgagggttgggtaggaattgacagtgagacctgaggcctgtgggaggggacccaaagagggaggggatgcaatagggagggggccaggggtgacaaggattgaggaagggagagaggggggaaaaaaagcaagggatgccttagaaccacatttcacagccaagggaacagaggcccagaaagggaaagtaacctgcttagggtcacacagcaccttgctcagtggagagccaggttttccttcctgtgcactcctccaagcccagccagaccacctgaagttccccaggcatctctgcctctattactccaggacttgaactttccgggtgccgggcaggtaccgggtctggtctgctccctctccctctggccatcgctgaggttgaggttttttgaatgtacaagtatggagaagggcactgccttcagaagcctgaacgtctcccctgagagggagggggtgcacaggactcaattgtttcagcttgaaaatgggggagagcggggagaaggggagatggctctgcttggggcagagcccctgcggggaaaggggcgcctgaaaggacgtgcgattcggagtgggctagcttatgcagagagcctgggggtgggaggaagctcgcactctgaaggacacgctgatccccgtggggactcccggcgccccgcagcccgggccgccgagggaggcagtaggacccaggggccgggaggcgccggcagagggaggggccgggggccggggaggttttgagggaggtctttggctttttttggcggagctggggcgccctccggaagcgtttccaactttccagaagtttctcgggacgggcaggagggggtggggactgccatatatagatcccgggagcaggggagcgggctaagagtagaatcgtgtcgcggctcgagagcgagagtcacgtcccggcgctagcccagcccgacccaggtgaggggcgggagacgcctgcgtgcgtgcggcccgggggagcgccgagcaatctgggggtgcgcgagggagtaagaggggcgaggggaccctgcgaagcgttgggtgccgagccagagcctacaaattggagtcctcggcactttgggggccgctggagggtttggaatcgagagcccagggctagccagtgatggtgccagctgagggctagggcggagatcggagccgggttgggagtccgtgcactcggaggactgggaaaaagtgcagggacccctaaaaggtggtggtggcagatacgagactaggtgctgtgtaaagggggctgggggcagagagcagagcctctgcggaaagaaacagaggaggaaggagatgggtctggtgcctcttcccgcaagggtagggaggataggccggcctcgcagttccaggtcacttccgttctggggttgaggctcaggggcagcggtgattggtggcccagcctcctcacaggcttgctgagggaatttgagcttccggtggtgggaaaggaggtgaaatcgtctcgactcctggggtccgtgtgctctggtagaagtgggcgacagtggctcaatttctgatcagcagcttgcagcctagatgatggcagccaaaggaaagacttggccagcgaggctccctaccactccgaaaaaagagagtgggggtcagcagggtctgctctgctctggggattaaggggctgactagaaggatttgagtctttccttctgtccactgccacagggttcttgtagtaactgcagggtttaaactgcagggtctaacttccagaggctggggttccctgccccccagcttagagacattcctgaggtggctgaagagcaggaaggagaatgaatgcacttccagactggcccagagtctcagcccctcctcttccttgtttcccgctggtccctctgggctgtacggcccggatggaggcctgaggaaaatgagggggctttggttctccggaattccggccggggccacaccctcctgtcttcagatggttcatgtacccatccccccttcccgtcctctcctttgtctcctctgtcaccgggactcccagcagagattttttttttgtactggctgtgtaacaggacaccgcatgcagccctcaggaggggctctgtgcttctgtgaggaaggacccctgtgctgggaaggcagacccctgtttatcccgagggacctggggtgaccccctgccctggcctcgtttctcccattttacagtgaggtggtcgatctccaaggtccctgtagattggggactggttgtgccctctgcgccaggggcctcctcaccatctctcctttgccggctcccgccctcttcactcttctgttttctttcagaatgaaaaaggcaggcattgacctccctctgaggcagtttccaggtactttagacctctcaagtgtttgggaccctctggtggggtcccatcatctcctccccttcccttccagaccctgctcagtccagctagctgtgggcacagccctggctaggtgatcttgtattttctttgtgggactgtaactcagctaaccttggcctgagggctggcatttctctgtggcaagatgggctgggctgtgggaggctggcctgcttgcagtaacttgccttcccccattcctgctgctgggttcagtggggctgcccttctccccagtagcgcatttcccttcagagattcatgtgcggatgggaagggaactaaggccaagaaggctcctggagtcccctggcaaatatgtggcaccccctgggacctgagtcaggcctgcttcccaggctggaagcccccctctgccggccggtggagatagttcagcctcctgcctgccacgtcaccaccaggagcaggcgctaagctgccgcgggcctagcgggctgcctgaggaatcccaaaccagttatttggagcttgcttgagaagcccctcccagtcctttgaggttctggctggtgggggtgggggctgtcaagatggtacctgccacgtggcatggctgggagtgggctcttcagctgcctcctcagggaaggaaggctggtggcctctgctgtggtctgagctccagcatcactggtctggatcagaggtggattttgagtagggtggccatatgcctattgtcctggcataataattagtagtgcccattttactcttataagtgtccttgtttgtgcaataaattatatggttgctctgcctttgaggctccagttctggcagggaaggagccagagctgggagggaggtgtcttggggtttattctaggccccaagatatccccttcattttagggtgagactcagatctccccgctccttccagacatttttagatctctgggccttccctcctctccccaccttcctccccttggaccctttgcttatcttatactgcaccttcaaggctccgaggagggaggcagtcccgggagatggggagcctgtccaggtttttgggatggcagcagtagaatcttcccagaaatacagtggtccccaggcagccagagtcctgagggtcttccaccaggatttcaaatgttcggtcttcttcaaggatgactacaagttgggatctaccagagcagtgggatcgcagcctccaccaggattccttctatccttccctttgccctgtcatctctcctgtgctgttgcatgatgtagaggaggataatggcccgaagggagagagggagtgtggaagtatcccaggaacagagactgtcccaattggaggccccagagagggaactggggcttgtccttggggccactgctactgctggggcttggggaggaggcctgagggcaaccctgaagccgtggagcagatggcctgtgtggcagtggctgtcagattggagggcagaatggaatctgatgtggctccagcttctttgaaggctgagtgcacatctggccagctgctggtgatggggaagggggtcactgctctattgagctatgtgtgactcacccttttccctagtatcctgtccttgtgctatgtcaggaagcctcctccccagccccaccgagtcttcaaaggagttggtcccccaggagcttttgtcctggggatttcccatccgcactgggagcactgtgggtagatgggcattccaagttcctgcccagacagaagccatgggcatggagacctggacctttcagcttggaaaagggagactgaggctgagtggacacaggacacacacacactctcagggtcacccttggggcagcaaagtggagcatcttggctccccatttaatgagtgacccaactggtgactcattaacatcccagagcagaatgaaaggcatgggggcggggcagccctccggctctgtccctcatcccttgcccaggcatctgggtttcctgcagattctcagctcagctgctgctttttctcactggaaaagggctcccagggctatgtgagatcagggctgaccactctataaactgatgaggaccccaggtctggccaagtgaccctgttttaccttcgttcaggaagagctgaggcctactgtgtactaggcacgggagatatagtggcaaccagattggctagcttttctgtcctggaggccacagcctacttaggagcagaaatagttatgaaataaacacacaaataagtggaagtgttggctggccgatgcaggaaatcaataaggtggtctggtggtgacttgctgggaatgcttctttgagtagggaggtaacagaggcctctgagaggctggcagctctgagtcaagtctgggattcctggactgtgggctctcttgcccccatctccaggggacttgtggcagccagagagctgagggtggttgttggggaggaaggccttgggcttcaagaccaccctgtctgtgcaatcctcacaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctggggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgctagtcaacgccatgttcttcaagcgtgagtcgggggcgcgttcaggggtcctcctcctcctcccaggaccccctgcaagagttaggacgacattccgtgcgctccattcttcactgcctctcatttatgctgtgacaacccagggaggcaggactgtcactcagctttttgtacagactggaaactagattcagagacaggtagcagcgtgtaaaggaatggttcagggagcggaggccccagagggactccatggaatgtattccgaccgaatttcgtcaaagtgctcgtccttgtgtatcttggaatgaataacatttaataatccattctgcctcagtagtgagctagagaaagaactcaaatcctttttttaaaattatttttattttgagatggagtctcactctgtcacccaggctggagtgcaatggcacgatctcagctcactgcagccttggcctccgggcttcaagcaattctcctgcctcagcctcctgagtagctggggttacaggtgcctaccaccacacccagctaatttttgtatttttactagagacggggttttgccatgttggccaggctggtctcaaacttttggtctcaagtgatctgcccgcctcggcctcccaaagtgctgggattacaggtgcgagccaccatgtgcggccaagacccagaatccttaaagcaaccttgggggcaggcagtgttaccttcatttcacagtgaggaaactgaggctcagcaaggaggaagcagagccaggcctcaggcccagatgcctctgtcttcagttgaagattagatgtagggttaataaatatttttgagtacctccatagacaacactattctcacagtttgctgtgagaatgaagtaaccctcgttttacaaatgaggccaagctaggagagctgaggtctccccgagtcagtggctgagcttggattggaacacaggtctggctgtgagcaagggcagggttcaggccactctcagacattttttgttgttattttctggtcatggagacagaacttgcagaggaaaacgaagggtgggctgagcacagtagctcatgcctgtaatcctagcactttgggaggccaaggtgggtggatcacatgagcccaggaatttgagaccagcctgggtaagatggcgaaaccccatgtctacaaaaaattagccaggcgtggtggcgcatgctggtagtcccagctactctggaggctgaggtgggaggatcgctggagcctgggaattcaagactgcagtgtgtcatgattgcaccactgcactccagctgtaggatggagtgggacggaccttgtctcaaaaagaaaaagataaaaaaaaattaagggtggtcatggggcactccctgcccagggcacagctgtcccccaggtaccagggagggtagaaagcccacctcagagcatgcttccaaaatatctgacaagtgctagagctgggggtggccatagaggtggctgacctgagggcggaattaattctctatcatatgggagcagcaggcactgactgtagggaaccgcatcctcagatggcatgtcctggggccaagaccccttcccaaagctgggaacatagactctgtgggctgggtgctctatagctgggccctgaagaatggagcaaagacctgtggcaaggataaatcaaggtctgcagccgggggtggctgtgggctgtgattgtgtttgggggcggccatgtgtctctgaccctgtgttttgccccaactacagcacactgggatgagaaattccaccacaagatggtggacaaccgtggcttcatggtgactcggtcctataccgtgggtgtcatgatgatgcaccggacaggtaggtgctgtgaggagcagggtgtcaaggtgggtgggggtccaagggtagttggtctgacccacccctgcacacagggtgcccagtgtcctttccgctcctctcccaggcctctacaactactacgacgacgagaaggaaaagctgcaaatcgtggagatgcccctggcccacaagctctccagcctcatcatcctcatgccccatcacgtggagcctctcgagcgccttgaaaagctgctaaccaaagagcagctgaagatctggatggggaagatgcagaagaaggctgttgccatctccttgcccaagggtgtggtggaggtgacccatgacctgcaggtaaggggtggcccagcctaggggcctgcaggccttggagccagggggaggtgcttgggggacccactcaccaattcagcaggtctgtcccaagaccccctggatgtccaggcagtgctgggctctgtgatgggggaagctggggcaggaggtgtgggccatgcccttgggaagatgatgataataccagcagctaaatataacggaacattcctgtatgctaggcgttcttctaagcactttatatgtattattattattttttttttgagatggagtctcactctgttgcccaggctggagtgcaatggtgccatctcgactcactgcaacctccacttcctgggttcaagcgattctcctgcctcagcctcccgagtagctgggattacaggcatgtgccaccacccccagctaatttttgtatttttaatagagacgggatttcaccatgttggccaggctggtctcaaactcctgacatcaagtgatcctcctgcctcagcctcccaaagtgctgggattacaggtgtgagccaccgtgcccagcctttatacgtattaaactcttttaatcctcaaaacgactttattaggtaggactataagtttcatcttagagatgaggaaactgaggctcagaaaggttaagtaacctgtgcaaagtcacacagctagtaattcagacatcttgcaccagagctaaccctcggtcactgcactgcctctgaggtctgaagtgcccccagttatagattgtttaagctagaggattatctaccatccaataatcagactggtagctatgggtcatctaggatggccagaaacttaacacacattctcaagattctcccttgcaaccaccctgggtagtgggcagaggctcagagagaagcaatgactccctaaggttccccaggctcataagtggtggagttgcaattagacctcaaggtaaaaacataatagccgcctttttgtcaatcgagagatatttttgacttacccaaaaaaggaaactttcgtgtcattctttccttggatgccacaaatggttctcacctgcagaatcgatccagacttgctgcccagagagcttggagagataaagctggagatgaagtggggcttaggctccaaaccagggacaagtggagctcgtactggtctgtgctgtagaccctgggagttcctggagaggggtcactgtctctctcctggtcctggccctgatccttccccagccccttctccagtggctgttgtcccacccccttctccccttgttcctctggtgtcttcctggaaccctcagtggagaccccaccccccagatatggggtagattgagttaggaaatttgaggcggatgacgtgtgcaaggtcatcggggtgggaagagctgggcctacctcgaatgcctgtctcatgaccccctgactctcaggacctcaggcctagttcctgtgtggccttgccagggaggtggatgttatcctgaagaatcctggacccggatgctgccattcactcagcccacagccatttactgtcctctctcctgcattgagagccagggagagcgctggacatgggccccgccctcagggagctccaagccaggtgggagagacaggcagcaccagactgataacaggaaggtccagggaggcaccactcatcctgtgggctcgggaaggcttcctgaaagaagtggtttctaaagagccctaatgggagacaggatggccatccaggatataagctgttctgtgaggctgtctggagagtggggtggggcgtgccaagggatgtggctggaggctgccacggaggcacaggtcatatgttaaagagcttatggttggcttccaagagctgtgcagggccatggaaagatgtttgtgtgtgtgtgtgtgtgtatgtgtgtatatgtgttttaactttttactatcgaacattggaaaaataaaagtagattagtgtaatgaaacctcaagtgtctgtcgcccagcttcaagcattatcagctcatggccaatagtgatccatttatacccactaattcccccctgcatctgattattctgaagcaaattccaggcatcctatcactctggacaggttttcagccccagagtgatgtggacatagttgtccttagatcagtctttctcaaacttgagtatgctaagaaagcacttggggagtttgtgaaaaggaatccatgcccactcccagagattctgattcagggggtctgggctggggtcaggacatgagcatttgagataagctcctgggtggtgcccatgctgtctgtccctgaactgcagctgggcagtgccgggatacgttctcacttgtttttctgagtctcagcttcctcatctgtgaagtggcaattagaagcccttgtagggttgcagtgagaattgagaaagctgtgatttgaagtgccagtgccatgcctggcatacagaaggtgaccagggggtggttctctcctctctgaggagcggtcagggtagtatggggtggagggtttgagggtggaggagcctggcagccatggcctcacctggcacacctccttgttcccacagaaacacctggctgggctgggcctgactgaggccattgacaagaacaaggccgacttgtcacgcatgtcaggcaagaaggacctgtacctggccagcgtgttccacgccaccgcctttgagttggacacagatggcaacccctttgaccaggacatctacgggcgcgaggagctgcgcagccccaagctgttctacgccgaccaccccttcatcttcctagtgcgggacacccaaagcggctccctgctattcattgggcgcctggtccggcctaagggtgacaagatgcgagacgagttatagggcctcagggtgcacacaggatggcaggaggcatccaaaggctcctgagacacatgggtgctattggggttgggggggaggtgaggtaccagccttggatactccatggggtgggggtggaaaaacagaccggggttcccgtgtgcctgagcggaccttcccagctagaattcactccacttggacatgggccccagataccatgatgctgagcccggaaactccacatcctgtgggacctgggccatagtcattctgcctgccctgaaagtcccagatcaagcctgcctcaatcagtattcatatttatagccaggtaccttctcacctgtgagaccaaattgagctaggggggtcagccagccctcttctgacactaaaacacctcagctgcctccccagctctatcccaacctctcccaactataaaactaggtgctgcagcccctgggaccaggcacccccagaatgacctggccgcagtgaggcggattgagaaggagctcccaggaggggcttctgggcagactctggtcaagaagcatcgtgtctggcgttgtggggatgaactttttgttttgtttcttccttttttagttcttcaaagatagggagggaagggggaacatgagcctttgttgctatcaatccaagaacttatttgtacattttttttttcaataaaacttttccaatgacattttgttggagcgtggaagaagattggatcaggagattcttacaccattcttcccaggggacaaggtctcctgttaaggcagactcactactgatggctcatatcaggccctggaatgctggcagatcgctggcagatcactgtgcagacagcgccaagtggcaggtgcattccgtgctgacccgggaaatggttctggctctggcagccctggagaagtagcagctgcaggacctgaatgagagcactggacctggagccagtcttcagcctcttcgcctttctttctttaccctttttttaagatgtgaatcttgctatattgcccaggctggactcaaactcctgggttccagcgaacctccttcctcagcctcctgagtagctgggactacaggcagggctatgggcatgagccactatgcccagctcccctagcctttccttgcacgctgacctcatgctacatccagggctacaggtacaaactcaggcacacatttagtaagttgcctggctttgggctgggctttggaaggagattgtggggatccttgcccttaggtggcccgaagtgttggatttgtagcaggggaggaggaggcacccaacacggtcctttttgacacagtcctccggttggatgcctcatggtccttagggctcctgacaccgtaccttagggagagagagggatgcacggaacagagccagtggccagggaggcagaggagcagaggatattgggctggaggcccatttctgctgcctgctggccttttaacctaggacaggtcatttttctctctgggcacgtccagctttcctctgccaaagattgtgacctgggggttgttggttcaggaagggaccccttacctggctgagcaatccagcagtagccaccaagatgtacatgggtctgcagaagggccagctgattcactcccatcattgccacgacagagtttcagcaagactgctcagagtcccagggccatcctgtgcttcggctcaatcattcagatctctatcctcaaggggctttgtctagaggtggagacttagggatagggtactcagtgctcactgtgttccaggcacctggatcattctgttccaggtgtgccacgcttgtccccctgcctcagggactttgcactagctgtcctttctgcctggcaggcggttcttgtagatgtttgcagggttgctttttgtcatccaggattcagcgtaaacgtctgctcagagaggccttccctgaccaccctacacaaccagtccctctcccacctcagtttctctaccatgatttctcactttactgactccttagcactatgaaattacccacttaagacttccctgcctgcctcccctcttagaatggaagctccatgaagagagggtccatggctgtttgtctattgcagcaaatcctgcacctagctttagcatcatgcacatatcgaggaaggctcccaggaggaggtgatatgggggctgctttaaagggtgagtaggcatttctggatcagaataatgctttgagtgcaaccagctggtacgcctttgtgttttgctcttcctatgtgccaaatacttaatatgtacaattttatccaagcttcctaacagcttggctagttaggtagggattgtccccatcttacaggtgagataacaggctgagcagttaagtgagctgcctgaggccctacagtcagtgggggccgagctgggactagatcctagtcggttgggtagttgcttcgccacataggaagggcaggagaggcccctaacacagtgcctggaacccagcactgagcacagattctagtaatgaaggcatgttaacttgcatacgatctgtatccatctctcttaatccttgcaatagccccgttaggtgggaagtcatcctaactttacaaggtgtagctcagagaaggcagagactgggctggaacccaggcctcctggccctgaagttcagcc

SEQ ID NO: 15387 - DNA, 14621 bp, Human; identical to SEQ ID NO: 15386

SEQ ID NO: 15388 - DNA, 10434 bp, Human
gaggttctggctggtgggggtgggggctgtcaagatggtacctgccacgtggcatggctgggagtgggctcttcagctgcctcctcagggaaggaaggctggtggcctctgctgtggtctgagctccagcatcactggtctggatcagaggtggattttgagtagggtggccatatgcctattgtcctggcataataattagtagtgcccattttactcttataagtgtccttgtttgtgcaataaattatatggttgctctgcctttgaggctccagttctggcagggaaggagccagagctgggagggaggtgtcttggggtttattctaggccccaagatatccccttcattttagggtgagactcagatctccccgctccttccagacatttttagatctctgggccttccctcctctccccaccttcctccccttggaccctttgcttatcttatactgcaccttcaaggctccgaggagggaggcagtcccgggagatggggagcctgtccaggtttttgggatggcagcagtagaatcttcccagaaatacagtggtccccaggcagccagagtcctgagggtcttccaccaggatttcaaatgttcggtcttcttcaaggatgactacaagttgggatctaccagagcagtgggatcgcagcctccaccaggattccttctatccttccctttgccctgtcatctctcctgtgctgttgcatgatgtagaggaggataatggcccgaagggagagagggagtgtggaagtatcccaggaacagagactgtcccaattggaggccccagagagggaactggggcttgtccttggggccactgctactgctggggcttggggaggaggcctgagggcaaccctgaagccgtggagcagatggcctgtgtggcagtggctgtcagattggagggcagaatggaatctgatgtggctccagcttctttgaaggctgagtgcacatctggccagctgctggtgatggggaagggggtcactgctctattgagctatgtgtgactcacccttttccctagtatcctgtccttgtgctatgtcaggaagcctcctccccagccccaccgagtcttcaaaggagttggtcccccaggagcttttgtcctggggatttcccatccgcactgggagcactgtgggtagatgggcattccaagttcctgcccagacagaagccatgggcatggagacctggacctttcagcttggaaaagggagactgaggctgagtggacacaggacacacacacactctcagggtcacccttggggcagcaaagtggagcatcttggctccccatttaatgagtgacccaactggtgactcattaacatcccagagcagaatgaaaggcatgggggcggggcagccctccggctctgtccctcatcccttgcccaggcatctgggtttcctgcagattctcagctcagctgctgctttttctcactggaaaagggctcccagggctatgtgagatcagggctgaccactctataaactgatgaggaccccaggtctggccaagtgaccctgttttaccttcgttcaggaagagctgaggcctactgtgtactaggcacgggagatatagtggcaaccagattggctagcttttctgtcctggaggccacagcctacttaggagcagaaatagttatgaaataaacacacaaataagtggaagtgttggctggccgatgcaggaaatcaataaggtggtctggtggtgacttgctgggaatgcttctttgagtagggaggtaacagaggcctctgagaggctggcagctctgagtcaagtctgggattcctggactgtgggctctcttgcccccatctccaggggacttgtggcagccagagagctgagggtggttgttggggaggaaggccttgggcttcaagaccaccctgtctgtgcaatcctcacaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctggggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgctagtcaacgccatgttcttcaagcgtgagtcgggggcgcgttcaggggtcctcctcctcctcccaggaccccctgcaagagttaggacgacattccgtgcgctccattcttcactgcctctcatttatgctgtgacaacccagggaggcaggactgtcactcagctttttgtacagactggaaactagattcagagacaggtagcagcgtgtaaaggaatggttcagggagcggaggccccagagggactccatggaatgtattccgaccgaatttcgtcaaagtgctcgtccttgtgtatcttggaatgaataacatttaataatccattctgcctcagtagtgagctagagaaagaactcaaatcctttttttaaaattatttttattttgagatggagtctcactctgtcacccaggctggagtgcaatggcacgatctcagctcactgcagccttggcctccgggcttcaagcaattctcctgcctcagcctcctgagtagctggggttacaggtgcctaccaccacacccagctaatttttgtatttttactagagacggggttttgccatgttggccaggctggtctcaaacttttggtctcaagtgatctgcccgcctcggcctcccaaagtgctgggattacaggtgcgagccaccatgtgcggccaagacccagaatccttaaagcaaccttgggggcaggcagtgttaccttcatttcacagtgaggaaactgaggctcagcaaggaggaagcagagccaggcctcaggcccagatgcctctgtcttcagttgaagattagatgtagggttaataaatatttttgagtacctccatagacaacactattctcacagtttgctgtgagaatgaagtaaccctcgttttacaaatgaggccaagctaggagagctgaggtctccccgagtcagtggctgagcttggattggaacacaggtctggctgtgagcaagggcagggttcaggccactctcagacattttttgttgttattttctggtcatggagacagaacttgcagaggaaaacgaagggtgggctgagcacagtagctcatgcctgtaatcctagcactttgggaggccaaggtgggtggatcacatgagcccaggaatttgagaccagcctgggtaagatggcgaaaccccatgtctacaaaaaattagccaggcgtggtggcgcatgctggtagtcccagctactctggaggctgaggtgggaggatcgctggagcctgggaattcaagactgcagtgtgtcatgattgcaccactgcactccagctgtaggatggagtgggacggaccttgtctcaaaaagaaaaagataaaaaaaaattaagggtggtcatggggcactccctgcccagggcacagctgtcccccaggtaccagggagggtagaaagcccacctcagagcatgcttccaaaatatctgacaagtgctagagctgggggtggccatagaggtggctgacctgagggcggaattaattctctatcatatgggagcagcaggcactgactgtagggaaccgcatcctcagatggcatgtcctggggccaagaccccttcccaaagctgggaacatagactctgtgggctgggtgctctatagctgggccctgaagaatggagcaaagacctgtggcaaggataaatcaaggtctgcagccgggggtggctgtgggctgtgattgtgtttgggggcggccatgtgtctctgaccctgtgttttgccccaactacagcacactgggatgagaaattccaccacaagatggtggacaaccgtggcttcatggtgactcggtcctataccgtgggtgtcatgatgatgcaccggacaggtaggtgctgtgaggagcagggtgtcaaggtgggtgggggtccaagggtagttggtctgacccacccctgcacacagggtgcccagtgtcctttccgctcctctcccaggcctctacaactactacgacgacgagaaggaaaagctgcaaatcgtggagatgcccctggcccacaagctctccagcctcatcatcctcatgccccatcacgtggagcctctcgagcgccttgaaaagctgctaaccaaagagcagctgaagatctggatggggaagatgcagaagaaggctgttgccatctccttgcccaagggtgtggtggaggtgacccatgacctgcaggtaaggggtggcccagcctaggggcctgcaggccttggagccagggggaggtgcttgggggacccactcaccaattcagcaggtctgtcccaagaccccctggatgtccaggcagtgctgggctctgtgatgggggaagctggggcaggaggtgtgggccatgcccttgggaagatgatgataataccagcagctaaatataacggaacattcctgtatgctaggcgttcttctaagcactttatatgtattattattattttttttttgagatggagtctcactctgttgcccaggctggagtgcaatggtgccatctcgactcactgcaacctccacttcctgggttcaagcgattctcctgcctcagcctcccgagtagctgggattacaggcatgtgccaccacccccagctaatttttgtatttttaatagagacgggatttcaccatgttggccaggctggtctcaaactcctgacatcaagtgatcctcctgcctcagcctcccaaagtgctgggattacaggtgtgagccaccgtgcccagcctttatacgtattaaactcttttaatcctcaaaacgactttattaggtaggactataagtttcatcttagagatgaggaaactgaggctcagaaaggttaagtaacctgtgcaaagtcacacagctagtaattcagacatcttgcaccagagctaaccctcggtcactgcactgcctctgaggtctgaagtgcccccagttatagattgtttaagctagaggattatctaccatccaataatcagactggtagctatgggtcatctaggatggccagaaacttaacacacattctcaagattctcccttgcaaccaccctgggtagtgggcagaggctcagagagaagcaatgactccctaaggttccccaggctcataagtggtggagttgcaattagacctcaaggtaaaaacataatagccgcctttttgtcaatcgagagatatttttgacttacccaaaaaaggaaactttcgtgtcattctttccttggatgccacaaatggttctcacctgcagaatcgatccagacttgctgcccagagagcttggagagataaagctggagatgaagtggggcttaggctccaaaccagggacaagtggagctcgtactggtctgtgctgtagaccctgggagttcctggagaggggtcactgtctctctcctggtcctggccctgatccttccccagccccttctccagtggctgttgtcccacccccttctccccttgttcctctggtgtcttcctggaaccctcagtggagaccccaccccccagatatggggtagattgagttaggaaatttgaggcggatgacgtgtgcaaggtcatcggggtgggaagagctgggcctacctcgaatgcctgtctcatgaccccctgactctcaggacctcaggcctagttcctgtgtggccttgccagggaggtggatgttatcctgaagaatcctggacccggatgctgccattcactcagcccacagccatttactgtcctctctcctgcattgagagccagggagagcgctggacatgggccccgccctcagggagctccaagccaggtgggagagacaggcagcaccagactgataacaggaaggtccagggaggcaccactcatcctgtgggctcgggaaggcttcctgaaagaagtggtttctaaagagccctaatgggagacaggatggccatccaggatataagctgttctgtgaggctgtctggagagtggggtggggcgtgccaagggatgtggctggaggctgccacggaggcacaggtcatatgttaaagagcttatggttggcttccaagagctgtgcagggccatggaaagatgtttgtgtgtgtgtgtgtgtgtatgtgtgtatatgtgttttaactttttactatcgaacattggaaaaataaaagtagattagtgtaatgaaacctcaagtgtctgtcgcccagcttcaagcattatcagctcatggccaatagtgatccatttatacccactaattcccccctgcatctgattattctgaagcaaattccaggcatcctatcactctggacaggttttcagccccagagtgatgtggacatagttgtccttagatcagtctttctcaaacttgagtatgctaagaaagcacttggggagtttgtgaaaaggaatccatgcccactcccagagattctgattcagggggtctgggctggggtcaggacatgagcatttgagataagctcctgggtggtgcccatgctgtctgtccctgaactgcagctgggcagtgccgggatacgttctcacttgtttttctgagtctcagcttcctcatctgtgaagtggcaattagaagcccttgtagggttgcagtgagaattgagaaagctgtgatttgaagtgccagtgccatgcctggcatacagaaggtgaccagggggtggttctctcctctctgaggagcggtcagggtagtatggggtggagggtttgagggtggaggagcctggcagccatggcctcacctggcacacctccttgttcccacagaaacacctggctgggctgggcctgactgaggccattgacaagaacaaggccgacttgtcacgcatgtcaggcaagaaggacctgtacctggccagcgtgttccacgccaccgcctttgagttggacacagatggcaacccctttgaccaggacatctacgggcgcgaggagctgcgcagccccaagctgttctacgccgaccaccccttcatcttcctagtgcgggacacccaaagcggctccctgctattcattgggcgcctggtccggcctaagggtgacaagatgcgagacgagttatagggcctcagggtgcacacaggatggcaggaggcatccaaaggctcctgagacacatgggtgctattggggttgggggggaggtgaggtaccagccttggatactccatggggtgggggtggaaaaacagaccggggttcccgtgtgcctgagcggaccttcccagctagaattcactccacttggacatgggccccagataccatgatgctgagcccggaaactccacatcctgtgggacctgggccatagtcattctgcctgccctgaaagtcccagatcaagcctgcctcaatcagtattcatatttatagccaggtaccttctcacctgtgagaccaaattgagctaggggggtcagccagccctcttctgacactaaaacacctcagctgcctccccagctctatcccaacctctcccaactataaaactaggtgctgcagcccctgggaccaggcacccccagaatgacctggccgcagtgaggcggattgagaaggagctcccaggaggggcttctgggcagactctggtcaagaagcatcgtgtctggcgttgtggggatgaactttttgttttgtttcttccttttttagttcttcaaagatagggagggaagggggaacatgagcctttgttgctatcaatccaagaacttatttgtacattttttttttcaataaaacttttccaatgacattttgttggagcgtggaagaagattggatcaggagattcttacaccattcttcccaggggacaaggtctcctgttaaggcagactcactactgatggctcatatcaggccctggaatgctggcagatcgctggcagatcactgtgcagacagcgccaagtggcaggtgcattccgtgctgacccgggaaatggttctggctctggcagccctggagaagtagcagctgcaggacctgaatgagagcactggacctggagccagtcttcagcctcttcgcctttctttctttaccctttttttaagatgtgaatcttgctatattgcccaggctggactcaaactcctgggttccagcgaacctccttcctcagcctcctgagtagctgggactacaggcagggctatgggcatgagccactatgcccagctcccctagcctttccttgcacgctgacctcatgctacatccagggctacaggtacaaactcaggcacacatttagtaagttgcctggctttgggctgggctttggaaggagattgtggggatccttgcccttaggtggcccgaagtgttggatttgtagcaggggaggaggaggcacccaacacggtcctttttgacacagtcctccggttggatgcctcatggtccttagggctcctgacaccgtaccttagggagagagagggatgcacggaacagagccagtggccagggaggcagaggagcagaggatattgggctggaggcccatttctgctgcctgctggccttttaacctaggacaggtcatttttctctctgggcacgtccagctttcctctgccaaagattgtgacctgggggttgttggttcaggaagggaccccttacctggctgagcaatccagcagtagccaccaagatgtacatgggtctgcagaagggccagctgattcactcccatcattgccacgacagagtttcagcaagactgctcagagtcccagggccatcctgtgcttcggctcaatcattcagatctctatcctcaaggggctttgtctagaggtggagacttagggatagggtactcagtgctcactgtgttccaggcacctggatcattctgttccaggtgtgccacgcttgtccccctgcctcagggactttgcactagctgtcctttctgcctggcaggcggttcttgtagatgtttgcagggttgctttttgtcatccaggattcagcgtaaacgtctgctcagagaggccttccctgaccaccctacacaaccagtccctctcccacctcagtttctctaccatgatttctcactttactgactccttagcactatgaaattacccacttaagacttccctgcctgcctcccctcttagaatggaagctccatgaagagagggtccatggctgtttgtctattgcagcaaatcctgcacctagctttagcatcatgcacatatcgaggaaggctcccaggaggaggtgatatgggggctgctttaaagggtgagtaggcatttctggatcagaataatgctttgagtgcaaccagctggtacgcctttgtgttttgctcttcctatgtgccaaatacttaatatgtacaattttatccaagcttcctaacagcttggctagttaggtagggattgtccccatcttacaggtgagataacaggctgagcagttaagtgagctgcctgaggccctacagtcagtgggggccgagctgggactagatcctagtcggttgggtagttgcttcgccacataggaagggcaggagaggcccctaacacagtgcctggaacccagcactgagcacagattctagtaatgaaggcatgttaacttgcatacgatctgtatccatctctcttaatccttgcaatagccccgttaggtgggaagtcatcctaactttacaaggtgtagctcagagaaggcagagactgggctggaacccaggcctcctg

SEQ ID NO: 15389 - DNA, 10434 bp, Human; identical to SEQ ID NO: 15388

SEQ ID NO: 15390 - DNA, 235064 bp, Human
  misc_feature (1)...(235064): n = A,T,C or G
ttgtgtaaagtggatattctttctttcttaaatgtttgatgaaattcatcagtaagaccatttggacaggatttgtgtgtgtgtgggaagattttcaattgcttattcactaaaaaagtagatatgggactatttagatgtttcatagtatgtctgtttgggcacttttgtgtttcttttcaaggaacttgtctaattaagttgtcacagttattagcataaagttgttaataatattctcctaatatcctttaaatgtctgtagtgatataacttttaatgatactactagcattatagcgaacatgtatgtggtgcttattaaatacctttcattttacagatattaacttttaattcccgcattttgtgaggcagttactattatcatctccatattacagatgaagaaaccaaggttaaactaagagcactctggttccttgcttaagattatatagctgttgtattgaaggcttgaattggactcctggtgggtccagagtctttttttctaaattactgtgtactctccccaccccccacttttttttttttaagaaacatgactatttattcctttttatcttttttttttttttttgacagtgtcttgctctttcactcaggctggagtgcagtggtgtgaccgccagattggttcaccttgccctctgcctggacagagccaatttatcaagacaggggaattgcaatagggaaagagtaattcatgtagagccagctatgcaggagactggagttttatcattactgaactcagtctcctctgcctttcttaaatgacagagatacctattctgttcttcttctggaattgtcctgtattctttttagaaagtatccttgctactttgtaccacagagtagaaatatttgtttctggtgttcctagtcagaacttggaatgcccttttccccataaaaacattacatatgatggctaggcatagttgaaatattattgttaatactctttttgagtcacataatatgttaaaatgacttctggagcttccttgggaggttcaccacaatttataatgtgaaacattgtttccgtgggaaactgtgagaagaaatgtattttatttttttgacctaacaccgaatttatcactttttaaaaacaagatattttcaacaaaagtgaagaaataagaaacaaatccagtgttcatgcattcccaaactgcagccttgattccaggatacctccttctctcaaaccgagctggcttcctgggaatccagtggtggtacatggatcgagggttcctttgtgctgcattttttactgcctctctcctgagttgtcgggatagattctgcaggctcttgtgctagcccaaaggtgcccagccttgactccacttccgtgtctttgatcctgggtgggcacgtttcctgggtccctgtgctctcagaagctttctcaggcacctctccttggtgctgttgccccaggtgatgttcagccatcatctggagctctctcgttgtgggtgtgatccttgtcatcttctgtcactgtggagacattaccaaagtgggtcgaggatccgtgttcatctttctctggggatgactggtcagcacaagggtggcagcgttgggcgacatgtccaaatctgctctgccccctcggggtctgggggctgttgtcttcctccatggctggggcggcacctgctgggctggcactgtggtgggagggaaggccgcgggactcagggctgggctgggcgcgctccttctccactcttgtcagatccccctgccaaaatttattttacattccctcacctgaaaggttaggcttctattacatggcagatatactttactttttggaatctctaaaattttagatttactcagttgttaatatgtcatatttttaaaaagacaagcatgattaatttgtgcatatattttattttgtttggttttgattaatttgttggttaatgtctttcagggttattcaaatgctcagaagactattcttctgcaggtggatcagaactgtgttcgcaattcttacgatgtcttctctttgctacggtaagaaacttcttagattgccctgaattctaaagaatctttctcattttgagtttgtgacatttcaatgtgagaaaattaacggaagctttagaggctgttattcaagcttagcattttttagtgcaagcgtcataaattttgtagctacagtgatttaaatttatctattttacaaagtctttggaaagccatttcctttctctggacagtgggagagaatatttggaagccagtgatctgaaaacagacatgaactgttttctggtcttctgtaccctacagaacagtaatcaaagttgcaaaagttagacttatcaaagtcttaacaactgcggcatcactcggaaagcccttcaacggccccaaacatggctttgagtttggacctgttctttgtcttaaaagaattatgtttggcaagccaaaaaagctttgcatgtatctaatgctcagaggcttaaaggcctcagctctatattttcataatgtctgggcttaattttgaaagattttaaaatctggctttaattttaaatgtgatagatcatcaaggatatttttccagggagcaagccaccaaaataaatgcaattccaaataaagttaacagcaacactcaaccaatgttcaccctactcagacagattgttcattgaaatttgattttgacagtattttctaatgtttacgtgacacataatacatttcagaacattagacatcctttatatatgtacttgaggaagaatccagaaggatgctcggagaactggttattttagaaactttacaaaattggcctttcgtttgtgaaacttgaatcttattacacatgatatagagtttggtcacatggactgtgtccattaatcttaagaaacatgattttgactaaagtaaccatatacattttctgagttttggttcttgcttgagagatgcctacaccttgactgcttaggatatgtagcagaacacacaggatttagaaattagagggtggagattgtagtaaacatattttaatgcctgttcagtttgagacacacaaagttttaagttttgaaaagaagaaagttcagaaattatttgaaatatgagtaagccactaatatttcttgatctcagttttccttagtaagtaaaatgaggcgtagggtacaattattttaaagatatgttctaaatgtgagattgtgtgaccttattagagaaaacagtagaattaaaagaaaaaatactaagtcaggaagaagaggatttgggatagtgcagtatcatagatgctgaaagaggatagtttccaggagtagcgaacactgtgataatgtaggagagcaggaactgaagaaagactgttggatcttgtgaagcagtgtggtatcatggaggatgctttgattaatcctaccctgcctttatctttgatttatcctaattcatttaacctctgatgcttctaaaaagtggaagcagtgatgtaacaaatttgtgtaatttacaagcattttcacattttttatcttattctcttagaagtccttcatgcatcagggatgatagatagcccttgtcttgattgtagaagctgaggccaagaggcattaaatgttttatctatctgagggcacacagcaagtaagagccagactggaggatgctttgacggttttctgacaatgtttttgtagatccttttaatagtctcaccttcctaaactggtggttacaaggcacacatggcataatgactgtggacattctttagaaaacacaatgccctacataaatgcaaagtcatcaggctaatttagtagttgctcagttattgaacattgatcttgcaatgatttggctcttggggagttcatatctagagtatttttcagactcttcagatgtgtcagtaatttgaactgccttattaacagtggtctcctcatgcctattgtacaattcatgcctagctaataacacagatatacttttcctaaaccagatcacgtgactatttatcaaccaaatttactgaacccagggagttgttctggaattggaaactttaaattgcacttattaaagttgatgagtcagatgggactttggtgatagttctctcagacattagtaaagagtacccatcatctgctctattaaatgatcctcttttcccatagtgtttgccatgatatatgtgaagtgctttctaggaaacttaattgtgtgcctattgaattaaactctagttcgtggtttcctctctaacattgtccttggctggagtcattttaaaaaatatatcttttcttttcctgatgctttcttggtttataaaattgctgttacttgatctgtaattttgtgtgaaaacacacagtctaaattctttaatgccacttaactctataaaattctgcatgctgtttagagtcatgtttagaaccctggtctcctgattctgttttttttgagacagagtttcgctctgtcacccaggttggagtgcagcggcccgaccttggctcacttctgccttcatctcccaggttcaagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaggatacatctgttctctctcctttttgtgtgggagtgtcacagaaaaatgggcactcttgactaaggcaaggactttggagcacctaaaaccaggtgctccttcatgctgggtgtggtggctcatgcctgtaatcccagcactttgagaggccaaggcaggcggattgcctgaggtcaggagtttgagaccagcctggtcaacatggtgaaacctcatctctactaaaaatacaaaaattaaccaggcatggtgacacatgcctgtagtcccagctgctcgggaggctgaggcaggagattagtttgaacctgggaggcggaggttgcagtgagccaagattgtgccactgcactccagcctgggtgacagagtaggactccactgcagagagaaaaaaaaaagaaaaaagctccttcagatggatgggttgtattgttttatagaaaaacaatgacctgagaccttattcaggtgctttgacccatagttaagaatttaggctaatttcagtgttgccaaagattagcagttctttccaaatttacatttaatgtgggatagtaattgaactattccttcttaactcttggaaatctctggattaagcatttgttttcaggtaaaagtagacatttaattaatagccagtttacttgttgttgtatttcatattttagggtgctcaccacaaggtgtcaatgttattccttaactagcatttgaaattttatttattttacaattttgggttgagaaaagtacgggactaaaatggaatataaagcaatgttgtaaattataaataagcattcagttttaggagttaactaaaaaaatctcttagtatgattccttctaggttaaggaatacaggcttagtagatagctttctaataggcttattaggtacctttctccttttggttctgtttttttaaagtcctattgatagggaattattgaaagattataaagagaggaggagtaaatgacatagtcaggtttgcaatttagaattctaaccatggtgtcagtgtggagtggacctgagggatgagcctggaagcaatgatttctgtctaatcatttcttaatgtgtctaatcatatctaatctgttctctgactgagagattatttttagtgttaactcattttttggttgttttttcttttatactttttcaaagagataactctgttatagtaagaaaagtaataattctggtttttttctagtatagttttcattgtttttttccccttcttcttcagaaatatcctgcttttgccagtttaataagtggaagtatggtggaaaataaagggctttggtccttcacctaaattccagtcctaaaactgccatgtgtaggtagactggatgcaagactttgagcaagtaacgtcaactttttgtataccttagtctgcttttgtaaaatggggctaatatttgtctcttctattaggaatattgttagaattaaataagataaaatatttgaaagatcttaggatagttactggcatatagtagacatttaataaatgttagttttcttcttcctctttacttacctggtcttggatatagctttctcctctaagccagtattccttttccttgttaccactagcttttctacttttcagcatattttccctttctctccccagcattctagtgttttccatatctgcttttataactgcatgatggattcttcttgctcactgcccagaaaagtcaatgcattgagaacaggttttgcagcaaagaaagagtttaattattacagggccagccaaatggaaggatgggagataattctcagatccgcttcctcagaattcacaggctagagtgtttcaaggatagtttggtaggcagaggtctaggaaatggggaaacctgattagttgggttggggctaaaatcatagggggtctaagctgtcttcttgtgccaagttagttcctgtgtgggggtcataagaccaattaagccagtttcttgatatgggctacttatttgataccagctggtccatcagaattcagagtctgaaaaatacctcaagcaccagtcttagattttatgatagtgatgttatctataggagcaattgggaatgttacaaaccttgtgacctctgggtgcatgactcctgaaccataattttacaaaggtgttttcagtccctgagtaataaggaggaggttactttcaggaagggactgttatcatctttattttaaagttaagctataaactaaattcctcccgtagttagcttggcctatgcccaggaatgtacaaagacagcttgtgaggctagaagcaagatggagtcagctacatgttgattgatttctgtcactcataatttttgcaaaggtggttttactttcaaagttgcttttgttaattctaaacagtcataataaaaaatatttaacatgtgtgtgtcttttctccttaatgacattgaaatcttcttgaaggaaaggattatttcttatggctatatttctcctgtccttctatcttaccaatacttcttggttaattgttggagttcctttggcttgtgagcttactaggactcttctgtattactctttttccctaggtactctcttgtgttactaaagctacaaccaacacatctacatgttaatacctcttcaatctatatctctagctctacctctcttttggatttccagtctgcattttccaaccaccatggatatttgaacttttttgtccttgaggaacctcaaccccaaagtgtctggagccacactcatcgcgttaatactcctcttccttttcttttccctggtttgtctaatggtattatcaccatcctagtctcccaagctagtaatcttagtcatttttggtttctctaatttttcttcccttggtgatagatatagttgatgataaaccatattgattctttggcaagatgtctcatctgtcgacccttctttgtttttaatctgtattttcctagactatttccttatctcctagatgaagaaattaaggcacaaagcagttaagtaacttcaccaaggtcacacaaactagtgttagaatttgtattcaaacccaggcagtctagctccagaggctatcatataaaccagtgtatcttaaatccttacaatcttttacactgctgctggagtgatcttttaaaagatacgtgggctgggtgtggtggctcacgcctgtaatcccagcactttgggaggccgagacgggcagatcatgaggtcaggagatcgagaccatcctggctaacacagtgaaaccccttctctactaaaaatacaaaaaaaaaaaaaaaaaaaatagccaggcatggtagcgggcgcctgtagtcccagctactccagaggctaaggcaggagaatggcgtgaacccaggagcagagcttgcagtgagccgagatcgcgccgctgctctccagtctgagcaacagagcgagactccgtctcagaaaaaaaaaaaaaaaaagatacatgaattttcttactcgctgggcttagaaagctttgatatatcatgtacaggagaaagttcacacttcttagtgtgatattcaagggacatttagcaatacatgcccttagggaccaaggtctttatttcaaagtcctcccactccctacttgtataatcaataactatcatttatggagtgcttactgtgttataaatagttcttcattgtctgattttccctccactcatctcaacacccccaaactgagagcacctttaggcaagaatccttgttttattagtctttgtattagccctatcgcagtgtgtatcatatatatgttaaacagataataaatgccatttctattgatcaaattgaactattgttcaggttactagaggactaaagttttgtttttcctaatggtttccatctggtaaaatgagagttgcaaaaaatttctaggctaatatttaaaaggtgatgaaaatgcaatcaggtctgtgagccttcagctgttgctttctttcagcccctgctctccacacaacatgtggtgagattttcaggattttgtgactttcaatccaactctttctataagtgttttgggaagacctttatttggctctctagaagcaaattcccctccccgcactttgctagaaagtactgtcaactataaaattccaattttaacaggaaaatgctcacaaccaataaattatcaatagcatagtgtttagagaagagatgggatgagaagtataaggtataactttgtttatcatctttaaactatggatgtgataaccaacttttaggctgcaggaagagatttttttttttcctccctgcctaatggactctaagtggtaattgcagttatacagaatacagctaagaacccaactgtaagcagactttacaaagtttatgtgctaaaactcgtgtactttcttttcttaatagagactaggctcttacccagtttctgtatgcttattttaagtaagttaggggaggaattaagaggattactgttaaaatagacacactgacagcaagaagcgaaagctgatagtttgctctgttatactctttgattctggaatatagctgagtgataaatcatattagctactgtcctacctttgtagtcactgtttggattcttaaacagccctgtctcactacttcatgtaaaaagagagaggaggagaaacagttcactgtaaggagaggccaactaaagaaaaaaacatagctagccaacttggccaaagcacatgtctgtattgcatttcataactcaagttactcacgagaattatgagtgcactgtcttagtttttaataatgctgtctccatttaacagatgaggaagcagtcttaaaatggtgagatgatttgcctgggccacaggctggttaagtgtggaagcaggtctgaagaaaggtctgccaggctccagtgcacgtgctgttttctattatgccatgttggtgccaaatcatcagtaaaatagaaaagtgtaattatgagagccttcataagaaagcaggcacatagaagatttaggaaggttttcaatcaaaatttaaaataaaataattttgggttttttttttttttttttttttttttttttttgggacgaagtctcgctctgttgcccagcctggagtgcaatggtgtgattttggctcgctgcaacctccgcctctccagttcaagcgattcttctgcctcagcctcccaagtagctgggactacaggcacgtgccaccacgcctggctaattttttgtgtttttagtagagacggggtttcaccatgttagccaggatgatctcaatttcctgacctcgtgatccacctgccccggcctcccaaagtgctgggattacaggtgtgagccaccacgcctggctaattttggtatttaatgtgagttttggtggagcaaaatttgtatttatgtgcagcagcacattttattcttctttattcatccgtctctacatatactataaatatatctatgtatgtatacatacacataaagacacacatatacacacacacacagttttacaaaaataggatttaagcaaaatacgggagtaattatagggtgaagtcttctccttcccctttccttgtactttttggctcatcttcttctttaagcccttttcccccattccgctgccagcaaaccacccaaacacagaacataggtccgcatgacccctagtcacccttcacccatgttaacaatctgatatgtatccatctgtattttttcccatagtctctctatatgtcatagatatgatttatagatacatttatatatgttttctatataatttatggtttatgtatatggtttgaattaatttataaaattaaaattgttttataaaattggagttgatacacatacttgggtttcttgttcaatattctatgcatacattcctctaattcactttttaaatggcttaataatagtcagtggtgaggctatatcatatttattcagccactaccctattgataggcatttaatataatatttactctggctctggtttttaatgcgtgtttgttttgacagtatgcacattactgaaggaaatatttatacacatatataaccttgtttttatgatgattttgtttccatggattacattcccagcagtgggatttctgagtcaaagggtatgtattgtttcaattgttagagataatcaggttgttttcccaaagggcacaaaataaatggcattactccttaccctgattctgtgctggcaatggccatcatcaatttttatgatttttactaatttgatgagtgtaaatgatacctcagtattacttcaatttttgtcagcctggtgcaagtacttagtttgagctacaagtgaaatttaacatgttttcttaagcttattagctatttagggtattcttctgtgaatttgcctattcatttactttacctagtttttaaaaattgagttgcttgcatttttctcataagttcctaagagtacttggtatttttttcccaaatctgacaattacatcttgacttatgataccttatacaaaaagttcatatttgttgtatcgtgtaattctgttttctgttttatattttctgggcactcttgagttgaagaggactctcctataccttgcttctatagatattttttgctaactttgagatttatattattttactttttaaattaaatatttaatacaaattgcaatttattttttttttcttttaatccacccatctgcacactgatatctagtatagatagtccatatcttgtaaggtagaaattatttcttcatagatgaattcattgtgccagcacctttcttttcccactgaatttaaataatacttttgtaatatattaaaagtgcatatatactgggatctatttctggattcgctctttttttgtttatcttatccttttgtgtattttgtaactttcagattgatttaactacaggggatttttttgtgtggtctaaaatcaagtaaggcacgtcctgttgctactcttctttttgatactatttttggctattctcagaactttattcttttatgtgaactttaagcttattttatcctactttaaaagaccaatcttattggaattttaatcgaaatttttatatcagttgaagttttacaattattttgggaaagatgtcattttatattagtatacccatccaagaacatggtgtcttttcatttgtttatattttattttattccttcaacaagattgtagttctctttatatggtcatttggctttctgttacatttgttcttaagtatgttatagtttttacagtattttgtataaaataggtgttccattccattcttgtgtgcttactgctattataaggaaaagctatacttctaggaaaatcttatttatatttagtaatatatctaattgtttttattgctattgtttttttaaggaaagctctccttttttggcatacacattatcatcagtaaaaggataggcttttcttctctaatgtttatactgattttctagacttactgcatttgctaaaccttctggaactttcagaataatgttgaaaagtaataggcattgtgaccatcccagttccttgttctaattgaaaaagttcagtagtttgctgttcagaatattttctgttaattttgaaaactattggccgggcgtggtggctcatgcctgtaatcccagcactttggaaggcctaggcaggtggatcacctgaggtcaggagttcaagaccagcctggccaacatggcgaaaccccgtctctactaaaaatacaaaaattagctgggcgtggtggcacgcacctgtaattcctgaggcaggagaatcacttgaacccaggcagcggaggttgtgatgagccgagattgcaccactgcaccccagtctgggcgacaagagcgaaactacatctgaaaggaaaaaaaaaaaaagaaaaacgaacatatatatataagaaaaaaatatatatacatatattttttcatatatatatatatatatatgttcgtttttctttttctttttctttttgagacggagttttgctcttgttgcccgtgctggagtgcaatggctcgatcttgactcactgcaacctccgcctcaaaaaggaaaatattttaaataattctttttattcacttaatgcttttgttaggattggttgctgaattttttgaaatgcctttccacatttattaatattatatattttcttcctttataattgtaataaggtatgtggatttcccagtgttgtattactgactagttataggttattcttttgatcattacttataagcaagattagtttttagcagttgtgttgttgttatggggggaggtataaattaccgtctctcccaaaatcataaaattgagttgtgaatgaattgtgaagctttccatcttattctatgatcctaatctgtaaaatgatgatgataatagcatttgtctctggatcgctgggaagatgaaaggtattaatgtgaactgcttagtacagtgcctgaattgtatgtgtcagctatcattatcatcattaccatctgaaacagattaaataattttgaaagtttttagttctttgaaggttaggacttagctagtaaatcatccagttcaggtgcattttataagggtaaatcttctttcaatccctttagtactcatcgctctgtccattttttcctgcttctccttggtttattttggaatttgttttttggtaggaaaccacctatttcctctagatttccaacattattgctgaaataatgcacatagttttattttataattcttttaataatttcaataatttacagcacattttctaattaagaccagaaactactctaatgttgtagttagaaatgttgttacattatgacctcttcttggacaggatgctctctgatgttgaaattgtaataacttttttcatgtaaactaaaacaaaatatttcagatacttttgccttaaagtgtttctcagaatgagaatggagaatgtggactatatacgttcagggaatttatatctcagtttacaatgttgttcctagcatatagcaccaagctggctcagagcgaatgctcagcaaatatttgttaaatgaatgaatgaagaaatgggtgaaatataatcctgttggataataactgaaccaggtagattttttgaggaattttttaaatggtagatttttaattacctttccaaagatgattagtactaaccttggatatgttttgccacagttatagtatattttatatataaaataatttaatatttcattttggatacagtgcatgctaatgaaaaattcatgttgaaagcattgtgtttttttttgtttttgtttttttttgtgacggagtctcgctctgtcacccaggctagagtgcagtggcatgatcttggctcactgcaagctctgtctcccaggttcatgccattctcctgcctcagcctcccaagtagctgggacttacaggcgcccaccaccatgcccagctatttttttttgtatttttagtagagaaggggtttcaccgtgttagccaggatggtcttgatctcctgacctcgtgatccacccgcctcggcctcccaaagtgctgggattacaggcgggagccaccgtgcctggcctgaaagcattgtttttaaattaactgcagtttactaaatgagtaaaccagtagtcaggacttactgatagatctcatagtctttaactaggacctcttataggcaattatgctactaagttcattttctctagtttactgaatgtttaatagagaatggaaatgtaatgggtaagttaaatgagcccttcccaaaacatgttcagaacttttggcttagagcaaaagtcagctttcaaatgttgaaaaggtgaatgaagaataaaataggaagaataaaatcagcgtaaagaagtaaagcattctttgagggcagttaagtatatgtagtcttctgcccaagagatgttctctgtctctgcccctgtcctttaattttggcttgaattcacagagttactggactaagactgctttgtttgagatgtcactgcgaattaaggcttcactgtcacatctctcatagctgccttgtaacttctacattcccgctggtgccaggcatgttccaaggcagcattccaaggtttagtgatttcaccctgatgtctctgccaataaaaataaccagttaccattaaaacctaccccacccataacttgatttttacatgccgttttattaagaaaacttattgatgattttaggagaattaatacattaagtttatcaggatatcaactggcccttggagtaacttttgttctaaaagtggatgtttcaccttggaagagaatctgagactcagcatgtttatctattgagagtggactttgtaataaccttattcctacagttgattctttatgactggaaatactctgttaaaatgagaagccagattattaccttagggatttatattctagtaggacagataacagatacagcaaacaaagggtctttcattcgttgagaaactaataataatttctaaatatgttgtgttctaagaatgagtcagaatccgttccttttctacaaagggcctacacagggggtggagaaggaaaataagatttgaatattaaaaattttcacttaaatacattaatgctattaagtaaaatagcatttcagttaaatgctaaaagttagcatacatctttttattgtgttcacaatagccacactactattgcaattccaatactattacaagctcagactgaagcttgcaaaagttgagtagtgtggttcccaggtgttcagctagtaagtcatgcagagtctgagtttagtggtaaaggcctttccattatatttctccatctcatgtggaggaattccccgtgacattcttttctcttgttgagacttccttatagcacccttagtcttcccagtaaaagttttttttttttgatgatacaccaacataaaatgagccaggaattacttagagtcttgtggcacccacacaatggagactttcctaataggctttcctggagccctccagagtgtgcttaatatactcctcaccttgtgcctccccgtggaggaggtcttaatggtttactattgaggagtgtctctgactctatgaccacataggtctttttacttcttttctcccaatatgtcaagtgtgaagtgattggacccaatgattctttcttagttggcatccctgactgttcttaggcttctgttccttaaattcagactctgcaagaagtaaactaatgtcatagaggaaaatgacttttccacagtagcactgatttttctgttcccgagattctttgattctaatgacagagttaaatttgaacatgggaggaaaactgactttaaacagtttatggggagaacatctggagatttaaactcatgaaaaattcagtgtaagccaagaaattgactcagcagcattaaaaaaggagctaagatgatcttatattgcattaattaaaatatattgtccagatcaagagaagtaatagtcttcctggactttgtgttcattagatcatatttggagtattctgtttaatttgggtcccagtttactttgatgggaaagagccggggagatggccaggaagataaatgattttaaagcagtcatgtaaagactagttgggaatagaggatatttagagaatataaatatcctagagaagagaggactttggggatatagttgccgtctttaaacagttatgtagttaatttggcaaacaattttagggtaataagagtaaaagacacatttattggatatgtactatctgccagttaagtttttcacatgctttatctcatttaatccttaaagcaagtgtatggattgctgctagtcattgttaccgctgttttactcatgagatccagaaaggggaattgatttgcctaaggttgcattatggcaaaggcatttttttttttttttttgagatgaagtctcgctctgttgcccaggctgcagtgcagtggcgcaatctcgggtcactgcaacctccgcctcccaggttcaagcaattctcctgcctcagcctcccgagtagctgggactgcaggtgtgtgccactacgcccgtctaatttttatatttttagtagagctggagttttgcgatgttggccagactgctgtcttaacttctgacctggtgatccgtctgccttggcctcccaaagtgctgggattacaggtgtgagccactgcacctggccagggatgtaatttggaagtgaaaaagtatataggttgttgttattcctgagagtagaatataatgatagctatgtttattgagtgttgttatgttctaggctcttgttatatactgaaaaagaaagaaaaagtcctatcttcatggagcgtacattttaataggaaattcagaagtagataaattagttataaatttgttgctagtggtaagttctatgaagaaaaataaagtagtaggaggagaatagaggttggtagatactgaggatggtaggatgatcagggaagacctcactgagaagaaaatatttgaacaaagacttgaaaaaaattagacagcaaagttggatgggcatttggagaaagaacattccagagagaagagatagcaggtaggaatgagtttggtttgttacaagaatagctaggtggtcagtctagtttgggcatagtgagcaaagttggcaaggccagaatcatgtagagttttattttttttccaagcatgataagaagttgttggagggctttgagcaagggagtgatgtgatctgatttctagtttttaaaaaaatacctctgattagccaggcttggtggcacatgcctgtagtcccagctacttgggaggatgaggctggaggatcccttgagcccaggaatttgaggctgtagtgagctctcattgtgccactacactctagtctggccaacaaagctgagaccccatctctaaaaagaaaaaaaaaatgcctttggtgtggagaatagactgggcttcggggtcaacccaccacagctgtgatccagcaatcagaaaactgctgctggtgaaatagccatcccacacttaccagacacctaaataaggaaactgtctactgcaaaacctcactcctgaaagagcttgtcactgctgcaggaagaatggcgtctatcccttctaccttccagattttgctcaaggcattccaacatttaagaagaggatgatagaacagaggagaaggacggctaatgaggttgtggaaaatctaggacaaagaggtgtcccagaggtcaaagtaaattaaatatttctaagagagtgattaattgaatcaaatattgatggctgggacatggtggctcacgcctgtaatcccagaaatttgggaggctgaagggggaggattgcttgagcctaggggtttgagaccagcctaggtaacatagtgagaccctgcctcagaaaaaaaaaaaggttgctgattggttgagtaatgtgagggttaagaatcgaaagctgggccgggtgcggtggctcacgcttgtaatcccagcactttgggaggcccaggtgggcggatcacgaggtcaggagattgagactatcctggctaacatggtgaaaccccgtctttactaaaaatacaaaaaaaaatttgccgggcatggtggtgggcgcccgtagtcccagctacttgggaggctgaggcaggagaatgacgtgaacccgggaagcagagcttgcagtgagctgagatcatgccactgcactccagcctgggcgacagagcgagactgtctcaaaaaaaaaaaaaaaaaaaaaaaaaaagaattgaaagctgaatttagcaacttggagctcactggtgacatatataagagcagttttgatgtgtggtgaaagtggtacaaagaagaatggaagtgttttccaacattttaaatgattgaacaattataattatgtgactgtgagaatgtgtataaaaatagtaacaataaagaattttaccatatagtatccatatgaatcgtggagattgctgtgtgataaactttgcagttgagaattttatgacaaattaggtgcagagtttagtgatccagtaatcaagaaaaagaatgcttgttaattatttgaaataaaatgtcattagtgagaaatctttattgagaatctgttgttagtagaccttgtgttactctgtcagtcacccccctccattctgtcagtttgaatggggagctatgcacagaataaacagtagcggaatgaaaatcagagagttgttttatgagtaggtgcccaaaggaagggtgcagtcgctgaaactccctggaaaaggactgggttaaaatagggggatttaggcccaagggaacctcctacattacccctaaatctaaatcttggcctcagcgtgctcagtcatatttttattttggggtgtatgttggtgagggagagaaatgaagcccgttgtcatcttctattataaaattttacatggcgatataattctgtgtttaattattctgtatccctccatagatttgtgggggacagggactctagtttatcttgctcacggtaacagccactggtgcttagcttgttccctgtcatggggcaggtgttaaatttataaggaataattgagagtttatcaggcagtataaggaacagaagataacacctgggtaccagcatgtggaaaggtggggaatgcttgcctgacacgttaaatacattcttagagatgtagatcacattcctctgctttaggaagcattgttggatctcacttcgttcctgtacccatattgcacatagaaagtattctgtgccctggatactttgcgttattcaccttacattatcatatagatacctccttatctcctcaatactagtcacaactttttttgattgcctgtcatttgcaaatattgtgctaggtgttgtatatattttatcattctatttaattctttcagcaaccagggacattaggcaaatgaataaattgaggctcaggaaagtttaacaacttgtctaagattgtacactactttcttagcaccttccaaaagcttgaggcttcttctgttccatggtgttttttaacaggatacatacttcagtagaatttgtatgcttaatgaaagtcttttatactttttttaagatcttaccacaattcctttcttttttgttgattatttgatcaaagggccatgtaattctaacacttcttgaaacattggagctgaaaagtaagactggtgaaatagctgactttaaatattgcgttttcaaggctaaaaatgagtgtctaacttactgattcattgtatgataaactaatattatagaactgtttttatatagagcagacagaaaaagttttataattgctctgagaaaaaaatatacttactcaaaatgtgttaagcattccaattttgatgcttcaacacggagctgtcccctgtagccttggagaccataacttcacagtgcttgtttttaaagtaaggttttcttttgaatgtaagcagattttgatggtagaaagaagttgtcgtgtggaattattctgtggagccatttgaatagacttgaaacattgtttatgcataaataaattcaccactctgaaaagtattctgacaaggcacggcatgtgttggcatctgcaagtcagcctgtactgagttttcactacccacaagaggtggtgaaaacgatctctggtataaagcaaatggaaaaggtaaagtgtcgggattttctttctttctttctttctttctttctttctttctttctttctttctttctttctttctttctttccatttttaatttcttttaacctttcctgggtattcatcaaaagtttcttttcaaaattaattttttggtgagatacagttagcatgacagaactataaatgttgatgttcattttatgtttttttgggagtttgtttctctcttcttttcctttttttaatgctgttttgcaaataatttgtgtgatcatttttttcactatggaccatcattcatgtgttgttttcattcagcagatacttattgctcttctagttattatactgttatgtgctggagatacaaatgtcacgttatgacaccagccttccaggagattttagtctagtgtgttagtcatacaactatgcacacagacacagtacagtatattaaatgcttggatagtgtctcatgcttgcctgttgggaacacagggaaaagagaccccaaggtagtcatgggaaacttcctggagaaagtgataccatctttccttttgttccccaaacaaacttagcccccaattgcacctggcatattttaaaaaattaaagtgaaatctgcatacaatttttaaaaaatcaaattctaaaatgaaaagtaaaagttctcgttcaaccctcccaaccttgacccagtcacagcccttagtaataaccacctttcacactttctattttcccttatgatggttatcattaaaacatgaaacaatgtatttgtttctgttatttaatacaaaaacattaaatagtgatttggctttggacaatgaaagatgaggaatttaccacatttataatacctgccaccttctctctctcactctacctctgtgtttttgttagctatctcatttttacattatcaagtttaaaaaaactttacatgttatgttgttataatcagctcctgtgctttgtctatagggtgactttaggagttgagccacagacaaatacccttcataatattattataggcagaagtagtgaaatgtgctaacactggaagaatttcccaagaatcaaggtccagtggtccaatggatggtttgtcttttttttctttttaccacaaagacctgacttttttctcattggatatgtgaattccaaccttctttttgaatgacatttagtatggtgcttgaaaattcaaacagaataatgcctcatttatttggcaatatcaatttataacagccaaacagtaatccaaagttagcattaaaaatccgctaagcaaattggaaaggaagaactcaaattatctttgtttgcagattatatgatctttatttatttatttatttatttatttatttatttattgagatggagtctcactctgtcatcaggctggagtgcagtggtgcgatcttggctcactgcaacctctgcctcccgagttcaagtgattctcctgcctcagcctcccgaatagctgggactacaggcgtgcatcaccatgcccagctaattttttgtatttttagcagggatggggttacaccatgttggcaaggatggtctcgatctcctgagctcatgatctgcccgcctcggcctcccaaagtgctgggattacaggcgtgaaccactgtgcctggcccagatgatatgatcttatgtttggaaaaatcctcaagactcaaccaaaaaactgttagaactgataaacacattcattaaagttgcaggatacaaaataaacatataccaaaatcagtttctatatgccaacatgaacaatctgaaaaagaaatcaagaaagtaatcccattcacaatagctacaaataaagttaaatatctaggaattaactaaagacatgaaagctctgcagtgaaaactacaagacattaatacaagaaattgaagcagacacacaaaaatggaaagatattccatgttcatagatttagaagaattaatattgttgaaatgtctgttctacccaaggcaacctgcaagtttaatgcaatttctatcaaaatatcaatgacattcttcacagaaatagaaaaaagaaaactcctaaaatttatatggaaccacaaaacacccagaatagccaaagctatcctgagcaaaaataacaaaacttcaggaatcacattacctgactttaaattatactacagatctgtagtaaacaaaacagtatggtactggcctaaaagcagacacatagaccagtggaacagaataaagaacgcagaaataaatccatacatctacagttaactcatttttgacaaaggtgttaagaacatacattggagaaagatcagtctcatcaataaatgatgctgggaaaactagatatccaaatgcagaagaaggaaactagaccactgtctcttgccatataaaaaattaaatcaaagtgggttaaagacatgaatctaagacctaaaactatgaaactattaaaagaaaatattggggaactctccagaacattggagtgggcaacagttttttgagcaatatcccacaagcacaggcaaccaaagcaaaaatgggcaaatgggatcacatcaaattaagaagcttctgcacagcaaacaatcaataaagtgaaggcacaacctagagaatgggagaaaacatttgcaaactacccatctgacaagggattaataaccagaatgtataaggagctcaaacaactctgggaataaaatctaataatccgatttaaaaagagcataagatctgaatagacatttctcaaaggaagacatatacatggcagacaggcctatgaaaaggtgctcaacatcactgatcatcagagaaatgcagatcaaaactacaatgagatattatctcacgctagttaaactggcttttatccaaaagataggcaataacaaatactggtgaggaggtggagaaaagggaacccttgtacactgttagtggaaatgtaaattagtacaaccactatggagaatagtttggaggttcctcaaaaaaactaaaaactgagctattacatgatgtagcaatcccactgctgggcatatagccaaaagaaaggaaatcagtttatcaaagagatacctgtactcccatgtttatcacaatagccaagatttgggagcaacctaagtgtccattagcagatgaatggataaagaaaatgtgatacatatacacaatggaatactattccgccattaaaaaaatgagatcctgtcatctataacaacatggatggaactggaggtcataatgttatgtgaaataagtcaagcacagcaagacaaacatcacatgttctcacttatttgtgggagctaaaaattaaaacaattgaagtcatggagatagagagcaagaagtatggttaccagaggctgggaagggtagtaaaataggaggtggtggggaggaagtgaggatggttaatgggtaccaaaaaatagtagaaagaaagaataatacctaatacttgctagtaaaaacaagatgactatagtaaaaaaaatttaattctacatttaaaaataactaaaagtataattggattgtttataacacaaaggataaatacttgaggtgatggataccccatttaccctgtaattattattacttattgtatgcctgtatccaaatttatcatgtagtctgcaaacatatacacttactgtgtgcccactaaaattaagaataaaaaatttaaacaaataataactccctagttacaaaaaaatccactgagcagcaaaaacatctcatacctaaaatgttctacattttatgcctagtaagaatccataggcctcattcagaagctgtttactcttattttgtgtgtcattctacaaatcatgatctagtctccaagtctgtaacagattaaatgttataatttagtgatgctacaggcaggcacattgaaagccctaagaaatgtcatatgggaatctcatagagaagaaaggcagtctgtgcatatcatcctgaatgtgcctgatgttgtctgatctcagaggctaagcagggttgggcctggctagtacttagatgggagaggaaaggcagacaaaatattaaatgctgactatacaatttaaaaggtattatgatgtagggctgtatgatactgggcataatgatgctctagtgatcatcaacctttacaaaaagaatcactattttcattgtacagtgtcagaagacagggaagtaagtagtcattgaggatatattcctatccaaaatggttaaattttgaaatattgttcatacaattaaaaaagataagcgtatgatacagttatctggaaagttaatttgtgtgggagctcttctccaaggtcagtggaattgtatatttattatcacatttgtgacatgaatgggaattgctttattagttattaaaaactcaacaaattagctattgtgtgaattattactgggaggcagctgttgactttgttgtgaaatatgtcagctaggaaaaaaggcaatctgtctctctttctctctctctctctctctgctatatcagtggattgaccattatttccatggattaaaagattggacaggctgccactggggataaagggaatatgcttccttgtggaagagtcttggtttgggatactgctaccttaatactccctgcctttatttcttgagtattttatgtctttttccttggaaatatttccaaacttgaagaaacattacagaaatagtataaagagctttccccctgctaaccatttgaaagtaaattagaaagatgatccctcagtactcccaaataaatcatggatatttgctacaaatacgaacatccttctagataaccatagtatgcccatgaaaaccaggacattaaccttaacatgttactggcatctcattcatccatccattcaagtttcttcagctgtctcagtgtcctttataactaaaggattccatctaagaccacaaattacatttacttgtcatgtatctttactctctgtcaatctgaaataatttctcagtctttccttaagatttttgaagagttttaggccagttaatttgtaatgtttatcaattttggtttgtctgatgtttcctggtgaagagattcaagttatgcatctttggaagaagtaatgcggaagcaatattgtattgtttttgcatcctgtcagaggggacacattttgatttgtcctattgctagtgatataaactttgaagccttaattagtgtctaccatgtttcttctctgtgaagttaaccttttagactttgcaatcagtaagtatttgtggggagatacatttttagatgataaatgtctcattttttaatcaaatctctgtccactagttttagcacatattgatgtttcttggctaaattaatttttttaaatgatagttgccaaatggaatggttaattcagttctcctacatttattagtgtgacattccatttaaggaaaagctttcagctttttctgtttaattgtatcaatgtagacacatggattcctgttttatccggtgaattattatctggtagtataagtatttattttgatactcaaatcactccagatttggccatgggaatctcttcaatctggcttctgtgttcttaagacatatttccatcactctttgagtatgtccttactttctggcataatatattacaggctcatattccctttgcccctggattagaattagtcatttctctaaggagttttgttttgttttagtacagaataataataataaaaaaacccactgttgattgacttaaacatttctgttttttagagacaaggtcttgctgtgtctcccaggctggcgtgcaatggcctgatcacagctcctcaaactcaagggattctctcatctcagcctcttgagtagctgggactacaggcttaggccaccatacctggctgatttaaaattttttagagatggggtcttgctatgttgcccaggctggtcttaaagtcctggtctcaagtgatcttctgttctcagcctcctgagtagctgacaggccaccaagctccagttaattaacttttaaagcaatttaaataataagaaaagtttttaggctgggcgcggtggctcacgcctgtaatcccagcactttggaaggccaaggtgggcggatcctgaggtcaggagtttgagaccagcctggccaacatggtgaaaccctgtctctactaaaaatacaaaaattaactgggcatggtggcgggcgcttgtaatcccagatgaacctgagaggcagaggttgcagtgagccaagatcacgccactgcactccagcctcagcgacagagtgagactctgccaatatatttaccatttctggtgctcttcatttcatttattttcgtctggtatcattttccttatgtctgaagtatttccttttgcatttctcatggtgcctttctactggtaattgaactctttcagtatgtctgaaaacatctctatatcatcttagtttttggaagatgctttcattgggcttggaaatctaggttacgggttttttatgtcttttaattctttaaagatgttgctccactgttttctagcttgtattgtttccagtgagaaatctgtcattctagtatcctctcctttatgtagtgtgtctttttttccttgggctgctttgtcactgttgcaaggcaatttgattctgtgtaccttggcatagttttctttgtgtttttcatacctggtatttgttggtattcttgcatctgtgggtttgtaatattcatcacatttggatattttgcaaccattaattattcaagtattattttttctgtctcctccttcattattttccccttcatgaactccatctaaatgtatattgggcctcagaagttgtgctatcacacactgatgccttttattttgtttttgttttagtcttcctctgtttttcattttaaatagtttctacccaaatgttcactgacatttagtatatcatcaggtttactgtttttcttgtaataactaatttgttcatccatcctttaaaaatatgtgtgtgtatatatatgtatatgtatatacacacacacacacatatatatatttttctcatttcagacatcatgatttccttttttttttgcagtcagctttctcagattaaacagacattgtgattttcatctctgaaagttcaatttgggtttttcaaaaattttcaatgtcactatatgttcagtctattttctggcttttaaacatataaattatagttgtaataactgttttaatggccctatctactgattctgtcatctctagcaattttggatcagttctgattgattttgctgctcattttggattgtattttcctacttctctgcatatacagtcatttttaattggatgtcaggcattgtcaattttaccttattgtttgttggatatttttgtgttcctataaatattctggaaacacagttatgttatttggaaaaattttcttcctttcagttcttgcttttacgcttcctcagcctgtactagagcagcatcaagtccaggattaattttacctacccctgaagcaaacctcttctgagtactttattgcgtggcccgtcagttatgggccatactctggctgtcaggaataggccctgttcctggtcctgtgaaatctctgctttttgtttcctctgtctaatccttttagattgtccttttcctggccttggatcatttcctcagatgattcactgatcagtactcagctgaatatttgagtgtgaccctctgcagatctctggagttctctgtgtgcagttctgtcttcttcagtactgtgccctgagaactctcgcactcatggcttccctggactcctaaatctttcttctacactcaggtagaccaccttattctgttgggatccccatccctactctgaagcctggaaactttctctaagcattaagccggggcaattgtagaactctcctcatgtgtttctctactctcagatgttactacaagttgtctggtggccagtcttgaaatctatcctctcatgttttcctagggtttttttttttaagttatttcaggtgggattaaatgcagtctctgtcactctattttggccagatgcggaataaattttgctggttcttaacattttgatgtcctaaagatcattttagtatcttcagggtaaaaaatgaattttctctacactgtagtgtaaggtgtggaccataccttgctacctctgtatcattttctttgtcctctttgttcttgttgaaacttgaaccaatcttatgggaagctgactatgggccaggcagagtagaatgggagttagattcatatgatctgattccttcccatagagaactcagagcttagagttacataatatcctctaaatcatagctcttaaattggtagaactgagttttgaaccatatattttggccttcccgttgaatgtctttttcactatagcagtgttcttgaataacccccatacatatacatacatagactcacacatatgcatacatacacacacacatacacaccctttgtaactcaggaagcctcatgagcatatggtctaaagtgttcacccccttcagattgctttttgcttatcagtgattaaaaggcttgggaggcatttgagaatgtgtgaggctggtaatgaactggaggtccaacgggatgaaaagggaggaaaaaggagagtgtggtgttttattttttggaacagacttcaataattataattactagtatgctggtataaacttgcctttggagacactgtggtaattttgatttatgtccagttaaaactgcaacaaaactgccaatacagaaggaattctgtgtttactcattttcttcagatagtaggccaaatggagaaattcgttaagccaatcctgaaacactataccaaaaacttaaatgagcaaaattaatcacatgtattggcaataggggattccatgaaaatgtttcaacttctggcagcaacttttaaactttctaatttcagtaataaggctatttgcataactctaaatgtagcaggcaaatggtacaaagaagaaagaagacagtgtggtgtagagaaagaagggaactggaaattaagaaacttggcctttctaaactggcatagctttgagacattggacaagtcattgaatcttaactgtggtttcattttcatatttaaaacgagagcattgaattaaaagacttctaaaataactcctagtactaacattatcatggtcctttgactataaaggtgaccttaattgacttaagagtcagttttctagttatttctaaaactaataacattttaaaaaaatgatttactatactatcacattttctattctacttaaaaggtcattgtccagtttgattgccttgtaattcacaaaaatttagcccagattaattttaatgattcctaaaataccaagtcctctagcaaaggtggagatttgccattatagaggatatccagtgatggtaccacaagttttgtggagaactccccaagtgctttggacagtggcattcttgctggaataaatatgtaggttgtaaggggatagtaataattagagtcactgctaatatttgagtacttatcaagtgataaaactgtagatgcttttgaagtatttagttatcagaataaacctttgaaaaaatgtatgatttttatccccattttgcagatgaagcacgggacttttggttaatggttaataagccactgagctgggatttgaaccatcactggcaccacagcctaccttcctaaccactacactatgctaactactatatttataaaagtcaaatgtatcaaattgcctgatgtatttccacaagtagacatcattaattgtgaaaattctgccttcaaaaaaagtcctttgacattactactaaattatctgtcattctgaactgtttgttaccattctgcaaaaaaaaaaatgaggcagttttgccaaaatgttttcagcaatatccttaataagcacattgttgagttcagctgacattttgtaagcaagattttctcagtgaaggaagtagtcattcattgacttacactcaagagcaaactgcataaaaatgcccttctcactttgcttttatgagctacccaaagtctgtgtaaacccaagaatatagatgaaaccaactgtttctgttcagatttttgttgttgtctctacttctccatatctttattattaatttccctggaaattagaacttttctaaaactgtaagatatttaaaaatcttaaaatgtgttttcctttctaaaaagccttctttaaagttactcattactacaggttgagcatcccttagccaaaatgcttgggactagaagtttctcaggtttttttgtttgtttctttttggaatatttgcattatacttactggttgagcgtctgaaatcccaaatgctccagtgagcatttcctttgaaggaaatgttgatccacttgtttatgctcaaaaagttttgaattttggagcatttttgaattttggattttcaggctagggatggtcaacctgtatcaccatatctgacattcccccctgcaacctgatattatttcctttggtgcagagtttcagaatcaaattaaggaaatgtcatgtttccacagatgagttctctgaaaaacttcctcttacagtgaaagtcatagtccaggagaactttagatgtggaacttcagggccaggtggaaggccattatgaactcttgcattggctctcttatgatcataagcctgaaagtacagaatcctggaaaaggaggcctctctctgcacccatgtaatttttaaaaaggagagaaagatatgaagggtgctaaagcttgatcctaaaagatcagggcaatgaaaacaaatgataatgaataactagtactagaattaaaaatgtaaggcattttaaagagatggggtgccagttataattcagttttgaatactacattgcaaaagaactatttttgaaaatagttaagggaaaaaatatctgaattgttgaataagttccccctatttattcctggtaaacttcaatcccatcttactgcttcattctaagttcttgtggagtgtgaatatcagcaattttctgaccttcaaagaggaacttgaataatttcattggaactctgtgcgttttttgatagtatgattctttgagtttcttgggatgtgttgtcatttttaccttgcagtgaacctcactattgtcctgtctaatgactttgaataaaatatatattttttctttcttgtccctgaagtccatggtggaagcttttgcctcttgtttagacatgatggtggtggcttttctttcggatctccacaaacagcagattcacagcgggagagtctttctctctgagacttacaaatccatgttttttcttcacagctcaacaccactgctttctgttaagatgtaaacaagtctaataatttctttttcaaatgccgttctgatgaaaacctgagtagttaaaaaatactatttaaattacaatttaaaaattgtacaattattaagtgtacattaaacacttgctaagtgtacagctgtttatcagacacaatacaggaggggatacaaaggaagaagacaagaagcgaattgtctagttgaataagatttagcttgtggaagaattagtgtcaagataaatgtattcaagtgctgaacttcatggtacatatgcttactgaataaagcagcatgaaaggtcctttgtatccttagtttatgagccttaaaacagatttagaaaaaggaaaagccaactagacacagtggtgtgcacctatagtcccagctactcgggaggctgagacaggaggctcacttgagcccaggagtttgaggttacagtgagctatgatcataccactgcactccaatctgggtgacagagcgagatcctgtctctaaaaaataaaataaaaaaagtcccacctcccaatactatggcaattaatttcaacatgagtttgggagggtacaaatatttatactatagcacctataaaatcatcatggcctacaccctcccacccccactttggtagcgtttttagtttctttgtagttatcgatctattcaggttttcaacctcttattgagacaatttggtaatttatagtttgatagaaaatcattcacttttcctgtttttttttttttttaaatttattggcctaaagttgtatataatattccttttaaattgtaaaaatcttgtccatatctgtagtttgttttgtttattgtttctaattctgaagtgcttttctgtatacttcctcaagtgtgtttattgtgtaatgaatacattttaaattaaacttactaaaatgcacatggatagtattatgaaaaaatttggaatgatttagcttgcttttatgccaaatgtggttcttcttgcctgaaatgagttagttgagatgtaaattggaaatgcgaagagttgattattgttctataactgtcgcttcatcagtgttgttagtttttgagggtatgcatatcctggttagacttgatgcactaattatcacatgctttcacaccacctaccatctcctcaatagaactttcccacccacgatgctatttacttttccatgaaagtaggttaattttataagtatttataagcaatagtattgtcttatttgatgccattaccatgagattgtgttcttcccaactatgtgcatggtctagacagaggaatgtagaagcaggcttttgggtagactcctggtcttttgggaaactatcatatttaataaatccatcaacgagtatttgagtgattcccatgtgccttagactgctgtaggtgctgtagaggtgcagagaatttattaggcatttaaagtctatagcactgtagctctgatcaacctttccagcctgcctctcatgatattgctcttgtgccctctttgttttatagcacacaacccactttctgttctgaacgtgtaatgcactctgcttccttaatgactttgaaaagctattcccaataccctaaacagcagttcccttgcatacagctgtcagagtcttagctacccttccttcatattggagcttaaatgctgtctcctttaatgagcctttcccaagaacaagttatcttagactaatgtatccattttgcaagggtacttagatttgtagatacagataacttcaataatgtgtttgataaggtatgtcaggatagctttgggagcaagatgaagaggtgtaagctaaatgacagaaaagataggtcgactggtaactacttgatgacttgctatctagagggaaatttttaaatgcatggcatagggctctgctattgacctagtctttttcaacatgtccattcatttgattacttacctgccaaatgtttattcagtactgcatgctggaaactatgcaatatgctgggtatacagtggtgatcaagggagacatggtttttcctcttgagaataccacaatctaagcctttgaacaaagatatagaaaattgactaagttaatgcagtggtaacgtggaacttatagagacagtgattattgcgtaacggaattagtaaataagatctctggggactggaaagatagaattatattcagctcatcttaaattttaagatagagtttaattgtgaaaagaatatagtcttatacttgagtcctaaaaccaactgtatcagaagagggaggcttggcatatgggcaacagtctgagtaaaaaaagatacagaacctttagtcagtagtcaagtcaatatcaataatcagtgagatattactgccagaaaatgttgggttattaaattgatagacatgtagtgtctacaatgagaaatgatcagtcttttctggtttacaaacattaaacaatgttctcaaggcagtttcccaggagtttttctacgcttgatatacatctaaaaaaataaattaattatcactgaataaatattgcatagcatctgagaaaaatagaatcagagaaatcttaaaataatcatttttaattccgtgggtgtctgttgtgctttggggggttaagagaagggtgagatgtgcccctctgtatttctgaggaaggaaagggagtaatctttattacagtctgttactgaaggcctctatatacaaagtactacggggaagctcaggagcacagacactaccaagttataggcctaggttttcaaggagtgtggaatccactgctggagaaagccggaaaacaaatgattatagatgatatgaagtctagatggagcatgctcccagtgctgttgagggagaccacaacccttaccaaatattgactattcctgggctcctacttgagttcttcctcttccaaaatgaatttgtgggtctgttttgtacctacaggtgcctggtctttttgcattgcagcctacatacatgacatctcgtggtcaggcctccaaatgacttatttatttgccttgagagtaaagctccttatcctaatataccaggttttcataatctgacctctgcctgcctttttacctcatctcttgccatcctctcccatatgaccctgtgctccagccttgctaagctgcttacagttcctgaaaatgttagggtaccttttttttgtttttgtacttgtttttgcttttgtctggaatatctttctccctttttatctagctaattcctacttttccttcaaatgttggctcagtgtttaccccctccaagaagacttttgcttccacttgaccccgtccctagaatagatgctccttttttatgttcagcccttacccgatgcatgcctgtgttgtagcctgtataatgctgttatgattgtttacaaaccaagttgtctacaaagtttgagcattatgaagataatgctctgatctctgtatttttattacttaacagagggcatggtgaacatttaggccttcaataaatgtttattgcatgaatatgtaaataaatggtatatttttagagagcacagactgtctgcaatgttttttctcttaacactagactcagtattagcaacatagaaagtgctcaatgtgaagacaggatgaatgaataaatttaaagatacgttaacatgatcagataaggaattaggctaaagatttataatgtgcaggtgttattttgactaatgtgataatgtgctcagtaaatggaatcatgaagagatggctgtgaaagaaggataattaatatttggattgaaagaatgtattagtttttgattgctggataataaattaccacaaatttagtggcttaaaataatacctgttttattgtttctcggtttcttctttaggccggaaatttgggaacagctgacttggttctctgcttatggtctcatgaggctgaaatcagtgtcagctgcgctgtgttcttttctggagctcagggtccttgtttaagctcccatggtttttggcagagttcacttccttgtggtttataggactcagcctcttgttctcttgctgatagtggtctgagggctgctgtcagccccattgaggccacctgcagtttcttgccatgtggcccactttataggccctctcatgcttcaaatctcttctttcaggaagggccagtcccttttaagggcttacctggttagagcagacctaccgtctgtattagtcagcttagactgccataacaaaataccagtctgggtggttttaacaacagacatttattttctcagagatctgaaggctggaactctgagatcaaggtgccagcatggttcagtttctggcgaggctctctccctagcatacagatggccacctgcctgttgtgacttcacatagcctttccttcttgcatgcgtgtggagagggagagatctttttctcttcctgttcttttgaggccaccctatgacctcatcaactttaattacctcctgaaagtcttgtttccaaatatagtcacattaagggttaggatacttcaacatgaatttggggcgggggatgaagggatacagttcagcctatagcacccagctaatctcccttttggttaactcaaagtgaactgatacgtgaccttaattatagcccctcaattccttcaccttgtaaagtaacatttctgggagtaatatcctatggtgtttataagtcctgctaataaccaagagaaggggattatgcagagaatgggaatcttggggtgacattttagaattctgcctaccccaaagatagtgggataaaatgcagcagcagatttagttgagatacgagttatattatgaatagaatcgtagaataatggaagagaaaagcacacagcaacctgatatataaggggaggaatactgagcttggacacatatatttggaaggtttaacctaaataatgtgtctgtgaaaaagcactttggaaactaaaattatttaacatgtaaggtgttactgatgccaaggtttgtggggagatgatgacaagattagcttaggaacgatgggtttgtgggtgggaaataagcagtgaagaccacgggctttggagttaaacaaacctgggtttaaatagtgattctgccacttaccagcttcagttttctcacaggtagaacgggaatgattacgtctatggatttttgtgagaattaaatgaaatatccatttcaagtttttagcttagtgcctggcacatagccagcactaaataaatatgtattcattcaccaacgaattattaaataaatatattctatgtgccaggcactgtattaggcctcaggtttctggtaaatattaatactattgtgcctgagctagatttcattggactttgaattgccaggctaaaacaacagagtttaaatgtttatttaaatcgccctgagctgttttcaagcaaagaataacatctaatattagctttttagaatttgtgattatttggtgctagtacatggtggtttttttcttttgtataaagagctcaaatttgcctgtagtcattctaattattgatacactaagacttaaaagatctccatacctcttacatcattgttttgattttttgaaggacgctattgaaatctgtgttttaggagagcattctcatggcagtgttccaaatggattgaaaagggcagagattaaaaaggaaggccttttattaacgcagaaccagggtgcttacagtgggaatgatgaaaaggaaattatgcggataagagcattgggaaagaagaatcaataggtttaggtgattgaacacaggaagtatgagtgagggaaaaggcagcactaatataatgtgatgtcagttctggagcactgcagtgattcatgactatcatggagcggatttatttgataaaatttatttgaataggtggatttatttgaatagaattctttaaaaaatggaaaattcatttagtgtagaaaaatgtagatcacgcctttttagacaccagaaaaatccttttatcatcgatggaagatgttatcaacatgactagaagtacatatatgttaattacccatagatacataatgaaaggaactgtgtaggcaaccacacactagctattagagggcctagagtatctaaaaggttagtgtccatcagagaagaagaaagataaagtggtgaggtactagatgcattagcacgaatctttgaaattgtaagtttatggattgtgatatttctagttgtctctaaggaaatataattttagatgtgtataaggcaggcgttctggatgctgttggggaagataaactacaattagtaaccgagcaaatgaagaacagggattctttggtactaagaacagaatagaattgagaagaataagagttgaagctaagaaaccagttaggggctattggctaggtggcagtctatctggggtgaggtgaacggatttgaaatggctttaattaagtcgttgctgctaaatatgtagaaactgtctaggccttaggttgcttgatttttgtgacagtggtcattcctcccttgatgggctgttcctttaactgctgtcataccagctctcccagctgtccttctgcttctccctggatattctggttcacaattttttgcaggacttttttcccccctaatttcttaagtattgatattcctctggattctgttctaggttctgtttactctcattctcgcagtcttcagggtgatctcattcactttcatagcgttcataaccatctgtgtgctaatgactgccacatttttatctctggccaagatctgtctcctgagcaacagatctttatattcaactcatattcaacacatcctcttggatgttacacaggcacctccaactgaaaatagaactttcttctcaaactgttgctgccgtgttctacatcgcagtaaatagcatcaccattttttctggttccccaagccatataccagcaaacattcttttctttttctttggcagtgtaatttatatacaacaaaatacatatatatatatatatatatacacacacacacacacacatatacacatatatatatacacacatatgtatacatatatacacatatatatacacacacacacatatacacacagtttgatgaattttaataaatatacacacctgtattgccattgttaaatcaaggtatagagtattttcattatccagaatgttccctcatttgccagagttctgacaccctcattcccatccctgggacacttttcttactgccttatcatttattagctttccctgtttttgaacttcttataagtggagtcatacggggcactcttttggtttctggcttcttttgtttaacatacaatttttggaatttatccatgttcttgtatagattagcagtgtattcctttttactggtgaagcagtatttccttctatgaatatattacagtttgcttattcattattctgttgatggatatttggattgtttctactttttggctattataaataaagccgataggaacaccttacacaagttttttgtggtcatgtgctttctcctatttatttatttatttgatattttagagacagggactcattctgtcaccaggctcggagtgcagtagtgcagtcatagctcactgtaacctcaagctcctgaactcaagggattctcccttcagcctcccacgtagctgggaatgggtgcgcactaccatgcttggctaatttaatttttttagcgacagcgtcttgctgtgttgctgggggctgatctcaaactcctgatgtcaagtgatttctcccatctcagcttcccaaagtgttgggattacaggcatgagccaccgcacccagcccacattatacctgagagtgaaactgttggcttatacgagaggtgtatatttaacttattaggtattgccacacaggtttccaaagtagttatacatttttacagtccctccagcaatgtttgaaaagttccagttgctctacctcttgccatcatttggtattgccagttttgtaagttctagccattataataggcttgtagtagtgtatcattttgattttgatttttacttttataatgactaaagttatgagcaccatttcatgtgctaatagctcattcttgtatcttattttttgaagtgtttgttcaaatattttgcctattctcaattattgggttgtttatatttttatttttatgtaggaattctttgtgtattttggatagaagtcctttgtcaggtgtacacacacacacacacacacacacacacacacacacacacatatcccaagtgtttttttctcagtcatgacttgattttttttcatttcctcaataatgcccttaggactaatttttgcctagtcagagtttttgcatatattttcctatgtgttattccagaggcactgtagtcttagcttttacatttaggtccctaatccatctcaaattaatctgtgtgtatgaggtgaggtacaggttaaggttcatttatttcctatatacgtattaagttatttcactgccatttgttgacaaagtttttcttttccttattaaaaaattgagtatgtatgaatgattctttctataatctgaaatgtgtgcgtgtgtgtgtgtgtgtgtgtgtgtgtatatattttttgtttgtttgtttgtttgtttgtttttttgagatggagtttcgctcttgttgcctaggctggagtacaatggtgcgatctcagctcaccacaacctctgcctcccaggttcaagcaattcttctgcctcagcctcccaagtagctgggattacaggcatgtgccatcacgcctggctaattttgtatttttagtagacacagtgtttctcaatgttagtcaggctggtctcgaactcccagcctcaggtgatctgcccacctcggcctctcaaagttctgggattacaggcgtgaaccaccgcacccagccctaaattatatttcattgatctgtttgtttagttctgtgtaactactgctgccttacttactgtagctttatgataggtcataaaatctagtagtgtaagccctccagctatttcccgcccccaacattttcttggtgttctaggtcttttgtatttgcatatcaattttaaaagcagtttgccaatttctattaaacaaaaatcttttgggtttttgattgggattgctttggctctagatcaatttagggagacttgactgcttaataatatcgtatcttccaatccatgaaatgatatatgtctccatttatttaaatattctttaatatctcagcggtgttttatggttttcagtgtacaggtctttcacatctttctttagatttattcctagttatttattgatattaaatagaaacactgattgatttttaatatattaatttaaactcttgcaatttgccgaatttactcattagttctagtagttggattgtagatttctttggatttttctacatacacaatcatagcacctttaagtagatttgcttcttcctttcctatacctatggcttttatttacttttaaaatgcattattacaatggtttggaccttgagtatatgtggaatagagtgatgaaagtgggtatctttgccttgtttttgattgtaagtataggattagctgtagatttttttctataaaccttttatcagattgaggaagctcccctttcctcctagtttgttgagggttttttttttatttttaaccattaacaggtattaaattttatcaaatgcttctttttttgaatcttttaagataattatgatcttttttcttcattctgtcattgattgattttcaaatattataccaaccttgtatagtatttgaaaatcagtcagtttaacagaatggtataacctactcagataaacccacttgatccagttgctttatccttttcatatattactagagttgatttgctaacattttattaatggtttttgcatttatgttcatgtataataattggtctataatttttttttcctatagtgttcgtgtcatgttttggtatcagggtcatgttgacctcatgaaacaaactgaaagcatcccttcttcttcttggaaagatttttgatgctactggcattttaccggtgaagctatctgagcctagagtttcctatgtgagaaaatttttaattgcaaatataatttatttaacagatggtggttctttagattttctgtttcttttgtttgttttggaaatttgtggattttaaacaatttgactatttcatttaagttgaatttattggcatacagttgctcataatttctccttaattccttttaactatgtgaaggatctgtagtgatgtcttctctttcatttttatgctggtaatttgttttcaagcatcattctttatctctcttctctctcacttttcacatttacaccatctttcctgtcactattttaatttaggacagagccatttgttacttggactgttggaataacctcacactaaccttcctgtttgcagtctcttttctctgtgtgccattcacctattacaagaagaaatatctttctaaagtgcaaatgtaattaaatctttcccagcttaaaactttttaatggttttctgatgccttcagaataaaaatctaagcaccttcatatgaaatacaaaaccattaattataaggtattgatttgtttcatagacatctgtctttcctgtatttcttctccctttttatctctctctgcaagccgtagggaactatacttcactgcctttgtaggtattctaatttgtcattctttgtcttaaacttgaatgcagggtttctgatgtcatatgatcaatattatcttctaacttctccttcagtgagattatttttaatatctcattggcttcatctcagttaatctttattaataatttacttgacataattttttttattcaatgtatctttacgttcacagaaatatatagcctcaaagcactttagtccagtttcagtttatctcaaatcatgttaaaaaataggaatgcatctctttcctatcaccagaatacctatcggatagctatttgatctctccttcccaacaccagtgacgataagttttatttcagcttgaggatgttagtgttgatattgaccactcacccatattactacatgatatatatttctttctttatagattcttttgatagtttgcaaaatcaagaaacattactctgaaattggccaaccagtttggaggtaaagcagttgtttcttttttagttagtccttcacctctttatccccaggggaatcaggatgtcccatgttatttttcaaagtctaaatacttcaaacttttattctcctgttgggtttgaaaggggggtgttattagctctgtcttgatgcagcaggggctctgaaagtctatttggataacactgaagattggaggaaatgtgactctgtctgtgtgttttaagcccctaaggtaagatcagaaagcgtctggggcagtgagagccaaatagttgaagtcatacattaattatggtcatgaatcatttttatttttaaagtctttaccatttgacaaggttgtttgcatagtaccagtgaagttttaggcggccctttcctacttttaaagtaacaggctattttgttgatttcttctctgggttgatgatgcctatcatttttagaattctgataacatttttagtaaaaattgctgtttcctcacttgaatgagtggtctctatgtgatttttattttgatacactattttgaagttacaaatctaggaaactaccacactgatcttccaattaatctcccactgatgtcaaaaatgtcaaattttgggactgtgcttttatgttcagacgttaggcattaagccagcaaatacattttgagtccctcctttgtgccacattctgtgcttagcatttggaatacaccttagaagatgaaatttatttttcccccagaaagatctggtgaaataggcaaagaaataaacagttgctgtaaaatagggtcatgtaatatttttgtggtgccatacacatgaagtagcagatttccagaggaaggagcacctctacctgtccgtaatagtcaggaaaggcttttgaagaagaggttgcttgagctgcctcttgatggattaggagtttatttatctgttaagggatgggaagaacttgtaggcacatagaacaactcacacaggggtacagaaggaataaattataaggatatgtttggagagttgccagtagtttagtattgctagagaagatggtgcaaggtaaaaaataatcaggaatgagactggatgtgtcagcagggtctacatcacaaagggccttaccttgatgtaaaattactttagagctgtctttttaagagagtattactgtcaatgtagattaaacacacaaacacacccagaccaagaggcaacaggatggagtataatctcctctattggattccttaggagccctgagggatttgttgaattactggtcccatgaacaaaatagctgtattgagagttggtcctttttatgtgacctaagaaatcatcaataaatatcaggcaatttctaaaagtaaagaatatatcatgaatattttcagggtttagggtaataataataatgttggcagaggtagtgatatcatcaaatgcctaagaaaatgaacctctcatatatatgatgactttcaggttaggattgatgaccaccttttaaaaaccgaggtaaaattcacacacagtgaaatgcacagatcttaagtgtaaaatctgtgagttttggtgtactccttaccctaatcaagacatcaaagccaggtgcagtggctcactcttgtaatcccaacactgtgggaggctgaggcggaaggatggcttgaggccaggagtttgagataagcctgggcatagcgagactctgtctctacaaaaaattagtcggacccagttgcacgctcctgtagtccagctactcagaaggctgaggcaggaagatcccttaagtccaggaatttgagggggcagtgagttatggtcatgccagtgcactccaacctaggtgacaaagtgagaccaccatctagaaaaataaagacttagaacatttccatcacctcagatagttcctttgttccctcttctccctatgttagtccccaccactcttttgatttgtcaccataggttggttttacctgttcttgaactttgtaaaaagggaatcatacaatatggacttttctgtttctggcttttttcactcaacatattgtttttgagatccattcatattgttgtatgtaccagtggtgtgttcctttttattgctaagtagattttcattatatgaatatacctcaatctgttgattcttctatttgatagacatttgggttgttttctatgaacattcttatacaaagcttcttgtagacatacgttttttatttttcttgggtaaatacctaggagtagaattgctgggtcataggttaaatatatgtttaacttaataactaataatttctaaaaaatggcactattatttattaggctggtgcaaaagtaattgcaattcttgccttttttttttttttttgagatggaatcttgctctgtcgccaggctggagtgcaatggcacgatctcagctcactgcaacttctgcttcccgggttcaagcgattcccttgcctcagcctcccaagtagctgggactacgggcgtatgccaccatgcctggctaactttttgtattttagtagagacggggtttcaccatgttggccaggatggtcttgatctcctgatctcgtgggttcttgcaatttaaatttaaatttaaaataattgcaagaactgtagttacttttgcaccagcctgatatatttttgccagcaatgcatgcaagttttagctgttccacatccttgccagcatttagtgttgtcattttaattttatttattctaacaggtgtgaaatggcacctcattatgattttaatatgcgtttccctgatgactaagactttgagtgacttttcctgtgcttattggccattcttatatcttcttttgtgaagtgttcatttcattctgttgtccatttttaattggctgtcttgattactgatttataagacttctttatagtcagataggtgctttgcaaatatttcctcccagtctatggactgtttttttttttaaattttcctaatgggagctttgttaagattaacaggtatttctcatttttttaaagtctaatttattcctttttaattttatgattaattctttttatgtcttctctagtgaatatttgtctaccccaagtttgcaggagatagtcctacatttttggtcataagtgttatgatttcagctttttatatttactgtgatcctctttaaattaatttttgtgtgtatgaagtaggggatgagattgattttttttctatgcttattcagtgttccatagcacctttgtttaaaaaactttgttttctgcactgatttgccttcattcctttgtcaaaaattaatttgctatatatgtgtaggattattatgatacactttcttctgttccattgatctttgtttttttttttatctccatgaccacaccatattgtcttaattatgtaacttaatagaaactcttgaaatctggcatatttcaagattggtttgtcccttctagattctttgcttttctctataaattacagtatcatcttactaatttctgtcaaaaaaaaatcctttgggaccgtgattaggagtctcaagctatttacccatttgggaaaagctgacaacttaacaatatagaatcttccagtccatgtacatgtattttttacttactagttcttctttattgtagcagtgttttgtgacttcagggttgagtcttgcacatcttttgtttatttcatccctaagtattttatgttttttgatgctgtcattaaagtattatttaaaaatttcataactcaattgtttggggctaatacaggaataccttggagatactgaggatttggttccaggctaccccaataaagcaaatattgcaataaagcagtaaatcaaatatttcaataaagcgagtcacatgaactttttggtttcccagtgcgtataaaagttatgtttacactatgctgtagtctattaagtgtgaaatagcattatgtctaaaaacaatgtacataccttaattaaaacatacttcattgctaaaaaatgctaacgatcatctgaaccttcagcaagccatatctttttgctggtggagggtcttgcctccatgtcagtggctgctgactgatcagattggtggttactgcaggttggagtgattgtgacaatttcttaaaataagacaacatgaagtttgacatatcagttgactcttctttcgtgaatgattctctgtatcatgcgatgctgtttgatagcattttacccagagtagaacttctttcaaaattggagtccgtccttcccctcaaaccctgccactgttttatcaactaagtttatgatggcgtaaattttttgttgtcatttcaacagtgtttatagcttcttcaccaggagtagattctatctcaaaaaaccacttttcttgattaactgtaaaaagtaactcctcatccagtcaagtttgatcatgagatcacagcaattcagtcacatcttcaggctcctcttataattctaattctcttgctattaaaaccatgtctgcagttacttcctccactgaagtctcgaacccctcaaagtcatccatgagggttggaatcagcttcttccaaagtcctgttaatgttgatatttttatctactcccatgaatcatgaatgttctgaatggcattcagaatggcgaatcctttccagaatgttttccattgattttgcccagatccaccagaagaatcaattatctgtggcaactctaggcttatgaaatgtatttcttaaataataaaacttgaaagttgaaatgcctccttcatccatgggctacagaatggataatgtgttagcagacatgaaaacattaatctccttgtacatgcccatcagcactcttgggtgaccaggttcattgccaatgaacaataatattttgaaagaaatcttttttctaagcagtaggtctcaagagtcctaaaatattcataaaaccatgctgtaaacagatacattgtcatccaggctttgatgtaccatttatagaacacaggcagagtagatttagcataattcttaagggccccagggtcttcagagttgcaaatgagcattagcttcaacttaaaatcagcagctgcattaacccctagtaaaagagtcagtctgtcctttgaagctttgaagccaggcattgacttctcctctctagctatgaaagtcctaggtggcatcttatttcaacagaaggctgtttcatctatgttgaaaatctgttgtttagtataaccaccttcattgatgatcttagctagagctactgagtaacttattgcagcttctccattagcacttcctgcttcaccttgcatgtctatgttctagaggtggcttctttccttaaacctcataaaccaatctctgctgtcttccaacttttcttctgcagcttccttacctctctcagccttcaaagatttgaagagagttaggtccttactctggattaggctttgggttaagagaaggttgtggctggtttgatcttgcatccagaccagtaaaactctttccgcatcagcaataaggctgttttactttcttatcattcgtgtgttcactggagtagcacttttaatttccttcaagaacttttcctttgcattcacaacttggctgactgtttcatgcaagaggcctagtttttggcttatcttggcttttcacctgccttcctcagtaagctttgtcatttctagcttttgatttaaagtgagagacataggactattcttttcacttgaacacctagaggttactgtaaggcttggcctaatttcattattgttgtgtctcagggaatatggaggcccaaggagaggaagagagactgggaatggccagtcagtagagcagtcagaacacaaaacatttatcgataaagttcactatcttatacgggtacagctcgtggtgctccaaaataactataatagcaacaccaaagatctctgatcacaggtcaccataacagatataataataatgataaagtttgagatattgtgagaattaccaaaatgtgacagagagacatgaagtgaccacatgctggtggaaaaatggctccagtagacttgattgactcagggttgccacaaaccttcaatttgtttttttttttttgtttcttttttttaaatatctatgaagcacaataaagcaaaatgcagtaaagtgaggtatgcctacatacagaaatataattgatttttttgtgtatattgaccttatatcccatgaccttgctaaattaacttattaattttagtatttgttttgtagatttctgatcattttccacatgacaattatgtcatctgcaaataaagacagtttgaccatttggtatggaaatgtataagaaatacatgagctatatttaaagataaagaggccaggtgcagtggcatagggctgtaatcctagtactttgagaggccgaggcgggcacattgcttgaacacaggagtttgagaccagtctgggcaacatggtgaaacctcgtctctgcaaaaaatacaaaaattagccaggcatggtggtgcatgcctgtagtcccagctatttgggggcctgaggtaggagaatcacttgagcccgggaggtcaaggctgcagtgagccgtgattgcaccactgtactccagcctgggcgacagagtgacatcctgtctcaaaataaaattaaattaaagataaggagaccaagaagcaaaaacacaaagaaaaccataatttaaaaataaaaatagctcttaattttttcattgttccttgaaagagaccttactgagaatgtagttggctagtttgaacctggccgagtatttaattcctcctattactttgtcttttctatcatcttttggttttttcttatatctttgagagtgctgtctgctttgattcaaccttctcaacttggattactgtgaattctttttttcctttatggatacctagaagtaattgtcacctttgagagtggtgatactctctcggtgactttagcaatccatttaatttcactgggcgtcagtttccacatctataaatgataggattttactatattactttctcagggctcttcccaactcctttgagttcttcatcttacctcacagtacatcagaggcaggcaggcaagtacaaaaagggtgttttagagctttactgttataggatttattgtattccctgttatttcattgcgaatatgctagataattaaaaatcaattgagttcattattaattctatgtatcctccaggtttgtcatttatatctgaggctctttgttgagtttactgttaactcatttacatttttctataacttatatttctaggcttcatagagcccagtgtgcaattaaacagactcaggtaactgttcagaaaattggaaaggaaattgaagaaaaactaagactcacatctacaagcaatgaactggtaggtttttatgtatttacctgtttacacttcttgttttctaaaggagagtatcatattcttctagggttaattttaaaaaacgctttagatcgtttttatcttcttaattgtccacagagagttctattggcatttaaatgttggaaataaactttcccatctgctaataatgtaacgcatgaagtgcctgctttattctgctagatgaaactttatattacataaaattacttagaagataattaacaggcagttttattaatgtgaactctaaacatgaactatatagcgaatgaaaaatagccgccaggaggaaaaaaaaaatgggagctaatctacttttgaaagacgaatttaaaaagtatttggattgagcaaaacaggctggtttgtggacagtgatctcttttgggaaatactcttattaaggaggcatttccaaagaaatagaaatcctaacccaaatgggcagatttaagatattagtataattttgagttgtttttcctagtggagtggaaaaatgtctattttgtaatgaatattgtgtttttctaagcacaatagtgggtatggctaataaattgagcttttttttttaaaagccacttgggtatgaatagcttttgaggaactttgtgctgtggattggacttaaaataaaattcagatcttcaaattaagttctagataaaattatttaaatatttgttcgtgtgaactcattatcacagataggcagcatcttcctattgtcatttacacccttctcaacttagcagagggcctttatatccccaaatgaaagctttttgttgccttgaagatttgcccaagataatcatatagtagaagtatagaaaagcagcaatgcacttaaccttacagaaacttctctctcatggaatttgaaattaatatattagttcaaactgtatacagttgctgattttctagctagtgctatagctggcaggtagcaaacatacaaaataggataactgcaataggtatagtagtaattcttattattcacttgactttccttgtctataaaaacatcttccgtttcaaaggtgctgttaaaccacctcttgttgtaacttagccccagcaagactaaatttcagactataaatatattgaagggggaggaaaaatcactaattttaattctttctgtagtgtataaaaatgctggatttttagaacccttggggaaaattgctgggttttatttttgttttcctctcccaaggaaagactgggaaattaattgttgcattaaatgacagcatatgctttatctcagtgtggaaaaatgtatttttaatcctgtttttaaaggaatataagtggtgacatacagagcaaggtaacagaatgtgtgagtttaaagaggtcaagttcagaggttcattgtgtgtttttatgctgcctagtcaacacagaagaaaaatcattggatttttgaactgaacgtgaacctagaaatcatctggttccctaataaccccattcaaaactatagccccctcagtacattctatcccttttcctgctttattctgtataatattcattaccatttaccatgatacatattttgcatatttttctctctctctaagctctataaggcgaggggtttttgtctctctctctttttttacattggtgtatttccagcatctagaaaagtgtttgccacacagtaggtgctcaataagtatttgttgaatttaagaatgaatctagcataatgtccttttataataggacaggaaaatgaagcttaaagaagggaaacagctttcccacaatcatttgacaatagagatggataatttggtttacttgtttccttttagagaataatgccatctacatgttaattagtcagtcactttgaggtttacctatagcatattagaaaactttactatttgtctttttgctcatttacttttcaaattggcccatggccattgtattccaacccatccatttccgatatttaagaaatcattttcattttaacctacgtaaaaatgcagcaaagaaggcatatttgatgttgaaagaaatcagattaccttccaagaccatatatgattaactgtgttataagaaattgggttcatagttggtgactttcaaaaatttggcatcttctcacattacatcaatgcctaatgttttttggcatttaattttatttcttatgaaatttctgctgttatcattttgaatttttacttatgttttataagttttttgtttgtttgttttgaggtgagatctcactatgttgtctgggctgctcttgaactcctggcctcaagtggtcctctcacctgagcctcccgagtagctgggattatagacgtgtaccagcatgcacagtttgtgtttcagattttgtcagattcctttcctgtatctgtttagataaatgtatgttttttctcttctggtattaaggtgaaatacattggttgattttttaatattaagccaactttgcattcctagggaaagccctcttggtcatggtgaattactttttaatgctcattactggatttaatttgttaaaaaattttaaagaaattgtgcatatgtatttataaagaatattggtctgtagtttgtttccttgtaatctctttgtctcattttgttgtcagggtgacgttggccgcaactcacttttgggaagtgttttctccctttttgttttcaggaaaaatatgtgtagaatgggaattatttcttaaatgttaagtagaatttgcattgaagccatctgggcctggaggtttttttgtgggaaggtttttgaactggaaattcaatttctttaataatttaccttttgcattaacttttgtagcttgtgtctttcaaggatttgtccatttcatttaggaggtcagtctttttacatttagctattctagcagttatgtagtattttctctttttgttctaaattgtatttccatgatgagcatttttcatatcctattggatatgcatgcatcttttaataagtatcagtttagggctgggcgtggtggcccacgcctgtaatcccagcaatttgggaggccaaggcaggtggatcacgaggtcaggagttcgagaccagcctggccagtatggtgaaaccccgtttctactgaaagtacaaaaaattagctgggtgtggttctatagttcattgttttgtatcacgtacgtaagggtaattttttccccctgcatggatatccggttgatttagcatcatttattgaatagtcttttcattccccatttaattgccttgacatgtttgttcaaaatcaattgatcatgtatatgtgcatctatttctggattttcttttctgttccattgatctatatgtctgtatttccccaataccaaactcacttattatcatagatttgtcatcttaaaatttgacagggtaagtcttccaactttgttaaaacttctgtggtttttctgggttctttatatttccaactgaatttgggaatcagtttgtcaatttctacacacacaaaaaaaaggtctgatggaattttgataagaagctgtagataaaattgtggagaattgctatcttaacaatagtgggtccttcaatccgtgaacatggtgtatatctcttttacttagatttctctctaattctctttataatgttgtagctttcactgtagagattttggacatcttttatttatttatttatttaattttgagacggagtctcgctctgtcgcccaggctagagtgcagtggcgcgatctcggctcactgcaccctccgacttccgggttcacaccattctcctgcctcagcctcccgagtagctgggactacaggcgtccaccaccacgcccagttaattttttaaaaatatttttagtagagacgggggttcaccgtgttagcctggatggtctccatctcctgacctcgtggtctgcccgccttggcctcccaaagtgctgggattacaggcatgagccaccgcgcccggcagatgttggacatcttttgttagagttattctgaagtgttttatgggagttttttggcaggggaggcattattgcaagtggaattgtttttaaatttttatttctcattcgtttgctgctagtatgtaataatacaattaattttaacttattaatcttctgtcttgcaatcttgttatattaacttattcattatgctagttatttatagttttttgggattttctttgtaaagaatcataacaggaaagtttgcacagttttatgccctttatttgattttcatccagtacaatgttggacaaaaaaaatagtaagaacaggaatcctcaccttgttcctggttttgaggagaaacaactcatcatttctctgttaaatatagtgctaagaatgcccttcattaattttaggaagttcctcttattcctagtttctgagagtttttatcacgaatagaagatgaattttgtcagatggtttttctatatccattgcaatgatcatatggttttttctttattctcttaatgtgattaactttttggtttattttcaaatgtttaacattgcatttctggaataaacctaaattgattataatatataattatttttgtattttgttggatttattcttataaatttttttccttcgtattgtcttggatttgctttggtaataatttaaggaattttgcacttgtatttatcagggatgttgtgatacaatgttttgaattgcgttttcagattttggtagtaggattatggtagcctggtaaaattagttgggcagtgttctttttttcctattccatcttgcccaggagcagaaatctggaccttttaaatattttctagttctctgctgatatttcatatccttttattcactataagaatatttcaatttttgtcgacatatatgtatgagtggctttaaagtttttgtaattctaacatctggatcatcttggggttggcatatgttggttttctcctccctagagagtgagtcacattttcctgactcttcatatattgggtaatactgcatagtattctggacattgtgaatgtaatttggtggaatctctggattttgttactttgttccaaaaaatgttgatgtttttattttagcaggtagttaacttggttaggctcaaactgtcatgcctgcaatgaacattggctcagattacagtgtagttcttttactcttaggcacaagcttctttctgtttgtctcatgcatgtgtagtataggattcagtcagagacttaggttgaatttaaacagaatttggggtgcccattctctgccttcctctattctggtatacttgattgcctgaccatttttccctggttcctctggtcagaaaggaagttgactttctgttggagtttgcagccaccctcagggaaaagccacagaaaaggggaatttcattttattggttgtttatgccaagttctgactcacctccaaaatatgcctgccattgatcagtctcaagaaccctcaagtagcaatttttgtattttatccatagtctatatttgttatccatagtctatatcttctatgagaggaccagtttgttgcatacttattcttttacaccagaagcagagctcctgtacattttattattatatatttttgctgtatcctcctggctaaatccgggttctaagcctgttactgctaagtctgtgaaattaatggataggaaatattttctgcggaaatcttttccttttcttagtggttgactaggtgtaggtccagtagaaacaacctgtaaatgacatttaaaagcagatgtgttaacttttgggacagctgccacaattttaaaaccttttttctgattgttatttattttcaatttggggggaagaattactacaggtgaagataaaatataccctaagctgtcaattctcaaagttattggtctcaagacctctttgtacccttaaaaatctcaaagaattcagtaatacatttttatgaaaaataagcatatttttctgaacaaaaggtttaattagcattacattgcttaaatattttgtgaatttaactgctattaagctaatgtctagcctaataaaagacacctggattttcacatctgcttctgcagtgaatctgttgcaatatcgtaagtctcgcagactctggtaaactccatcatacacttatgagaaaatgagagtggaaaagaggcatacagcttagtaatatgcgaatatgttttatcttacaagactctgtaaagatgtcaggaaccctcacaattcccaggaacatgcttgaggaacttttgacctaaggcaaaaagctttagctccaatatgatcaatgtgaagacacttgttccattactggttgaacatctcaaatcaaaaatccaaaatccaaaacactccaatgagcattttccttgagcatcatattggtgctcagaaagtttcagattttgtagcattttggacttcagattttaggatttggcatattcaacctataatatgttatttatacgttagtcatctttctgaaatgaatgtttaacatttcccatttttttggcagagactcataaataggaatgtgtgtatctgtgattttcagttcacatatagtgttgtataaaaacactaaaatctaattaaatgtaatctattggcgaaatatatgtgacattacacttggagtaaacagataaatagaacactgaaactcattagaagattatggaacattaagatctttgagcagttcatctttgatgcattagaaaggaagtagaactagatcccacatgggtttgtttactcatcagaaattggagccaacaattctggttttgaatgacttgatatatttctgtaaatgagccagtttctgaacatggaccataacacaaacactatacatatgccttcccatattaatgtagtatttagattaacttgtaaccttagttctttaaatctagaaaacatatctcagtatgtaccctggaatagagcaggttatcctcctagccaggcatatccctgtgttctctgaatatttgcttttctttttctgtattttctttctctgcccaggtagaattcaatttacatattttgtggaaaaattcaagttaagaaagttgaacacctcactctttgtgggaaaagattgcttcctaaagattttacctatctttttcctcagtgatgtaagaacaccttaggcttcttgattatactattgcattgctaaagaaaactcagattgtttcttcgttcctttttctttcataataaacagcctcattgactttttttccaattatttttgtggtaaaatacatataagatttatgatctcatttcatttttaaatgtacagcccagtggtattaaataccttcagaatgtcatgcaaccattatcaccatccatctccagaagtcttttaaactgaaactgtacgcattaaacactaactcctcgcctccctctactcccagcccctggcaactaccattctactttttgtctccgtgactttgactgtactctgagtaactcatataagtgaaatcatgcagtgtatacctttttatggctggctgtttcacttagtgtaatgtcctcaagcttcatccatggtgtagcatattgcagaaatttccttcctgattaaagctgaataatactgcattgtatgtatataccatattttgcttatccattcatttattgatagacactgggttgcttctgcgtcttagaaccttgtggacttttggtttctgtttttacagtggggtggcagggcaaaatggcttttatctccagtagacctaaattcatagaaagtagagaccatttctcattcatctagaagcatgcagtagggcctttattgatgtttggtttgttcaggaaaattgtttaggaatattctatgaaaggcatatttcatagacctttcaagctaaatataataatgattggaaataagtttttctgctgttttctcagcttgaatgtctttaacagatgatcataccatctgtttagaatcagtgtgtcagggatgagtaagaaagcatcttgggtgagaaatgatgctgtaagtacttttaatacattgccaaaaatcgttgtccatgcccgttgcttcaacgaggccataccatgatgcatctcactgagttcccacgcttcctcattgtgagtcaaatcaagatactaaccttttccttttaaagttttctatcagcttatcctggatcctggtaacctatttatttaatggatgagttttgtagttacaattttaattgtttactttataccttaggaaggagataaaaatttactagctataaccaaattgctgtttgcttaagatttatgtcataaaaaatgatgaaaagtgtattagtgacactgataaagactaggagagaagacacattcatagtgcagtaattatgtgtgtgcacacatatgcaggcacagacatattcattttggggacagaatttcagatttgtatctggaggtaaattcaggcaaggcttttggagaaaaaaagaggctgagtaaagtttaagcaatggtttgatgtagtatttatatggaaacgtaagttaacaaacaacaagtttaattgtatctctggctggtagaatgggtcaggaatttcattttattaaatgtgtattcagtaaaattgatttttaatgtaacttaaaaagtaaactttctttttcaaggtagttttagattcatagaaaaattaggcagaaagggccgggcatgatggctcatgcctgtaatcccagcactttgggaggccgaggcaggcggatcatgaggttgggagatcaagaccatcctggctaacatggtgaaaccctgtctctactaaaaatacaaaaaaattagccgggcgtggtcgcgggcgcctgtagtcccagttacttgtgaggctgaggcaggagaatggtgtgaacccgggaggcagagcttgcagtgagctgagattgtgccactgcactccagcctgggcaacagagcgagactccatctcaaaaaaaaaaaaaaaaaaaattaggcagaaagtacagagttcccatataacccaccccatccccaatttcttctgttaaaacatcttgtactcgtgtggtacaattgttatattgattaattaatattaatacattattattaactgaagtacatagtttacattagggtttactctttatgttatacagttctatgagttttgacaaatgtattatgtatccatcattacagcatcaaacagaatagttgcattgccctaaaaatatcctatcctccacgtgttcatccttttctccctcctctggcaactgatctttttactgtctctataattttaccttttccatgatttcatatagtaggaatcacacagtatgtagctttttcagactggcttctttcatttagcaatatgcatgtacaatttctcttttgatgggttgatagctcattttgtttcatcactgaatagtactccattgtatatataccacagtttatctgttgacctattgaagtatatcttggttgcttccaagttttggcaattatgaataaagttgttgtagacatttgtgtgtaggtttttgtgtaaacgtaagttttcagtatccaggttaatatataagagtatgattgctagattgtatagtaagactattttagctttgtgagaaactgccagactctgccaaagtggctgtaccattttgcatccccaccttcaatgaatgacagttcgtgttgttccatatctttgccagcatttggtggtgtgagagttttggattttattctaatgggtatgtagtcgtatcacattgttgttttaacttgcaatgccctaatgacttacgatgttaaacatcttttcatatgcttgccatctatatatcttctttgatgagatacctgttcagttctttgttgcatttttaaattgagttgttcattttctttttttttttggagatagagtctcgctctttcactcaggctggagtgctgtagcacgatcctggttcactgaaacctctacctcccaggttcaagcgattttcctccctcagcctcccaagtagctgggattacaggtgtacaccaccatgcccggctagatgtttttttgtatttttggtaaagacagggttttgccatgttggccaggctggtctcgaactcctgacctcagctaatctgccagccttggcctcccaatgtgctggtattacaggcatgagccaccgtgcccagccagggttgtttgttttcttaatgttgaattttaagagctctttgaggccaggcccaagtggtagatcacacttgggtaacatagtgagaccccgtctgtattttttttttttatgagagttctttgtatattttggagaccagttctttatcagatatgtttttttgcatagtttttctcccagtctgtggcttgtctttactcttaacacagtatcttttgcagattttaaagatttccaagataccaatttcttttttcatggatcttgcttttggtgttatgtctaaaaagttatctccaaacccagagtcttctgtattttctcctgtgttatcttctagaagtataatttttaatttcatgtttagatctgtgatctggtttgagttaattttttatgaacggtataagacctgtatctagattgattagtccctctcgcactcactctgtttcttccttctttcctttctttttttgcatgtggcggtccagtggtttcatcatttggtgaaaagactgtcctttctgcattgagttgcttttgtttctttgtcaaatattctttgactgtatttgtttgggtatatttctaggctctctgttccatttgattgatctgtttgtctgttcttttacccataccaccctgtcttgattactatagcttatggtaattctagacattggctactgtcagtcttccaactttgttcttctccttcaatattctgttgtatattctgggtcttttgcctttatataaactttagaatcagttttgatattaacaaaataatttgatggataattggataatttgattccacttgttcattgctgttacacaggaagacatctaactttttatacttattaattctatattctgcaatcttgctataattgctttttctaggagggtgtttttttgttttgtttgtcaattcttttggattttctatatggaaacaataatattatctgcagccaaagacagttttatttcttctttcccaacacgtgtagcttttctttctttttcttgtcttatttcattagctaggacttcaggtataactatggtgaataggagcgaaaggggatatccttgtcatgttctcaaacttaggggataagcatctagtttcttactattaagtatgatgttagctgtaggttatttggtagatgttctttaccagttaaggaagttcccctcttttcctagttagctgaaagtttttatcatgaatcgtagttggattttgtcacatgctttttctgcatctatcaatatgtatgatcataccattttttcttccttagcctgttgatgtgatgaattacattaactgctctttgaatgttgaaccaaccttgcctacccgggataaattacatgttgccatgttgtgtaattattcttatacattgttggatttgatttgctaatattttgtagtgtctttggtttttgtgttagggtgatgctggcttcatagaatgaattagcaagtgttcatcaacttctaatttctggaagagattctgaagaactggaattgtttctttttttttatactttaagttctagggtacatgtgcacaatgtgcagttttgttacatatgtatacatgtgccatgttggtgtgctgcacccattaactcgtcatttacattaggtatatctcctaatgctatccctcctccatccccccaacccacgacaggccctggtgtgtggtgttccccaccctgtgcccaagtgttctcattgttcaattcctgcctgtgagtgagaatgaggtgtttggttttctgtccttgcgatagtttgctcagaatgatggtttccagcttcatccatgtcactgcaaaggacatgaactcatccttttttatggctgcatagtattccatggtgtatatgtgccacatttttcttaatccagtctatcattgatggacatttgggttgattccaagtctttgctattgtgaatagtgccgcaataaacatatgtgtgcatgtgtctttatagcagcatgattataatcctttgggtatatacccagtaacaggatggctgggccaaatggtatttctagttctagatccttgaggaattgccacctgtcttccacaatggttgaactagtttacagtcccaccaacagtgtaaaagcgttcctatttctccacgtcctctccagcacctcttgtttcctgactttttaatgatctctattctaactggtgtgagatggtatctcattgtggttttgatttgcatttctctgatggccagtgatgatgagcatttttaatgtgtctgttggctgcataaatgtcttcttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcacccgccaccgcgcccggctaattttttgtatttttagtagagacggggtttcaccttgttagccaggatggtctcgatctcctgacctcacgatccacccgcctcggcctcccaaagtgctgggattacaggcgtgagccaccgcgcccggccaaatgtcttcttttgagaagtgtctgttcatactctttgcccactttttgatggggttgtttgattttttcttgtaaatttgtttaagatctttgtagattctggatattagccctttgtcagatgagtagattgcaaaaattttctcccattctgtaggttgcctgttcactctgatggtagtttcttttgctgcgtagaagctctttagtttaattagatcccatttgtcaattttggcttttgttgctgttgcttttggtgttttagacatgaagtccttgcccatgcctttgtcctgaatggtattgcctaggttttctcctaggggtttttatggttttaggtctgatgtttaagtctttaatccgtcttgaattaatttttgtataaggtgtaaggaagggatccagtttcagcttttgacatatggctagccagttttcccagcaccatttattaaataggatttcttgtttttgtcaggtttgtcaaagatcagatggttgtagatgtgtggtattatttctgagggctctgttctgttccattgatctatatctctgttttggtaccagtaccatgctgttttggttactgtagccttgtagtatagtttgaagtcaggtattgtgatgcctctagttttgttcttttggcttaggattgtcttggcaatgcgggctcttttttggttccatatgaactttaaagtagttttttccaattctgtgaagaaagtcattggtagcttgatggggatggcactgaatctataaattaccttgggcagtgtggccattttcacgatattgattcttcctatccatgagcatggaatgttcttccatttgtttgtgtcctcttttattttgttgagcagtggtttgtaattctccttaaagaggtccttcacatcccttgtaagttggattcctaggtattttattctctttgaagcagttgtgaatgggagttcactcatgatttggctctctgtttttctgttattggtgtataggaatgcttgtgatatttgcacattgattttgtatcctgagactttgctgcagttgcttatcagcttaaggagattttgggctgagatgatggggttttctaaatatacaatcatgtcatctgcaaacagggacaatttgacttcctcttttcctaattgaataccctttgtttctttctcctgcctaattgccctggccagaacttccaacactgtgttgaataggagtggtgaaagagggcatccctgtcttgtgccagttttcaaagggaatggttccagtttttgtccattcagtatgatattggctgtgggtttgtcataaatagctcttattattttgagatatgtcccatcaatacctaatttattgagagtttttagcatgaagggctgttgaattttgtcaaaggctttttctgcatctattgagataatcatgtggtttttgtctttggttctgtttatatgctggattacgtttattgatttgcatatgttgaaccagccttgcatcccagggatgaagcccacttgatcatggtggataagctctttgatgtgctgctggattcagtttgccagtgttttactgaggatttttacatcaatgttcatcagggatattgatctaaaattctcttttttcattgtgtctctgccaggctttggtatcaggatgatgctggcctcataaaatgagttagggaggattccctctttttcttttgattggagtagtttcataaggaatggtaccagctcctctttgtgcctctggtagaatttggctgtgaatctgtctggtcctggactttttttggttggtaggctcttaattattgcctcaatttcagagcctgttattgctctattcagcgattcagcttcttcctggtttagtcttgggatggtgtatgtgtccaggaatgtatctatttcttctagattttctagtttatttacatagaggtgtttatagtattatctgatggtagtttgtatctctgtgggatcggtggtgatatcccctttatcatttgttattgcgtctatttgattcttccttcttttcttctttattagtcttgctagcggtctgtcaattttgttgatcttttcaaaaaaccagctcctggattcattgatttttttgaaggtttttttgtgtctctatttccttcagttctgctctcatcttagttatttcttgccttctgctagcttttgaatgtgtttgctcttgcttctccagttcttttaattgtgatgttagggtgtcaattttagatctttcctgctttctcttgtgggcatttagtgctataaattcccctctaaacagtgctttaaatgtgtcccagagattctggtatgttgtgtctttgttctcattggtttcaaagaacatctttatttctgccttcatttcattatgtacccagtagtcattcaggagcaggttgttcagtttccatgtagttgagcggttttgagtgagtttcttaatcctgagttctagtttgattgcactgtggtctgagagacagtttgttataatttctgttcttttacatttgccgaggagggctttacttccaactatgtggtcaattttggagtaagtgcgatgtggtgctgagaagggtgtatattctgttgatttggggtggagagttctgtagatgtctattaggtctgcttggtgcagagagctgagttcaattcctggatatccttgttaactttctgtctcgttgatctgtctaatgttgacagtggggtgttaaagtctcccattattattgtgtgggactctaagtctctttgtaggtctctaaggacttgctttattaatctgggtgctcctgtattgggtgcatatatatttaggatagttagctcttctagttgaattgatctctttaccattatgtaatggccttctttgtctcttctgatctttgttggtttaaagtctgttttatcagagactaggattgcaacccctgcttttttgtgttttccatttgcttggtagatgttcctccatccctttattttgagcctatgtgtgtctctgcacgtgagatgggtttcctgaatacagcacacttatgggtcttgactccatcctatttgccagtctgtgtcttttaattggagcatttagcccatttacacttaaggttaatattgttacgtgtgaatttgatcctgtcattatgatgttagctgattattttgctcgttagttgatgcagtttcttcctagcatcgatgatctttacaatttggcatgtttttgcagtggctggtaccggttgttctttccatgtttagcgcttccttcaggagctcttgtagggcaggcctggtggtgacaaaatctctcagcatttgcttgtctgtaaaggattttatttctccttcacttatgaagcttagtttggctggatatgaaattccgggtcgaaaattcttttctttcagaatgttgaatattgcctccactcttttgtggcttgtagagtttctgccaagagatccgctgttagtctgatgggcttccctttgtgggtaacctgacctttctctctggctgcccttaacattttttccttcatttcaactttggtgaatctgacaattatgtgtcttggagttgctcttctcgaggagtatctttgtggtgttctctgtatttcctgaatttgaatgctggcctgccttgctaggttagggaagttctcctggataatatcctgcagagtgttttccaacttggttccatcctccccatcactttcaggtacaccaatcagacatagatttggtcttttcacatagtcccatatttgttggaggctttgttcatttctttttactcttttttctctaaacttctcttctagcttcatttcattcatttgatcttctatcactgataccctttcttccagttgatcgaatcggctactgaagcttgtgcatgcatcacatagttcttatgtcatggtttacagctccatcaggtcatttaaggtcttctctacgctgtttattctagttagccattcatccaatatttttcaaagtttttagcttctttgagatgggttcgaacatcctcctttagcttggagaattttgttattaccgatcttctgaatccttcttctctctgctcgtcaaagtctttctccgtctagctttgtttagttgctggcaaggagctgcattcctttggaggagaagaggtgctctgatttttagaattttcagcttttctgctctggtttctccccatctttgtggttttatctacctttggtcttcgatgatggtgacgtacagatggggttttggtgtggatatcctttctgtttgttagttttccttctaacactcaggaccctcagctgcaggtctgttggagtttgctggaggtccactccaggccccgtttgcctgggtatcaccagtggaggctgcagaactgcaaatattgcagaacggcaaatgttgctgcctgatcattcctctggaagcttcgtgtcagaggggcacctggccgtatgaggtgtcagtcggcccctgctgggaggtgcctcccagttaggctacttgggggtcagggacccacttgaggaggcagtctgtccgttcccatatctcaaactctgtgctgggagaaccactactctcttcaaagctgacagacagggatgtttaagtctgcagaagttttctgctgccttttgttcagctatgccctgcccccagaggtggagtctacagaggcaggcaggcctccttgagctgcggtgggctccacccagttcgagcttctgggcagctttgtttacctgctcaagcctcagcattggtgggcgcccctcccccagcctcgctgccgccttgcagtttgatctcagactgctgtgctagcagtgagcaaggctccgtgggcgtgggaccctctgagccaggcgcgggatataatcttctggtatgctgtttgctaagacctttggaaaagcacagtattagggtgggagtgacctgattttccgggtgcgattttccaggtgccgtctgtcgtggcttcccttggctgggaaagggagttccccgaccccttgtgcttccctggtgaggcgatgccttgccctgctttggctcacggtccgtgggctgcacccactgtcctacaagccccagtgagatgaacccggcacctcaattggaaatgcagaaatcatccatcttctgcgtcgctcacgctggaagctgtagactggagctattcctattcggccatcttggaacctccctgcctcttttttctggtattgtttcttacttaaacatttagtagaattcactgtgaaaccaactagaccttttttttttctcccctgtttctgaaggttagtaattgttaatttaatttctctctctctctctgttttgtttgtttgtttgttttttgagacagggtcttgctctgttgcctagactgagtatagtggcaggatcatggctcgctctagccttgaactcctgatctcaagtgatcctttcacctcagccttctgagtagctaggactataggtgcatgccaccgcatccagccaattttgttattttttatttttatggatggggtttcactgtattgcctaggctagtctccaacttctgggctcaagcaatcctcccacctgggcttcctaaagtgctgagattacagccatgtgccaatgtccagcctaattgctttattatctctttttcctactgtgagttttggtagattgtctttcaaagaattggtttatattagctaaattaccaaacttctgggcatagagttgtttatagtgtttttttattcttctgatgtttgtgagatcaattgtgataacccctctttcttcatattagtaaattttgccttttctcttttttccttgaagagtctggctagaattttttttttttttttgagatggagtttcactctcgttgcccaggctggagtgtaatggcgtgacctcgactaactgcaacctccacctcccaggttcaagcaattctcctgcctcagcctctcaagtatctgggattacaggtgcctgccaccatgcccagctaattttgtatttttagtagagatgaggttttgccatgttgactaggctggtctcaaactcctgacttcaggtgatccacgtgcctcagtctcccaaagtgctgggattacagacctggccctggctagagttttatcaattttatttaccttttcaaagaaccagttgttggtttcattgatttttctgtattggatttattctatttggatttaactggcttcttgaatatgtagatttctttcttctgcctaatttggtaagtttttaaatttaaaatttttagacagagtcttgccctgtcgcccagactggagtgtagtggcatgatcttggctcacggcaacctccacctcccaggttcaagcgatttttccgcctcagcctcccgaatagctgggattacaggtgcccactaccgtgcccggctaatttttatatttttagtagagatggggtttcactatgttggccaggctggtctcaaactcctggccccaagtgatctgcccacctcagcctcccaaaatgctggaattacaggtgtgagccactgtgcctgcccctaatttggcaagtttttagccactatttcttttcttttcgttttttttttgtgtgtgtgacagggtcttgctctgatacttaggctgaagtacaatggcatcatcatagcttaccgcagcctcaaactcctaggcttgaataatcctcctgcctcagccactgagtcgttgggattacaggcatgagccatcttgcctggctccattattttttcaaatactttttcagtccttctctgtttctcttttctttctagtattctgatgacacaaaagttagctcttttggtatagttacacaggtccctgatgttttgttcattttttttcaaggctattttctctcttgctaaaattggtagtttcagtattctgttcacagacttttccctgcttcctctgtgctgccattgagcccattcactgagtttttgttattttttgttctaaaatttccatttggttctttatatcttctgtttctttgctgagactttctagttttttttttcctactttttcatttgtttcaagcatgttcttaattgctattgaagcatttttatgttggctactttcaggtatttatcagaaaattgtaacacgtctatcatgtcagtattggcatctgttgtttgtcctttttcattttgtttggcattttcctggttcttggtgtggtgagtggtttttgattgaaacttggacattttgggcattaagttttaagtctctggatcttatttaagccctctgttttagctggcttcctctgagacctctctggtaggggaaagaagaggtgccatttcattactgccagatgagtatagaagtccagattccctatgcagcttccattggctaagtggcaggggagaaagctccccttgccttaattaatactggccaggagtggctccccactaggcctccaatgataaattcttagctgggaggaggagagatgccttgttacttctccccacatatcttccactgatatcacagaaaggagggtggcctcattagcactgggtagagtgaaagtgactctcaactaggccttctctaataccactgcattgggggtgggagagggttatcttattacagacaggtgggtggtaaaagtccaggatccccatgtggtgtcagtagttaccacatgggactcgtttggttactgcctagcagggatgaaaacctcaggcctctgcttggccttctttgaaacgggcaggggggttagagcacctcggtttggtttggcaaacgtggaaatctactttttgtttctatggatttgcctattctggacatttcatataaatggagccgtatagtgtgtggccttttaaaactggattctttaacatagcataatgtttttaaggttgatccatgttgtagcatttgtcattacttaatttctttttattacaaaataatatttgattgtatggataggccacattttatttatcctttcatcagttggtggacatttgggttttttatgtcgttcggctattatgagtaatgctgctatgaacattagtattcaggtttttgtgtggacatgtgttcagttctcttggtatatacctagaagtggaatttctgggtcttatggtacctctgtatttaactttttgagaacttacttattattaagttttaaaaatcttattgtattgtattgtggtatcagggaaggtacctgagatattttgtgtagtgtctgttgggtccccagacttaagatttacttttactcttattctttgcttatttctatatgattttcattaaaaggatggtgctggtaattaagttactcaagagttccataagtttgatgagtattaaaatgttttaagccattatttatttttaaacattgtgagtatgtaattattcatagtcatgacatttatattcataaatatacctgtgattttatttatttagaaaaaaaaaagtgaatgcctgcagttaaaaattttggtgcttcagaatgaactggaacggcagaagaaagctttgggacgggaggtggcattactgcataagcaacaaattgcattacaagacaaaggtgagtggaaataccatacaaacagcctaacctccacattcagtagttctcctttcttcttcttcacaagctcaaatagtcattttttgtgtaaatacagtcacacatcacttaatgacagggatatattctggaaatgcatcctttggtgatttccttgctgagctgccatcatagagtatgtttacacaagctcagatggtataaactactactacacacctaggctatatggctgtaaacttgtacagcatgttaccatactgaatactgtaggcaactataacacaatggtgagtatttatgtatctaaatatatctaagcatagaataaaaatactatgctataatctgtgggaccgccatcttgtatgtggtttgttgttgattaaaacatcatcatgcagtacatgattgtatggtgatagaattttctcaaatttttaaaatatttttgcaagtattttgaagttagtccatagagacaagtgtacagatctgtattcaaatcgtcccggacttacaatggtttgatttaatgatgatttaacgtacgatttttcagttttacaatgtgcaaaagttatatacatgtggtagaaaccatactatgaattttgaattttgatctttttccaggctagcagtatgtggtatgatattttcttgctatgctaggcagtgacagtgagctgcagctctcagtcagccacatgatcatgagggtgaacaaccggtactctataatgtactctgttgctagtgttttttggatattgtgttttatgttttcacatcccatcaagtctacaaagtgctcatctgtgtacggtattcaatgctgtgttataaaataagttttgtgttagatgattttgcccaactgtaagctaataaaagtgttctgacaccttaaaagtaggctaggctaaggtttcatgatcagtaggttaggtgtattaaatacattttcaatttatgatactttcaacttacaatgggtttatcaggatgtatccccatggtaagttatggagaagttgtgtccacagagcttgaattttcacaaagcaaacatacccatgtgagcagaatctcaatcaagaaacaggaccccaaagcctcctcacgcttccttccatttaccacatctccagccagactagccactgccaagactcaaaccggattggttttgcctaattttgaactttatagaaatagaatcatatatgtacatgtggtggctcttttcaacattatgtttgtagagtcattcttaccttcatgtggttgcagtttgttcgtgtttaatgccaaatagtattccattatataagtgtgaatttatttatctactcttgctgttggtttcagtaattttcattttgggaacattagagttaatgtttccatgaaccttctaggtttctgagtgaagaactttcatacgtttcttaataaagatttttaggtatttcagttgagtagaaactgaggagtagaattacagtcaagagaatgtacgtatcttcagctctagtagattgtgcccaatggttttccaatatgattgtgccagtttatctcccctctgtccagtgttgctccttcctacatccttgtcaggaatttcttttctttttttttttttttgtatattttgtatttatcgcatttggtaatttgtatttttcgttttagcctttctgttggatatgttgtaatatcctcttgcagttttaatttttattttcctgaagactaatgaagttagtctttcatatgttataaattttataaacatttcatatgcttcttgctgactgagatacactcttttgtgatatacctgtttgaatcttttgcccattaataaaaaaagtttggtttgactgtctttttgtttgtaagatttctttatatattatggatatgggttctttttttggcatatgcttaaaaatatattctcccattctgtggcttgctcgttcactctttaatgatacctttaaatgaacagaagttccattttatcagtctttcatagatgaggctttttgtgactacttggagaaatatttatctattttaagattttatagttgtttttctatgtgttctttaaaatactttactattttacttcttacatttatatctataattcatctggaattactttttgtatgtgatgtaaggtaggagtcgagattattttttttcgtattgatagtcagttgacccagcaccattcactgaagatcatcctttcaccattgcgttgcagttttgcttttctcataaatcagatgaccatttgcttgtaagtctgttaagaaccctctgttctgttctattgatctatttttctggtcctttgccattatcttgctgttttaatttttttcatgttataataggtgttgatatccattaaagttcttcagcttaattgtttttcttcaagattacctcagttatttttgccctatgtcattttcatgtgaatttctacatagaaaagaaaaccttgctaggatattttttcttaattgtcatacctcattgctgggatttgctaggattttgatggaactgcattgaatatatttatcaaatgtaattggggataatagacatctttacaatattgaggcttccttcccaagaaaatgatatatgcctttgtttattagatcttctttacaaaacgttatcgaaataagatagtgtatgggtctttcccatgattcattgaatttatttctattttttgttgttttatgatactattgtacatatctttaaatcttatttttactagtttctggtatatagatgtacaattaattagttttttttaagtggtattagtatttattatgtttaaagaaaaattcaccggaagccttatagacagattagtaattgttaatgttacagttacagccctgcagctgcagtcttgctgtggttatttatttacattctaatttagttgcattataattaaatttcattacactaaaattagtaatgattttaattatttgttacaaatataaaaaattgcagaaaattaaaaaatcagattattgagatataattcccataccatataattttgccattgaaagtgtataattcagtttttcttagtttattcacagagttgtgcagtgatcaccacaatctgattgtcctacctaaaagaaaactcatgtgcattagcagttattccacacttcccctcccccagttctaagtaaccacccccctaccttctgtctctagatttgccttttctggacattcttttataaacagaatcatgcaatattgtggtcttttatgaccaacttcatttgtttagcgtaatatttgtaaggttcatccacactgtatcatgcatcactaattcatttttactcctgaataatacattcagttatatggatatgtcacattttaaaaatccactcatcagttgttggacatttgggttgtttccgctttctgtctatcacagataaagctgcttatgagcattcatatacaactttttgtagggatgtttgatttcattcctgttacgtacacctggaagtggaattgctgggtcatatgagaactctatttttaactttttgaatgactgccaaccattttccacaacagctgttttacattcctaccaacaatatatgagggttccaatctccccattttctcaccaatatctgttattatctctccttttaattatagccatcctactgaatatagcattgtttctcattgtagttttgattcaaatttacctaatgacttacatgcttcttacaccagattttcgtatgttaattttatatccaaggaacttattaactagttctaataattgttagattgttttgaattttctgtttttacagtcatctcacctgcaaatgatggcatttttatttctcatttcctaatacgtatgcctttaaaacttttttcttacctgattgtgttgtctgagacatccagtacaatattaaatagaagtagtatcagtggatatccttttctcatttccagtctcagtgaaagcctttaatatttcatagagggtttaataaaacatagaaggtttactataagcatttttgtagttcttattttgtggtttaccgttttgcatcctttacccattttgtcatttttgcattaactgttttttttttttgagatggagtttcgctcttgtctcccagactggagtaaaatggcgtggtctcggctcactgcacccctctgcctgctaggttcaagcgattatcctgcctcagcctcccaagtagctgggattacaggcacctgccaccatgcctggctaatttttgtaattttagtggagatggggttttgccatgttggccaggctggtctcaaactcctgacctcaggtgatctgcccgccttggcctcccaaagtgctgcgattacaggcatgagccaccagcccggccgcattaactgttcttttaatgaattgataagagctcaatatgtgaattttcatttctttgttttttttattttcttaaaaatcagttttaatgaggtatattttacaatcaaattaatcaatttaaaatacacagtttgatgagtttagctaatgtattcaggcaggtagctaccaccacaatcagtgataacatttctatcattgtaaacagctttttggccttgttgtagtcagttctttcctccatcgtttgaccactagcaattactgatgtgctttctgataccattttccttttctagcatttcatatgaatggaatcatacaatatgcactttttatatctggctctttttcacttagcatagtagctttgggatttatgtggttgtatgtgtcaggaattcatcttttcattgctgagtagtattcactgtatgtacatacaacttgtttatacatttacctgttaatggccattgggtttgtttccagttttgaattattgtggataaagctgcatagatattcaagtataagcccttgtgtgggtatattctcttggttaaatattaataactaggtgtgggattgctggggtatagtaaatgtgtgtttaactttttaaaaactactaagctgttatgcattttcaactagcaatgtatgagagtttcacttagtccacatctaaacattaattttagattttagccatgttagtgggtatgtagtggtttctcattgttttaatttgtatttccctgataactattgtggctgagcatcttttcttgtgcttatctgttacctgtttctttcctctgatgaaatgtctgtttagatctttcatctgttttttggaaagtggggaagggggatggatggtaacgttattattaagttgtaagagttctttttatattctggatatgttctttatcaaatatacgctttatatgttttttcttccctatcttaacagtgtattttgagtttattcatcattttttttaaactttattcttttccttttttttgagatggggtctcactcttttgcccaggttggagtgcactggtgtcatctcagcccactgcagctttctgggttcaagagactctcctgcctcagcctcctcagtagctaggattacaggcgtgtaccaccacgcctgggtaatttttgaatttttagcagagacgtggtttcaccatgttgtccagcccggtcttgaactcctgaccccaagtgatccgcctacctcccaaagtgctaggattacaggtgtgagctaccatgcccggccacttctggaactttctttgtgtttgttcaccctctgcattgtggcctggaaacactccccatgtagtgatttggagccgttatagggctcacgtttcttgttttccttctctcaggaatcattatactaggctgcctcttatctattgtctgaaaactgttgttacatataattttgtatgactttctagttgtttacagtgggaggaaaatctgatgtatgttattccatcagtcagaaatagaagtcttttttacctctatacttgcttttatgagaacacactttactcatctctccttggtttagttcttttggttcttcaaagacatgctcaaatactacctctccttgaggcttttttctccctcaaatgaaagtttcctgctccttcttctgtgtccccatagtgttttgatgtcgtcttatcttcgcacttatttggtaagccctttcagggcagggactttgcacttttatggtatccttctcagtgcccaacactgaggccctcagtgagtattacacagcatgaatctttgaggggctttcatataggtaatgtaccattaaatgtagtacatgaattatttaaccttattttatttgttgcatccttttgtggtttcctgtttagtttttggtgtatttcacatagttgacattggtggataaatgagatataataggaaacagaaaacctactgtggcaagagtgtatttggaatgtgaataaagtaagtcatttttagcaggttttaaagttttgacctatatgaagtatagtttacattacaaagaataattttataaatgtgatttttcttcatttcagtaattttagaaaataagtttctaaaggaacaggctttgattcagaatgccttgtttcacaagcctacttcattgtttaccagctgtgtaaccttgtccaataacttagtgttatctctacaatggggttaatagtaatacttaaaactgtgtctcactgagttttaacaggcttccaagttctgctgatgtttctggtctgtgaaccacattttgtgtagcaagaatatgtataatatgatgatcagatgagttatgaagatgaaatggtctcataaaaataggagcaaaacaccatctgttttattcctatgtcatactctcgtgggtttctgtacctttaagataaaagtctcagcccaagatgacttacaaaggcctccaatggctcacctcaatctgaatgcttcaaccacacagaactcttttagttacttaagtatgctttgttctatcttacctgcatacaggcctttgcctaaatgttgttttcaccaggaaaccatcactggctcccttctctttctcctcccacccctaggttaaatgtactactgtgtgtttccatagcaccctatatttttccatgatagcactttgattattagtctatctccttctctagacagattctgagggcaggcactgttcaaggactacattaaatactcatatcttttaggcatggtatagtacctgggatatagtacacatagaataaatatttgttgaatgaaagcatcgtacttatgcttattggtgtcatgtcatgggtatcattgctaaagaaagacttctctaacttctagtttatcattcatatgggaagactgatactcttatgagaaagactgcagaaaaagtgtatgttgtttggcagtgataagtatctgcattccaatacaacttgcatatttataaatgagagtcaaaaggaataatgccatttaaaatcatgaagcattatgataaagtccatttgtctttgttagaatggccccaaataaatagacagttgttttgtacatacaaggcctgcttcaaaagatttcatcttctgtgaaaagacacatttcttacagtgctttggaagtaccatcaacttttactgtacttacattgcctgctatctgtggcatatatttctgcatatcttaccttttttaagatcattaactttcaaaatgaaaacactataaggttgtaaagggtttagggacttttgaccttttctagtaagagtaataatagtagcaataatgtatccagtacagtgcttattactataaatatgtaatattgtttaatcactacaataactttatgaggtagatgctattattatttaccttttatagctgaggaaactatgtcagggtcagagagattaagtaacttacttaaattcatgtagctaatgagaggtgatgttgagattaaaatctactgattccaaaactgtcaatcactgaataatactacatttttataactagcatgatatataaaaccaaggggtatatattattctagaatatggtaaaaagatagggagatatagttctttaactgtttctggttgtatatttgcctattaggatagaaagaggtcccaggatgtctatccttagattataagcaaatgaacatctaaacagtgatatctataccatttacaagactgaggtttaataataattgctcatatttagagaatatgagcttgtatttatattttatagaacacaagccggtattaattgctcttatatatagaatattagtgccaggaaatgtcatgttttctattctttatctaattttgtcctaatagtcctatacattaaagatactattattatccttctaataataaagatactacatattagtacccagtttgcagatgaggatgatttgtccaaaatcacataacaagttatgtgcccaaagccacatgcatagcaagttatggcagagcctgtgttcagagttactgctgcctaactgtgctgcgaagggagattatagaattttatagatatctcttctagtattttaattctgacagccaagtcagttgcacattcttgaatctctattttatcatggagagaaagaatggtaatcttcaagttaaatatgtatttgtcatggagggtcacaattgttgatttttaacactgagtttgtacttgaagtgccattttctcacttttatatatgtttttgagatgagaattactttgtattcccctggactattagaatccttagaaggttaggatctaatgttgatactttggttcctaacataagtaggagaaagagtgctgctgttggcttcactcttattcccattgcgaatgtttgtgggctgtggtgatcggcactggggagtgggaaagagggggatggctggatacagataaccacatttatttactagcataacctggtctactttttgggcacctgtgttcttcatagtggctgtgctaggtaaccagatacgtacttgttcttcaatattctattctaaacatatactattatatgcttgtgttgaacattattcttgtacatttacatgaaggtactatttaatgaatcttgagccaagttaaaatattttgaaagcaccatagtcactggtatttgctcaacgaaggtgaaaaaggtatttttctcttgcatttgcagctttgatttagtttgtttgctagggagtagtgaaatgatttgctgatatgaatattactagtgcgttcttacatattgtgactggcacttggtgcttatctaggtacttggttctgagtccaggagctcagttaggatataaagtcagtactatatcatatttaattgtgactttgctgctgattattctgaatgaccacaaaggaattatttactgtctgcatctttttacacatctgttcagtaaggatagctgctaataatactgacataggaattaatttgtgtaaacatttggaagaaaccaggtgcttatatttttgttcatgaaaatccattgcagcaggatgatttattggaaagtgccaaaaagacaatttttatccacgctgctgacttgctgagtggtcacataactccaaagggcctcattacttcacactcatacgttttcccttcctatccctcaaaggcagtggttctcaacttgtggtctatggcaacttccagctgggtcatgagctgatcttttcagtattaatgtttattagtgtatatattttcatttctggaaggtattagtagtttaacttaggatgtttaataaaaaccagatttcccctcagtaactcaagccaagtaatcttcccattaatgaattctgtgttgctttaccgggtcttttgtcctgacacaacccccaaatctttgaaaagcaacactctatcaaaattagtttgctggaaacttagctcaaaaaatggtatgaaatgttggttttatggaagtgtgttcagtagaatgtaggtttcttattgtattagtccatttttgcatcactataatgaaatacctgatgctgggtaatttatatagaaaagaagtttaattggcttacggttctgcaggctgtacaggaagcatgatgccaacatctgctccaggtgagagcctcaggaagctttcggtcatggtggaaggtgaagccagtacaggcgtatcacatggtgaaagtggaagtgaggggggtggggagaattgccatactcttttagacagccaggtctcctgtgaactaccaaagcaagaactcactatcaccaaggggatggcattaagccatttgtgagggatccatccccatgttccagtacttcccattattcctcccctccaacattgaggatcacatttcacacaagatttggaggagcacacgtccataccatatcacttataaacaaatgttgataaaaacccaagaatacttcagtggtgcctgggaagtggtattaactttataaaaggagagttctccaaactttgtgggaagaagctactttttaatacaattactttcttgataataaggataaccatacagttaaaaagtgcttatacagaagttcttatgtttgatccttaaagcatctctgaaagctaagtagggcagatgttaccctcattgtatatgtgaggtactgggaagttaaatgacttggccaggaacacacagacaattagcagcaaagttgagatgtggacccaaattcagcacagatttcaactctaaattctgtgcttttctcagtattccatactacctaaaactttgcaaaacattcgtttgaatcccacataaatcacatgaagtagataacttttattgaaatcctgtaacatgccagatattttagttttggtatattattaattcttaaaatagtcttaagatatcttttttaccttcttttcccaaatgaggaaaattagggctcagagacacttccctgaggtcccaattaagtgacagatccaaattcaaacattggtttctcttactccaaagcctgtcttgtttccactaaacgaaacgtcattactgctttctctagtatgtgtccgggtcaactcacagtttgctgtttttctatttggcctgtgaggtgttagctagagaactttgttttgctttgttcctttttattatagtatggctgaagtgaattttctccaaagattgctttgatttgggtctgccattttccaactttgtccttagacaggtctttcaactttttgagcttatttcctctgcataaacaaaacaaaacaaaaaattctgaattatacagtcaagatttctttcagctctattaagattttggttatctcagaaaggtaggactggtggaaatgatggtgatctgttcaccttttttaatgcctctctttattattgttattattataagtttaatgctgatgatatattttccagcattttataaaagttttttttttttttaatctttgacccaagtgtgtctatgattgttgcctgtttaatactgaaaagccatttggtgggaatgacctattagaattctgtaactagccatacttttctcctattttactttggcaattaagagcaaaaacaaacacattattttggtggcagtgaataggagaggtcagatatgtcagatttcattgctcagatttggggaaataaattacccttggtaatttcagtgaataaaaagttgttgccaaaataaatattttatgtgaagttcccatcaactgtaatagtttcttattgtcattttgaaaaaaaaaaaaaaagagtaattaaggtgacctacatatgtagtttgttctatttaattagcttctgcttggttagtaaattactgtgtccttttggtctgcatctcagataaaagaagaatcacacagtatatttaaattgatactttaatttctatcaaaagctcataggtttctatttgaagttgtaaatacattattaagtcttgcataacaattttttccttttcttaggtcatacagttacttatgaaaagttacttctcagtttttaaactcaaaatatatttatttgaaatgatggcaaaatttaaattttattagtttatatgtgttctgattttttaaataaccatctgacagaaattcttaaataggcatcttcaaaattattaatatctaactttcaaaaaaaagtctggacctgaggacagattctccctaggatttatgctattagcaataaaagccagacaacttgtggcaggggtattttgggggaagaggtaggtaaatatgagtcctgagcaaacttctgattttatttcagtttccatgtaagtatagtaatttattccagtaatgtcttatttgtttgtaggaatggcaaactgtcatattttaatctctgtttcccatgggaggtatagatgtgtagaaatatgccacctgacacaattgtatattggtttgtcataattttttctccacttactctcaaaatgcactggaagtaacatttacaaaaaaaaaaatacatttacatttaggtggttgaagatagaagtaaaaagagagcatatgacttgtaaaggaagtagaaggagcattgatttttatttttctgcatatatgcctttgtcaattcatttattcataatttgtggaacactttcaaagaaccagacattgcgattagagtcaacatggcaggtgtgataaatatgtaaccgaagtatatagaggatactgtaggaacacagaatataaacatgataatcagaacaacaggtacaggaggtgacacactgagcctagaagaatatatagtattgttctaactagggggagaaggtgagaccttccaggtaaagggagcagtttatacagaggcatggaggtagcttagggaattgtgagcaattccagtaaagcttactgggggcaggcacaataatgcaaatgttaagaatgaaattctccccattttacagatgaggaacatgaagttcagagaagttgaaacttgtctagagtcttgaaagtagcataggtaggatttcaacctagatctttctgattcataagtccatgggctttctaaatacagttcactgccttccatagaatctgcttattgttcttaagaactaatattagctctgacctcagctgtcaagccaattgtgtagaggtatgacagatatcgtttgttttacattgcctgttaataaggaagcctatcagttctttaaggggagaaataaaaatactctcttagcactaaatgcagagaataatttagtttcatatgtgcaatatattaaatatcataatgaaataaagtcagttgtaattttgcaaaagttacagcaagaaatatctgttaacccttgagaaaggcagcatcataaatcatagtatagaaaaggcatttctgcagggaaggaagctaaagtactccaagtatattgctttttggtcatctgacttaatgtggaaaacccagaagaatgacaatttattggttttaactgtaattttgacaggagctggccattggccagtctcagaccaaactctggtgagagagaaccaagagtctgtgttttgttttgttgctggaagcaagattcatagtctttagctattatatttataggagccaacattgacattttgctgttaaaattatattgcctgacttgtgttcttgctgaacagagaggctatctgatttaacagagtagaacattgatatatgcctggacagggtcaaagcagttttggaagatggtaaaccaagctccggcatttttgttccctctctcccaatgacctattgatgtgataataaatatacatgtataaagaatgaaaccatggtaatggtagaaacaaaagaggatgtcattgggatagcaaaggttttggcacagttctccaagatacaaagtagataggactgttttgatgaataaactaaagtagagaaaaactgcagcctagaacacaaatagaaacggctgcaggtagggttcctgatagaaccatcagaggcttcaagcttggaatttgccagtattgagatcaagaattaagtagagcaataatcagggtaattgagcctgttggcccattctccttcttgtgtgcatttggagcagctttctataacatttgctgtagctgctttctaaacataatggattcctgacctgcttaggtcccacggtataagtgtttgacatggtagaaagttgcagtagaacttaaagtgactggacttttatcgccaacccagaggaaaacatgaaagacaactctactcaagagtgaaatacctaccccaaataaaatcccagtgtgaagctcccttgacagttgcagtaatttgaagtaaaagtataccttctcccagcatatatacccagaaggaaagcctagttgtcaacaggaccagctcacttatactaatggcactaaggggtgaggctttttatggaaataaatctcatagctccagaggaaacctatgccagttgtctatactaatcagtctaatcacttattcatgggtttgaaaggagcactaaggatcatcagatatttgaggaaaacagcatgaatgagacctagttgaataaacagaatagctgacccaaaataaacagacaatacaaagaatggagaacttttaaaaaatcaaattaatatcctcagattttccttccagcctctgcctaagatgtaggtgaaaggagtttcacttctaccctgagaataaagaaaaaaaaacactggataatatacaaagtcataacttttcttaaatccatcagaaaactaggatctcaaggcaacgaagtagcttgagtgtaaggaaagacagacaacctccaaggagaggtaggatgtgagcactgattactaatggtagagcatgggaagaagttgggggctgctgtgtaataaggtgaaataattgagctaaagcttttaacaaatcgttaatgaccaagtgtagactagtatgtgactacggcagatataaggcagtttttactagcttgcagtttcttctgcatagacctcttttggatattcacaagaaagattgaggacaggttaggaaatctttgttcttctgcaggtaatgtgtcttttttctatggctgccttggacattttctcttcatttcttgtcttcagcagtttgaatatgatggtctggggtgtggtggagcaagaaggagggaggaagggaatatgtgtgttttcaggtggatcacctgaggtcaggagttcaagaccagcctggccaacatggtgaaaccccatttctactaaaaatacaaaaattagccagacatggtggcgggtgcctgtaatcccagctactggggaggctgaggcaggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggtgtgagccaccgtgcccagccatatttttagtttttttatgctctacatgaagtggtataatattacaagctgaatatttctaatcagaaaaatctgaaagccaaaatattccaaaatttaaaacgttttgggtgccaacatgatgctcaaaggaaatgctctttggagcatttcagatttcagattttagggtttaggttgttgaaccagtatgtataatgcaaatattccaaaatctgaaaaaaaattaaatctaaaacacttcccatcccaagcatttcggataaggtatgctcaacttgtttttgaaggtagactatgcttaattaaagatacattttgtgaactcctgggcaaccaataaacatttttaaagagcttaaaaaataagccaatagtgaagaaaaatgaaatactgaaaaatactcaatccaatagcatttaaaaagagagagaaaggaacaaagaagaaatggaacatactgaaaacagctagcaaaatggtagattttaatcataacaatgtttatattaggtgtaagtagtctgaatattctagttacaaaagggattgtccagatttgatttacaacaaaacaaaaaacaagacccaaataaatactatctacaagaaatccactttgaatataaaggtagatatattcccaggtgtggtggctcacatgtgtagtcctagcactttgggaggccaaagcaggaggattgcttgaagccaggagttcgagaccagcctgggcaacatggtgagactccatcaacacacacaaaaaaacttaaaaattcaccaggcatgatggagtgcacctgtagtcctagctacttgggaggctgagacaggaggattgcttgagttgaggagttggaggctgcagtaagctgagattacaccattgcacactgcagcatagcctgggcaacagagtgagaccctgtttcttaaaaaaaaaaggaaaaaaagaaaaaagttagatagattaaaagttaaagaatggaaaaagatgtaccatgcaaataacagtcaaaagaaaactgtagtgtctatattaatatctggcaaagtagacttcaaaacaaggattactacctggaataaagagggatattacattttggtgaagaggtcagttcaccaaaagacgtaacaattctaaatatgtgtgaacatagcaatattattttaatacagataaagcaaaaatagatagaactgaaaggagaaataagcaaatgcacaattatagttagaaaccacaacactcatcctcagtgataaagacaagtagagagaaaatcagttaaaagacattactatcaattttcttcacctaattgatagcataccactccactgaacactagcagaatctgcatttctttcaagtatacatggaacattcagttagaccacatttggtaccataagacaaacaaatacaaaataattaaaatcatacaaagtatgttttctcaccaaaacagagtaaactggaagttactaacagaaaaatgtctggaaaattccaaatattccacaattacacaatatatatatcataaaccacgggtcaaagaagaaatcacaagaaaattggaaagtattttgaaatgaatgaaaatgaaaatacatttgaagtttgaggtaaatttatagcatttcatgccaatattagaaaagaaggtctccagtcaataatctaagcttgtaccttaacaaattagaaaagaggagcaaattaactaaacccaagtcaaatcgaaggaaggaaataataaaggccactaatcagtgaaactggaaactgaaagagtagaggatatcaatgaaaccaaaaggtagttccttgaaaagatcactaaaattgataaacctgtagccatattaactaagtaaaaagagagaaaataagaattaccaatatcaggaatgagaggggacatcactacagatcctacagaaattaagattataatgtagtattttaaaaaacatgatggcagcatctcacaaggactttagaggcaggttgaagagagtcccactggttgaatctgggatcacttaagcaccaaataattatgtacagtaatgagttataaatcattgaaaaataaaaaggagttaatgattctttactgataatggatagttaatagagaagatgggggggcttctgcttagagaagaatgctgagtgctgactgatgattatggaggaattactgaagttggaatattatttttcagcatgtttagtaaagattgatttaaacagaaaccattaatcaagctcattctagggagaaatttatatgagaagcaggacgtatgcatgctcttaaacatggacatcattgcttccagatgtgatacccttagaaggacacaacatcagtcatgtagtattcaggttggtaatataaaacctgaacaacccctgtagagcttgagtataccattgcatcagtattattacttattttgaagtgacttttagaatttaggttgagttttctggagtatcttcaaatacttagttcttctctatctgagcctaaataacccaaactgcttcagttttattccagagcccactcctatggaaccaataagctgtattacctttcatagagaaatgaatgtggtatgttacattttgttagctgattgggatattttttttaatttcctttctaccacattgcaaggagttttcttgaggggaggtcatgtaataacacattctagagtcttctgaactgaggaaggggacactcatttgtgttttgaagaccagatctgtctttggtccctatttgtggtcttgttaacattgagttgaggcagcctaaattatctgggatgaagaatgatactgcacgtttctctagtggtagaagaattcatatactttctgatgaagtatgtggggatagagggtgtcaacctaaatgtcttaaaaaatcactaaggtgaagatttgggaaggagttatattgtgggctaaaaagttaagttgtgttccttggttaaattctgttggggtcagagttcccaacttactggtcttcatagtatgttgaaagagaagagaagggtgcttaaatatgttgggaaggccgggcactgtagctcacacctgtagtcctagctctttgggaggccacggcaggcggatggcttgagctcaggagttcaagatcagcctggacaacatggtgaaaccctatctttacaaaaaaatacaaaaattagttgggcattgtgacatgtgtctgttgtcccagatacttaggaggctgaggcaggaggatcacctcagcttggggaagttgaggctacatttagctgtcatcatgccactgtattccagcttgggtgacagaaaccctgtctaaaaaaaaagaaaaaaagaattgaggtatgagggtatcatttaaaatgtgaaatattcctgtaattcacattcatggagttaaattttgtacagccataactcagactatctgtcgtcatgtaaaaatagttgaaaaatcagaatacacatttcctatacactatgattttcacgaaaatactgatttttttttttttttttttttttttttttggagacagagtctcgttctcttgcccaggctggagtgcagtgtcatgatcttggctcactgcaacctccacctcccaggttcaagcgatttccagctaatttttgtatttttagtagagacggggtttcaccatgttagccaggctggtctcgaactcctgacctcaagtgatctgccagccttggcctcccaaagtgctgggattacaggcatgagccaccgcacctggcctaaaataatgatatttatgaggaagatgacggttcataaaaactcctttatttatgaactatattttagtagtcaaaatacaggtacttttttactcttttttaaaatatactttcagtaatgttattccgtagcatttttggttggaaaggaattaatcactcatttttttaaagtgaagtctgaattttgatatcttatcaattgctgaccatctttctcagtcattaattgagaaatatctataggcagagagtcttaggcgtatactcttaggcttctgccagaggctggacttatgtgaaaactggaccaatagggaagtttattctagctactctccccaaaaaatctctgtactcaacccactttccctaactctttttatttccctctcacagtcagggatttggcttggcctctttggttgtgattgagtaatcctatgttacatatggaattatctccttccttttctttctaggaagtgcattttcagctgagcacctcaaacttcaactccagaaggaatccctaaatgagctgaggaaggagtgcactgcaaaaaggtaaatgcacactgagaagaattgctgtgagtgtggagtttactgcgaggatagatttgaaaaagtagcattctttaaagctgctggtattaatttatagcccatatacctcagtaccacattcgtttattcaacacatattcattaattaagcacctactgtgtgtcatgcactgtgccagaggtcagttatgaaagctcctagtatgtagttataatcagaaacatgaaccctattcaagtttctcaggccacagcatcgtggtttaatgtttgaatttcttccttctgtcttctacatgcggtttagcttataggttttttttcaataattttttcagatttacttctgcttcttgttagctcatttggattacttcagcaactagattatctctctaacatcagtctcttcatctttccagattgttctccatgctacgatcagacctctcctcttaaaataccatttttaccttattttttatcttctttttttaatgtggagaaacatttcattcattcattcattcattcattcattcattcatagacagggtctcactctgtcacccaggctggagtgcagtggtgcagtcgtagctcactatggcctcgaacttctggcctcaagtgatgctccacctcaacctcccaaagtgctgggattacaggtgtgagccatcatgcctggcatttttatcttcttaatatggtgattcttttgcttaactttcaaatagcctgtaataaattggcaccttgcaactgtagttaattttagtcgctctcccaacattcgtttaacaaatgccaatagtttttctcttcattttttccaacatatgcttaattcgttggtacctctgttcttttggtcatcttcacttgcttttcctggaaaatccatccatcatgcacttttcttcaaaaaactttagcagttggggattcaaaaatgctagactggccgggcatggtggctcacacctgtaatcccagcactttgggaggccgaggcaggcagagcatgcagtcaggagatcaagaccatcctggctaacacggtgaaaccctgtctctactaaaaatacaaaaaattagccaggtgtggtggcggatgcctatagtcccagctactcgggaggctgaggcaggagaatggcgtgagcccgggcggtggagcttgcagtgagccgagatggcgccactgcactccagtctgggcgacagagcgagacgccatcttaaaaaaaaaaaagtgctagacctatagaaaaccatagagattatctattccaattctctcaatttgcagataggaagtcaatgctctggtaagttactgtttgtccaactcactagcaaagccaggactagatcccgttgtcttcagtgctgttttagataactaaaaaaccagtgattttcgtactgttacacaccactcaatacaacacttttaacattagattctccagcagaccctcactgtatgtcttagaatttctcactctgtcttcctgcaaatagtatcagatcccacagaattaaggactcattcccacaagactgcctcaccacatcaggtgccatttggcaagccccaggttgtgacctgtgcttctgatcgacctgctttaaatagaggttcccataacccactccttggattcgattaatttgctagagcagctcacagaactcagagaaacatttacttaacccttactggtttattataaaggacattacaaaagataccgatgagcaagatggaaggcatgcatagggcaaggtatgggggagggagcatggagcttccatgccccgtctgtgcacatcaatctccagacactgccagtctggaagctcattagatcttgttgtgcaagatctccagccctcttctcagagtttggtgggtggggaagaaagtccaaccttctaatctcttggtttttctagtgaccagttccatcctgaggctgtctaggagcccctgccttaagtcatctcatagcataaactgtggtgtaatcaaaaggggctcataatgaatagcaaaagacactcttatcgctcaggaaattccaaggtttttaggtgctctgtaataagaaccgggggcaaagaccatatatatgtcatgttatactttgatctacagtttctcctaaattccttttgttcttaaattcttgacacagttgatcaggcaacttactttacaggtattttatgtattgatcatgtttcttaagtagtgcaagaaaagagctggtgccaggcaaggtgtctcatgcctgtgatcccagcactttgggaggctgaaacaggcagatagcttgagcctatgagtttgagaccagcctgggcaacatggtgaaacactgtctctacaaaaaatacaaaaattagctcagcatggttgggcatacctgtagtcccagcttctcaggaagctgaggtgagaggatcagctgagcccgggaaggtcgaggctgcaatgagccaagatcgtgccactgtactccagcctgagtgttaaagtgagaccccgtctcaaaaaaaaaaaaaaaaaaaaaaaaaaagagagagagaagggtaatttcatactatagctttttatttgttgtttttactttttttcttacagtccaacatattggtttttgaggtaattataatatgtaattgtgagtgaaatatagaatactttttgaggaaataccatccagatctttcttgaaatcaaattggcctcattaaattgactgtgaaatcttggtcacattactcagactctctaaatattgtttccttgtttataaatagatataacagtatcaacctgctagagttgttagaataaataaggccatttgtagatgcctagtgaatgattatttgtaccctttacatttcttttttttcaaagacaaggtcttgctctggtgcctaggctggagtgcagtggcatgatcagggctcactgcagcttcaacctcccaggccccagcagtccttctacatcagcctcccaagtagctgggaccgcaggcatacgtcaccaagccaggctaatttttttatttttgtagagacggggtctccctatattgcccaggctggtcttgaactcctgggcctcccaaagtgctgggattatgggagtgagccaccactcccagccccctttacatttcttagcatggtactaatcacacacagtagcactcagtatatagttagcttgattgatactatttggagataggtcaagacttacggtaactattatttatgcttctacttctgagtttctgtggcctattacagacagtataatctttctttggattaattgtgtggaaataaatgttacaaagcatgcaagcatatattttttaataaatgtattttttctttcctcattagagaactcttcttgaagactaatgctcagttgacaattcgttgcaggcagttactctctgagctttcctacatttaccctattgatttggtaagtttcaaattttctgaaaatatttttcgttttgaaaagatgatttctgtatgacatttcctctcaatgaaaaaactcattgctttaggcttaatcatatgctctgtcatgattcattcaggagctaatgtctatttaaaacatagatttagacttgtttggccttaggtcctactatttcatttatatcactttggtggtgggatgcactcatcatctgaaagactgccaaattatttttggtttctttaggatctttttacttaaccacattatccattatcaccacttttttttttttgagacggagtttcgctctgtcacccaggctggagtgcagtgatgcgatcttggctcactgcaagctccccttcccgggttcacgccattctcctgcctcagcctcccgagtagctgggactgcaggcgcccgccaccacgatgcctggctaatttttttgtatttttagagagacagggtttcaccacgttagccaggatggtctcgatctcctgacctcgtgatccacccacctcagcctcccaaagtgctcgcatatcaggtgtgagccactgcaccctgcccattatcaccatttctgacatacacatgcaaatatatgtgcactgctttaaaaatatgattgataattttcatgtattagtgttacttaagatattcctggggtaactgtcaggctgttaggtttttgagcctagtttcttagaatgaatgaaaaaaggaaaacttcaataaaattgattaggattatttttcagagaactaaatctgctaaatttgatagttttctttttaatgaaaatttgtttaaaagactaattttcagagaagaaagctaataggatttgagtttgcttatagaatcttattaaaccatttatatatgtgaatgaaataaggatatttttatgatgataattttacatggctttttccttggacatgatgtcttaaatgttattatagaaaatttcaagtatatgtaaatgtagggagagagtagaatgaatcaccatgtactcatcatccagcttcaacaattatgataatacttggagtttagaacagtgttttgagtcagcaccgacctgctgatctgagatttaacttagagtttctttgctttatttattaattttattctttaattaaattcacagaatgaacataaggattactttgtatgcggtgtcaagttgcctaattctgaggacttccaaggtattttattttttattttgaagatttgttatatattaatatatggaaatagaatatcttgaaatgctggttgcctagcactttatccaaaggaatttttggactttctgtcctttcccaattgcaagtatgtatatcagactccttgatgggagatagaatgttaggtctgatcatagaaaaataattactgaaccttatattagaaatttaaaagaaaatagtttttaaatgggctttaagcaaattagacagtcaggttcttaagaatacaaataatcgcccttccttttggtttgatttttatgaaaaatttgtgtatggttgggagcagaggaacagcaaacaaaatctgttctgttattatttagaaagtcatattactgctgacctgaaaagtatttgaaaatttaattttgtgaagtttccattaccacaggcttaatttgttatactatcatttctgttatcttttaactaaaaataaagaaagaaattacattaaaggtattatagaatatgatccttagtaatttctatattttaaaatcttttgtttttcctactctgcaaatattccaaagaatttattttctttggcatatcagtgatcatttttattgttagccaagtgggttcttttcccttagcctaaacaatgctttgaggcctactaaatatctttatagattattcccaagccagcgttttatctacttgagaagttactaaagaagagagcattgctagttttgatcaggactttcattttcttataaagaagctgttgttattggtgatcatttaacatctaagagtgttttgttaccctgttgggcccttacctgtaagtactttggacgtgataaaaggagagtgataaaccaggagttggaaaacctgtgttcaagtcctgattgcccctgtataaaccatgtaatttggaacaagtaatgtaacctttgagttgatttcctaattgattgaatgaactattaatttatgccctacctgtcttatatgattgttgtggaaaataagtgaggtataccagtagctataaatgcataagattttgcctaatctttaatactcacaaaaacaaagggatcctataaggaaaatggtattcagtgacttgcttgaggccacaaaactaggtaataatatagctaggatttgtctggtttccatttcatagtgctccctcagatatctgtaagacattcacaaaaatgtgttttgatattaattttaggcaaagttgtggtatcttgaagcccatggcgcatcattttcctcattgattcatttagtaaacatattgagtacttttgtcccgtaccagtttcctgggatacagaacattattcattgaaaaaaatgttcattgaacacctaaatgccaggcacatgatgcagaaagtaaacatgttctctccttccatggagcttattgggggagacagccaataaacaagaaactaagtaactagcaagtatttaataaaggaatatgctatcccagagaatggaagaaactgctttagataaagcagtcagagaagacctctctaaggagaaatataaaattgagggctaaaaggagccaactatgctacagctgggggaagagcatttctaggagaagggtcaccaagtacaaaggtgatgatgaaggaggaatgggcttggcatctctcaaaaaactcagcgtttggggaatgtgagaaaagacttgtattttgggtaaatcatgtaatctttcagcttaatttcttataagatatctatatctgtaatttcttgtgatgattgaatgaaatcacatttgaaaaagcttttcatataggaggtactcaataaatataattggaatttgttgcaaaagagagaggcaggaaggacagtaaagaccagacgtgtgcagctggagcatagtgagcgagggaagagctacgttagaagaggtaggagagggcagccagggccttgaggtcactataaggagttgatattttattctcgaggaagtaggaaatgcctgagggacttcaagaagcaggatggcatgagctgagttaggcttttaaaagtcactctggctgctaaatacagaatgatttgaagggggcagtcagagaagtaggaatatcaggagtggtggtctgattactctgagatgtgtcttgattctattttgttttctttgaaattccttgtctcctagtttttcatagcttttgtagttatctacacttacaatgcccaacaagctgaatacagtctccctaccctttaataaattagtgtagctttttagtgcagttgttgaaaaacaaaatgtgagataaaatgaaataaatgtttaattttactctaaggtcatattcattcccattccccattacccttaggaatcagaaattttaagaagcacatgcagtaatattggactttaaaaatcttacattggccgggtgcggtggctcacgcctgtaattccagcactttgggaggctgaagtgtgcagatcatttgaggtcaagagtttgagaccagcctgaccgatatggtgaaacactgtttctactaaaaatacaaaaaattagctgggtgtggtggcacacacctgtaatctcagctacttgggaggctgaggcacgagaatcacttgaacccagaggcaaaggttgcagtgggctgagattgcaccactgcactccagcctgagtgacagagtgagactctgtctaaaaacaaaaacaaacaaataaaatcttatgttaatatcctgcaggcacttgcatttactaaatgtattgagtgttctgtgtatgtcatccatggtgccaggtgttgagggtgtaagagatggttaagacattgatcctgcctcagtgagattatagtccagttgaggatatcagatttgtaatcaagacagtcagtaagtatttattgaattcatactctgtgtcaggcacttagaagtttatagcaggtacatggtactcaaaaaagtgagaataatcacttctatcaggagcgatcaggaaaacttttatagagaagatgatttcagtgtcttaagaaataaaatgatgttttccagtagaaaaaagagtaagaagacattttaggctgggtgagtagaaatatagtaacataggctgggcatggtggctcatgcctgtaatcctagcactttgggggactgaggtgggaggattgcttgtgaccaggagtttgaggctgtagtgagctatgattttgccactgtactccagtctaggtgacagagtgagaacccatttcaaaatagaaaataagaaagggaaataaatatgataacatggaacatcatgatgttctcacatttaccctaattctcacaactgtgagaattaattccatctgtaaggaaaggaattaccctcaatttaaaaaaggaaaaaaaaaaagaaaaagaaaattgaagctcagagagattagttaattttttcaaggagtcatattaaacagtgataaacctaaggttattcctggtctgcctgattctaagattcgtataattcttgccacaattcagttttcttcctcgctttgaataataacctctttaaacctgtgacaactttttagtattctatagcagctgctttctgggagagactctagtgaaggaactccaagctggttattctgtgatattcatgagactttgctgggatagactttatgctgcatggggtgatactgtttgagaaactccaccgtagtgctccaacattagtgtgcttttctaagtgggtaagttactgttgcagtatgccaaggagacctggacacagtgggagaaaaatgtccagtgaagggtgttcatctgagttccactgaccgagacatttagcttaaaaaaaaaatgtttgtgtgtgtgtgtgtgtgtgtgtgtgtgtgtgtgtgtgtgtgtgtgtgtttaagtaatccataacacgagagccttttgtggtaatgagacccagatttccttctgtgtctgtatccctttatgcaggcatgatttcttggaaaggagagtccatatgtcaaacaatgtctcattgagaacatggaatgattccatagatgctgtggcagtgattagagtcttaaatattttgtcctgtctggatcagtgggtgcttggttccttaacaaatcagctgcctcagtgattgggaaggcaggatggtaagagcttttagatcacttattgtacttggatgcgtttgaatattaatagtttgtccaacatataaatcaaaggaacatttgaatgcatttataatgttatggccattgcgtgtttgtggaatttgttgtcataaaaattatacaaaagctacagccttgagtggttacctacattttaaaaataaaccaggaatatttattatgaggaaactgggttttaattttattttcaagccccttaaaagtttgttggaattagcatctttttcacatacctgagtcttaaggttcattcgtgtttctccctggaccgtccactcctgctccaacttctcactaacaaaactattgtctgtgacctttctaacccccagaacagcataaggtacacaaacttctgctctgccttaggtgttagggacgtcattaatgcttactggaaaagcacaccccagagagctgggttttggctgtggcaggtaaaaaaatctttcagatcttgcaatgctggaaaccttaaaccttttggttttttagctaaagtgattggcaacagaatgtgacatctgaggttgcatggcctgcaatagccataattaaccacatgagctcacattttcccactggagattcagtggtcttggggtgatgaaagtgacttccctaccaggaggtggttttccttttgagggtattgaaatacccttgggccctgtaatgcttcacccatggtccttttaaaatgctttttaatataaaggttcaatattggaaatctaacaccacagtgtttaacactgagtctgtgatggagcactatggcctggaatgggaaacctagaatttttaataggtggagtgggaagacttgtggcaagaatggtgagtgtgaataacctgaatcaaagctgatttccaatattattcaattttcagtgtgtgctatttctttttgttttatttctgtgtgtagacttctcttagagatgcctttttatctttaaacaaagttgttttgttcattggtgggaagtgatgttagaaaatcaacttttggttattttaatagagatgtggatgtagtctcaaaatatacaaatataattctttagcagtcctcctttcataatatggggaaaatgtagatgcttgaatgtttagcattagatagatagttttgaaacattcattgtttgcatttgacttgcttgaaaggctaatttaagaggcctgctcctttctggaagttttcaaatcctcttctgtcaggtcatataggaaaggaaaagctttgtataaagcacatagagggaagttgcaacttagcatagtattatctgtctttaagtcctcatcttcttcctcttcccctctctcttcaaaaggtggttattgaagatcaagtccttttactgacaggaatattttaaatttgataagacctaatctttacggaaagcacgaggcagaattcagtcacctgtgaagaaactcacagttacagctgtgactccacacctgtataggtattctggaggattgtggacacaattctttcagttacttcatcactcatagtttctacctatgtggctttgaccaagccatttataccacctgggtctcatttctctcttctccaagttggtagcatcagagtcagtgattgtgaaagtttctcttagttctattattgtatgataatgaatttataatgtaacaaatttataatgtaaagtacttttagtccctaaggtagtctgatgtacgggtttcagcagaaggaaagtgttgtagtagtattcaaggtacttgggtgggactggggcaagaggacacggtctctaaaaataattaggattctagttagttagagcatgactcagtagttggttgaaaattactgctgtttgatttttttccatgggtttgttttagagaacagacattccttgagaagcccattttctgttgagtactatgcaagtcatcgaggactctcagactttttatgtgctctttgctcttactagaaaactgtgaagaaactaaggtggtacacgtgtgtcatatgcttggtacattcgaggctcccaagttaaaaaattgttatatgctgggcacagtggcacaaacctgtagtcccagttacttgggaggctgaggcatgaggattgctcgagcccaggagtttgaggtcggcctgggcaacatagtgagacctcatctttttttaaaaaataattgttatattaatgtttaacaataaatttatgagacagtacagtagactggttaatcgtggaagattgggtgtcaagccaacctgtttactagctgtattactttggaaggattccttaatctctgagccttagtttgtttatctgtaaaaggaatgcaatagcatttaaaaggtgtttaacattgttagtgaatgaatgaatgtcatatataaagtactatagacagttctggacagaaaaaagtatatatataaaaaaatatataaatagttacctatttttataagactaccaaagaaaaacaaatagtctgctatggtagttaagggtagagaattcactgaggaatggatctctgtagtggcacttctaccataagaaggtagtgcttacgtaattaagtggaaacagaaagaagaatgcgaaaatttttattggtaattgaggttaaagccacccttagaagtcagggaatagtcaaggcatggtcattgtgatcatttcagcccttcttctctagccagatgggatattccagattatgtgttaaatgttttagtgtatgagtgcacacacgtgcacttgtgcacttttaaaagcatttaggaatactgtataccaagaagatcctgtttccttcctcttgggggaagtttaaaactttctgttgtattactcccttagcccctgaatcatcatttatcacttgatagatagtggcagaaatctggataagtttagaaaatgtaattgtctgtggctttttgaaagctagatgcttatgtctgattataagatacctgcattttttcctagtagttgcttccacctatattacataaatagggtggtatatgaacagtgtggtttttcaccttttgcttttgctgtttaaagcattttcccccttaacccatatttaacttcatagacttattatgtaaccctgtctttttcaatatcaagaacataccccataagaatgattatactatttcatttccctttagaattaataatgttgtaaaatagtacaactatattgtctaggaaattcttaatgaataaaatgtataaccactgtatagtgtgttaagtttaaacctctgaagctaattttcatatcatgtaatagactcaagtattaattcatcctgtaaaaatgctgggaaagaaagcaatggttatttggacatagtaagagttcttgctttaaggtatatatcaaatgttaatctcatcacattaattattgggaaatagtttaaaatacagttagtagatgaagtttcaagtcttgttaatgtgtttacatttgcataaaatttatataatttagataagtggttaatattttatgtaccacatatttttataaaatattctttgaaaattatttattatcttatggttatttataaggtaaatagttattttcttttcctctgcttttgaatttacagcaaaagatgatggaagcattgctgttgcccttggttatactgcacatctggtctccatgatttcctttttcctacaagtgcccctcagatatcctataattcataaggggtctagatcaacaatcaaagacaatatcaatgacaaactgacggaaaaggagagagagtaagtgtcttttttttaaaaaaatgattttaacatcaagccagtataaaacatggggtataacaaaatacataaaatgtaatctaaattatgacaacttttatataacctttgtagagtgcctcattcatttaaatcaaatgtagttattatgtgaaactagttattcatataaattttaatgactcaacccctgggcttccaagaattgctaatggtggcaaaaatttacttaagtttcatttactttcttcttacttttgtgaggataagtgtcatatgatctacaaatattcacctagtacctcttgcctgccactcaacaagtaaaatgttaaaagatttgtcagagatctaactaggaaaagatataatggcagattgaacatagctgaaaagtagattagtgaattggaagataggtcagcagaaaatacaagtgtctaatatacatataatttcaggcacagagaggctggaaagattgtgaggtaaacacaaaattttaagagataatgactaagaattttcaaatttaacaaaagacatgaaattacaaattcaagaagcactaacaaaacagaatgacaataaagaaaacatacctggggaaattaaacagctgaatatcaaagagaaagtgaaaatactaaaagcaactagagagaaagacatgatagcatgaaaagattgatagtaagactgaaagctgatttctcaatggaacaatggaagccagatggtgatgcagtgacattttaaaatatggaaaaaacagaactgtccacttagaattctatacccagtgaaaatattattcaaaagtacaggcaaaataaagatatttcagaccatcaaaactgagaaaatatatcgcagcagacctgcagtaaaggaaatactaaaggaagaataaaaataatttcaaaaagaaacatggaaatacagtacagaacaaagaataagagaaaggaacaaagaataagagaaaggataaagatgtatttctaaattcattttgactataaataaatactaatgtcttcttaaatataacatgcatatacataataatatatgtaggtttataatgcatggttctaacacaaaaagtaaaaagggttgagtggggttaaagtgctcagagatcttagcattgtctggaaaatggtaaaggtactaatttatattcagactaataaacatgcatattgtacttttctttttttttgccttcagcactttaaatatgtaacatcactctctcctgtcctgttagtcttccactgtaaagtctgctgccagatgaatgggagctccattgtatgttacttgtttctttaaaaaaaaaaaagatagagctttattgtgaaaaatcatttgattgctaatgtaatccaattatttggttccactgtgttttttttgttgttgttgtttgtttttttgagatggagtcttgctctgttgccaggctggagggcagtggcgcaatctcggctcactgcaacctccacctcctgggttcaacaattctcctgcctcagcctcccgagtagctgggaatacaggcacgcaccagcacgcccagctaatttttgtatttttagtagagacgaggtttcaccatgttggccaggatggtctcaatctcttgacctcatgatccacccaccttggccttccagagtactgggattacaggccattgtgtgattttatagcattctttgccattgctttatttatatttatccttgtttcttttctcctgctgcttttaggatcttctctttatacttgacctttgggagtttgattgttaaatgctttaaggtagtcttctttgagttaaatctgtgtggtgttctgtaaccttcttgtacttgaatattgatattttttcctaggtttgggaagttctctgttattattcctttctactcctatctctttctcgacctcctctttaaggccagtaactcttaggtttgccctttgaggctattttctagttctgtaggcatgcttcattcttttttattcttttttcttttgtctcctctgactgagcattttcaaatagcctgtcttcaagaccactaattctatcttcttcttgatcaattctgctattaagagactttgatgcattcttcagtatttcagttgcatttttcacctctagaatatccacttgattctttttaattatttcaatctctttgttaaatttatctgatagaagtctgaattccttctctgtattatcttgaatttctttgtgtttccacaaaacggctattttgaattctctgtccgaaagatcacatacctctgtttctccagaattggtccctgatgccttatttagttaatttggggaggtcatgttttccttgatggccttgatgcttgtggatgtttgccagtgtctgggcattgaagagtttaggtatttactatagtctccacagtgtgggcttgtttatacctgtctttcttgggaaggctttccaggtttttgaaaggacttggatgttgtgatctaagctgtatctgcattagggggaacactaagctcagtaacactgtggttcttgcagtcttgtagaggtaccacttggtggtcttggataagatccagaagggttctctggattaccaggcagagattcctgttctctaccattactttttctcagtctctctctctatgctgagccatctggagctgggagtagggagacacaatcaccctcgtggcctccaccactgggatttccctggttcagacctgatgccagcataggactgggtcttatcctaggccctgtgtaacctctacctggctaccacctatgtttgctcaagaccctgtggctctacaattagcaggtggtgaagccagccaggattgtgtccttcccttcagggcagcaagtttcccccggcccctgagcaggtccagagatgctgtttaggaggcaaagactggagtccaaaaccttagaaatctatctggttctctattctattgcggctaagctggtgcttaaactctaagacaaagtccttcccacttttccctctccttattatacgcagaggtttctcttcacttggccaccatcacctagacccacggtgggtactgtcaggctatcactgatgttcacttaaggctcaagggctcttcagttagcttgtggcgaatgctgccacacctgggagtcacacttcagggcagagggttcccctctggaccaggacacgtccagaaatgccatccaagagccaaggcctggaatcagggaccccaaaagcccatttggtgctctactccactgtggccaagctggtacctgaaaacagcacatctcagagtctcacccaaggcccacagcttactgtctagctattactcctggttcttcagggcccaagggctttttggtcacaggtgatgaatcctgccaggacttggtccttccttttaaggcaacacattcccttctggcccagcgtgggtctagatatgtcatctgggagctagggcctggaatgggggcctcatgattgcccagtgccctatcctattgtggctaagctggtatccaagatgcaagacaaagtctcccttctcccaacaagcagaaagaaggagtctttttttttttttttttttttttgctgcaggctgcgctgcctaaggttggtgaaggggtgtcacaagaacttccttagccaccccggctagtgtcccatgtccattgcctctaaggccagcactagcactaggacttacctaggaattgcagtcttcacagcctagactgtctttcaagattatttagaaccccagagcaccttttccgtggtagaaagttttgccaaaactcaagttctaaccactgggatgggcgattcccctctgactagggctgatctaaatgctgcctccatggatgggcattggctgagtttagtccagttttgtttcccactgtgacagagcagcactgagttgaatgcaaagtaccacaatcgctgtgctctccctccctcaagagcacagatgctctgtatctcatggccgctgctgaaggagtggggaaggggcggcgtcagcaattcaagtctgtctttcctaccgtcttcaatgcctttttcagctatatgaagttaaaaccaggtactgtgattgcttacctgatttttggttcttatgtaggtgcttttttgtgtgtgtagatggttgttaaattggtgttcctgcaaggttagcaggggaacaatcggtgaaagcatctattcagccatcttgcttcaccctcctcatggtgttttcttataatccttttcatttctgtaaggtttgtagtaatgtccccactttcatttctcattttactgcattttctttcttctttttcatagtcattctagttaaagatttgtcaatttcttttcaaagaaaagacttgtggttttgttgattctctctagtgtttttttgctctccattttgtgtatctctgctcttatctttattatctccttcattctgctagctttgtgttttattttcttttttctctagtttcttaaagatggcaacttaggttaatgagatctttcttttataatgtcagtgtttacacctataaaatagtttccataccccattcatttttgtatgttatgtttttttaaattaaagtcaaagtattttctaatttccctgtgatttctttattgaccactggttgtttatgagagcattctttggctgggcctagtggctcatgcctgtaatcccagcactctgggaggccaaggcaggcagatactttgaggccaggagtttgagaccagcctagacaacatggcgagacactgtctttacaaaaaatacaaaaattagctgagcgtggtggtgtgcacctatagtcccagctactcaagaagctgaggtgggataattgattaagcccaggaggcgaaggctgcagtgagccaagattgcagcactgcattccagcctgggtgacagagcaagaccctgtctcaaaaaaaaaaagagcattaattttcacatatttgtgaattttctagttttcctttcattattgagttctcgttttattccattgtgacagagaagcagagatgatagttttatgattgtaatattttttaaattatgaagacttgttttgtggcctaatgtattgtctatcctggagaacattctacatgcacttgagaaaaatgtgtattctgctgtcattagatgctatttatgtctgttagatctagttggtttatgatgttctcaagtcctcgatttccttattgatcttctgtctaaatgttccatttatgactgggaatagagtattgaattcttcaactattagtgtaaaactgtatatttctcctttcaattctgtcaacatttgcttcatatattttagacctctgttgttttgtgcacatatttcttgttatgtctgcctgatgaattgacccttttattggtatatttttgcctcttataacaacttttgaccaaaagactgttttatctgatattagtatgaccaccccagctctcctttggttactatttgcatggactgtctttcccatcttttcactttgaacctttttatctagaataagtctcttgaagatggcatatagttggagcatgccttttatgcattcctccaatctctgcctttggattagagtttttaatccacttacacttagttactggtagggaaaaacttacttatgccactttgctatttgttttctgtatgtcttatgctttttttgtgtctcatttcctttattactgccttcttttgtgcttagttgatattttttgaggtgtacccttttgattcctttctcatttccttttctgtgtattttatagattttttatggttatgatgggattttaattaacaccctacatttataacattctagtttgaactgataccagttagcttcagtagcatataaaaactctgtttctatacacctctcctcctccctcccatctttatgttgttgttgtcacaaattgcatcattatacattgtgtgcccataatactgtcttttttatttacatatgtaattaccttttctggatttttatttctttatacagcttcaagttactatctatggtcctttaatttcagttgaaggccttagccttcactttctggttgcactaagcctagctgtcagccagaggggaaagtgtaggcccttcaggttttttctgaacatgcatcttgtttcgggcatgaatgtagcttctacattccccactatacttggacacttttgaatgacctaatttctcaaagaaactctctccagcttttcttcccaggctttaggcaatctgttttatgtctgaactgtaatttttttgccccaggtggctctgggttgtttgtttgccttactgcttgaacatttgttagctgcttttcagttctgagtgagttcagactaggtgaggaacaagggaaagtgacttgcattagtccttcaggtagccaccagacaagttagaacagacacactttgtttttagaataagaatctgatcaaaaaatgaggtgtcatactgagagggcaggctgttgtcttcaagacctatgctgagctggagaggagggtggggccaaggcaagtcaaaaagctgcaaaactttcttcctggttttgagtttcttttttcttgatttaatgttcagacaattgatataaacctttgactgttttccggggttttgacaaagttgattttgacaatttttcttgattttttctttttagatgtttccctggagggataggtctttggctatatctactgtaccatttttgctgacatcatttggtttgtttaatgatgaaaaacatggcttataagggatgaagggacgcctagatgattttaagcaaaagagaataccatgaccagatatatacttaagaaagatcaccttgtagttctctggagactgggatatttccaaccagccttctcctagtgccgtaatgttcaaattaagtgtctttccagatttttatcaaaatttttcatgataatcagactttaaaattagttatccaggaaaatcactttgcgagcttgcaggaagggtgttccttgagatggtaaatattcttgctccagatcagttgcacactttaatttgtgaagtagcaacttaatatgtgggcaatttcaagtagcatgccccagtgtgagtagcagcagtgatttattaattgattggttgattttctcgagtgatctggtaaggccagctggttttaggtgattatgttatcccttttttccttggcagccagaggaaccacaggaattgcattttggtgaatgaattttatattcttcctctatcttcctccttttgctgaaacacaaattgtattttgttgattttgatatatacattttgggcattttaatattgataaaaatgagatgcatcttataattaatgggcatgtcatattataattgatagtacttttcttagtgttacataagttaatgatgcattttacaattgatgctgtcttagattttaggaactcttaagtgttttagctggttttatgcatttttgtgaagtacttcaaatcctttttggaataacatggatgtataaataaatatataaatagaaatatgtttagtgattatgcttatgcctcagttattcttagcctggatcactgaaagagcaaattagacatggtttttctttctcttgttttcaattttgatgtaaacctttccaggacattagatggaatcagatcttcatgggagatggcaagtagaaattgaatgactcattggataaattataattaatgtaatggccctaggaattttcagcctctcccctctctgattatctatctcatctggctattggcacttgagatgttaaagttcaaagctctatttagccagttttgctggaagagaaaaagaccgatttcttttctttgtctggccagtttgaaacacaggcctggactgatgccttgtctaaaccattacttgtgcacctgcatactgtaaagggaaactctgaaatctttgctgcgtttcactgtgaggctcagaccacaaaacatgaggaatgtaaccagagtccagctgcagtgttcctccaccccccacttctttcactgaggactgaaaagtatgttttaaagtgatttttggaatgaaattcattagtcattgttattgtgctacttaactgtctggtagataataaattcagaatggattagtgaaacaagccatgagttaggacctagctgatcagagcatatggctttttcaaggccttaaaagatgtctgaagtttgttttattctcaggaggagaaacagggggtggtataattggcaggcacttttgaaactttctggcctgctcacaacaatacttttataaatctctaaaagatggtcagccatttttctgttgtagaattattggaacttagagaaatggtaatgctgtttccttgattttgtgtacttatgtttgttcctatggaggatcctgaccttaccaaaaccccaagagttgccctttttacctgattgattctgatttcaagacagaatttctaaagtataaagaaattgtgatgtgttcaaaatcagataatattgggccaagatcatagtcattgcatgtggacctgattctcattagagtggaatggtctaacaccttttttgtgactaggtgcataaggcggtcatatatcctatgtataaagaggttggccaaacaggtccccaagtcttatgacctgcgttttttattattcttgcagccacatagacaggtcaagaggattatggaccttcccgttctgcatagctagtttgcattttaccaagagggaagagacaaaggagttttcagagtagcagtgagcaggctgattccttatctctgtattccctcagcctacctcttggctgagcaacactaacttgataaataaatgaatgaaaatgtctttctgatggcctcttcttgaaacaattagaataccttgagctttatttgtataagtaataagttttctgtagaaatagtgagtggcacccagaattttattggtaaaaagcttatattgaaaacataaatgaaaattccagaactctagttttcagactgctgtaattctgactcctcatttctattattacctgcttcaggcatacttaaacacctgttgacaacatcttatattaagaattacatattccttcctataaaaattctcagcttctgtttgttaatcaagctattttagtgcagagagttcagaaatgattgttgttttcactagattagcatctgtttgctttcatggcatccaattaaatctgatggccttcttccagaaatggggaattttcatatcatgcttaggcttaaatgctatggccttcatttccaactctcttctgtgtatcctataaattagaacatttcttataacctttcatcttcattttattgtaggttgttgctcagatgttggcatttagagcactcagtagacccagaccctaaacctttaaattggatgataaatacattgacttgaggcagtggaaaagagtggaccaaatgctttggttctctatcttccttgctatgcaactttaaagtataattaagcaaatatttttcagggtgactaatactactgaaatgaatgaaaattgttagttcttttggattttccacttgattacaggaatttgacctaacttgaaaaatctctgttcatgtgaaaactttcccaaatgtctgtagtccaattctctataattacctaacagtacaccatggaacagaaatcaaggtgaaaaaaaaaaagtccatgcagaattgtagacttactgtgttttagaaccagtcggaatattattacatcatctgattgaacccttcatttcacaaatggagaaacaggttgaaagatgaagtgaggtcatacaagttaactaagcattcattttgatatgcccccctgaggagaggcaagcccagaagatgaagtgctaattattaagttttgtacttgtaaagcaaacatataggagatggaagaagtatttttatcaaaatgggtctgcactggagcctgaaatactcccttttcctgatttagggaaagcactcttgtaaagaatgcagaaatgtgaatctctgaatattaagcagttactctgttactttctcactgaaaatgttaattattcaaatcacacttattagttagttcattcgacatttgttttttctctaaaaggtatggtgcaaaatgcatctctttttttctctcttgcctccaatttaaacttgacaaaatttttgttttttatttccaattattttggactttggggtcatgttggcttctctcttattgctgagtgactgtggcaatgttctcctctctgagtcttggttctcctggcatagtacctatgtcactatgccactaggttgttgtaaggattaaataagcgcagtgcttggcatacagaaaatgcttaacaaaattttgcaactactgttatgtatacgttgagctttgcaataggaatcctaggcatgtaagtttttattctgtgtgctagatagaagatgggcctaataaagggcaaggaatattaaaaatgtaatccagtgggaaagtactgtatttccttttgtaatagtgttgtgaggtacatcatctttaagtcaatggtctaagtgcagaggactagtgaagttccccataatgcagggataaaaactggtgtaggtctgaaggcttgtctgtttacaggcatacctcatttttttgcattttacattattgtgcttcatagagactgcattttttacaaattgaaggtttgtggtaaccttgcatcaagcaagtctgtcagtggtatttttccaacagcatgtgctcactttgtgtctctgtcacattttattaactttcacaatatttcaagcttttcattattattatatctattgtggtgacctataatcaatgatctttcatgttattgttgtaattattttgggacaatacaaaccacaccaatataagatggcagacttaatcaatgttgtgtgtgttctgactgctccactgaccagctcttcccccatctctctccctctcctcaaacctccatagtccctgagacacaacattattgaaactagaccaattaatatagccctataatggcctctaagtgttcaagtgaaaggaagagttccaatatctcattttaaattaaaagctaggaatgattgagcttaatgaggaaagaatgtgaaaagctgagatgggctgaaagctaggcctcttgtgtgaaagagccaagttgtaaattcaaaggaaaagtccttgaaagaaattaaaagtgctactccagtgaacatacaaatgataagaaagtgaaaagacttattgctgatatggatagagttttagtggtctggataaaaaagtcaaaccagccgcaacattcccataagccaaagcctaatccagagcaacgacctaactttcttcagttacttgaaatctgagagaaatgaggaagctgcaggagaaaagttggaagctacagaggttggttaatgaggtttaaggaaagaagccatccctagaacacagaagtacaaggtgaagcaggaagtgctgatagagaagctgcagcaagttatccagaagatctagctaagagtattgatgcaggtggctacactaaacaacagattttcaaggtagacaaaaatagccttctgttggaagaaaatgccatctaggacttcgatagctggaaaggagaagtcaatgcctgactgcaaagattcaaaggaaaagctgactcttttattaggggctaatacagctgctaactttaagctaatgctcagtgaccattctgaaaatcctggggcccttaagaatgatgctaactatactctgtgttctataaatgtaacatcaaatcctatatgacagcacatctgtttacaacatggtttattgaatattttaaggcccctgttgagacctacggctcagaaaaaaatattcctttcaaaatattactgttcattgaaaacacacctggttacccacaagtgctgaatggaagttgtcttcatgcctgctaacatagtatccattccgcaacccatggatgacttttaagtcttcttatttaagaaacacatttcatcacatttcataagactgtagctgccatacatagtgattcctctgatggatctgggcaaaatcaatggaaaactttctggacagtattcaccattctaaatgcgattcagaatattcatgattcatgggaggagataaaaatatcagcattaacagaagtttggaagaagttgattccaaccctcatggatgattttgaagggttcaagacttcagtggaagaaataactatttcatgataaaagtttaacaatgaggagttgcatcttatggatgagcaaagaaagtggttccttgagatggaacctaattctagtgaagatgatgtaaaaaaaggatttagaatgttacataaacttagttgacaaggaagtggcagggtttgagaggaaggattgactccaattgtaaaagaagttctactgtgggtaaatgctatcaaacagcattgcatgctacatgaaaggcaaagtcaattgatgccaaaaacttcattgtcttattttaagaaattgtcacagccactccaaccttcagcaaccaccaccctgattagtcaatagctattgccaagtaggcaagaccctccaccagcaaaaacattatgactctctgaaggctcagatgatcattagcattttttagcaataatatgtttttaaactaagatacgtacgttgttttaaactatatattttgtattttctttaattttttccatgaacacatgttcaaagatatttttaaaacataatgctattttcatatatactgggaaacaaaaaaaaaactgtatgagtcactctttattgagatactcactttatttatttttatttttatttgtagagaaagggtgccgctatgttgaccaggctgatctcaaactcctggcatcaagcgatacttctctctcaccctcccaaaatgctgggattacagctgtgagccacaacacccggccaagatactaacttttctgcagtggtttgggaccaaacccacaatatatccagtgtatgtctgtacttcaaataggccgagagttaactgtctacagtctgctaagtagtcacgtaagcatgtgtgccttggaagatacgggttagtgaatgctgaagcccttattcttacaaggaatgcagagcattttcaaactaaatagttctcaccctggcccactatttacttttttagtcatatccccaggttccttcccagttcgtaacctatgcttcagtcagactgaacaattggttgttttccaaacacatcacagtatttcctaccttgatactcattgtccatgctattctatttgtctggaatgccctccctagccatctctagcatcaaaactgtgcttgtacatgaagccctcccttattatcaaaactttcatcgtaagctctttcttgatttcccatagtttggtaaactgtaattcttttggattcctgtgaactattctctctatatagtatcacagaaatgaagttctttatatgtactttaatttaataacagcccaactcaatgatgcaggtagtgtatttgagttatttatccttgtctgaaatattttcagggtagaaactgcatcttacttggtgtcagacttccctgacttgcagagaggcttgtattttgtagacactcaataaatatttcttgaattaggagagtaaaaggaacattcagtttttgcaaattctattaggtaatctgacactctactctgtgacccattgttttaactctggatgctctggccaggacaatcattatttcatagagtcccttgggactgtggcaagctattaacttctgtgctgttgtaatccaaggcacaggcatcagcactgatggggttatgttcaggggtgtgagcaaagaacatgttttaaaataaggaatccccatggaaattcaggcagtaaagatcaacaaaataaaaatgcagaaggtggctgctgggtgagacaggaaatgaacaccttgtgaagattaggcattccgctgagagaggagaaatgtggaaaatgagtcaagagaaattgtgcagctatttcatcactgacacttggaggtatattgttgtgtgtgttgtttttaatgaagtgtgcttttatagtgctgatgttattatctggatgaggaagtcttctctagtattactgtcatctcagctttctgtaaccaactaaattaaaatacagtaatgtaatgggacagtgggataagaaagaaaaccagatgactctgacatgtgaccccaacctgaacttactgcttttctagttttcggtatactcaaataaaaatagagtccagtgtaatgcttgcaggggctggggggactggacagaggaataatatatttagttaatagtggggtatgtcccacattcaatactgttacattattaatatatgtgaaatcagtgtttctcaacaggactcccaacacatcagtgagcgtgccagtagttcatggactatttgcagtccattattatttatcataggacagcatagatgctttgtgttctgatatgaagtaatcattgaatttaataaagctttattttattggtgttgcatgaaagtagctctgttcttttctttaattcttgtatgtttgaattttttggtaagcaaagaatgggagaatgagggtaattatatcaagccagagagtttgcagtaggtaatttgggggaatattttggtttcctgacaaaaatgaatggaaggaaagagtaaaaattatttttaggtagatgtgaaattattttaacttccaaaagcatctcataatagttctctagacagttttctaaggataataacatttatgtcctgggtaatggtatcattataaaacaaatttatgtcactctttaatccagatagttttaactaccatatttttatacctctcttttggatgatttacaattattaaggatgatcaccaaaagtagtttctgaatcagattaaatgatcaattagtttttaatagttgcttttcttctctaattcattgaaaatgaaaaactgatataacatttaattcatatatagttaaatcataagagagttcagttgtaagaggggacatcgcaagaaagccaaccatgtttattgagcactaggacatactagtcactgcacaagatgctagaattaggtaaagttacctggctctgaactggcatcaggatgcacagcaagtcagcagagtcattctccacataataagacccatgctagagatcagcacagggttgggttgcaggtagtcagcagaggcatgcttgatgagatggcccctaagcatctgagctgctgagtatggaataggattaggagctgtccaagtgacccagatgtaatgaaacacgtacactggcacaaagcagataatacacctttccatggaccaaagcctccactttctcaccttgcctcataagtgaattcactttacactgctgaacagttaacattgagacatgtataagagaagagtattaatatttagtctaagtataaattaaacttaccttcaaagatgattagctttaagtggttaatattaaaatacatttgttcaaaggatagaaacctatctataaagtatttttgatcacggattggttgtaataaatatatgactaatttgatttaaacagagtttcttccacatgtaactatctaacagagataagccatgttggcttttaaataataaaacttgtatattctaaattaggaaaggaaaaatcatggctttcctgtttcactcttctgaaagaactttggcatcagatacaccttgaaccagtttattccacctctctagcctcagaatactcttttggaaagcaaaaataatggcttcacagaaaggtggagaagaatagagagaatttatataaaatgacctttgcatataatagtcactcagtaaatatttgtatactgataaatgaacctagtagtcacgatattaatttttcccttctagttgaatttatcttatattattccagtagaaatgagactcataagtttttagaatttgaaaaatccttggctttgaatttagaaaggatttcttaactaaatcacagaaacaagaccatattatgagaaatggtctataagtttgatttaagaaaaaaaaaccttgtctataattcatagcttttagattaactaaatgtcaggatccagaatatatatttttaaaacctttatttataaacaagtaaaggagcaatcaacctaataaaaatatggacataatatatgaagaagctgttacagaagaacaaaccctagatgtttaataacataagaaaaatactcagcctcactaataatcaggaaatgcatgttaaaaccagaaggagatgccattttatatccatcaaactggcaaaaattagaatgtctatttagtaccagatttagtgagcacatagaggaagagaaactctcatcctttgcttgtgagagtttcagttcatttgtttcagaaagcagtttaacaatacagttaaatctgcaggaaccccactcaacctaagaacctcaatcctggttatatactagtctgttgagtagctgttacatatatgcatcctacaaatatttattatgtctgtattatatagatatttaaaccttatatcttagttaccattattgtgttttggaattattcataattatatagctaatatttaattgttttaagagcctgtgtcctcttgtactatccctttcagagccattatttctgtgcaacattattttctgtctatttctatttttttgaaacaaggtctcactctgtcactcaggctggaatgcagtagtgtagtcatagcagctttgacctcctggtctcaagcacatctcccacctcagcctcccgaatacctgggattatagtcttatgccagcatgcccagctattttttctaattgtatttttttgtagagatgagttctccctgtgttgcccgggctggtcctgaactcctgggctaaagtgattatcccgccttggcctcccaaagtgctgggattacagtcgtgagctacccgcacctggcccattattttatttaacgtttttttaaaggctactttttaaaagtctaggatatatgtttctctgtacctagcttctttctttttattaacataaggtcaatgtgggtggttacttttttcttataattcatgtcattttcatacaccagttctggcttcttgattggttttaattttatagtagcagtttgccatatttccttttgagcaaagactggtgttaataatgcctagaattttgagtgctattcatttatattattggaaacctttaaaaagacttacaaaagcattaattcttcccatgatgctcattagttactcccattaatataaatgatggctcccaggttcatgatgtggagagtctagtgatgaaatactagaagtattaactgtagctagttatgggaatttactgttgtaaattaattaaacacaccaataagcaacggaaactttttattattttaatttgtataaatataaggttggtaagctaatgagaagtggcaggtctcttggagttgattgacacctatacttaaactcttttaaatgtgtagatgacgaatttattgagacaacttctgttgtaagatgttccatacagcgaatatttatttttgagtgtgtagtacacaattttgtcatttccagctttaaaaacttagttactaggagaaaaactttttagaagccacctcctaatattgaatttgctgagtcatgttctgtgtgagagatataagaattttgtattatattctggtttctgtattggtggtttctgtataaatcacaaaatgggaggttcatagttgcttagaaggaatttggtaaatagcatgttatttcactcagcaatttctatgagaaaatgatagatagtattcctttctaagatgatgcagtttggtttaaagaaatttccttttctatttttgtattattttaattggaaactgccctgttttgtagtatgcaatttggaatagacacttaactcagttttgtattattaaatactaattcaaaatcaagagtcacagtctcagaatgataaatatacaaatgaacctgttcacctattcatgcattcattaaatgtttaattagtacatagtatgtgacaggtattgttctattgataggtctttgtgatttagtaaagaacagtaacaacaattaaaaatgttctgtctttaaaagaaatggacagtttaaagtaaattctgtaaatactgctgaatatctaccatatgaatatacttcatgccatatatttttatgaaacagactaagaaagtgagcatactatcagcttattatctagtttcagagataacaaaaatcgccttgtttcatgccttttatttaataacactcctttctttacctggcatgcccttgtctcatgagtaaatacattgcaagattcattaggtatccctaggggtagaaagaagtacaatctgattttaagcaaaaataaggttggttcataggtggtttgggacctgtctcaagtgtcaatttgtcattaagagtaaaggctcgataattgactggaaagagctttttaaagtttcaggatcaacttaaaatttactttgctcagaatatctatttaatgtttagttctcactcctgcaaaaatatactaaatcaggatctagttgtttgacaaaactgaagcaaaggaacagtgagtagtgtttatcctctcaactagccaatgaaatgaaaggttaaaacgttaaattaggctgggcacggcagctcatgcctgtaatctgaacactttgggaggccaaggctggaggatcacttgagcccaggagtttgagacttcagcctaggcaacatactgaaaccccatccctaaaaaaatagaaagattaaccaagtgtgatggcacccagctactgaggaggctgaagtgggaggatcacttgagcccaggaggtcaaggctgcagtgagccatgatcctgccactacccgacttcaacttgtgcaatagagtgagaccctgtctcaaaaaaaaagaaaattaaattagaaataccatgcatgattcattgtcatgagtttcaaatgtggatgtgcataaaagaagttatgggacatggaaaatgattgagaggtgtcaacatatatctaaggggaattctaggaataaagattagaagacatggcaagaaagaaatattcaaaacatggtggctgagttaaaaaaaaaaacacagacaatattaagaacaaaaaaaggagacacatgtgccacacagattgaaaactcataagaacatactgtgaacagtttttaaaaggtaggtggaatagtcttttttagaaaaaaatataaaataacaaaattgatccaaaaagaaatgggaaaactgaataggagctgcttccagagtatagtagcatagatatcttgaccaacactgaaactgcttgagaaaaacaaattctttaattatatttattagttcacaagaaaataaagaatacttaggtcaaaaactgagtaaaggcaagaacctaaagaaataaggtgaacactgaagccagctttttccttgaaggcatttaataaactgaataagtgtgaatttgataaaacaacctgaacaggacaatagaagaaaacaaaagttatagacaaatatctttcatactaagttgccacttttgtatgaaagacatacaaaacaaaacatatgcaagctgaatctggcaattcaggaatgagtcaatggctcagcatttaaaaagctttccacataactcacccattaacagattaagaaaaatatcatatcatttcaatagatacaaaaaaagcattcaataaaattagatacttatttagaaaggcaatatacgttttgattaggaacatacattctcagcagggcgcagtggctcacgcctgtaatcccagcactttgggaggttgcagcgggcagattgcttgatcccaggagttagagaccagcctgggcaacatttcaagactttgtctttacaaaaaaaaaaaaaaaaaaaaaaaatcagctgggcgtggtggcatacctgtaagtcccagctactcaagaggctgaggtgggagaatcacttgagcctgggaggttgagactgcagtgagctgtgttcacaccactacactccagactgggtgaaagagcaagaccctgtcgcaaggaaaggggtggtgggggcgggtacttaaattctggaaccagataatgagagtttgaatccagactgttatttagtgtaaatggtaggcagaatttgaaacagcactcaagattcccattatcctggtgtacatgtccgtataaatgtcttccccttcagtgtgggcaagacttgtgaatatatagtcggccctctcaatctgcagattcaaccagccacggatagaaaatatttagacaaaaacaaacaaaaggtaacaatacaaaaattttaaaaatacagattttttttttattttcaaagtatttaggaattctttaattagaaaattaaaggcaatgggattatctattggttctagaagtacccatgaattaaatcacttacatctcccacttaaaaaacaaaacaaaaccttaaatcacattgctgttaagctttcatacagtaagaaataagaccaagctatgctggagtacaaaaacctgaaattgtgagcatgaaaataatttattgattagacatcttgcttactcaagcattaggtctactggagatagaattaacacagttcatgaaaatggaaaaaaattccattcagcacctgcttcctttcaaatttcctggggacatggtttatgcaaaaaaaaaatacaaattgcaaaaaaaatacaaatttaaaaacaacagacataactatttacatagcatttgcattgtattaggtattataagtaatttagagataatttgaagtatacaggacttatgtacataagttatatttgtaggttatattaaaatacaaattttatatcaggggcttgagcttacttggattttggcatccacaagggtcctggaatcaatcctccacagatactgagagatgaatgtaatagaattttcctcccatgattaaggttcccaaccatttgactttgagttaatttaaagcaaaattatctgtgtaggcttggcctaatcaagtgaacccttgagagccaagaagcagtagcagatgctcttctgctagcccacaagaaagcaaacagaactcctcatggagggagccatgtggctaggacctgagggtggctcctaagaactgggagtgaaatatggctgacagctagcaaggaactagctcagccctaccaccacaaggaactcaattctgccaacaacctgaatgagcttggaagatgaccctgagctacacatgagaagcctggccaacaccttgattttagatttcttagatcctgagcagagaactcatttatactgtgcctagagttctgacctacagaaaccatgagatagtaaatgagtgttttaagctgctaagcttgttttattttttaaagcagtcatagaaaactaatatattgtgtgactttggacaagttacttgatcaccctatgtgccttactgtcattgttaaatggagagataacagcacccacttcatagggtatctaggtggattaaatgagtgaatacatggaaaatatatgtggtacttggtaaagcatcaaatgttggccaataatagtagtagtggttgttataagaactcattgtaaagtagaaaatgaaaggaatttccttaaaatgccaaaagatgattatcacaaacctatagcaagcattagacttaatagtgaaactttgtaaggactccactaaaatcagaaggcacataaggatgccagttgtctttacaataaaatattgtatttgtggccctggccaatagaattatatgagaaaaagaaatgaagtttacatatttgaaaaaagggaaaaaaagcttacaaactgaaaatgaatacaatacaagcacctagcaatatggttaataaaaagggtgaggccaggcgcagtggctcacacctgtaatcccagcactttgggaggctgagtcaggtggatcacctaaggttgggagtttgagaccagcctggccagcatggcgaaaccctgtctctactaaaaacacaaaaattagccggatgtgggggtgggcacctgtagtcccagctacttgggaggctgaggcaggaggatcgcttgaacccaggaggcggaggttgcagtgagccaagattgtgccactgcactccagcctgggcaatgagagcaaaactctgcctcaaaattttaaaaaataaataaaaagggtgaaagacctttatcaaagaaaaatataaaacattataaaaatgatagtgaaaaacacaaaagttctgaataaatggatgcacacacatatatacataccttgtttagctatgccttatgcttctctgatttggcataatactatttgtatatatatttttaagttgtttttgaatttgaaataattcattgcagtatattgtaaatctttttttccctgggcattatcaagtgttctctgcctatagccaagtagaagaactttgacccataaagactaactaaagtatgcaaataacagcactagatctgcagcaaagaagtagaagaagcggccgggcatggtggatcacgaggtcaggagatcgagaccatcctggctaacacagtgaaaccccgtctctactaaaaatacaaaaaattagccgggcatggtggcgggcgcctgtagtcccagctacttgggaggctaagccaggagaatggtgtgaacctgggaggtggagcttgcagtgagccgagatcacacccctgcactcagcctgggcgacagtgtgatactccatctccaaaaaaaaaaaaaaggaaagaaagaaatagaagatgcacaacacactggatttttggttttttgtttgtttgtttgttttgttttgttttttggttggggcggggacggagttttgctctgttgccaggctggagtgcagtggcgcggtctcgactcactgcaacctctgcctcctgggatcaagcaattctcgtgcctcagcctcccgagtagctgggattacaggcacgcgcaaccacacccggcttaatttttgtatttttagtagagacgaggtttcaccatgttggccaggatggtctcgatcttctgactttgtgatccgcctgccttggcctcccaaggtgctgggattacaggtgtgagccaccgggcctggccaacacactggattttaaaatgcaagtgttaagtggaaatagaaaacacggtaacaatcagcagacaaggagggtttggttgaagttacttgacaataagaagaatatcatgcacattactgcaaccctagaaagactgattaacaattatatgaaagtatatcagaaatgagtttgtgagtgaaaattttagcacataaatagcaaaaaaagaaaaaaaattccaatgcaagaacccttagggaaaatggttaaaagacaaaccactcaattaaaaaattatcaaagggtattgtatcaatcatgtttcagtcagaaaagcagaattagtgtgaatattatggtctgatggatttattgggacaagatcgtacgcaattgtggaagaagctacagaaataagagtgcaaaagcagggcttggagatcagagaaaagtcactaccccagcccttctgaagctctggtgcaggtagacaactcaggcaaagaagtaggaagtgaggtatatccagctgctgcgtggaaccccagaggagagcaggtggagacatctatggaaggctgttgccactgcatctgatagtgggaagggagttggtattggtcagcagggccagcagctgggaagaagagctagatgcagaatggaagcacagacaccaaatggaatctgcaagcagccttgcatctgtggattactgtgtctaacaccatgccctgccaccatgccagtgtagtggctgctgccatggccagttattatctttggaagacaatgaagtgaattctatcttccaaatcttacccaaatttatcttttgttcatctgtaacctggatccatataggcagtcgtcttctggtaaatacttccagcttagccaggttgacacagttaaaaaattacagtggatataaacaggccttatattatattctagtaatacaaagattaatagcaataatagtaatcactcagaaaattatagttgctcttgcgatctttcaggtactgttctacacgtgaattgtcacaaaagcagtatgagattaatgatattattatctacattatattcacaaattgtgtcacagagagttcaagaaaaaatacttccaagactacatgttgttctctagggttagcagtaccaacaatttgtcagaatctagtaaaacggtttcgagtacatactgtttagaagtttgtcccctagagaaacttgctcaaaggagggcatataaagatgtttagtacatcattacttgtactggtgaaaaaattagaaacaacctaaatcccctttagtaagggagtggagaaataaaatattgaacatccataagatggaatactaatcaggagttcaaaggaatattttagatacacacacagacaaaaatagctttcagaaaacactatggagtgaaaaaaagtaagttgcagaatggtacgtatggttcattgtttttcatagaaacacttgtattttaaaagtataaaaagcagtaaacacagatattaaccaaattataaaaggagtggcttgtggagagaagatatgacaggtgctgttggttacctaaccatggtcattcctgtttctcaagaggtccctattgttagtaattaactctcttcttgggtatgtggaaagtgggttccagtctcagtgccagggagtgaactacaattggctttttactaatcatgtgatcccactccactcaacagtgatggatttaggagttgattcacaattctggccagttctatggggtactgctgggaatagttttatgcactaagacagacacgtggctgtgatgctggtaatattcaatttcttggtctgggtgctggtttcataaaagtattaattctgtgaacattaagggagtttgcccttacctatctgtatgttatacattaataaaaagtttatatattaaaaaagacacacaggagaaaagtctgccattttctactagatgtctctacagatgagagctgattgtgtaccaaccatcctgtgatcatgaatgggccttgcccaattttctaaggatggcagagtggaaagatgggaagacctgggtcccaattaatgtaataaagtttctgagttagccatttctttttcttctttgaatcagtgatttggtttttctgtcacttgaggttaaaatgatcctaactaatggaggaagggggagtccctgaattggtaaacaaagaaggctcacttgatctgtaatgttttatttattttaactaaaaaataatatctgttgtcaactctgcgtagtgagtatgtaggtcattattctctaattttaaaatgaagtgggtagtattatttaaactgttctttaattttttttaaaaaaaggaagaaaaagtatcagatgagttgttgctcatcaggaacaaaaatgagggagtgattattttaagttgaggggcaactgggaaataatatttctcagcaaatgaatcaaaagccaatttgtttatattcatttaataaatacttagtgggcttttactgtgtataagctactgtgacattctgtttggacctatatttgaaatcactaggtttttgtaaagaacatcttgatatattggtatgtgtcttcaataggaagttatatgttctagaggacacccatatgtctgggttaaagtctgtattttaaattagagtgtctctagtagtatattcaaatttggcaaaaaacttatgtaagtatttttgtatgatacagaaacatatgtttccatcatttagctaagtaaaattcataaaacaaattattcttatgtctagtagaagtgtacatagaattctgactcccaagtttgtattatttcttgagatagtaaccatgctcaaccctcaaattatgacatacatatgtatgtgttccaagatacaataatttaaagaaagtctttggttaaaaatacacactgtggtgtaagacctgagttagaatccagctctttgtcaccttaaccctgggcaagttacttctctaagcttcagtatggggaatagtgtcattgtggagtttgtatgtaatggaaacctcaaattaacaatgacttaaataaaattttattttcaggcataaaaatccagggatcagtaatccagggctggagtggcagttccgtaaatgcttcaggaaatgcaggctgcttcaaggtctctgctctgccatccctggattgtggccctcatggtccaagatggttgttggaatgtcagtcattatgtagccaacaggaagtgggcattcctccctcctctaaggactcctctaaggacctctgtaggaggttgagaaatgtcttttttctaagtggcttttaaacttcaggggttctgttaacaacagaagaagagaatgggcattggggcacaatcagcagtctctgtcacagggttgttttaagaattaaccagtacatataaagcccagcacacagagcctgacatggaaacaaaggctgctattttaatcactagtagtaaatgtcaaacttctgactgaacaaatgtgcttatcttttctcaccaaaatgccaatgaaataacagtatacggattaaaatttaaaaagcaggccaggcgccgcggctcacggctgtaatcccagcactttgggaggctgaggcgggcagattgcctgagctcaggagtttgaaaccagcttgggcaacacagtgaaaccctgtctctactaaaatatcaaaaacattagccgggcatggcagcatgtgcctgtagtcccagctactcgggaggctgaggcaggagaattgcttgaacctgggagacggaggctgtagtgagccgagattgtgctactgcactccagcctaggctacggagcgagactccatctcctaaaaaaaagaaaaaagaaagaaaaaaaattttaaaaagcataagtaaggaacaggagaggcaacctccagagcagagaaactgtgaaatcaacaaaattgtgagaactgaacagcaggtgaaagtagcaattgacgtagcagactggaaaaatgaaaatctaagagctcgcaagggggaaggttaagaagcaagctgattcatgctgcagaagtccagaaagtctcagaattggaggccaggagtctttgaaggtgagtcgggtatgtctggaagtctgtattagaagccagtataccctgacaacctctctcaggcaactacctttcacttcaccagcagaaaacctgatgtttactctagagaggtcgaactagactaatgctggattcagagacagctagcataactgagggcagaggtgccagctgaaaaaaggaattgattgtacatataagaacgtggaaaactgatccaagagaagatacatacagcttcttagagttgtacatctccatatgaaatttccagttctctgctaataaccccagagtgaaacctgccttttggccagttctgtcaatgcacatctttcaatatgtgtgctctttagtgccttgcttttaaaaatgattaaccaaagaattaccagacatttgaggaaacttgagaagccaaaatcatgaaaaagaaatgtggaggaaagaaagaatatagggataaataaaaatcaatagtttgttgggattttttttaggagactttaaataatatcctcagagagacaagggaaagtactatgtccaagaacaaaaacaagatgatataaaaatgaacatttagaaaagatgaagcgtggcaaattaaaatgaaggaagtgttttaaaaattcaacagaatgctggaggtaaagttgtttttctcttaaaaaaaaaaaaaaagccggagatcaaagataagaaagaaaagataagaaattagaggatttcctcaaatatttgatgatccaacaatccagatagcagtgagtacaaaaaagaaacagaaaagggaaggtaggaagttatccaacaaataataatgcaagaaaattctaataattaaaatacttgatttcaaatggaaagagtcgagcccagtgagtgcctagcacaataacattttaaaagcccacactaaggtacatcactgtgaaattatggaattctagaggtaaagtgaagattctaaaagcttgcagagaaaaaaaaatacatacaaaggaataggagtcataatatccgactcctcaaaggcagcactgaaagttagaaagcaatggaacaatccttcaaagtactgagggaaaattatttctataacctatatttaaatcaagctatcagtcaaataaaagggtagaaaaaagacttttcaggcatgaaagtcctatgcacctttcctaggaaacttctggaagatgtgctctattaatataaaggaataaaccaagtaagaagaaaacattattcatggaaaaggagggatctcagggtgaagggaaaccatagatgatcagcccccgcactggccaatggagcaagagatcgaaggcaccaagaaagagtgaaactgaaagaggatttaaccatagcaagagggaattttcattgcttccaggggttctgggaataaattagtgagaggtacgtaaatttagcaaatgaaaaaactaggttgttattaactccagggaaaaccaagtttaaaagaattaaaatatgatacattatatggctctgctcaaaaaaataacatggttataatactgtaatgttgcatactgatttaaccaaaaattatgatgttgaccctagtgaatggattggaggaaggggaagtgtaggtattttggaagaggtggggaagcagtgtgtaagagagctatatcctcatcttccccagtatattgtcagtagatcatttttaaagccatagggtcgagaaacaggaataaaaggatattaattagaaacatagagggaaaataccagggggaaaaagcagcctaaagtgatgagaataataagcttggaggtctaggaatggagataaagctctagggtattttaactaataaacatgtaaactaatgtttttagtatcaggcttgtagaacaattttgttttttcaaccatgtatatgttttattttgataaaaaaacattgatttttaagtgtgcttttggtggcttcatttgtacaaagtctttgcaaactaacaatacaattcagtgaacatttattcaatacctgctctgttagaccattgtacaagagacagacatgtaaacatatgattgtaaaacaaagcctaatgtgattacctgctcccaaatgatgaataaatactgatatctcatagaagcacctcacttcttttgggactaggggaaggcttcagagaggatagaacatttgcactgggccctgaagggtgggagcaatctgaagaggaggttcagtgccagctgtggccagtgttgtccaatcccaccatcactggaaaaggagatgtgtttaggaaagaagtctggtggagctgtgggaggctgttttgacttctctgcctctcctagacatttatattagtcatttcttcctgaggattttctcctccctgccctatcacccagacacccttaattttagtattgactttaccatgctgagttatattgtggttctctccccactggcaccctgcctcttaaacttttggtctaatttagagaaggacaagggaagggaaaagaaaatattggtttcacctggccagatgtagattcccgaatataaagataggaactctctttcctaacctcataggctactaggtatagctgttatcttttttgaggcactaagattaaactgtcattttcacagtttgaacgtaatttttagaaccctcaagagtaatataggacacatctaattttttcaaagaagtataattgtttcacaactataaaatatttctctgtgaagatgcttttcagaagtaactgggcaagtcattatggtgtgtgtacatgtgtaacatcctccaactttagaattttgtgccctggatttgttttcttttatattgttgggtccaaaagaggaaaggctggcttagaactaaatagcagaactaaaccatatgttttataccaaattagaaacaggtgaaggttgttaaaatccagcaagcacttagaaaagcttgagacacaagtttgtattaaaggcaggtggttatatgtacaataaaaaacagtcaccagcacactggctgattgatacatatgtgattgatctttttggataaaaacaaggaggagttaataaatcactgcacatagctataaagatgtttgggcttgaaagcctagcctgtaagagcaaatgtgggccctgaaggaaatttatgaagcctagatccttttagctttacttaacagctaacatctgactgacccagggggaccatggaaatttattgctgggccattcaaatatttaagctgttgtgtgatgcagaacaggtaaagattagcccaataacaaatatgaggctataaaataaaatgagatttcgatgacttgtaagtacttgtcagaggtcagctccaaatgactggtcagaaatggtaaaaacttgttgataattaaaggggattgactatgacaacctagatgtttgcattggttgctgtcagatcagtgatccttggaatttccttctcctttgaagtccatgcttaacaaaatgacttaggggcctctaaattgtctttttgtgctctgaaattgggcaagatgatgaattgaggtgattccttttgcaattttatcattgaaatatgtctttctcaaatacattctgaatataatgcaattcctagacagcatattcactttagaaaactgactttagctaacttatgtgtgtaattttgagcattgacatccagaaagcaggtaaagtttttaggctttttatgatagatgatctaaaatcagcctttaaaacttaagtagtttaacagatttatgcacaccattattgaaaagttgatttagtggaattaagtggatgtaaggaacatggctgtgctgcagccaagcaggcatagggcagcaggcataagccgaggtaaacagcccacatgactcagcgggattggggcgcaagcgcacagtatcatatcttatataatcatagccatgtagacacagcatagagaagctccccacctggctctcagccgctattgtttgtgtagtgtataaatgtaacactaaccctgtgaaggggctgctgaataaagccatgtctcatctacctgctgtctcttgagtgttcttccagctccctgccccacatccacccactccgctcagccctcagctggggctggaatctgaccctgagcatgacagtggatttttcaaaaactttccaaatattctacccacatttatttaagccccaaaagcaataatgtatataatattgttaataggactatggaagttacatgaatgagatctacagttattggtattgacaatctttgcctttttgactttaaacataaaatgtagatttgatggttttcagagtgccagcttatcaaatcacttggtaaatttggcagtgatttggcatatgaacatctgatttgtggggagaagaaatcccttagtttttaatagaaatcttgtatgaaatgaaatttacaaataatacagctttacaaaatggggttattacttgatggagagcatggaatagaataaaaagcagaggcttagaagtcagacaggcatgggttggaagtagctccgccacttctacttcacccatacattcacccctccctccattccacaaataaatgtgttccagatgcagggctcttggaactgggatacagcatcagtaaggacttcggctcatagttcacattcctttggaagattcaaggaataaacaagcaactacaatacagtgtcaaaggtaccctgttagggattgtacagggttcgtgaagacacatggggagaaataactgattcaaacttggggcaggggtgaagtgaattggagatgggtggctgttgtggagtgttaggaaacgctatgtgaccatgggcactaaattaatagtgcctgcaggacaattgctaggattgtatagataaagtataataagtacaatacctgctgcataataatattccataaatgcaatccagcatcaacatcattgttattgctgtcatcttatcagtactcactggcgtttgctctaatagtagacggctctacctgctgttaatctgtggcaaacaccattctgtaatttaggatcttctctcaaccaaataatttttcttttgagcagaactcaaagcactttctaaaaataagagttggttgtctaggtatattaaaaccaagaaagaaagagtaataagaacatacctgaatcttgaaatcttccgtattgattcctgtgttttgttttttaattcacagaactatatgttacttagttctccttcagtatttacttaatatattcatttgtttaatcattcatttgcagatatttgttgaatacccactttcaataagaatctgagcttaacacccatgtcctcaaggaaattgcgttttaattcaggaagtaagacatttgtataaacagacatttgtataaaatattgagtagaaagtgccaggtgcataagaatactttttgatttcagaaggcaacaaaatgaataaaatatgctgtctctcttgagacacttacagataggagtggaggaaaagaaaagggaaatcaagcataccgttaagaaaggtaataataataattgaatgcctgctgtatcctactaactgtgctgggtcatagattttttttaaatgcattttgttatgtagatttgaggttgagtcatagattttcttgtttaattttcacagcaatccttaaagattgctattattaaacctattttagagttttggaaacaatttcagagtagcatgttctagttcataccacaagtgaataacaaagttctgtccctctgacttcaaagccttaacttattgtacctaaatagcccttttgcctttctcctcttctcatctcaaaataggtatcagcacaaaaattaaataaacaatttttatataaaggattgagtacctgttatcagcactgtataaggaagcaatttatagacaatatagaattaggtgtcctgatacgtttaagcaaatcaatattatatgcacacattgtgaagtgttgtctttagatatttcaagtggtgaataggttttcttccaaatttatgttccagatggaaaatatcttctggcattaccaagtatttatgcaccttgcatgcttaattgtggatttggtgtttttttttttcttaacatttacagatttttgtgggaaacaggtgctgttaaatccaggcaaatgcaggatggctgttaatgttgtggaatgtgattttgatttgcttggcagaatttttatttaacaaaattgactattaaaaaaagacatggtttccatcctttaattttactctgttcactgaaatttgcctgtggactgtttttcaacagttacaaaaagggtgtggaaaaactggaaggtttctataaggaaattgatattgagttctttaacaatttccacagccctgcaacttacaagtaaaaaaaaggaggggggattatttttaaccttcttactaaaattacctggaattcaatttccctgaaattccattctttttttagtatagctctgtctaaaatattgtatataatattggcaaagagaatgttctggtgtaaatcttctcattacatgatttctcctttaaaaactttggggtgatattttatttcctgttatatcaaatttaacctcttttggttggcacatacgtctcatattttctcttttttcttcccccaaagaaggaggaaaaaacaatcactcctctttttgttcttccatgaggacttttaggatagagatcagcccatggtctggcgtggtgtgtgtagagggccctacctaatctgtcacataccttcctatgcaacttcaaagtcgtcccttgccattcctccttcagtccagttctgttggccttcttgccaatccttgaagcagcatgtctcctccttccacagggcctttacacaagctgcttcctctaaccagaacatttcttcctttagcacctacccatctcatttattaggctgattatatgagcactatctgtctaacccactggactttaacctcatgtttgtgtttgcccagccttatatccctaccacctaacaccatacctggcacatagtatgagttctttgaaaacttgttgaatgaataaacagcatccacagtggtcattttccttcatccccccggttatgatgaaagagttgcccttgtctcacctgctgtctaaggcagacccttctgtactctcacctgtgtggtaaggaagctatcctctttcacctcaggacatgtttcctgctgtgcctcaccacatccctgcagctgctgagctcccctctctctatgccaggcttcccaccagcttcatttccttacctctagccactgctgaactcataccagtcggccttcatcccctgctacttcagttaaactttcatttaccatattatcagcgctacctaccagtgaacccacagagtcaatccagtagacgtttaattttgagattcgcttgacctgtctgcagcacttaactgttgatagcgtccttcttacattagcagtttgtctgagcttttctggtgagatacttcttggttttcctcatatcttttaaccagtccttttctggctccttctccccatccttcgttcatattctcaaggctctgaagtggttctcttgtataccatttctttaggccatctcattcatacctatggctttggtttccatctaaaatgtttataattccctattcgatattttcggcccaaattttgtcacctcatttcatttatatataataaatatactttgtttatattatagagtatctatatactatagagtatataggtataaatatatatagtttataagtgtattatatttatatataataaatatatagccaggcactgtggctcacgcctgtaatcccagcactttgggaggccaaagtgggtgaatcaccgaaggtcaggagttcaagaccagcctggccaacatggcgaaaccccatctctactaaaaatacaaaaattagctgggtatggtggtgtacacctgtaatcccagctactcaggaggctgaggcaggagaattgccccaacccaggaggcagaggttgcagtgagcccagatcataccactgcactccagcctgggcaacagagtgagactctgtctcaaaacacacacacacacacacacacacacacacacacaaaaataaatatgcacctgctccttctcccgtgtttcccatcacaattcacagataccgccatctgcctcgtttctcaattgagaaacgaaagggtcatctttgactcctcccctctttaccattttgtaacaatcaatccatcacaaaattctttcagttcttcccacatatctattcacatatcttcctctctacttctggaaccctaaccaaaactgttatttctggcctggattttgcaataacctcctatccaggtcctgttcacctttatttaccacactgtagccagtctggtctttaaaaaacataaacacccatgctttaaaaagttattatcctcccagctgggcacggtggctcacacctgtaatcccagaactttgggaggccaaagcaggcggatcatgaggtcaggagatcgagaccagcctggccaacatggtgaaaccccgtttctactaaaatacaaaaaattagccacacatggtggcatgcgcctgtaatccctgctactcgggaggctgaggcaggggaatcatttgaacctgggaagcggaggttgcagtgagccgagattgcgccactgcactccagcctggtgacagagcaagactccatctcaaaaaaaaaaaaaaaaaaagttattatcctctcattttccttaaggatacagtataggtttggttttcttgtggtttataaacccttgcatagtctggtacctgctgatcttagcagcctaatcttacggcacttcacccctcacactctttttttaaccctagctcctagctgtttaatttcacccgtaattttataaaaagatggcaattccattctgtcagttgcttaggtccaaaactttgaagtcatccttgactcctcttcctctcacacctcatagaagatctgtcaccagatcatgttggctctgtcttcaaaatgagagaatccaaccacttctcaccacctccacagccaccatcttggttcaaaccgctgtcttctcttgcctaaatttttgcagtagcctccccttgtttcttttcttgctcccctgcagtttatcctcacagagcagccattaaaccctccagtgcttctcctgtcattcagagtaaaaactgaagtccttgctgtgacctccaggaccctgcatgatgtaaaccgattcctttgctgacctcatctcctggtcctttttcccttactctgctccaggcactctggtctgccttcacttccttgaatgtgactataccaggcattcctgtctcaaggcctttgcacttttcgtttcacctgcctggaacactcttccccagatagcttcaagactttctctcacttccttcaggtttttgttcaaatgtaatcttctcagtgaacctcctcttatttgtcatgtctctctcactgaagtgtaagcttcatgaagacaggaactttttttgtcattttgttcactgtgttagcacctagaagagtgcctatcacaaggtgatgatgcagtaactattgctaaacaagtgaatgaagaatagtatttgctttatttgtccagtgctcattagagtctttggtataaagtaagtaaatcatttattgattgaatcagttcttttactctaatttcaaatgctcttacgtcttctctctttcaaatttctgacctttactttcttcaaaactagttttaaattttccacctataggaagctgcctacgattaatcctgtcactcagactggagtgcagtggtgtgatctcagctcactgcaaccttcatctcctgggctcaagtgatcctcccacctcagcctcccaagtagctgggattacaggcatacaccatcatgcctggctaatttttgtatttttagtagagacaggattttgccatactacccaagctggtctcaaactcctgggctcaaaggatccacctgccttggtcccccaaagtgctgagattataggcatgagccaccgcaccagcctgtttttctcttattatttactattagctaaaccttttgtttgtttatttatgttgtatcccaagattttattatgaaaatttctaaacatacagaaaagttgaaagaatcttgtagtgaacacccatacacccaccacctagattctgcggttacatttgctgtacctgtgttattgtatctttccatttatctatctgtttatctattatatcaacctatttatttccgtgaatcttaaagtaagtttcagatatcagtagacttcccctcaatgcttcatcatgcatatgattaaccagagctcagtatttgtttatggttcttttttcttttgaggtaaaatttatatgtaatgaaatatacaaaccttttttttttgagacggagtctcactctgtcacccaggctggagtccagtggcaggatctcggctcactgcaagctccgcctcccaggttcatgctattcccctgcctcagcctcctgagtagctgggactacaggtgcccgccaccacacctggctaattttttgtatttttagtagagatggggtttcactgtgttagccaggatggtctcgatctcctgaccttgtgatctgcccacctcggcctcccaaagtgctgggattacaggcgtgagccactgtgcccggccagaaatatacaaatcttaaatgaactattctgagttccatcaaatacataggcatctgtgcagtccagcacgtcaagatacagatcattgactctcccctgaaacttccctctctcttttttctagtgaatcactgtctttcccagtcccctgcttaaccattgtttaaccgtaagcatgcagtatgaacttctttacataaggcttctttcacttggcatattattgtaggttctttcatcctcaacacttaggtggttttcagtttttggctattgtgagtaaagttgctgtgaacatttttgtacatggtatttttgtgggcaaatgttttcatatttcttgggtaaatacgcaggaacagaattgctacatcataggataagtgtatgtttagttttataagtaactgccagacctttttccgtagagcgtaatgtacattttatactcccactcaacaatatataagagttctggttgctccacatcttaagtctcttttaatctgaaggttctctccttctttatttttccttgcatttttttccttgttgtataagttaaacttactctgcagatccctgtaaagttcctcacattttgaattttgctgatggtattaacatgtttatctttcccctgtgttacctataaactggagataaaaacttagttgatcatattcagttttcttggcaagaatacttcataggtgttactgatgctcccttttatatcacatttggaagcatattatgtctagttatcttttttgtgtgtgtaatgttaaaattgattagtacccctggccactcttagtctaatctgccctcagtaatctttctgaggaaggattttagattgagtgacctgcagtggtctctctaagggtgattctgatcaaaggctagaatgacaggaaagtgtcagctctgggaagatttaaggagcaaacacttaaaaaacagagaatagcaagttcaaaagtcccaaagtaggaaacaatcttggcatgttcagggaacagaaggaaaaccagcatgacttgagcatagtgagtgccaaggagaatgacatgaggtagcagtggctttagccacgtaaggccctgtgggctaccctgtgtggtttaaattttatttcaagtgcagtggaaaatcttttgatggttctaagtaggagactgggtgccacaatcagatttgattttttaggatcagttggctatgggaaagagggggaaaatgtccattgttaatcatgcttttcatagattataactttagcccgaaccaatggatatctgttactttctgtgttactttaaattgattatgatgtttaaaatgagatatcacttatgggggaaggttaaatggcccttagtgtaaagttattaatccaaagaagaatggaaacttaaaaaatagatttgaatacagttaaaatattaaatgataaatggaaacagaaatattattttaaaatggcttattttttaaagagtacattttggactggttaataaatgtaactttttaacatggaaacagatgctgaaatattttcagtccccagtgtaaccccccacagccagccatttccatctcacgtgcctatggcctgccttatgctttcacagcattaccatcaacagttaaaacttcagtgacactatacaatgtagcagaaaaatgcaagatgtttttttttttccccctctttagtcttggcagggtaaaacatggtcctttttactctaccaggtgctttactttggccataataatttagtatgggtctatagcttttggtcacttcccttactcgatcatgggggaaaaataggggcagcttgcatgctgctggcattttacattaacatttttttcacaggtttttgttgttgttgttgttattgtcgccctggaggacttgaatgaggctcgtgtggttttttttgttgttgttgttttgttaattgcttctttgaagtgcatgtagccttaacacttatcatagccaaccaagaactggttgctcctgatagtaggtcatcccaccagttatacagactggtattccacaggaggagcccagtaggtattcatgttataatctatcccaatttctgaacccctaagcataccagagttaactcacaatttactatagttgttgtaggggggactttgggaaaataaacattgaaaaacgtcttttaaaatgagttttaggtccgggcatggtcactcatgcctgtaatcttaacactttgggaggctgaagtgggaggattgcttgagcccaggagttcaagaccagcccgggcaacatagtgagaccttgtctctatcctcccgtgcaaaaagttagccaggtgtggtagtgcacacctgcagtcccagctacctgggagactgaggcaggagtattccttgtgcccgggaggtcagaggctgcagtgagtcatgatcatgccactgcactccagcctgggagacagagcaagaccctatctccaaaaaaaaaaaaaaaaaaaattattgtctttggcagataccctgatttaattttggtcacttctttaaatgtgatatagctgtcaaataaagcatgaggcagcaagaacaagaattatgcacatgtgaatgtgaatcatgaaatgtgggaaaattaatgcactaccaccagagcatgagataaatgaatatggaaacaactaccaatcaatctctaggcattaaatgggcaacaggaaggtcaaaggagaatcattgagtcctggagtggtcaagggcaatttaaaaaggaatgtgacaacttgaactagatctcataaaggatggaatagtatttagataggaaagcaagaaagatggacaccttcgagaagtaagtaaaggcagagaaagaaaagtgaacttgatgtgtttgtgacactgtgaggaaacctcttgagcaaaaggtgacagataaattgggcagatgggtcagatcacttaggcctcgaaaggtaggcagaggagttgaaatttaaaacaataactgattatgaagcagggctgagaagtgacatgataagaggtcttacttaaaagaaaataataacttatatttgtgtcatgctttacagttgcagtgtactttctcaatcttgtggtgttgtatcctcacaagatacttgtgaagaaggcaggaaagatgatagtttctccactttacagcttaagaacttagcattaaactagttatgatttacccaagttcatataacaactaagtatgtaatggagctgagactagaaaaactatgtcttttctgttgtaattcagtttttagaaacctactgggcttcctaaaatcaatctgacagtgatatggagaatgaactggcattaaggattctggctaggtagtaagcaaattgataagagcttggaccaatgattctcaactggaggcagtttgaactcctttccccacccacccaggcaacattgggtgatgtctagagacatttttggttatcacagctgggagtcgagtgctattggcttttagtgagtagaggatagagatgctgacctttctaaacatcctgtagtatataggacagcaccccacaacaaagaattatccagagtggcagcaggaatggagaatgttacagaggggaaatgatttgtcagcttggtgaagcactgcatatgtaaaaggcaaatcaggtgggtaaagttgaatgccactctaagtccaagtaattgatagagaaaagtagtaatggcaaactagtctggacaggagaaagtataccgagtttgaggtaaagtcattgcctcagaatatattgagtccatgttgtcacattttctataaatacgaatggcagaagtaatcttaatatgtatgatttaaaaatttgaattaactatagccatgtcctcatccccagttgccatcaaataactaaatctggatgtgaggctctgaaggtgaaggcaagaaactattagcagcttggagtcctttgtagaaatgtctgggttggtggggagagggtagtgtttataacagtgtatcttttataaatatttaaagtttgaaaatcagtttcttttcacagtttttttcaagttgtgtgtgatctatttttcatgtgttgcgtctctgtaggtgtgtatatgatatatatgtgaattagtaaaaaagaaaaatcctgctcagactcagcctgtacataggaatttctttttttggtactttacttaccagatttcagtcggtctactttgcaaccttacctgctacctatcatgatgactctttggcattagagtctcaaatctttcttggttcctgaaggaaaaaatgaaattgaggggtgacagcgtgctgacagccctcactcgctctcagcgcctcttctgcctgggctcccactttggcggcacttgaggagcccttcagcccaccgctgcactgtgggagcccctttctgggctggccaaggccggagccggctccttcagcttgcagggaggtgtggagggagaggcgcgagcgggaaccagggctgcagcacggcgcttgcgggccagctggagttccgggtgggcgtgggtttggcggccccgcactcggagtggccggccggccctgctggccccaggcagtgaggggcttagcacccgggccagtggctgccgagggtgtgctgggtcccccagcagtgccagcacaccggcgctgcactcgatttctcgccaggcctcagctgcctccccgtggggcagggcttgggacctgcagcccgccatgcctgagcctccccctcctccgtggggatcctgtgtggcccaagcctccccgacgagcactgtcccctgctccatggcgcccagtgccatcgaacacccaagggctgaggagtgcgggcgcatggcgcgggactggcaggcagctccacctgcggccctggtgcgggatctactgggtgaagccagctgggctcctgagtctggtggggacttggagaacctttatgtctagctaagggattgtaaatacaccagtcggcactctgtatctagctcaaggtttgtaaacacaccaatcagcaccctgtgtctagctcagggtttgtgaatgcaccagtccacactctgtatctagctactctggtggggacttggagaacctttgtgttgacactctgtatctagctcatctagtggggaggtggagaacctttgtgtctagctcagggattgtaaacgcgccaatcagcgccctgtcaaagcagaccactcggctctctgtaaaatgaaccaatcagcaggatgtgggtggggccagataagagaataaatgcaggctgcaggcaccagcagtggcaacccgctggggtccccttccactctgtggaagctttgttgtttcgttctttgcaataaatcttgctgctgctcgctctttgggtccacactgtgtttatgagctgtaacactcaccgcgaaggtctgcagcttcactcctgaagccagcgagaccacgaacccaccgggaggaacgaacaactccagacgcgccaccttaagagctgtaacactcactgcggaggtcccagcttcacacctgagccagcgagaccacgaaccccaccagaaggaagaaactcccaacacatccgaacatcagaaggaacaaactccggacacaccgccattaagaactgtaacactcaccgcgagggtccgcagcttcattcttgaagttagtgagaccaagaacccaccaattccggactcaaaattatattcagtatgtttagtttcacatattgagaattataacatcttggagttggaggagatactatacctcattgagtccagtggatcatccagtatttgattcctcctgtgttagtctctcaagctactgtaaattaccagaaacttgatgagataaacagcagaaatttgcctcacacagttctggaggccagaagtccaaaatcaaagtgtcatcagggccacactcctttctttatcctttccagcttctggtggctccaggcattgcccggcttgtggctgcataactaagctctgcctccatctgcacacaacctcttttccctttgtctcacctctgtgtttccttattacgatacttactagattgagggcccacctgaataataaaaaatgatctcaactcaagatccttaactattttagatcttttcatcaaataagttaacttaggtcccaaggattagaatatggacatatctttttggaggccgccgtgtaacccgctacatccactgaatacatgtgcattgtttgtgtttgtcgcccttctctacttggctgcctgtaaccaagatctttaggattttgaataactctgtagtgaaatcaatctcctgtaacgcatataccattcactttggttctccctgcttgaagccatgcagaaaaaaacgaattctttttctctctgaaagtccttcatttgttgtccctgagactgctatcctccaggacaaacacctctggttccttcaacaatttctctcaatactgacttctgttcccctaatcatcctgggtttgcttctctaaagcattcagaggcagtagagagaatactggatttattattgaagacctaatactgaagccatgtctcttccacttcctacttaggtgaccaagccaaatcagtttattttaaataacaataatactgactacttcattgtttcactgcatgctttatatagttaaatgagattgttataaacgttctctagaaacataacctttaagtaaggatatgagtgttcttctgtctatttataaaatactttcactcccagaactgaacataggtctctcggtacagtctaacctagtacaaagtagttatcactatcacgttccccagctgagctgctctgcttctgttaccgcagcctgggatcgcattagcttttttggtagtcatcgcataattcttaactcatattgaaactgttctgtactaaagagttccaaatatttttcacaaataatcttttttaaaaaaaattcaacaaatatttattgcgttctgctagtagcagtgcgtagagacttgacagagaggcaaagaggaagaaaataaaatttctgccctcttggagcctacagtatcataagggagacacacatgaaccaagtaatcacacagtgagtgtaaatttacaatctgagacagactggaaaaagaaagggttgcaaactgacctaagccagtttgatagttcacaatgatacaagtatttacagtagataaaggtgggctctgataattaagattggatttctgcagttctccccactaacctcttcaccacctgttgttagttagagtgacagtaaggctcagatggaattctgtcacacacgtaatctatttattgctttctaattccttgatttttctactatttatagaaagagctacaaggtatggttcaaataaggccatttgaagacagtagagtcggtgaattttcaatgtggaaatttaatttaatttgaaaataatattagccattttaattgaatataataataaattgtattgaatcttcataggaaatatatagttcatcctccagttatttaatgtaatactcctttaatgagtcctctttgtggtgttatggacctgcttctggttgtactttaatgaccacattcttatctaaagcttctatagcttgctaatgtaattctccaatataagatttgtatcttatgttctgacgataataggttttaccctttaaaatgggtatttttcaagattgatagatctataaatacatgtacttttgtaaagtaagatgaatgcatgatagttataagctattatactattcaacttcaagtgacctaagaatttgaaagcaatataaaatgtaaattctgtcctaatattcgatctgtctttgcattgccttatccgaaccataccttgtggctttttgtataaataagtcccactgaagtcataataaagtcaaatgttgtgaaatcaattttttaggaatgttgaagcttggttttcaatgtatgctgatctcaatttactcttctaacatacgaaacagtttctagatttataccttgaaaatagagatagctatgggtttggagagctgttcagatagtctacatttgaagcttatagaataacagctagacagcacagaggtttaggaccgtagtagattttctctaaagtgcccctgttgggtacttgcaaatacgtcgtttctttgcaggctaccccatctgaatttgaatgattcccagacatcttgcaacagcctggtgttacactttgcttatcctgaatttgctatgctgtcatttttatgcatctcaatttgaggccaaaccacatgtcctagtttattttttactgtttcaattaaatatgaagctctgtcttcttgatgggtgtgtgaagcatttggtgttcctttagtagagaataaatacagttcaggaccttgctcagtccccagtgcctataattttatagtgtaacaaatttacctttggatactatatagccagcaactcctgagaatttaatataaagcccttaaattctatttcctttattttattttctctagaaaataatatcctctaggctttatggaatgtatcttttcctcaggcaattaaaagacaattgaaattaagactagtaattgtcacctgccattcatttcaataagattattttattcttgagaataattgtatatcgcagaagtaaggaagatgaagttttcttcttgaccctaagtaataattgatctgtttgtaaagaaatctgtatcagatgctaaaacttttgcttgatcttaagaatcagaaaacaatgactagactataggtatgctctaaacttttcttcatttgcaggtgtaaagaaggggaatagtgaggggagttactctctaaaataactcattatctttatgaagatccagatctcatgcctttgttgctccagtgaggcaggttaaaatggaaattcatgtatgagagccttatggcatgagcacattgccttagagaagttgcatccaaatagccatccctgtaaatgtgaatgaatattttaatgaattttggctcatattggcactgttgatttcactggtcaccttaaaagaaacagaaatcttatatattgcttctaagtctgatttcttttccttcttaatcttcctctcccatttagtagaagttgagatgtcaggtccaagatattagagggaaaaatttctggtatcttaatcttagctaaggtggcaagtttatgatatgtaaataggaaccagtggcctcaactccttggggtgggttggtcactttcttaaacattagttccttgttctgtgacctgttcactttttcttttgaaagaaagcagccgttattctgacttaattaatattatgaagatgtcagtagattgcaatgactatagctaggtgacttagtccaattcagatgtttatgctgtatctaagaaacttcagcctctgttgacaacttggaggttgtatttactcagcttttgaaaatatctgatccttttttacctttcttaggtttccactgtatccaaaaggaggggagaagttgcagtttgattatggtgtctatcttctgaacaaaaatatagcacaggtaagtctctgttcttcacttctctcctacttcccatgcacagcctgtttccttagattgccagccttttttctttataaatatgcactgcagttgaccctcgcatttaaccagttacattagtaatacacagttcttttttttgatcacagtctttttccgtgcccttaaaatgactacagagaagcaatgaatacaaattggaatcctcttgctacttgctaaactcagaatctttttttgtatttttacttgctggtagactatacttcgatgtgtgggcttcatcatctcttgcctctgcagcttgaccaattgtaattttcttagactatttctagggactcaatttgcattgttgtttatggagtaaaagttcagtgcctttgcaagtacttcatggtctcctcactttattattcagggcccgaaggaaaagaccaagcacatgacccttccagtctgtcttagatgtttgtggcactctcaacatcacatcagttagtatgccacttaaataatgtctttccgtatgccgtagtaagactatcagatgcctaggtttgtattttcctgaaagaaatatgtagcatttctttagaacttctggccctacttcaagatgtaggcattccacaagttttctaattataaaggaagactaacttcctttgttttttatttttttttgtttttgtttttgagatggagtcttgctgtgtcacccaggctggagtgcaatggcgcgatctcggctcactgcaacctctacctcccgggttcaagtgattctcttgcctcagcctcccaagtaggtgggattacaggcgcatgccaccacgctcagctaatgttttgtgtttttagtagagacggggtttcaccgtgttaggcagatggtctcgatctgctgacctcgtgatccgcctgcctcagcctcccaaagtgctgggattacaggtgtgagcctttaaaacacccagcctatttatttttataaataacaagtgttttgttttgttttcattggacatccttccaactggaatatcacatggatgagtatccacaatttggcttttatttaaatacattgtgagctatatcctcagaccttttggttttaccaaagtaataagatttacgatgcttttgtttttgttggcctgtgttgccatttatccacatgaacctaacgacttgctaaacattcccttattcatttctgatcagtctagaattattcctctatgtggtgtcatctgccactcttccccttaaccaacctcagtttaatggtggagatttttttaatttgttttttattaagattgttgttctcttctgaaattgggtcagatttctggattgcaatcctcagtttatcatttgcttcatccttcacactcattgtcctctcaaccatactacttttactgttacttccactccagctccaggaaagcagccctctgacagtctctggcccatgactcacctttccatgtgccattcttcccacaactgatgcttgcccattctgcatttttggcagacaagtatttcattcaaagaagcagggctttaattccaagactgccgagctcccactccgctgatcacagttctgtcatgccatggaaaaggcagtgcttaaacagaacttgtcaaaagtgctcagactgaggccaggtgtggtggctcatgcctgtaatcccggtactttgggaggccgagatgggtggatcgcttgtggccaggagttggagaccagcctgggcaacatggcaaaaccccatctctactaaaaaatacaaaaattagccaggtgtggtggcatgcacctgtaatcccagctactggagaggctgaggcatgagaacctcttgaacccgggaggcagaagttgcagtgagctgagatcgtgccagtgcacttccagcctgggtgacagagcaagattctgtctcaaaaaaaaaaaagtgctcggactaagactgcactaaggaagaagtaaattagagggctcctccagcgatgtcagccgtggtggaaagagcatgtagatactacaggatccagtttgagagtaaaactggcatcatttagtagaactaagttctgatttgagttcagaacttctcttcttgccctattttctctttcttgctctaggcacttagatcctaaggtcagaaggctattggaagcttcctggtgaaacttactcctgctgaaatgcctgtatttcctcatatattccagcttcaaacatacacacaatatgcacatgtgtacagatatacacacacatgcacaaacacacttctttcttctcaagggcccaaaaggatggtatgccaaaagatcatataaagtgttgctaagaataccacagcttgctttgggagcaagaccaagatggaggctatgtgcaggggaaaacttagcaaagtcagccctcctcatcagactctcaactctagggcctgtttgatccccacttcccaagaggcctctgactttattattaactgaaccagggccacaagtatgctgacctagttttactcatctgagaaatggattgcttgtagtaattgtgtatcctctccagctttatatatgctctttgaaaattgagagaacaatcaataggttaactactctgaatccatagggagcaagtatcctcctctgtggattttctttttttaatcacactggaggcagttttaaaaggaggggacagtaaacttcttaaaaactggcttttttatatttcaaaatgtattcgggaagccctttaagcagttagaaacttttagaacagttgtgacctttcactttttttgcttcagctctgtctgttctgtctctcgctgtttctcagggaagctttcattttgtctttgaccttactgccatcactttttcacgttttgatttgtaacaaatgaaagaaccattaattgttatggctcctaagcgagcattgtagcaatcaggtatttccagcttttgaaggtttatttttatagacatatagactaatatatgttgtcaaaggggagtttgtcttctcagccagttccatatgtacccatcttttaagatgtgaacaaatcatactattaaaatggcctcacctcagtaatttataagccacattagtggaggtggatgaaagcattggcatgtgttaaagtgccagagaaaaaggagtgaagtcatttaatactgcatccataacttggttgaggatttgaatagtcaataggacctttcatcacaaccagaagtagtagtaaaatcacttttttggtagaggaaatgacagaatttagtaatatttgttacttcagtatttgggatcagtccagcccaagttttgaaagcacaagcttagagagacaggccttcaagtagaaatcctcaagtgttgtttgaagagctgagagcactggtaaggcctgcttgccctcttcatgtcactgctgtctaaaggtgtgtgtgtgtgctggattaagtactgagagtgagtgaagcaaaatgccttgttttcagcaccatatattaatatttgttaagtgccagcctcttcagttagaaatagccttccttcttggctagcatgtaatgctataggaatgggcctgtcaaaattcaggtgcagtataattgacgttgactttaaaaaccagatcctgccataatttcagttagttcataagtacattatattagaatttgtatagagaacagaaatttgcttttaattctcagagcataaaaattaaatggaaaacaaaaattataatacttttatcttatatttgtgggagccttatagtttgtaaagtacatgcatataaattcacatgatccctatcatcaccctgcaaagtaaaaagggcagatgctattaaatcgatttgaggacagcttggcttttgacatttgtccctccagtgtcatatcacataatttgataagtgtggcagagatccccttacttctatatacttcactgttctatatatttccatccttaaagtgcaccaaatcaaagaagacgacattcccagatagaaaaggaagcaaacgttttttgagaatggagacaaaaactattttgcacatcataatttttccattagcaagcacaatgccagaaacactgtaagttctaaagaaattaataatgaatggtgatatagcaccatcacacaagaaactaagatctagaaaagttaagtgactttaatgaattttaaaaattgtgatacacaaacacaacgcacacacacacaaatagaatattattcagcctctgtaaaggacatactgccatttgtgacaatacagatgaacctggaggatattatgctaagtgaaataagccagacactgaaagacaaagactgtatgatctcagtcatatgcagaatcttaaatgtaaaagttgaataactagaaacagagagtaggatagtgattcagtgggagggagaggaggaaataggaagaagcaggctaaagggtatacaaatttgcagttagataggctgcataagtctagggatataatatacagaatgaggattatagttagtaatattgtattgtgtactgaaaatttgtcaagagagtagatttctacagtttttatcacacacacccatgaatatgttaatttgtttgactgctataatcatttcactatgtatatgtatatcaaaacatcatgtataccttcaaacatcttgtaccccttaaattgatacaatataaaatttttttaaagttaggtgacttgcttataattcattagtttattcaacagtatttgttgagcatgtactgtgtgctgtgtacgctgagttaggttgcagtgggtagagcaatgaataagatacactagatccctgatccctgcctcgttaatatgctagacacaaaaggacaaatattgtagcgttccatttatataagtatctacaaaaagcaaactcatggagtcagaaagccacattagagggctgggggaataggagagctatattgcttaatgattacagtttccgttggggtgatgaaaaagttttggaaataggtggtgacaaccattatatatcattgtgtatgtaatcaatgtcactgaattttacacttaaacatggtttaaatggcaaatttgagttgtacactttaaatgggtgaattgtatgttatgtgaatcatatctcaataaagctgttttaataaaagaaaaagaaagatccctgtctcgttaagcttataacctgatgggaagagacatacaataaacagagaaagtcattttagattgcaataagtgctgtgatggaaattaattaggtgatataatagaaaataagtggaaaaggacctactttagattaaattgtcaaataacccttattgaggaagtgactgttgagcttagatatgaatgatgacaaggaactagccatgcaaccagctaaggaacagaaagttcctgaaggtcatgggaatagcaagggcaaagtccctgaggtaggaaagagctatgttgaggtaacagatggaaggctgatgtggcaggagtgtagtaattgagtggcagaggtacccagggagcatagcacataaaacctcagagaccacagcagagtttcctaaattattctaaatacaaagggaaaccattgagggaagatttaagcaggaaagtggcatgatttgatatgttttttcccaacgatcattctagctactacttttttttggccccacccacccatctccacattctagctactttaatggattgcagggaactagagttgaagcagagttaccagttagaaggctatttcagaagaccagattaggggcaatggtggtttggatcaggatggtaggggtagagatggagagaagtgaacagatttgaaatatattatgggacatgaactagtggactgaacgtgggagatgagggaaaaaaaggaatgtcaagaatgactcctaggttttgtgtatgagcaactcctttaatgttactgccatttattgagatggagaaagatccaggagatgggagtggggcaaccaaaagatcttctttgcaaatgttaagtttgagttacctattagaaatccaagtagacaacaggatatataagtctggatctcaggactggaggtcagtacagggtatagaaatttgggactcatcaacataaggatggtatttaaatccagagaactagatgagattacccagggagagaacgcagagctgaaaagagagagagacaaatacagacacacacgtacagtgggatttaatcctgggaaattacatttagaagttgaatagaggaggaagaaccagcaaaaactgagaggaatggacagtcaggtagggagaaaatgaagagagagtagtaatttggaaactaagaggagtaaatttctgaatagaagaagtcatcagtatgtccagttatgggtttgtaactggagatgactatgggattaagggaagtttctttttgtttttgtttttgttttcaacctgtttgttttgtgggaatgtagaatggtttgtttgctttgttttttaagatggcagatatcaaggcatgtttatgctgatgagagtgagcctttgctcttgccacttatcccaaattgcctttttcagatgcatgaaggatggtgggctctgggtaaggaagagaacagggaaaaagtccagctcattatttatcttataaaaggaagacttttgataggtatgatataaatgtatagttcttaaccacaactcacaccatactgtgaatatatttttaatgtgaagatgaattggccatctatataggcattgaattagtttaacttttgaatacagtgaagagagctatactgaaactaaataattttcttccagattgttggtactgagcctttagtagattttctgaatagtttcacatgagtgtgccaactgtacagaatttaagtgacagattcctttttcttctagagcagcagtgtaatcagtccctggttccttggggatccccaacaccctcagtaggtctgggagggcggaattattttcataataatactaagacatttttgcctgtttcactgtattgacatttacatgatggtggctaaaattgctggccacttagaacaaatcaaggcagagggactaaactcagctagcagtatttgtcttctgtaagactgtgtactcatagtttatatatatatatttaaaatggggttcaattaagaatgtccttaatgaagcagtaaaaattattgattatattaaatcatgacccctgagtgcacaccttcttaatattctgtgtgttggaaagagaatatgcataaatcacttctgctgcatactgaagtacagtggttgtttcaaggaaaagcacatgtgcaatcgagttgctaagtgaactaccttcttttttaaaagccttgtctttacttgaaagaatgactgacaaattatggttatttagacttaagtatttggcaaacattttctcaaaactgaatgaagtgagcctgtctcttaaaggaaatcaactgatgataaaattcaggattttaaatgaaaattagaattccagatcgcttgtgtctgccaccatgagattggcagctgcccaatccttaaggatttttttgataagattggtagtgataataacacatgtgatttttaaatagtttataatggaatgtgtcagcattaaaaatatatataactcaatgagccaatgttttccaaatgaccattgtataatgctatgaaatcatacgtaggtaaagatcctttcaaagtgccagaaagaccaatggattttaatgtaaaagagtatgaaaactttattgatagggtttcagattctgcattgctactagtacctttaaaaagctattacttaatgaggttgggagtagtatcaaacaagaatatccacaaccatctgaaaaagcacttaaaatactcctttctttttcagctgcgtatctgtataaggctggattttcttactaaacaacacatggtaacaatgagtgcagaagacaatgtgagactccagctggcttctattaagctagacattgcaaaacagacttgcaaaaatgtaaaacaatgtcactcatctcactaagtttcttttttggaaaatttgcttatttttcattaaaaatattatttatattaacaagtaatagattgctattgctatttttggaagaattcacaaacatgcaaaagttttcttaatttcaatttttaatatgataattattgatacatatgacccatataaatgaaagccctttggggtcctcagtcattttaagagtataaagggatcttgagactaaacttttgagaaccactgtcttagagaatgtggccatccagattttctgtgaaactcttcaattgctccaagacacatgtgtcatttccccaaatgtggaaacataatatgagagacctaccaatttgcattccaggaatgatatgtagtacaagtcagaaggctagcagctatcagtggattcttccttgttgcttttgtaagccaggcctcttctctccttttctgaaagctcaatatttaagagtattactttgagggtatattgtacaaataataatgatgatttacatttgtatagaatgtaatggctttggagtgtgtatttttatttgtgtagctcatttcatactctatgaagtatgttgaccaagtctgtctttagagataagaaattgagctgctgctatgctgatttcctggggatgacaaagctattaaatggcaagcaattcaaaaccaaatccagttatatcctactaacattatttgtttttctttttaatttgggccttcctacaattctgtgagttagacagggcatagacaattatctgcattttacagaagagccccctgagacagtgagttaagtagaagagctaaaattagaacctggggatttcatgactcccttccttttaccctattacttctcttccccttcaagttaagacttcatagaaagtaaaaatagcttctccatccaaaacagctgggaacccctgttctgccaaggacgtgatccttctgtaaatctttactcctggggcccacagtgcacagctatttagaagggatcaatgccagcttctacccagcagcttaaattcatgtatatttctttaacatacagccaaatgtatgtgacacatgagaagaaaatatgcttttattttcataattcttggaatcaaaaatataaattccaaggatgttttaatagtcaaaatgcctttccccaactactgcatacaaaatttgccaataataatggtggaagctctttataaaaagtactaaatttaaaaaaaagtttactgagatatatttcacataacatacaattaacccatttaaattgtacaattcaggccaggcgtggtggctcacacctgtaatgccagcactttgggaggccgaggtgggcggatcacttgaggtcaggagtttgagaccagcctggccaacatggtgaaaccctgtctctactaaaaaaatacaaaaattagccgggcagggttgcagtcgcctgtaatcccagctacttgggaggctgaggcaggagtgaaggagtggcttgtacctgggaggcggaggttgcatgagccatgccactgcactccagcctaggcaatagaacaagactgtgtctcaaaaaaaaaaaaaagtatatagttcagtggcttttaatatattcaccaaattgtgcaactatcaccacggtcaattatagaacattttcattgcccccaaaagaaaccctgtacccactagtagtcattcctcattccctcaggttccccatccctgggcagctaccagcctactttctgtttctatagatttgctgttctggacatttcttacaaatggaatcataaaatatgtggtcttctgtaactggctttatttgctttccataggctcaaggtttatccattttgtagcatgtatgagtcattcctttttgtagccaattttttttgcagttggaagatgtgtatgtatatacgacatgttatttatccatttacgagttgatagacttttgggatgtttccatttcttggctgttataagaatgctgttatgaacatttgggtacaagtttttgtggggatatagttttcattattttggggtgtatacctaggagtggaattgctgagccatatggtagctatgtttaaatttgaggaattgccagactgttttctaaagtggcaacaccattttacattcccactactaatgtacaaaggttctgtattagtctgttctcatgctgctaataaagacatagccatgactgggtaatttataaaggaaagaggcttaatggactcacagatccacatgactagggaggcctcacgatcatggtagaaggcaaagtagaagcaattttactgtgttacatggcagcaagcaagagggcgtgtgcaggggaactcccctttataaatctgatctcacatcagatcttgtgagacttattcactatcacaagaacagcacaggaaagacctgctcccatgattcaattacctcccactgggtccctcccatgacacgtggaattatgggagctacaattcaagatgagatttgggtggggacacagccaaacggtatcaggttccaattgctctgtatcctcaccaacacttatttttcttttttattatagccatcctactagttgtaaatggttttgacttgaattttttctaatggctaatgatgttgagtgtcattactcttttatgtacttattggccatttgtatatcttctttggagaaataactattccaaccctttgaccatttttaaattaggttgtatttatttatttatttatttatttatttattagaggcagatgacaagaccccataataaaaaaattagcagggtgtggtggtgtccaactgtggttccagccacttgggaggctgagatgggaaaatcacctgagtccaggaggtcaaggctgcagtgagctgtgattgtaccattgcactccagcctgggcgacatggcaaaccctgtctcaaaaaaaaaaaaagatgtctattgaaagaatgaatgatgaatgagtcagtcagagattgttctttcctctttaaggttgataattaaacaactcatttctgtttaatgtatattatatattgtatatataaaatatataatatatgtaaatattatatatacacacacacacatctcttgtatctatttaatgttttaattgaggtcaaaaaattatatttatttatacatagttttttccaaaagttctattctgtgtttaaagggataacatactgcatttttctagttgcaaatgattggttaagtgttcatgtattaatttttctgagagccatcattagctattaaccaatgtgctagacatttttaatgtcattgactatgattactgtactctttgattgctgaaagtgtaaattgataaaactttttatctcagttggacattttttccttttaaactgaaactacaaatacagtgccaaaaatatatttccaaatgaaaaataaaacaattgtaacttacatatatagcttattttagggcacagggccctttcacatatattatttcttttatcctttgcagaaacccttaaagtgttggtattattatcttcattttacatttagataaactgagcctctgaagggtgagtcttttgctcatagtcacacagctgttagataaacaaagaaattcagaccctaatatctgactctaagttcaggagaccgtacttgctgctttccttttgtcagacaggaagaaacatcttacataacaggcttccctttttttctgtggctaatagctcaatataaatttagcaccttacttggcttaccatctttgataacatctatctcttcctttatcctagttgttttaaaagattcactttagcctttttacttgttcagtaataagattagccttttccaaagcaccaccatgagtgacatcttttgctgggaggaaaatatttaaagaatgtacctcaactgaaatgaaatatgcagtgctagctagttcagagaggatggcatataaattctcactatactttttatgattaagcatcatgaaatgaattatgagctatatgaaaaatgaatttggtctgattttagttggcatcaaagtgaccggcatagcttaggtgtaagctctttaaagagatgagctccaaaaaaatggtttatattgcctgattcaaaacccaaagtctctagattttaggggaaggtagcacagtagatttgaaattctaaattttggaacttttaatgatgttatgttttgctaatttatctttttgaaagagagactactttcaccaacatacccacagttatctgtggatagacccatatcataattctgtatttaaaataataactttgtagatatttctgtaaattattggtttaaaaatatatatattataaatgcagactagcactttacatttaaataattaaattatttaggtagatgcaatgaaaggaatgaaattttgtcatccacagatttcaaaaaggtggatgaaatgatttaatggaaagaacataacaccaacaattagaaatttcaaggttagaccgggtgcggtggctcacacctgtaatcccagcactttgggaggccgaggtgtgcggatcacgaggtcaggagattgagaccatcctggctaacacagtgaaaccctgtctttactctactaaaaatacaaaaaaaaaaaaaaaaaaaaaaaaaaaattagctgggtgtggtggcggacacctgtagtcccagctactcaggaggctgaggcaggagaatgatgtgaacccaggaggcggagctggcagtgagctgagatcgcaccactgcactccagcctgggctacagagcaagactctgtctcagaaaaaaaagaaatttcagggttatattccatcacttttaacttgccagtaccttgggcagatagtatctttctgctgtgtctcagacttctcatctaaagaatcaaaaagttgagtattatgtgccctgagccccatgtcagcaccatgttctttacatctctgcttcttaactttaccactcttataatttagtctgttcattgctttttcaaaatcacttttaagttgtttgactcgcgacagcatgatcaaaaaggttttaagattcttgcaaggtgcagtggctcaagcctgtaattccaacattttgggaggccaaggcaggaggatcacttgagctcaggagttcgagaccagcctgggcagcacaacaagacctcatctctacaaaaaattaaaaaaattatccggacatagtggcttgtgcctgtagtcccaactactcaggaggctgaggcaggaggattgtttgagcctaggtgttaaaggctttagtgagctatgattgtgccactgcactccagccagggcgacagtgaaaccctgtctcaaaaaaaagaaaaaaaaaaagattaagatgaaatgtacaaatagtatgcttatatattggtgattttgtttttagaaaatattcagagatttatggagtaccatactaggcttatgtaagtccaatacaatatggacttataaaactaatgataatactatcttacatttatgtagtgccttacagttttcaaagcattctcataagaagctcatatacttaccctcacaattttttctctgaagtagaattagtaagaatttctgcctttgatttagtagttcatcttgggaactctagcataaggaaataattctaacttcctgaaaacagttaaatatgtttatcataactgaaaatagttatctgggaataggttaaataaatgaaggagcattgccttcattcgttttctgctgctataacagaatatcatggactaggtaattaataaagaaaagagatttgtttggctcatggttcgggaagctgggacgtctgagagcatggcaccaacatcaagcaagcatcaacccatggcagatgtgagatggagagaggaaaattggactgaattcacccctttattaggagcccactcttgtagtaatggcattaatccattcatgagggtggagccttcatgacctaatcacctcttaaaggttccaccccttaatactgtgacagtggcaaccaaatttcaacatgaggtttggaggggacatttaaaacatagcaagcattcactgtgattaaaatttttgtgaagattaggtagcatagaaatacctttgttattagtgtagaaaagagagcatggggttgaaggcacactgtggttacagatattaaaataattttaaaggcaccaaacaaactaccctgtatataggagggaaaagactgcctggttgtataccaaaactgtgttacatgtttgttttgtgggacttcagataatccttctacttacctttttatttatttttattgagcacatattgcttttataatagaatatatatatataaattatttttttcagacaaaaactgaatcctagtgaagttttttgacattctcaaaatggtacaaatggttaatggtgaacctgggacaagaaaccagttttcttctcttaatctattcgttagtacgttcaaattatagaatattccagcagatacagaaatttcagctttaaagaggctggtcaagctatgtattttttctcagtaacgtgtacttcctctttaagattcattagcccatagtcaaattgacaaaatcagtgttattttttcatactttgtaaaacacagctatattccctctagctgagtatgtttccagacagtatatgtggttaggagaacaagtacagacagacatggattcacttcctgatcagtgttgccacttgataactgtggccttgtgagtttctaggcctcagtttccctacttaaataatgagattcacaaattccgttgtaaaacgtaatgctaacttttctaaactgccctaaaacatttctgtgtctgtccccattgtgttcacatttataaatagtagttgtatttcattgtttccagattcccttgcaaggcagcttaatgccttggaaagagctctagattgtgttctagcttcagagttgcttctaactctttggttttctaactcattgtccctcttattcactgtaacattgagccagtctctctctttttttttttgagatggtctcgctctgttgcccaggctggagtacaatggcgcaatcttgactcactgcaacctccacctcctgggttcaggccattctcctacctcagcctcccgagtagctgagattacaggcacctgccaccacgcccaactagtttttatatttttagtagagacagagtttcaccatgttggccaggctggttctgaactcctgacctccaatgatctgcccgcctctgcctcccaaagtgctgggattacaggtgtgagtgaccgaccgcacctggccaagttagtctctaatttttctaagccttggctccttctaaaataagaaacttgaagtaaataatcttttcatttccttctaacagtaatattctacaatttctcccagtctagttttgagcacatgtatgattttaaaaaaaaacaataataaaccggttactcttaaattagaggtgatgggagggtagattgatcatttaaaaaaataatttgacattatgcagtgaaattgaagatttgtatatgagaatgtttatagcaccactattcataatagctgaagattagaaacaacttaaaatatatcgacaatatgttcatcattaattaaggtatatttatgtaatcaaatactgtgcagccatgaaaccatagcaatgatagggacgaatttcaccagcatgatgtagagtaaaagaaccaaagcaaaaaaaaaaaaaaaaatccacaatcatcctctatttatgtatagttcaaaaccaagcaagattaaacgatattatttaggaatgaaaactatacaaaaaaacaagggtagtgactaactacctctggaagtgagaaggggttataatgagaaaggggcttgtggaaggcttctggggcaccagcagcattgtatttcttgaccgagtggtggtaacacaggggtttgctttataatcctgatcctttaaacaatgtgtatgtgtgtttcatttatttttctatatgcatattatatcttgccattaaaaaatcataggtggctaggcacggtggctcacgcctgtaatcccagcactttgggaggccgaggcgggcagatcacgaggtcaggagatcgagaccatcctggctaacacggtgaaaccctgtctctactaaaaatacaaaaaattagccaggcgtggtgtcgggcgcctgtaatcccagctactcgggaggctgaggcaggagaatggcatgaacccgggaggcggagcttgcagtgagcggagatggcaccactgcactccagcctgggcaacagagcgagactccgtcccaaaaaaaaaaaaaaaaaaaaacataggtaacaattttttaaactgtataacactatttcatcaaattcttgtcatctcttgaaaaataattgccattacaaaggatggcaaggacttcgtatttcagcatcatatatcagaagaaaaagaattttcagctagagcgcttaagcattgtcttagctttacacataagaatatctactttgggccaggtatggtggctcatgcttgtaatcctagcactttgggagaccgaggcagatggatcacttgagcccaggagttcaagaccaacctgagcaacatgatgaaacctcatctctactaaaaatgcaaaaaaatcctagctgggtgtggtgattcacacctctagtcccaattacttaggaggctgaggtgggaggattgattcccaggaggtcaaggccacagtgagctgagattgcaccactgcactccagcctgggtgacagagaccgtgtctcaaaaaaagagtatctgcttttgatcacacaatatatccttgtaacaaatctgcatgtgtaccccctgaatctaaaagtttaaactaaaacaaaaaagaatatctgcttttattgatacctatatgcaaagagtgtcttattctttattcctagtcttcacaataacctttcaggtttttgttattatcctcattttacaggtgaggaaacaggtatagaatattttggtggatgaggaatttttaaaaaataattgaaacatctgcatggaccatttttggtatttttttttctccttcatgttataaaaagataaattacaaacaagatttgtgaccattttagggatgtatactattaaaataagccctaaacaaaagaatagactgagttttggctgttttttctttcaaatgtacctggaagtatgtaagatttcccaaatgcctaatagtaaacgagcttttgggtattggggcatttgccacttataggtcaagcccctgcactgagtgttgaaataaagcctaattagaagagaaagtgagagaaacaatgtctacatttttaatacactaattgtggtggtcactctatacaaagtttgctgaactatgaccactaagctaaccgggaagaggaaattactttgtataaccaagccaaaaaatttttttttagatttagttcataatgtcacttaagattcttctgaaaggcttgtgaacctttgccttcttttaataagccttcataatgacaaggtcccctgagaatgaaatcatctgaacggaatgtgcctgtgtcttaaaatctgataaacatcacttcatgttattcaggagatcaaaagagacttaaaacacgtaaatgttactttcaggttattataaccaaggaagcctgtggcccagctatcaaaataacttagctttagcaagttctaagcagtgggcttagccaggttggttagtgctgccttaggactgaccgcactgtcttttgagttgacctgtaactttcaatgtagaatgtaagtgcttcatctctgaggcacatttatgtgtcccttagctcctgacactaattcatcatttgctttatagtaattccactcagacatcatcatcaagccccagtggaggctactaaatgatgtgagtggatatatttcctaatcagtgacattagtttatatctccttattaagatacccattaaattcataccaggagagataacatgaacgctaatgcactttacatcttccatcagtgctttcttatttatttctataaaggcggtattaatatctgaatttaagagtccaagagaatgtaccgcttttattaatggtctaagatcttttattttgttaagaaatggaagatgtgaaaagcaaagacatttattatcatgttgtcatttttattctctttccctgcctagaacatagccattaaaatatacatactatcatttatttttaaagttgttaatatattttatatactttttccaataaaatgtatgatccgagttttcctgtattttatctttataagttatcttatttttctcattttagtctgaaactcagaatatatatagtgttttgtggacgttttggatataccagccaaaaagtattaattgaatatactatactaggctctgggtggtggtggagggaaacagaagaagttgctttatgtgacaaatagttcacatgtgtataaaatctaattgttctggccagtcgcagtggctcatgcctgtaatcccagcactttgggaggctgaggaaggcagatcacttggggtcaggagttggagaccagcctggccaatgtgaaaccccatttctactaaaaatgccccccaaaaattagccaggcatggtggcgggtgcctgtaatcccagctactcaagaggctgaggcgtgagaattgcttgaacctgggaggcagaggttgcagtgagccgagattgcaccattgcactccagcctgggggacagagcgagaccctgtctcaaaaaaaaaaaaaaaaaaaaaaaaaatctaattgttctgatgaatcccccaccacattgccttaaccagaatagtttgttcaacagatatttcttcatttattatatccttttgagacatttggcaaagttactaatgtgatttatcatttgaggaatccataaattactgtgttcaggaactatagcaacatcatggcaatgtggtcccctttgtttggctctggctttttgctgttattgctttctcagaactgataactttttttaacaattaaagtataaattgtgctgggattgtctgtgtcagtgctcgtcaaagtgtgatccacaggccagcaggcagtctgtagtccatagagcttgttgtcagtctgcagtaagataaggaaattgtaccaaatgtgaatcaattgtgtcaccaaacacactacttagttcagatgcaaatttttcttttgtatcaagacattctggatgaaggaagcagggcatttatttatattctctcactagcttctttgttacatactggcactttagccttggagtttaggcaaatataaaaagcagaatataatatccttttaaaaatcagattttctttttcaccttgcagggactttattatatatacatctgcttgtctgctacaggggaaaccactctaagctgggcattggcaaatcacattacttatgtcagtggaaggcacatttagcatttttcagcattaggtcttgtgatcaaggtaagcaggtttgtcattgtcatatttccacgtccttttccatgtgtgtttttcacaactcatctatcagcttgtatttctggagctctttctacatgtcagacaccccatgcctgctgacacccagtgccctcattctactctgttaaagccatgagccctgaagttggtgcaccaccaaaatccactttccctcccagttccatagtatgcaaagttccattccctcagtaagcagatagctgactaactgaagggaaaacaacctgctttaaataagtaacacgggtaattcaccttctgcttacatatttgtaatttaaaattcgggcctgttaatggaactatataagacatatttttgaaccatggatgccctcgcttaatcatgaacttaaatctttctttagttttttccatcatgtattctagaaagatttgtctttacacatctgtaaagctgctcactcctgccctaaagtgggtattggattttcccacaaccttttactttgtttggtaaccttcttgcatggaataaccttggacagggagacatgaatccaggaaaccaatcagaactattcttcgtatgtttaaggatttaaagtattggctgtattttgttttcagttgtaagtatcctttcatatttgaaattaattagatagagatttggtctattttttaatgtgttcccagatctttgatggcttgttaacatgatgtagtagactaggaacttctagttttgctttcatacttttaaaaactaaagtgcatgtttcataaaattaaagtgcctcaagagtcagctaatataaagtaatattttaccaaggtcataagtgatttaatatgaaagatcatattttatcataagcataacagacttaacaaaatctagacagacaaattgctagtttagaaatgatctgaacttatttttcccaaaaaaacaaagacccgcaagactgtgtatatatggcaacaggcattatttcattgatccccaaggctgtggatctagcagcagctattataacatgctttgttttcattattgcaatgcttagttagtcatctgaattctagctgttgctgtttatagcaagaaatagcatcccagctgaggcagcacagctagtcatacctttttattgatgtaatttaacttattttgtttcctttcctagtgtctaacattttgtgaagccctaacataaattattggcttgtataacccactgcatcaacttcacttggagatttgctgcctatgcagttccttaattttcaagtgtgagagatttatttttcctcagtgagtcctaatgtttctacatgcgcacacacatacatgtgcttgtgaatgtgtgtgtaggtacataggaatgccagtgagaaagtcaaacatattcttggttaattcctgcatgatattctggagaagtatttacaattacagatatgagttgccatgttctaaaattgaccggtgagcagtatggtaggtagtgtttttaaattttgtccctactttgttttcttttccttagagactctgactaattaggactctgcacgcttcatgtcctcagtgaatacttattgactgcatcacagaccaattgatttatcatacaccaatgtaaatggctaaaatactgccacagatgataatcataattactgtgtgtcagacaaggcacttcagtcctcatagcatgaggactgtaatatagatggaattctccctggtttacaaatgagaacttcgaagctcggaaaaattaaacaaattgcccttgttatacagctttataaatgaaggatcaagatactttatcaaagtatttttatgtgtattatttcctttgatccttatagcattccttaaggtggacagaacaagtccttctctattcccattttagaactgagtaaagaggtttagtaatttacccatggttactacagcgggcctgattgtcaggactatcctctgaaccctgatactacttggcatttgtaagcgtttagttgttttggttttttgttttgttttgttttgtttttgagacaagatctcactctgttgctcagactggagcgcagtggtgcaatcacagctcactgcagcctagacctccctggggtcaggtgatcttcccagtagctccctggggtcaggtggctactcctagcctctcgagtagccaggactacaggcatatgccaccacacctggctgatttttatatggttttttgagtcagagttttgccacgttgcccaggctggtctcaaacttatgggctcaagcgatagtgatgggattacaggcatgagccaccacatccagccccatttgtgaaaattcataagccagtaatgacatcagtgataccattatagcgcccctatagtagtttccattggctgatttttgtcacttaagtaattcttcattgcctctactaaggtagagtcctgctgaaatacttggcatttaggtaagcacttttataatgagaaaaacgaggacgaggggtgggaagtttgcaaatctgttatgtccacccctgcttaaaaccttgtcatcgttttccataggctaccttcccccaaatcccatcttctcctatgccacccccaacccccacttccgcccacccgcgccccctcccccgccttgcaacaagactcttttgcatggcaaagtcttcacatgatctatctgtcttctctctcacgtttcagcctcaactcctgcaaccacttaccccaaaacctccgccactggccctttatgccaggaaagctgaacatcactgaaaggcccatcttctgcttttgcttttatattccctttgcctgaaatttccttccccttttgtccatgtggtaaactcccactcattctccaggatccaaccaggccaacttctcttctgtgaagcctttctttgccctcctgaacagagttatcacccatcttctattcttcctgctcaccttgttttaaaaaacaagtaatcgatcaaatatgtgaatattcttacatttctgttgttattttgcatgtatgtctcccctactaaattaataagttccttaagggccagagactgaggttcattcatctctttatccagacacagtagctagcacataacatggactcaggaaaggtttgcacatgcatgatagactgaaccagtgaccttcctgcatggactaaaaacttaagaactcatctctgaaaggaatagccttccatttaaaaggcaaagggagttcacatttgtatcaaatgaaattacagtcttacttatagatatgcctggctttgcttgtgtctaggaagataatgcagggctttgagaagtggggtgagattaaggagaaattatacagtaagcgaacattttccccaaaatatatgcctgtggtaataagttgttatatgttgagtgactttttctcttctagtcagagagctgacaaatattttcaaagtgttatagtgttttctaagtgttattctttcactgacaattttatttaataattttagatacagtagtggctctagagctaactgaattactggcttatatgtaattcagctagtatattcatattgacagtataggagagatgattaccagctcacaaagaatgcatgacgcgatgccatttgaagaattgaaaatggaaggaagggggtatgtgaatttagataactcaaccctagagttctggcctattagccctttggttttagttttataaaattatacatgctgttaaagagtcaaatagatccttaaggctaattgtgagaaacagtatttctgcttgtttcccagaggtaacgactttcaacaatcttagcagattatgttactacttgcctctaaataatttgataatgttgatgcttcttggattttgttcgatttcttctgatttcttcagtaggagatgagactttagttccctttcacacattcatatcccctttctgttcccccattctacctgagaaataaaaataaattcctaagcctcccaaccaactgaacataccccgttttggccagaaggaccctggagaaaccctaaaaactgagtttccagctgtgatgggataggaagttggacctgccttattctacctccgccctcgctagccaccattcggtgttctttcccaagggctaaatggaaaccagccctttagaaagacttcctgcacctctgatttcaaccaatctcctgactgcacctccatttttatgtttcaaatgcagcaactggtcagcatttcttcctgataagagaccacactgactgtggagtggttctgccagtctacagaggctgtgcacagaggcctttcatgtcctcgctttaccttttgatgtacagggcctacttgtaatacatttaaatgttaagtctctaccccaaagtgagcatggtgtgcagactgtatacatattagcctactacgcctgcttgtgcttccccttcatgaatattcataactcctcctataacctgttgaatgtatatacttagccaacccactcagcataaattcccattccctttaaccctccctggcagtgcctatttccagcttctggccagaggctatccttcccagtctgtcagaatggctacctgcaggctgcaaccctttatgagaaataaagctctcctttccagacttaggaaccttgtcattcttcagttgacctaccgttataggttttcaaattactttgtctatataaataccactcagataagccatgtagtatactgtgattactttttttcccctaatgttttttatttcctttggagcttattttcttattttttctttgattagttttcagtgtgcttataactaatttcatcctaaattctctaccagttatctaatcacctctcaagatattcagacatgttagatatacaataaattacatatcgggtattcacacaatttcatctttgggagaaatctctcctagaacttctgatctgctgcagtctgtcatattgttttctatggctttaccataatcctagggatttccataatttctcttatgttgaaacctctattttctagataaatcctcacaaagaatgcatgacatgatgtcttcctctttctcagtgttctcccttgttttgttggagcatatccttctatagcttcctaagaaagcatgcatggagataaatttttgagaccttgtaaatctgaaaattatctttattcttctctgactgaaatggaatgttaggctggaaacaattttccttaagattttgaaatcattgttctattatattttagcttccagtgttactgaaaaatctagagatatttgattccccctttttgtatgtgaaatattatttacttattttgctttgccttgctttttatttttagaaatttgtaggaactgtatttgtgcccaatgttctgaaatctcagactgataagtctgtttttatctgttgtgctcggcactcaatggatctttttaacccaaaagctcaaatcattaagttctgggaaaattccttgaattacttcattaatggtttactcccttttatttttttttatatctcttcctggactactatcgtttagatattaggtttcctgtactgctcctgtaattttcttacttcttctctcctgttttctatctctttgtctttttgttctacctctggagagatttgcttaccttcatcttcttgcccttgtgtttttcattttggctttcatatttttaatttctaagagttctttttctctgaatagcatcttattgttctatgtgtgtaatatcttctcttttccacttgagcatattaatgatttttgaaatttttattgttgtttttgttttggacttgatatatcatttgtattagaagcttttcttagaagtttggagatacccgattgtatatttgttttttttttattattctttaagttctagggtacatgtccacaacgtgcaggtttgttacatatgtatacatgtgccttgttggtgtgctgcacccattaattcgtcatttacattgggtatatctcctaatgctttccctcccccttcccccgaccccacaacaggccccggcgtgtgatattccccttcctatgtacaagtgttctcattgttcaattcccacctatgagtgagaacatgctgtggtgtttggttttttgttcttgagatagtttgctgagaatgatggtttccagcttcatccatgtccctacaaaggacatgaactcatccttttttatggctgcatagtattccatggtgtatatgtgccacattttcttaatccagtctatcattgatggacatttgggttggttccaagtctttgctattgtgaatagtgccgcagtaaacatacatgtgcatgtgcctttatagcagcatgatttataatcctttgggtatatacccagtaataggatggctgggtcaaatggtatttctagttctagatccttgaggaatcgccacactgtcttccacaatggttgaactagtttacagtcccaccaacagtgtaaaagcattcctatttctccacatcctctccagcacctgttgtttcctgactttttaatgatcgccattctaattggcgtgagatggtatctcattgtggttttgatttgcatttctctgatggccagtgatgatgagcattttgtcatgtgtctgttggctgcataaatgtcttcttttgagaagtgtctgttcatatccttcacccactttttgatggggttgttttttttcttgtaaatttgtttgagttcattgtagattctggatattagccctttgtcagatgagtagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccgtttcttgtttttgtcaggtttgtcaaagatcagatggttgtagatgtgtggcattatttctgagggctctgttctgttccattggtctatatctctgttttggtaccagtaccatgctgttttggtaccagtaccatgctgttttggttactgtagccttgtagtgtagtttggagtcaggtagcgtgatgcctccagctttgttcttttcgctcaggattgtcttgacaatgcgggctcttttttggttccatatgaactttaaagtagttttgtccaattctgtgaagaaagtcattggtagcttgatggggatggcattgaatctataaattaccttgggcagtatggccattttcacaatattgattcttcctatccatgagcatggaatgttcttccatttgtttgtatcctcttttatttagttgagcagtggttttagtagttctccttgaagaggtccttcacctccctgtgtaggttagattcctaggtattttattctcttcgtagtaattgtgaatgagagttcactcatgatttggctctttgtttgtgtgttcttggtgtataggaatgcttgtgatttttgcacattgattttgtatcctgagactttgctgaagttgcttgtcagcttaaggagattttgggctgcgacagtggggttttctaaatatacaatcatgtcatctgcaaacagagacaatttgacttcctgttttcctaattgaatatcctgtatttctttctcttgcctgactgccctggccagaagtaccaataccatgttgaataggagtgatgagagagggcatccttgtcttgtgccggtttnnnnnnnnnnnnnnnnnnnnaattaccttgggcagtatggccattttcacaatattgattcttcctatccatgagcatggaatgttcttccatttgtttgtatcctcttttatttaattgagcaatggtttgtagttctccttgaagaggtccttcacctcccttgtaagttagattcctaggtattttattctctttgaagcagttgtgaatgggagttcactcatgttttggctctttgtttgtctgttattggtgtataagaattcttgtgatttttgcacattgattttgtatcctgagactttgctaaagttacttattggcttaaagagatgttgggctgagacaatggggttttctagatatacaatcatgtcatctgcaaacagggacaatttgacttcctcttttcctaattgaataccctttatttctttctcctgcctgattgccctggccagaacttctaacactatattgaataggagtggtgagagagggcatccctgtcttgtgccagttttcaaagagaatgcttccagtttttgtccattcagtatgatgttggctgtgggtttgtcataaatagctcttattattttgagatacgccccatcaatacctaatttattgagagtttttagcatgcagggctgttgaatttgtcaaaggccttttctgcatctattgagataatcatgtggtttttgtctttggttctgtttatatgctggattacgtttattgatttgtgtatgttgaaccagccttgcatcccagggatgaagcccacttgatcatggtggataagctttttgatgtgctgctggattcagtttgccagtattttatagaggatttttgcatcgatgttcataagggatattggtttgaaattctctttttttgttgactctctgccaggctttgctatcaggatgatgttggcctcataaaatgagttagggaggaatccctctttttctcttgattggaatagtttcagaaggaatggtaccagctcctccttgtacctccggtagaatttggctgtgaatccgtctggtcctggactttttttggttggtaggctatcaattattgcctcaatttcagagcctgttaattggtctattcagggattccatttcttcctggtttagtcttgggagagtgtatgtgtccgggaatttatccatttcttctagattttctagtttatttgcatagaggtgtttatagtattctctgatggtagtttatatctctgtgggatcggtggtgatatcccctttatcattttttattgcatctatttgtttcttctctcttttcttctttattgtatatttgtttttaagaggaaagaactagaaaattaattggaagcttggagcatgtggacagggattatcaactgtagagttcactagagtgtaatttggctgggctctttctcattagggaacacctgacatcattctatttaggtctttcctcttcagcttgtcaaggatgttccagtcatcccgctttaaagtacaagccgattgcttgttttctggaagcagagttgggaaagaggactgaaggttttggcacttagtatgcgtatgttcacttaatcaccttgttttcagtaaagtgcctttgcccttaattgtacctgacggttccctctccaaggaataaaattctagtgtatttgtcaggatggaaaaagaactgttgcctggctcacggagtttgaaaggaaatctggggatataattgtataacagattttcaaccggtcttcctattccccaactttactgccaattccagaagtacctagggccaccagttcttgagcctttgtggattctcagattgcctctcaactttccctacttctggcttggaattcaactttttcaattctgctaaatttgttaccacttatctatctgctttttagcttgcaaaacattgttgcagttatatattttcctattctttgtctttgttaagctaattaagccattaaaaaagcatgttattaaatttacatatgtaaaaaaatttgtgatataaatatatgtctcatatatcatatattcatatataaatatatgtcttatatatcatatattcatatataaatatatattttttaatcccttggagctgggtgtggtatctcttgcctgtaatcccaatgctttgggaggccaaagtgaaaagatcatttgaggccaggagtttgagaccagctcgggcaacatagtgagaccctatctctataaaatattttttaaaaattagctgggcatggtggtgcccacctgtagttctggctacttgggaagctgaggtggcaagattgcttgagcccaatagtttaaggttgcagtgagctgtgattacgccactgcactccagcctgggcaacagggcaagactctgtctcaaaaaaaaaaaaaaaaaaaaaagcccttagagggagatgccacctctgcttttactgagtagctcctatcagatcaactctcccacagattaaaaactgtaaacaaaaatataataaaacaattatatgaaggcagtagagaatgaccaggggagagtcaaacctggaagcagagggtagcacttgctaagtgtcatttgtgtagcttgtagcctgagggcaggccccagtcagaaccatgcaaggcagctaagattcttgtagacactcatagtctctctggcttgaaaaaccagaaaacaaaataaggagacacaaaacaaagattcactggggaaaccaaggatcccttctatgttgaaatttatttaacatggcttttttgtggcttaataggatagagaataaaattgtaacagaagttattgataagcctgaaaaaatgtatgttaaatataaaattattctagataagttaaaaacgtaagagtacgtccaagggaaggagatagctgtctttatatttggaggactgtcagggagaaggaaaaaaattaaaccttgctgagggaccaacttaatacaaatagctagaaaggataaatttttagctcacatgagaaataactttgtttaacagatagagctgcccaacaatggaatggaaagcctgggctaaattaagtgtctaagtcactgaaggtgtgtgtgcgtgctaaagtgaggtcacagtcaaggatgctgtagaaaaggagtctgctctgtggaaccgtaaaacccgaatgccttttaagttatgctctactccatagaattctgtgcctaaccaggcctcttgctgtcatctgggtggaaatcttgcatcagattttgccaccagagcctgttccacaagcaaataccctgaggcgccccttccttgagtcagcagtttcagctgggaccttaacccgggatttggaagtcctgttgaatgcagtgagacaggcctcatccaaatgaagcctttgctgctgctccaaggacctcaagggcatcctcgcccaaactgaggcctccagacatgttgaggcagagcttgttagccccttgcaaacttcctggtagccatagcactctttccttctccttcccttaactgaagcgtgcaaccccttctgttagaggcttgttttctggcactccgcaagtgcaagatggtgatggaggtggagagtagaataggaagtttctccatgtctccagaacattgcgtttccctccttgtgtaaaaccatcatccttctttgagcctgtataactgctcgaccctctgtcacacctcgtcactgtcatcaggcatgctcatgacttctctggggcacctggaattcagaaccttgcttaaaattttcctctctaggctgctgctcctctagtaacctacattactctctctcctccctgtctccaccaggccacaccacgtgctgtttctcacgttctctcgtgcttctggggatttgcacatgcagtttcctctctctggaatactgtgcctccctgccctttcactcactgaaatccagctagtatgccacagtccagacaggttatcacttcttttctgaaccttctagtctcactgagacttaggtgttccttctctgcgttcctgtatattcctctgatgtggtccttactcatttttaatgtgttctttactcgtttttactgtacttatgtttctgatttttaaatgtctttctattatattatggaactgcctcttccttatctttgttacctcatagaaggggttcaatatctattgattgaatgaatatatgcttctaggtgcttgtcttctttgggcctatacaagactgaaggtggaacaaaaagaaatagtgttgttaccatagctagtttatatagctagttgaaattctatttgaagtgtatatattcattctgttaaacatatatatggatgaacttaggttcaaaatgtaagtctactccttaccgcctatagttttatatcctctacctgataaccctgccactatcattccatttttgttgttctatccattttctaaccctattactttaatctactttcatccacagaaatttggcatttcttatcttcaaaacgctgtggatcttatcgttcatctcggatggtttttgtttgtttgtttgtttttttgtttttttggtgagtcttatctcttctagacacgcttgaatcagttgagatccaaaatagcaacatatagtcttaactgaaagaagttagaaagaaaaattaataataaattaagtagaaaaataaggtatagcattaatggtttagtttaagaaacagtgtccttaggaatagctactgagggaaaaggaagataactaacatttgtaagatacttagaactcacagactgtgtcgggagttttccaaaaattactttaattaatccacacaataattctgtcaagcaggtgttgttatatgagccagaggctcaggcgggggtaagagacttgcccaaggtcatacagagagtaactcgcaaacctagatgccaaccaaagaccctttcattttgttgttccttctcctgtaccatctcatatattttaaaatggctttttattagattgtttttcagtcaagaatttttggagttagctaggaagttaatgtgtaagtggcagtttgaagatagaagaccacatcattgtttaataagtgtggcacagtccttggaaaagctgattgatttgatgggggtagttttgtatcataatgtgctcaaagatgaatagcacaaagagtaatatttaaataccaaatggagccctcatttaccagatccttgatggaaattttaatacacctaaaacaaatttatgctgatttttttcgtacccccaacacagttgtccaaaattgttcatgcctgcataggtgattcacacattatataaaattcattttcaaagcaccttatgcaaacaaaattgtattcctgctctgttgttcgaaattaaataaaatggttcctcagccagtccactactcccagacatgcatccacacacgttcatcatacatgcttacctgcctctgaactttgcttagagtctttctaagtctccactcactggcctcctttcccagttgttaatgcattcagctcatcttctttcagataatggcttaggtcctaacacctcaagaaagcttttccaacaaggatgtattcatcaaataaggaaatgtggatttcacccttgcaatttgcagtgcagttcccccaaaaaagtctattaactaccacacacttggcatgatattagctgctgggcatttaacagtaagtaaaataaattctctgtcattgaagcatttacagtcgtcttgtaggtcttgtgtagggatcataggagcaaattattttcttgttctgtgcctccattttttcatctgtaatacgaggaaaataacagtacctgctttgttagggttcttatgataattgaatgaattaatatttgtaaagtacttaaaacagggcctaatcaatagaaaatgctttatttactaaaacaagactaaactttggaataagtgttctagttctaaaaagatcctatttgtatgttaagtaggattatagtaaatgtataggttagtttgtagagaaatgtcatctttatagtaacaggtcttcctattcaagaataggatatgagtttccacttactaatatcttcttttacatccctcaatagaatattaaagttttcttcatatagatcttgctattttggttatgtttatttccaggtattttatctttgtttctgtttaaaatagcaccacgtaatattctaattcattgttatttatataaaggaaaatcattgatttttgtttttcaattttgtattgaagtattttattgtttgtgatgagttttcatttggtttgcatggactttctaaatgtataatcatatctattaaaaatgatcatttgcctcttattttccaatttttatagctctagactttttttcttacctaattagtattaactgattatggtagtagtgaacatctctgtcttatgctgtgatttttgacttgtgaccattatacttgaaatggattattatatataatgttacgcattcccaatttgataaacaaaatcacaatgtgttttttaattgtccagtctgctttccataagcttaaacatccaaatttggctcttaccctgacaaaaatcttccagaatattttagagaactataatctatggagaacaaaaactcacacttccaaaaggagataaagtcagaaatgattcttcagtgttgctaaccctttcccctgagcacttaaattagcccctggggagtgtgtcctaatatgtttaatgttcaaaatatctgctaactaaaaacctctatactattgttaaggactaaccccattgtgcctgacacatagtagatacacaaaaatgtttattggaagtgttgatgaaattccagaaactctctccactggcttacctcatctaaatattacctgtccatcagtgaactgcttaggccatgttctccccatgaattctctcctaatatcttcaggtaaaaggtagatataatctttttcacttgaattagttttctgtgctttataacaaattaccacaaatttagcagtttaaacaacattctttaaaagaaaaaacgtttaggggtacatgtgcagttttgttatataggtaaattcttgtcacaggagtttgatgtacacattatttcatgacccaagtattaagcctagtacccaatagtactttttctgttcctctccctccttccaccttccatcatctggtagaacccagtatctgttgttcccctctttgtgtccatgtattctcatcatctagctcccacttgcaagtgagaacatgtggtatttggttttctcatcctgcgttagtttgccaaggataatgatctccagctccattcatgtgccttcaaagaacatgatctcattattttttatggcggcataatattccatggtgtatatgtaccacattttctttatgcagtcttccactgatggacacttaggttggttccatgttattgcagttatgaacagtgctgcaatgaacatacacgtgcatatgtctttatgataaaacgatttgtattcctttggatgtatacccaataattgaatttctgggtcgaatggtacttttgtttttagctctttgagaaatcaccacaatggttgaactaatttacactcctgccaacagtgtataagctttccttttccccctcaactttgccagcatctatttttttttatttttaataatagccattctgactggtatgagatggtatctcactgtggttttgatttacatttcttagatatcagtgatattgagcttttttcatatacttgttggttgcatgtatacttttgaacagacacttttaaaaagtgtctgttcatgtcctttgctctcttttaatggggtcgtttgtttttctcttgcaaatttgtttaagttccttatcagatgcatactttgcaaatattttctcccattctgtaggttgtctgtttactctgttgacagtttattttgctgtgcagaagctctttagtttaatttgatctcatttgttaatttttgcctttgttgcagttgcctttggtgtcttcgtcatgaaacctttgccagttcctatgtccagaatggtattgcctaggttatcttccagggtttttatagttttgggttgtacatgtaagtctttaatccatcttgaattcatttttatgtatggcataaggaagggggttcaatttcagtcttctgcatatggctagtcagttatcccagcaccatttattgaatagggagtcctttctccattgcttgtttttgtcagctttgtcaaagaacagatggttgtacgtgtacagccttatttggggggtctattctattccattggtctatgtgtctgtttttgtaccagtacgatgctgtttgggttattgtagccctgtgatatagttgtgaaggtggacagcgtggtgtctcctgctttgttatttttgcttaggattgccttggctattcagcctcttttttggttccatatgaattttaaagtagttttttctagttctatgaagaatgtcattggtagtttgataggaatagcaattgaatctataaattgctttaggcaatgtggcctttttaatgatgttgattctttcaattcatgagcatggaatatttctccatttgcgtcatcttgatttctttgagcagtgttttttaattctcctactagagatctttgacctgcttggttagctatattcctaggcattttattcttttggtggcaattgtgaatgggattacgttcctgatttagctcttggtttggctgttgttgggaatgctagtgatttttgtacgctgattttgtaccctgaaactttgctgaagttgtttatcagcttaaggagctttggggccaagactgggggttttggagatataaaatcatgtcatctgcaaacagggagagtttgacttcctctcttcctgttaggatgccctttatttatttctcttgcccagttgctctggccaggacttccaatactatgtcaaataggagtggtgagagaggggatccttgtctcctgctggttttcatgggaaatgccttcagcttttgcccattaagtatgatgttgactgtaggtttgtcatagatggttcttattattttgaggtatgttccttcaatacctagtttgttgagagtttttatcatgaagggatgttgaattttatcaaaagccttttctgcaacatccatttttatctcacagatctgcaggtcagaagctgggtgggctcagctggtttctctgctcagggtttcacaaggccagaatcaacgtgttggccaggctgagctcttatctggagtttcttggcaataatccacttccaagctcatctaaattgttggcagaattcagttccttgcagctgtaggtctgaagttcccatttacttgctggccttcagccaggggccactctttgctactagaagctatccacatttcttcttacatgaccctccatcttcagaccaataatgtcccatcaagcccttctcatactttgaatctctctctctgtcttctgctgccagccagagaaacctctgcttgtaaagagtttgtgtgattagactgtcccaccaaaataatctccctttgctgtaaacataaaattatcaaggaattaacacgagggggtgaaggtcatgggggccatcttaaaattctgcctactactcccacccatcaaactctctctgcactgtatgaggaggtaacctccttcagggtagtattcatggctgagtcattttgtgatacccaatcacacctttcacgtatatttattacatatctaatgaattcattactttttgttaaatgaattgtgagacaaaacaattatttacattatttgaaaactgtgaggaacagtgtgcacttgaaaggtcattgctgttttggttttttttttttttttttgaagctacatttatttatgatcaaccagagagactaaacagtggactcatgggtttggactctattgcaattcaagtgaggtcagaggaattccacagaaaacttaaaaggcatgaagtagctattatagtaaaattaatattttaggggaaaaatcattaatgagagaaaagagcattctggaaaactgtgttccatttaaggcacctcattaccagattctttaaggaaaactggagggagttctgagacacaaagaatgattaagaggctgtagggattaacttagaaacaacgattttaaaagactaaatatgtatagcttagctgaacagtaactaaacagagatgtaactattgtcaaatttctgaaatcaagagaagtaatgggcttctctgattaaaaaaaaaaacacttgagggtctcctttatgattattggagtaaatgaggaaaaagaaaacaaaatcttaaacaacttatatgcaatatttagactgtgcgctgcagtgtaaactatcagagttgaattcaaatcccaactcctttattttccacctggggaatttcaggcaactccttccaccttttaaactttgtcatatgtagagtgggaattacaccacctacctttagggttactatgaagattaaatgagatgacataagtaaacagtctagttccatgcctagcacagattgcaggttgagaaaaagaatagctgctattgatatcaccattatcatcatcgttcttaagtggttacgagttcaaagtgctaggattcagacaaacctagaattcaaagtgcctgaattcaggcacattcaaactgtatcatttaattctgtctctacctcacggtttctttaaccgtgatagtgttgtagtgaggacttaatgaaataatataacataaaatgcttagcattgattcctggcacataactaatcactgaataaacacattaacagctgtagcactattttcattatcgttagcaccatcattattccatcatagaacctggacaaaagcctaacatatatttagattatttccaaatttcccgttacaaacagtgccatgcatgtatctccatttctgccattatcgtcaccaccacacatatacatgcacacaattcagtaattatttattacttgttgaattaagtaatttcttctaatgatcctgtcgggtatttgtggtcactatacgtggctggggaggtaccagaatgctcctgtatgtttcttatgtaatccaatttatagcaacagatttaagtgcattttttcatttcagtaaaactgatatgtagatttatttgaatttttataaagaatccctgcacttataataatattttcatttgtgttttccatacataggaactccctgtagctacacattgcttataggattgtgttactgcagtaaacagaatatactctagctagattaggcagaaatggtatcaattagagggttgctaattagaagatattaagattaatcagagggtataaatcatatgtgttaagtattcatcagagctacctcacatttaccattagatagatcacagaaactgtgggagggccagtagagatacagatggcaaataaacatatgaaaaaagtgctcagcttgggcgacattgccaaacccctgtttctactaaaaatacaaaaattagccagacgtggtggtgcacacctgtagtcccagctacttgggaggctgaagtgggaggataacttgagcccaggaggtcaaggctgcagtgagctgtgtttctgccactgcactccagtctggatgacaaagcaataccttgtcttaaaaaaataaaaagctcaatattattagtcattaggaacatgcaaattaaaaccacaatgaggccaggtgctatggcttacacctgtaatcccagcactttggaagaccaaggcaggcagatggcttgagtccagggattcaagaccagcctgggcaacatggcaaaatgctgtctctacaaaaaaatacaaaaacttagctgggtgtggtggcacacgcctgtagtcccaactactcaggaggctgagatgggaggatcacctgagcctgaggtcaagactgcagtgagctgtggtcacaccactgcactccagcctgagtgatagaatgacaccctgtctcaaaaacaaaaaataaataaataaaataaaacttcattgagacactactatacaactgctagaatggctaaagttttaaaactgacagtatcaagtgctgataacagtacacagcaactgaaacactcactgaaacattgctgctgagaatgaaaaacttatataatcactttggaaagtagttcgcattttaaaaataaagtttaagatatatctgccattcaacccagcaattccactcctaggtattggtccaagagaaacaaaaatataagtccaattaaaaacctatgtccacatacttatagcaacttaattcttaataataaaaatgagaaacaacccagatgtccctcaactggcatatagataaatcatttttggtacatccatagaatagaatactactcagcagtaaaaaggaccagactactcacacatatagtaacctggatgaatctcatgtgaaaaaaggcagacacaacaggctaaatactctatgattccatttctacaatgttctggaaaactgtctctgttctattagactgtaatcttgatctgagtgtatagttctttgcaccaagattgcatcaaagtcaatgaattggaagcagaaatgcctatttttttttttaagatggaatcccgctctgttgcccagactggagtgcagtggcgtgatctcagctcactgtaacctccgcttcccaggttcaagcaattctctcaccttagcctcccaagtagctgggattacaggcacacaccaccatgcccggctaatttttttgtatttttagtagagacagggttttaccatgttggccaggctggtctcgaactcctgaccttaggtgatccacctgcctcggcctcccaaagtgctgggattacaagcgtgagccaccatacccagcctcagaaatgtcaaatttgatcagtttagagagtaagctttagctgtgaagggaatcaaagatccagattgggccaaaggtcaatacagggtattttggggtaaatcgaggtacacaggactatcaacatgagggcaaggagcagaagttgggcctgctggacctgctgaacagcatgaatatctacattaatggatcctactcaagtctactgactcatatagcctttagcctccagagaacatagcccttctttgatgaccactgattaaaactgattgcagttgcatccaaggttgtgatttacctgcttttgacaaatttgcagttttgctttgattgtttatttgcaatgtgcgttactaatcctccttagcaactcacaaggattggaagtgatagagactacactaacaggttgactccagagttgcatgagtttaatagtgcttctagttgctttctggccaatataagattccaaagcaaaggaccatcttaattgaaatatttttaatatggcagattttataatggtaaatttaactcagatataatctgtgccttgtgaatacaataaagcaacatatgatataaagaaaagagcctgtaagggtagaacttggcagacttggattctggtccctggactcaacctgttcaaccttaggccatttaacctctcactttcttcagaggtgccattcagctctagtattaattctatgattctgaaagcagttgatagtgtgactggaaggagaaatgaaagaagctttttcaattactagactttaaagcttctagttttgacttctaggcttcagtcctcagaatggtagacctgagctgtgtccagtgtttacattataacatatctattttggaaaagactggcacgtgtttatagatgggattggaaaagtacttaggttgttcttgcaaccagaggcccataatcgagtttttatatttttccttagaggtatatattgcaatgactcactgtaagaaacaatattattgctcatattaaatattctttaagtagcttttccacgtcttgaaagaattacgttttcttctaggaaggcagattttgtttttgacatggtggtactcttttttttcaagcgcataatctagttcttttcatgtcagtgaaacttagtagtacttaaaaatggattgaaatagtggtaactagttccacagagatgtttgcctacataaggcaaatctctaaagttaaatctttgatgcatatgtgcatttttcatttcgtattttcggttcctccacaccatttctttgtagtcaaattcattgtaatcccatcatgaaagtgttgatcttttagtaaccttttttgaagcattgtattaatccacattccctcacgataacacacggtttgtatcaaacatatcatgcagcttagctcaggccacatatggaactaataagtcaggcaataagtggctttgtgtgaatgaatacagtttggaagggtggggacatgtgtgtgtgttgtctaaactgcatttctcctgtgccaaaaccgaaatgacacaatgattcctgaatccccagaggctttcctggcctggaaaaattgtgtttaaaaaataaaaataaaattgagcactttgatattaaattaaacctctcagctcaataggaggatgcttactgggtgcaagaacacagcatttatttctcagcagtaaaatcatactacgttttaaatgtgatctccagagctgcaagtggtcttccctcatcaatggagcaacatttatcaagctgcatgaactagttaattccaactgcaagagctgtgacgtcatagttgatctgtcttatttgatgaaacacaaagtggatgtatagtgatttgagaagaaaccagcatgtggctttggaaaaacactatatttttatacaaaaagggggtataggagaggaaaacagagagaacatagacagttaatggaattgacatggccgtagttgtctgttgtggtctgaatgtacttgttgcttgggttttctttctttttgcttgttccggtaactataaagccagatcttcctgggtttttttagcataaggattatcttttgctaccagacaatacagtttgttaatttttccagggaaaccactgaacattgtttctccccacttcccatctaacttattatctaagtgtaattttcatcttggttgcctactagccatagagttgaacaaaatcttaattgcccccatggagtcctaaatcaatcaaagtaaagctgaaattcaaactaattgaaaccaaaattccacttaaagactgcttagactgttttggtggtggcggtgcagtaggaagttgttacaaaaggtgtttatttcagaggctaatttgaggcagttatacagacccaaagcaatattttatttgcctagttttcttggcatctgccttccccaatcaaaaatgagagcagaaggagccgtaatgtttagggaagtgtgggattgataatagttggtgagggcaggtgttgatggaacctgaagtaagatttcttagagacaagagtacttcagtcttttagcctgtccatagctgcctttgctgttgtttccctcgttcactctcttgcttaaaaccctggagtaggttcttactgctaaccagcaagataaagttgaactcttcagcttagcactcttagccctcagcagttataatgactaccctgtaaaagtcaggcctcaggaacttctattctctgtaaaattctaattgaactcttacaactatcttatgagataaatattgttggtcctgtttatagacaaggcatagattggttatgtaacttgctcaaagttatacacattatatggtgagaataggctgtgagtccaggcctctcattccaaagacagagagctgattcacattgcctagcttagtggacactcaataaatatttgctgaatgaatgaatagaacgtgtggagacttagtaaatgtagttctttctcccctttccctatccttgtcctttcctcctcgacctggttccttcttttcctttctatttttactaatatcttaccagggagttaacttgttgaagattattgaaatttttaaaagtttgcccaagcaaggaaggagtttgcgtgaccatacagcagagctgggtctttcaccaggtcccctgaccactcacatcatgtatcagtctttccatttcactatataattattttaaagatactgacatgtgtgtgtttattcctgcttctctggagtgcatgcagtcagaagcttaatgaaaattagcatttaaaaaagtgaacagtgtacttaagattttccctttgatttgaagtaactctttccttcttccttttctgccccccattcttagtagttaagtggtaagccattattgaacaccagctttatgcccagcctagtggtagatactgtgatgatgataatgtggagaatatatatatatctggtacatatatatatatatatatatgtattagtaatgataacaggtattttatattgagcacttatgatgtaccagatattattttggatagtctatatactttatcttatttaaactttacaacagctctgcaaggcaggcaacatccccattttacaagtaaggaaatggaatctcagagaagtgacttattcaaagtcaaacaactagtaagtgacagtactggtattcaaacccagctcttctgcatttaagcctatcctactgtgtcgtgatgcctctcatttcttcctatactgtattaatttaacttgttaattaacaagtatttatcaagtacctatccagttggttaaggctttccaaaaagaacaaatggaaaagtgcgtatggggaggagtttagggtcaagggtaaaatgcccacttacctgcagtaatcagagagcttccagtggaaaatggaacttctgttggttctttgagaatagataagacatgagatataggatgcctagagagagacatagagacaagaaagagagctttctgccagagtaatgagtactgtgtaaaaagctatcagaagagttgttagccagtattgaaaagctggttttttatatataaaatcccatatatatatatgagacttttatttgtttgtttgcttggagtcagagtctccattacccaggctggagtgcagtggcacaatctcggctgactgcaacctccacctcccaggttcaagtgattctcatgcctcagcctcccgagtagctgggaggcgcacaccaccacacctggctaatttttgcatttttagtagagatgaggtctcaccatgttggctaggctggtctcaaactcctcacctcaagcagtctacccgcctgaatatgtttgtttaagtcacttctctactaaaatgctactaataaggttaaataattttaaaattttaaattcacaaggatgaaaagaatagataagaccaagaaaatttagaaaacttcaaataaacgaatgagtgataaactgacttggcagaagcctttacgaagcaatataatccaaaccacagactccagaaggatgtggtggtaccgagtatctcatgaagtttagggataatatatagagctaaacataggagggtaggttgacagtctatagaaaaagaagtaatactcccagttcacttttcccactctgtgtagcccaataactacgttcccacatgccctagtgggaaaatgaaggtttacttgctgaaaaagattgagcccaagaagctctgaacgtaaactgcttgatatactgggaacaagaaggaaggtgccttaccaaaaggtgattacgtgaaagtgtaacataccaacacagagttccccaactgccttttccaactttattccccaaataagatccagattatgcctcaagacagaggattctttctgaggaaaaaacagaggcagcaatgaaaagtcctggggctgtagtactaacctttccccgtgggaaggctggatttccatccactcattctgcaatgaaccctccccccacagccagtcatcaagcactgccaatgcacagacttccttcacagctttttagagtctcacagtctcacctgtaaagataaactaacggccaaagattacgagacattagaggaaagcctctaatattaaaaaaaaaagtctaaaataaagtgaaaaaaaaaatccagagggtaaagtgaaaaaaaaaaatccagagggtaaaatgaagaaggaggaggaggcaaaataataataataggagaaaatgatcagaattaggcaataagagtattcatattgaaaggatgtactaagtgcttggcccagggaatgaaaacagactgaaaatgatgaatgaaagaccgaaatgaaggcttatcactatgaaatttcagaatactaaggttaaagaagaaagtcctaaaagcttccagagagaagaatcaacttacattcaaaggatcaggaaccagcatgttaacgggtttctcagtcaccacgtgaaaagctaaatgacagtaaagaaatactttggaactacctaagaaaaagtatttgcagccatgagttctatacctaggcaaactatcattcaagtataagaatggaatagttatattttcaaatattcagggtgtcatgaaagttacctcccatgctatcctttcccagaaagatattataggatacactccaccaagatgaggcagtagatcaagaaagaagacaatctaggaaataacagcttcagcacagaagaaaagtaaacaaaatttccagcatgatggctaaagaagcttgtaggaatataatgcagcaggcctagctagcagccagttcagttgaagcagagagaggaggcttcaggaaatatatctctaagagcaaaatggacttgatcaattttatggtgtgtttagttagattgagaagagttttaaggttttttattctatttcttttttcttttctttttttttttttgagacagggtctcactcttatcacgcaggctggagtgcagtggcacaatctcagctcactgcagcctcaacctcccaggctcaagcaatcctcccacctcagcctcctgagtagctgggaccataggcaagcaccaccatgcccggataattttttgtacttttggtagagacagtgtttcaccatgttgcccagactcgtctgaaactccacccgcctcagcttcccaaagtgctgggattatgggtgtgagccaccacacctggccagttttaagatttttgttagagtttggggagtatctagtgacaagtacatagaaaagctcaactggtggaaaaaatggcagttatcacttccagtgaaacaaacaaaaaagtacaagaaaggaataatacattacatggctcagcagtgaacagtgtttatgtaggtatagtgaggtaaacagtaaatattgatttaatttaaaatatgatattgaatgtattgagaagatgaggaagggaactatgtgtgggagagtagagtcaagttctcatattctttaagaaaaagctagtagataatgtatgggaaaggggataaagtgtttgtgtgagagcaaagtggtataagagtgctaaattctcttctttcatggtgggagcatagtagatgatgtctctaactggaggggaagggagaataagaaatcttaatataagcatattattcagaaatatgaggtaaagaagaaacagctaaaaggtgttctcagagtttggggtagatagtagagcagagaactgctttttttttcattataaatcttgtagtggtttagacttgttaaaccatacttatactttattaataataatatatgtgttatgtatgcatttatttttgagttccctatgtggaaaattaaaagggtaatatggtagaatttggagctgttattaagcggttctagccttggctttgtcccttatcatccctgtgactttgggcaggatgctcttgtcttcctgggccttagtttcttcatttataagaggaagaaggttggaaagatggtctccagggtctctttaagctgtaaaattcaaagattctatgatttaaaaaaaaaatagtactatgcagcaaatggagagttaagacccagacagaggcttgaaattcccacatttttcttttttttggttaaaatcagacttggagagaaattttcactgtggtctctgaaaacagttcaacacccatcttccgttgtggaacctggggcaggcaattgtctgtgtactcactcggagacacatagcttagtgttatttcagtaagtttttttttttccttgatgtttaatatttttcggtatgaatcacaggtaaaatttccatgccatgtgtaaacgatttcacttcttattgaaacaatgaattcaggaacgtcatgttgggatatcagccattttgcttttatcaatgtatggaaaaatgcatttatattaatacaagaaatgatgtcatttaatatggggtagatcttataattcaaggtctgcaaatctcaggaggtgatttaggtcaccaagctaggtttgaaaaaggaaaaaactattttccttctgctttctcaagtattgttaccagttttcgtctcagactttggggtaggtggtagagagtagcatggtttgtgaaaaggaggccctggctgataatatctttgccattgaaccatgcggccctggataatttacttcccctttctggggttcagttttcccatctgcaaaagaaaaggattggctgaaataatattcaagataccttttagttttaacattgtatgtttctacatccttactttatgtgtgtattcattcaaaccattcaggagacccagttatgtttggaggtttttcttaaaaagcccagaatcagtgagagtgaactctttctctaagtatcactcaagcagagaaaaatcagttgaattctagagtcaaacaaaagaaaactgactgtttttagtaggtgtttatttatgccccctgttgtcttactctgaaggcctgctttctattcacatgatttgtggttttattctttaagagagggatatatttaaaagtttgacttagccactcttaaatttaagtgctaaaagagttaaaccttaagaccgatgccccttcacatttgtacacagacatacattttataaagtctataaactttcttcatgtgtaatatgtcatttgaaaaacacatttttgcagagctgtgttgtccacttactgtgtgtttgatgtgtggatgagcatgtgtgagaatatgcacatccacttacttcggctctcctttatggtcagttacggaagcaaatggtgatactcagagacacagtgaaaggaagtgaagaacagaccgatgaaaaccattagcaacttatccagagtactcagaaggacacttaattttagaaaattggcctctaccagaaataaatcaaacaaagggcagatctagcccacaaaccagcagtttccctgtaccacctctccagctatgtgctctggtctggacaaagaggaacgttagagactcaagagaaatacagagcacagcctctgtcaaaagtgagttgcaatgtatttgtttaataagcattgaataagtaccagcactatgccagacactattggagtcagagatgaatacaagatggtccttacccttgtttatacaaaggggagggctgaatggaagctggcaatatctaaaaagaaacactggttttctggtatatgtccctggagttggtgttagcaaaccctaccagggtctgggggtagaaaagaaggctagatacaggggtctttgaaatatcctcattccacagttggtcactcttagtcttctctaagtttagggggcaagagaacagtaagtagatgaagaggctaccttaaataccatcgtaatttaagtgggtgtgcatactcatacacgtgcttatctatatgtcaaatacccagtaagtggaaagtactgtgaggctgataatagtatcaaacatttacatttcctcttttagagttcaaaaaaataacttgtttagtggttcatttttccgaagcttataatctgccaaaatatctttaattctattttttcaccttcacagctaagatatcaacatggactagggactccagacttgcggcaaacccttcccaacctgaaaaacttcatggagcatggactaatggtcaggtggtgagtacctttatctctgataaccagaaactgtaatgtggataggatcctgaaaatcttttctgacttccacattgctccacacctgcctctgagttttcttctgtaatgagatatgggaggaaaatgaaaggcgccatcacagttggggagatctaagctcccgtctggctaaggaggatgtagcccccttggagggaggaggggccaaggggatattgcttgaactttgggaaggtggctgagcaaggagcccttgagggcattgctgagacaaactggaagacagccagtatgattcatggtaagggagacccagagccccttggacctttccaaagaacaggtgaagggcctgattatagaatgagcatcaggaccatggctgtgagcattaaaggaagaaagcagataaggaataggtcagggggtcaggacttagtttgagaccagtaggtacattctgaaatgtttcttgtgtgtggtgtcagtacctgttgaaccgtgagggcaagctgctgctgaaagtgctccgtcaggatagacatggacctttgaaaagagaaggagagaggggaagtctgatagaaagaagacattagattcattcacttgacctaaatggaaagttgttggctgtatccatttagtaattcttgaagtttgaatccttgggtagtgggcagtaacttacaaaatcacgtgcctggaaagcaggcctgtagagttagacagctgggggcagcactggcttctgattccaggtatttttctcatcatctgctgtgtggatttgaaattctacctctctgaaatttgatttgctctgctgatgtgccttcagaaaagtaaaaaaactgtggttggtctttactttgattttcaaaacggcaagttccagatgtctggtcttagataggactcctgttaagcaaatacacaactgtttaaagaattccactcaaaacatcaaaataattattaaagcttggtgttgatatggacccggatgccttcaggaatatgagagaggaattaagttttaaagtaaagtaataagaataataaaagtgagctagcaggtatttatttagcttgtctctgtgtaaagctctgtgataggtgctttagagagatgagaaagctcaagccctgtccccaagagatttgtggtccagttggaaacaaggcacagaattcatgaagaggttttctaacacaatggtaaataacctaaaataatgagaaaattggcaacctacaacactaattaatcacactaaatgaatcttgctcagtacagatagcagattgtccctgaaccatttactgaagtgtctgtcttttctccactgatgataatggcatctcttttgtaaaccaagttcgcttatccatagagatccatttccaggatccctattctgttctgttgctttatttggctagccatcgattagtatgacatttttaattattgtaagatgtaatttctaaaagtgttgttgagatttgagaatgaaataaaaatcaaaatgtccattttactattgataaagctacttggaaaatggggctttagatctgaaataaaacgggcttgcaaagatgtcactcaaaattgaacttatcctcataatcacaatgtaaactggagagccataggctttccctacagaggcaggcccttaactacattggcagacagcgatcaggtgacttttcttcaggagcccagatagggctgagccaagaatacccagttgctattttgccctctagattcaccaatcaggaaagtccctcctcctctgagagagtgagaggatggagagagccaagagtgttaactcctaaagccatgttccttcataggaacagaaaaggaaaatacctccaattttcttgatatctgttagggaaaagctaacctccatatctgttagggaaatatctgttagggaaggctcttcttcaaaactcttggcttttcttgacttgagtctttgagtgatttcacagttttatgacattgggtcttcctaactatgaacatgttacatcgcttgcttttttaaaacatacctccatgaggtttataattttcttcataaaagtctatgcatcttttattagatatacttagtcctattagcttacagttttggttgctgttgtaaatttttttattataatagttaacattttctggctgatgtacaggaatagcactgatttttagtattttgagagtgtgttctggctaacattagttacaatagtttgtttcgattctcttggattttttgtgtatacaatcatatttttagtgaataatggtattgtttctatttttataacttcgttactttttcttgtcttactatgttttattacagaacaggagcagtgatagtgggtatccttgtcttctgacttcaaagagaatgcttctaatttttcaccattaagtattatatttattgtagattggggtagatatcctgcattagcagaaggaagaatttttctgttctcaggttactaagagttgttttttaatcatgaatatgtgtattttgaattttaccatgtttattctgaatctgttgaggtaacactacatttttctaatgttaaaccatctttgccccctggtcatgtgtattattttttcctacattattggattccttggctaatattttagaatgtctccatctgcaaactgaaatgagactggcctacagtttttctttcacataaaatccttgtctgattttggttagaattgagcaaacatgatgaggttataagagcttcataaaataaattgaggatctttaccttcttttctattctccagaacagttcatataagataggaggaagtatctctatcttaaaggtatggtagaacctagaaaaaaactactgttttttgtttgttgctggggagagtgtagatttttaactactgatttaatttctgtaatgcttacaggtctgtttctgtttcatttctccaattcctagttaactcactccagtctgatttttagttctatgagtatactgaaattccttttatctagcttggtgcctaccgaattctaaacatagacccaaactcaaaggtcacttttcatccttatcctgttcagtggcacctggccttgctggccattcctgccttcctgaaacactcttccttgttatcttccacaggactgccctctcctggctttctgcttctagcttctccatggccccatcttaggccctcttccctttttctctctgtactctcttctctttttttctttcctcctccgcctcctctctaccctcttcttaagtgttctcacccattcccatcattttgaaagctgttatgcttatgactcccaaagttttgtcttcagtgtaaacctctcctgcacactctggatagccaggggcctacttgactctgcccctgggagtattagaagcatctcagcctcaacacagctaaaaccctccttccaccagcataattcctgtcagctaatgggaccctgtctacccagttgctcaaaccagggaatcatccttgatccccttcttttctccactcacatcagagctaatcttattcatcagcaagccctgtcatcactatctgcaaaatacatatcaatctgttcacttcccatctctgctattgccactccagtccaagccaccaccttttcttacccaaacagctgcaccagtgcaatttgtctccttgtcttgtcctgcctctgtccactctccaaagtagccaggatgatctttctaaatgttggctagatcttaatcactcttcagcttcagtggcaagagtgaaatccaagttttcttccatagtctacttggcctctgcctcatctgataccactccctttccactctcacgtcctgtcgctgtactggcctctgtgtagtcatgtgaataagctctttcctgtctgagtggttgcactcactcttcctctgtgtagaatgtgctctgtctcttccttctttcctaccaccttcctcacctcatcgcctcatagagagggaatagtttaagaaaagccgctttatgaacacagcagctttattggcaatgaataggcaccttggctggaatgcaaattcattttaagaatggggagaatctgggctttgtggttccttggcaatcctttttaagaaaaagaatacaaaattacaaatacaaaattagagatgaaaaagcatttggaatgagaaacaaatcacaacaaattactggaaccttagggattaggtccttttcttctgagatgtctgtagacaatttactcaaattatttacatataaatgcttcctcattgcaacctgactgcccttctactcctaaaacactgtaatttccagcaactctcagttctaaggtacggagaaattaattgactttccaggcataattgacccatgaacctgtagcaataaaagtagaatctaggtgtcctggcactgttgcagcaaacccattaagctccaagctcatacatttataaatgtagtgcccctctgtgccagctgtgccaagcatattaacactgagtgaacaggaatgtgtcactttatggtactgtaacgtaaaataggctactaaagtagatgcaaagcactgcaaaatgaatgctacatatcagttccaagtaaagatcacggcaggaagccaggctggaagtcacaaagctaaacaaagccggagcaagcactttgagtctcagaggaaatctgagaatttccgagagcagccgtggagtgaggagttacctctcaagcctgtgctccttagggcaaagggtaaaaaaactcaggttcctaagggaggctcttacatcttttgtaaagcaaaacacttccattttctgtgtggttgttaccattcacagattggtccctgtggaggcagattgctgtatgttcttttggtgttgaggatttcatactggctgaggatcagtgcattcactgaattcctccttatggtaagcttcaaagttatgtgacagcttgttttgttttattttgtaaagaaaagctgtgataaaaatcctcttaataaagtaattctttttcttgcacagtatggaattcttagctaatatgagaatgatcgacctgattaatcctaaaatgaacccccattttttatgaacacagttgcacagggcacagctctcagtgatttatgccaggtctttccaaaaggagtgcccattttttcatcctaagattataacctagtcgtaactgccaagcaacacaattttgaaaagcagaatttcagcttagaatctgtgctcttttgaatactgtgattgaaagtcaccagaatgtcatttaaacatcctagttttcttttactattgcctgcatagtgatctgagactcagattgacatgcacaggcaccactgatgtgggtgctgaagaatgtgcacctaagctgcagcctaatggctgcctgtaagacaacaagtttagaactgagttgaagagattatgtgcgaggttgctgtgagtgggctgtgtgatggggccccagcatccaggtcctcaggcagtgcctcgattttgtctctccaccactctcccaccctttctcaacagacccccaggcatagcactctcatttgtgacctccgttctttacttaggcaagttcccactacccagaatagcctgccccttcctctgccctatccagatgttgctctcacttcaagacccagctcatatcctatctcattcattcactcactcaacaccacagtggcagctacagagataagtgtgtattccctcagtagcttagagtcacttctttgccgagtcttacccactaggcttttgagcagcttgggtctggggaccacgtcttactcatctctgtggtcccagcctggcattacagaagccagggaggctagagaagggaatgaagaagccatctgagctgttctactcatggaatatgctccttgagcttgtgttcaaggagcttacagtctaattaaggtggtgaaataggaacaaaacaacatgtactgaaaaaagtaaaaagtacgacatgctataagggagagttattttgaacattcagaggaagccctttagttcccggtgtgaggggtgtagacaaaccttcactaaggagataacatttcagtggagagtggatctggagcaaaagaagaatttggccacatgaggtttggggtataggacagagtaggttaagaaacagtggcccagttaggtggaaagactaggactatgaatttgaataccagcaccactatttactgtctctgtgacctcaaacaggtttaagctgcctgcctcaatccctttccctataaaatgagggtaatagtgcgtacttaatagtgtggtcagaagaattaaataggtaagtacctagcatactgcctggcacttagtaataaataagcggtagcttttataatgagtaaatgaatcgtagttactgtctatatctttttaaaatcaaatgcatcctttgctgtaggtgtttttactttgacatctatagtcatcttacagctaggtatagaatatggctcttgttcatattttggctcatgctctcttgtacattaatggtacggaagatttaccatctgtctacctctcactttccccaagtcctttataagaccactctgaggccttagagataagtaccctaaaacctgtttgcctacaaactttttttggtacctgccttcttaggtaactctcacccatagttagaagttacgaataataaaatctcttacttgcaaaactttctatgtttttacttaagcttgcaagaaccttgtgagagtagctgggcaagaagaatgaccactgttttacaaaccaaaaaactgagactcagtgtgccaagcgccttgccaagatcacgtgatactaaatgatggaactgggaccagaaacccagattatctgactcctgatcccatattctttttaccatatcacagtgcccattattgggtaatggccattctcttccttctctgcccttcccctgccctcctgtctctgtgccacctctattctagtgcctcctaccttcctcagggaaacccaccagagtcaaatccagagcgctggaaagatacactgcgaaatcaggcagcaggcctggtggaaacattcctggttgtttattctacctcatttacctccaagagggaggaaactaaaagtaataaaactttgggaagaatttaagaactttaagactgaaagaaacaaaaatgatcacgtttcaacttcattggttaagaaacaggaacactgaagaaggaagcacgtgggtcgggtgagtagcctaaagcatatttgcccgtagtgtttgtggaatgcttcctggaatggcatgctctttttttctgaataagaaaaaggaagaataagaataagatgaaagcaagatttcaaagccatctgtcctgtttttttcataggatttttttattctaagtttaatttttcctgattatagagcttaaactatgtaacatcttcatgcaaggtagtataacacagaggaaggagcactagatttgggaatcagaaaatatgggttccagtttcaacgctatcacttaattttcataagttgtttttgagtatcagttgttttgttttgttttgttttgttgagatggagtctcgctctgtcactcaggctggagtgcagtggctcgatctcagctcattgcaacccccacctcccaggttcaagcagttctcttgcctcagcctccccagtagctgggattataggcacgcaccaccacgcccagctaatttttgtatttttagtagagacagggtttcaccatgttggccaggctggtctcgaactcctgacctcgtgatccacccgcctcggcctcccaaagtgctgggattacaggcatgagccaccacgcccagctgagtatcagttctttaaatggagttaataccaccagttattgggaaactatttcccaagcatagtttttgtaggccaaatgagataatgttcatcaaagtggtttataaactaaaatgaactgtgcaaagtattattaagtattgtttttgattattattaagtattaaagaatttgacaattcattaagtgtctattctgcgtatagcattgttcaggagacaaagaaagattcaaaagtgtaagattttccctgccattgcttagttgacagtcgtttagtttataatctaaattattagataagacaaatattttgaaggacatgacttgcaggaatattcctatacattgttcactctcgctgtcatgtgggacttacaacctgaggcccatcattagtgtgtagtctgctacaatgatggagggcaacgttgggccaacttattttgttttagggccaagcaagccatttttaaagagacagaatcaatctcagtgaccttagtaaggatagagcactgagaagtatccttggctgttcaacagcaagctagaatatttctccagagtactttagtgtttaacaaacaccggtgtttaatgttgggagaagtaactagtggctttatgtgaggccatcccattttagtggtaaaatctccagatagtccttctgctgacctatttctaatgtagtcttccattccttttggaaaatagaatcaagctatagctttaaataaaagtattagaagaagaaaatacctaagaactttgacacattttaggaaaatgttttttcagtaaactgagaataatgaaaatttagaataagtgagccaatctactttccttaaaattgagtaatgatatggtagttctgcttttacaccaaaccacttaactcttgaaaatgaggcagtatccagtatttaaatctttacaaagcctcactttttagaaacagatctactctcttcctttctgtccatcatccttatgctgaattcagaactgaaatctggcagatgaccctctagggaaatgaaaaacatgttgtctagctgacgttggtttttaaatttagatcaaataacattgtctttgaagtctcaagagtcctacttaaggtagctgtatcagataggctcgcctttgagagcatttcttgcaggccggcacccctaatatgaaaagttaagcctagtcaaaaataagtgaaaaagaaagttttattggagttattttctctaagatagctgtttcagaagaaccttgacgagtcatctccttgtctctagacaggaacacacaaggcatatgggtatctgtagtattttaaaagaccttaggggaccaggcttcttccataactcattccagagtttaaacaccctcacttcaggaaattcttccctatatttaactaacaggccccctcctgcggttaacacccatttccacttttttctgcctccagtcaggatggagaacagctggccaacatcctttgtgcactaaccctccactggtgacagaaaggcacttgggtatcccggcgccgcctctcccctactccagcaaccaagtctctgaaccaaattgagagctcttttcccattgtttttacttgggtcttctttatttctatttactccttttgattataaaatagtatgggctcaatgaataaaatttggaagttgtaaaaatatgcagaagggaaacaatagccccataattcaggcacaaaaaaatcactattgtattagccagttttccttgtatttcttttctaattcagatcttaccatctgtaccaacacttttcaatagaaatataatatgagccatacatataaatttaaatattctggcagtcacttttttttttttttttttagacagagtctcgctctgtcacccaggctggagtgcagtggtgcgatctcagctcactgcaagctccgcctcccgggttcacgccattcccctgcctcagcctcccgggcagctgggaccacaggcgcatgccacctcacccggctaattttttagtagagacggggtttcaccatgttagccaggatggtctcgatctcctgacctcgtgatccacctgcctcggcctcccaaagtgctgggattacaggcgtgagccaccatgcccggcctggcagtcacatttttaaaaagctaaaaataaacaggtaagctaattttaataatatattttatttaattcaaataaaatccaagttatatatccaaaatatcttgtagacatgtaataaacattttaaagattattaataaatattttacattctcttttttcatactaagccttctaaatccagtttactcttgtagcacatctcaagtcagactaaccacatttcaagttccagcaaccagttcctagtggtcatggtggacagcacagtccttacagcttttttgtataacgtaatgtcttaagtattttatcagtgccctttaaaactttttagcatcatttttaatggctacgtagtatttcatcatttagatttactataacaatatattgaggtagttgtgtttttctcaacacattgccaaaaaacatcacctaaatgtttccttttgcacacaactaattaaattcatttatacataaaacaagtatattcactgaatatctgtgtgctctgtactaagttatattggaaagcggaagagggggtttccagaaataaagactagatccctcccatatgctgtttacaagacttggctccacagttggactgcacacaaataccgtattttattctgccttaaatgcccttcccttcatttcttgctctacctcacccccaacacacacgtacactgcctggttagcttccacttatccttcaaggtgccaatcaaatacaacctcctctgatgagtcttcccactgattacttgattcccttcttcactgtaatatacaaagtgtgtattgtattcagagcaccatggtgttctggttattggttaactctctgtcttctctactagagtgggaactccttaatgataggaatcttattttatacatctctttatttccagagcctcaaaaactgtcaggcaatgaaatgtggatttcggtaatgtctgaaagatgtgttgaaaatgcaagtgatcacattaagcatcagttggatggtaacataagtactaccttcagagttcaaagagatcacttagattggcatggttaaagaagacagaatgaaggagttaaagaaatgagttaaagaatgaatgagggccgggcacggtggctcacgcctgtaatcccagcactttgggaggccgaggtgggtggatcacctgaggtcaggagttcgagaccagctgaccaacatggtgaaaacccgtctctattaatacagaaagttagccgggtgtggtggtacacgcctgtaatccaagctacttgaatcgcttgaacccaggaggtggaggttgcagtgagccaagactgtgccattgcactccagcctgggcaacaagaacaaaactccgtctcaaaaaaaaaaaaaaaaatgaatgaatgaatgaatcaatgaggcctggcgtggtagctcacacctgtaatcccagcactttaggaggccaaggtgggcggatcacttgaggtcaggagttcaagaccagcctgaccaacatggtgaaaccccatctgtactaaaaatacaaaaattagccggacgtggtagtgtatgcctgtaatcccagctacttgggaggctgaggcacaagaatcacttgaacatgggaggcagaggttgcagtgagccaagattgcaccactgcactcaagcctgggcaaaaagagcgagaccccatctcaaaaaaaaaaaggacttgaattgggttttagaagatgggcatacttaaatgaattggagagggaattagtacaaaagccactgagataggcacactaaaaaagcagtgcttttcagtaggcattcattagcactggggtccccaaccctcggccatgtaccagtagcagtccatgtcctgttaggaaccaggcctcacagcaggaggtgagtagaggatgagcgagtgttacccctgagctccgcctcctgtcagatcagcagcagcattagatcctcataggagtgcaaaccctactgtgaactactcacgcgggggatctaggttgtgtgctccttgtgagaagctaatgcctgatgatctgagatggaatcgtttcatcctgaaaccagcccccctgcccacggcccatggaaaaattgtcttccatgaaaccggtccctgctgccaaaaaggttgggggccactgctttagcatatgttgataagtgtcagtaaataagtatccttctggatcgaatgcactgtcctaagtttcaagaaggcttagcaatatggtctttgcccatcaaaagctggtaagtgtcagcagcattagaaatgagcactggctgtttcagtatgaccttgggtgccaggcatgggaggtattttttgtttgtttgtttgtttgttttgagacagtgtctcgctctgttgctcaggctgaagtgcagtggcgccatcatagctcactgcaacctcgaactcctgggctcaagtgattccccccacctctgcctcccaaagtgctgggactgcaggcatgagccaccccgcccagctgtgacctttgggtttaagctcgatttagatataattccctgtgttttgttttgttttattttgttttagcctctggatccatctgaggaaatgccttgtgttttaattttaaagagtttaaatatcattttatatgatgtttattctataattcttctcttaatggatagcaatctataataatagttaatatcattgtagctaatatcaagtgactattactgcaaaccaggcactcttccaaagcactttgaacatagtattcagttaactcatttactcctcacacagccctgtgaattaggacctactaacctctcccatcttagaaatgaggaaactgaggaactgaggggttacataacttaatgtgacacagccatcaagtggaagagctaagatttgagcccaggcagagcagttttagaagtcctgctttaaccattacatggacaacctctcctataactatgttaagaataaagtgttttacacaagggatcatttagcatctggtgattccagaaaaggaatcttgttattacagccttctcctggttttcttcattcctctctgaatgctccttcttatctcattcggagggtcctcttcctctacctcatcacgaaaagctggagctcctaaaggcttagtcctaggcccttttttctctcactttattctaagtggagataagttctgatatcagaaattgcctcctgtacattttcacagcacattctaagtgcccatgcgtttttctaccagtcttccatcccagtcacgataagctctttgctttctgcgaatgaaaccacttttcactcttttacactagccaggaagccaggcaaaaacctttgttcctccttttcttcctcacccttatatccaactctggcaattcctgccaatttctcctgctatttctgtttgtctatgtctgtacatttccattctgatccatgcctccattacctttcacctgtactactgcacagcctgcagtctcccaccatccactctggacccctccattctgctctcccaactgcagccagagtgcactttccaaagtataaatgtctctctctctctctctctctgcacctctgacacacacactcactcactctcacactctctctcgctctctctctctctcgctttctctctctctcttctttgcctgaaagttctaaacatggcttgtggcttctgcatggtccagactttgttttcctcctcagttttatcttctaccatagaactcttcactcattgaccttttgggtcctcaaacattgttatctttcttgataaaaggtcttagcaaatgctgttcctgctacctggaagatactcttccccaccaacccattctttacctggtgaagaactctactagcccttctaatcttgtccttttctgtctgggtcagatctctgctacaagctctttgagcccgtgtcctctcctgcatagcttgggtcagaggtggttgtttgacattgatgtatgtgatgtatgtgtacttgtctgtcctctctcactagacaataaattccattaaaacatgaaccatggcttttttccaattattatagccccagagtctagcgcagctagatactcaatacatatttgaataagggggtaaatcaattaatttgttttatactctgcctcctttaggagtataggggactacaaaagataaggttaccaagatgtcatctctagagtcccagtctcttactaaacagtaattaaattgcggcaaattgcaactcaaacacttctgcccaaggcctccagcatctctgaaaatggtggcagagctatccatttttcttttaaagtaacaaacaactaaaccctcacagtttggttcagtgagagtttattagagagctgatggtaggtcagtgttagtagtatctttcaaagacttcatctcacagattctgtcactggccctgggagtctaatgcatcctttagctcccttccaagtctagtttttaaactctgaaagcattctctgaccagggttttaatttccctatcgagttccttctgggggctgggttctgtgagattgttgttcctctggtttccctggcaaaggcagaggttttgggtttttttgtttttttttttcattttttccctggttttcagcataaacagtttattattcccaagtatcaagtgttgtccagatactccgaggggtccccaggtatcattcctggcatctctttcctgttctttccatgttctcgtgtaggatgttacttaagccctatataaatgacatcaagatgggctatgtctgtttctacagaccattttacagtcctcataatgttggttgcctgactgtgattttactacattaatttgtatgatgatttcttaaagtgaaagctgatgagtgaagtggttgacttgacccctcccaggacctctctttatctccgtggaggatcactgtgtattccctgatcccatggagctcagcctggagcctgagctggcctccagatgggctctcggcaataggcaccccctcatcctctgtccactggcccaagctgggccatggaggcctgatggccaagacctcacatcacaaagcctggtgaactggatttcttcagcttgcttattttgtcttttgcctgtggaactttctctttcaccaattcatctttccatcactacttggtttaaataaaatccaaaggctgccttgttcagttatacctttttatactctgtttttatttagacagactttggtaggaaaccttccaagcaaagccccgggggaaaagtgaccattggcacagatttcagcctgtgcttttggcccaatattgtttctatttttattttgtttcatgtttttgttaacatccagggcaaagattaagtacttacacttatctggtaatggtgagaggcctttggattgcttgcctgtggcctggagaatgcatgcttaaaactattaacccccagctacctcctgggagataagatctagctgttaaatttggctttccctaaaggaggttctgagctcctacttgatctgagagagggaaagaagaaggataaatcccaacctttgctgaattttgaaaaaaggatagtagcttaatttatgaaggttgtttttttgaaaaaactaactttatgtcataatttcttagctgccaaaagacgtaattctacctcagctttgccttggcaacccgcttttggcactctgtgcaagcctgtcgttgctctgcattatttaagcagtaatctttaagaaggtgagaaactattattgctttttaacacagttgacatgatattggcgcagactagtacctagagcttcaaacatttctggtggccgtaaaccaacttaaacacctccatgtagaggtctcactgccatgaggtcatagattgctacaaggagggagaaagaagaagatcaaatgttgtttaaaagtctttttttttctttttaaatattcttattccactgagttgtagctgtagattttggccgggagccagacaatcaagatttagtattttgaccagctgtgatctagtaatgtccctcagaggaaacattttgtagggagggaaagacacatatttgagactgtgaattgtactctgtcctcatactttacagtgtgggacctggttgtagacagataaaacaagtacaagtgaatctgaaagagaattaggaaaaaaaaaagtgtttcaaattgttaaagcctcaccccagcttcaagaactctcttgatgtggtaaatctttacatgctttctttatttcatttttcctgtaagtttccacatttacatcagttcgtggcagaatttatttctgctcatagctgatgcttagaatgcctaacagtataagtcttagaaagtcaaaagagcaacacaaacttaatgtaggcaggaagagaagagaaggaaaatataccaatccacttaacctaaaaatttttctcattctcaccccatcctcaagtagaagtagagatcaaatgtagatgttttggtgacaacaaaaaacttaagatcctagggactgggagagagaaggaaattaacaattaggtagaccggcttggttaaatcacatctttctacctagtggcttcatgacctttggtcaagttacctaacctctgtgcttcagtttcttcatctgtaaaatgaggatgatgtttgtaatacttcacagagatgtcataaggattaaatgagaccatgtataaagctgttaacagagtgcttaatccatagcgctttataaattttagttgccgttttattattattaataatttattgggtacttattcattgtactaggaattttacttgtatatctcatttaatccttactgcagtaactattggtagctataaccatttcacagaagaggacacctaggttgggagcagtgaggtgcatcatcagtgtctcgtgtttcctaacgatggagctacatgtggagctctggaatattacctatgggagatgtggaaatgggaatcacattttggactggtgctttcttaacttgttttctctttcccaatctcttttctgtaaaaggaggctacagcttcaggcagtaaaaccaagaggaagaggagggaaatgatgggggcaaggatggtggagtagaggaaactgggctctaccagttcctgggttggcttcatggcaaggtatttgcatggcaaggtatttatataatggttataaaagtgctgaatatggtcttcttcattttagtcagagaaatagagaatttctccctcttaaaaaattctctcttcctgaagctaaattcatgcagaacaaggatgcatcaggggtttggggacaattggaatgtacctcaaaggattctgggaagttcttctagtccctaagcagtaggtagatcatgaaaacagaggaattttgagcattttgactttattcaaagctttccccacctcatgtccccaagaaaaaaagaaaaaaacctaagattgtgtttcacattgaacagattaaatctgttgattgatttgggtctttttctccaaatctcttttatacttttttttttctttttttcttttctttttttttttttgagacggagtctcactctgttgcccaggctggagtgcagtactgcaatctcggttcacgcaacctccacctcctgggttcaagagattctcctgctctcctgcctcagcctcccgtgcagctgggattacaggtgcccaccactacaccgggctaatttttgtatttttagtagagatggggttttgccatgttggccaggctgatctcgaactcctgacctcaggtgatccacccaccttggcctcccaaagtgctgggattacaggcatgagccaccacacctggccttttttttttttttttttggtgggcgggggagtcttactttcatccaagctggaatgcagtagcatgatcatagctcactgcaagctcaacctcctgggctccagtgatcctcccacctcagcctccctaagtgctgggactacagacataagccaccacgcctggcactgtacttctttatttccttcttgcagctagctccctgatgtacagaagtggaggtgtgggaaggtaggtggtaggagtttcgtttgttcctgcttgaaacagtatgctgtataagagaaacagtaaagggaaggagatttagattccagtccttcttctacctattaccctgtgttcctgtgcaagacatgaatatgtctgagtctcagttgcgccttctgtaaaatgagaataatacttggaatttgaagcctactgaaacgaatcataatgacaaccaccacaattacaactactactgacgctagtgtctatgccaggcatcctgccaacgattttaagcacattattttatttattacttactgtagtcgatctattttataaatagtcattaaatatgcccacagtcatataactcaggggtgcccaacccccgggccacagacttttacccgtctgtggcctgttaagaaccgggccgcacagcaggaggcgatggagggtgagcgagcattaccccctgagctccgcctcccatcagatcagccatggtattagactctcataggagcacgaatcctgttgtgaattgtacatttgagggatctaggttgtgtgctccttatgagaatctaactaacgcctgatgatctgaggtggaggtttcatatccccacccccaaatccataggaaaattgtcttccacaaaacgggtacctggtgccaaaaagattgaggagcactgatataactaataaacgaatgtaaccttaagttgtaactccatataggtgggatcatagtggcagagctaagagtagaatccaggtctttgaacagtccttcttgtcgccactgtctctagagctgaagagataagaaaagatagttgattgcaataaataaggactcacagaatgagaaacaaattaatcatcttaatttagagagctcagagaaaacttgatccaaggaagccaaactgacttcctccttgacatctaaactccaggccagttggcttctccctcatcgtgccattgtttgtgaccccaggaaatacttttttacttatggcaaaaggttaacagtccctggtgtggttcagttattcaacaagctacactgtgtttcactaaaccatagcctagtaaatttgcaattatgatatctttgggttgttgttttttaataaattccttttaattgcagcattaaaccacagatgtcatgtttccagtttggagctaagcccagctggaagagacagccacttacgggaaatggctggtgaggagaatgtgtgcagtgaactggtagactcggtccagttgcttgaacctcaggctctgcacccgcaattctagtgcctccgaacacacggggccccttggtgggagcagagaataaagaaaagctactgtgtttcctaatatgtccactcctcccaaaacacacacatttttgcttttggttgtctaagggttgaggctccctgtaagtttttcatcacaatataaataatgtactaattgcatatgatgagtaaattgtcaacagcctttaaaaattggtcatataattagtaaatctatgagtttcaacctcttcatctagatgaaatagtcatgaagccagactgtaatcaaagaatcttgaaacctcctgaatattctgttttgaactattatttgccttttcaattcctccctttctctctttaggcaagagtagagataaaaatactcttttatttctttaccttatactaaaatatgaatgaagggtctttctgaaaaccttccattaaatataaaatcaaaattattttattaaaaatctatgcattatgtttttatacgagatgctcacagcagtttgttttttaatagcaaaggttcagaaacatcctaaatctacaaaagtaagggaataattaagtaaattatgatagtccattcagtgaagcaaccatttagaattctgcttaccaggaggttttaatagcatccaacagcaggatgtagcattctgtatataccagaaacacagctttagtgtttctttcttgtttcctttttttttttttttttgagacagggtcttgctctgtcgtccaggctaaagtgcagtggtatgatcacagctcactgcaacccaggctcacgcaatcctcccacctcagcccacagttgctgggactacaagcgctcaccaccatacccagctaattttttaattttttatagagacagggtctccctatgtggcccaggctggtcccaaactcctgggttcaagcagtcctcccaccttggcctcccaaagtgctgggatcacaggtgttagccgccacacctggcccatagggtttctttaaaaattaaacacatatatttaaaatcaaagtctgaaaggaaaatacccaaaattaatagcagttatttgatgggtaatagacttgtgagtttttatttttttatatagttaacatagttttagttttcctgtaaaactattgtaataattaaaaatacatgtgtgtttaatgttatcatttgatacttcaactgtttggagcttggctatcttaaaaatctggaatgtagctgggatcctggaagtaataaaaaaatcaattctgaacagctaaaactaatgttaccaaactcatataataaatacagcatattgtgcccaggacagctcctggcccgccacgcaaatcctgtttactcatactttgcacacaattttcaggacatctgctttacaagaacacagcaaactaagaaagggtatagtggccactgcgggcaggggcactgattcaaccacccacagcgccagaggggactcgaagaacccacgccaggcttacctccagacctgcgtcctacagaacagacaccactgaacatcctgtagtccccttattgtgtcatcgctcagtaatgttcatatcagtggcccagaggcaacgagaaaatgccttttcttgttcaacttttttaagatggtaagaaaagctgtaataaaaatttttgaaaggttaaatctcatagaactaaaaatggagggaaaaaatgtggtgataaaaaggtaaaccttagatatgtagacttctttattatctctccaaaaataactaatttccttaccattcttaagagagaccattttggctgggacctgtggctcacacctgtaatcccaatattttgggaggccaaggcaagaggatcacttgagcccaggagtttgagaccagtgtgtgcaagatgatgagatcctgtctctaaaaaaaaattaaaaataaaaaacattagccgggcatcgtggcacacacctgtagtcccagctacttgggagactgaggtgggaggatcccttaaggccaggagttgaggctgcagtgagctgtgatcacaccagtgtactctagcctgagcaacagagtgagactttgtctctaaaaaaatttttttttaaattaaaaaataaaaagagagagaaccttttactggtacttggattttccagtttgaatctgatactaccattacttgagttttcatacaaatccaagggaactggagaagaatgtcacaaaatcaggatgtcagaaaataccaaagttcccacctctcaaagccttggagtccatccatgaaaagaggaataacattaccatcttagagtttgtgggcaaatgagaaggcatttagcttgatgtgtactatgtctttggcacttagcaaatgttacttgaatttgaatgtcgtgttcccttgtgggacacaatagataggatgggctctggagtcagacagaatctagttcagatgtggttcttcagccttgaacaaaccacatgacccaccacctgcctatcttcctcacaggacactcgagggctctgtgtgggcagctcatcttccacggggctcagaacattattgacagtcgggaaaatggtcgttcccttcacattgtagttggcaaggtggggcagtgggggttgtcgcgcctcattagttttctgttgtacaaagttgagaacttttagagttctcaaactcaacgagggctacaaacaccctgttcctcttgtgcggcaagcactgctgggtgtgccccaggcctgtttctcatgccctgccttttatcagcccactgggagccccacaaaacagcagagcaggatttctggggtgggaggatggcagcgcagggtcacagcatgaggggttaagcacctggctctagccacacaccaacaagtcaccttcagtgttccgggctgtttcacctggtgcttccacccctcgtgggctgggctggcaaatgaaagcttggcttttctgcacagaatagactgtctgaggtggtgctgatgttctcttttggtttgagtacctagtcaacctgcaagatgatttagagagggacactgttagcaaatggtagagtaaaaacaaggcttgcaaaaatgtgtagcttacccaattattgtgaatttgggcaacatattaactataaacctagatcgaggccagcagattttgccctgttttgttttgtttttctggagaactaaacactgtaatttactagtctacttgcctagttctatatgtaccccagtgaccacgcctaattatgaaatctctcctggcaccagtactcacagccaggcagaggagtctgacagacccaaggattagaagccgtgtggttgccccttcccaagaataacccttgcttgggtgtctgagactgcaagtataatcctgcatcagaggagagagagcagggagctggggccagggcttgtggctgtagacacaagtggaagaaaccccagatctcttttcttttctagggcacttcttgctattgtaatttgaaaatgtattatttgaataatgagggatgtctttctcctgcaggactggtagctccttggaggaagggcctactggtcttgcatctgtctccctaccccaaggccaggcacatatgggaactatttgttgggtgtgtgtagtttcaagttctgcctctacccctgcctagtggttgcccttctgcaagccacttaaccctctatgcgtgtttcctcatctgaagcacgcaagtcaaatgatctgtgtgtgcctccctctgcctctggacccaatctgttcatatggttgtattgaagctaatttcatccacatacaagaatgtctagagctagcatagtgtataacatagccatcatttccaggatgtagatactctatttccattaactgattattatttattatttcagactttaccctgctttctctatagggtttttgtaaagactaagtgaaatgatgtataggaaattacttcagaaattataaagtttgtataactgaacaatgattgttattgctggcccaaagataccctcctgagaagaaactcagacccaaaagacagcattgcagaccaagtattgtaaaacatatgtgtggctagccccatcaaagaatgtatttcccaagttagtttttcattttaaaaaaaaaaagggaacccctcaaaaatttttttaatttnnnnnnnnnnnnnnnnnnnnnnnnnnnnnnnnnnnnnnnnnnnnntctctctctctctccctccctctctctctctctctctctctctctctctctctctccctccctcctctgccagtcctctaatgcaaggtggttagcatttgggtgttggcaaggttgttggtcatgaaatccttctcactgcctcactgagcatgggcaagtcatgtaaattctctgccagatgaggatgcctgcttttcaaagctaaaataagaattgaattgaatactaaaacaagaatgagattatggatagcccttcagaaatatgaagttagttatatccttcacatgtttttcttgctagatccagcctgtccagttacttcacctcttccccataggacagggtttctgttccctgccctgccttgggccctcttctctaaatatattgcagtgtgtctgtatcctgctggaaggaagctcccaaagttggacccacatacctcatgttgttttttgcattgagacactgcaataactattgtctaagattgattcttatctatttttattagctcagacctaagtatgctgttccctgtctctggatccagaaggcttacactgagttctgaagtccaaagtaacttcttgtttttgtttctcttctagtgacagacatcacacctccagtgcaatccctgttcctaagagacaaagctccatatttgggggtgcagatgtaggcttctctggggggatcccttcaccagacaaaggacatcgaaaacgggccagctctgagaatgagagacttcagtacaaaacccctcctcccagttacaactcagcattagcccagcctgtgaccaccgtcccctccatgggagagaccgagagaaagataacatctctatcctcctccttggatacctccttggacttctccaaagaaaacaagaaaaaaggagaggatctagttggcagcttaaacggaggccacgcgaatgtgcaccctagccaagaacaaggagaagccctctccgggcaccgggccacagtcaatggcactctcctacccagcgagcaggccgggtccgccagtgtccagcttccaggcgagttccacccagtctcagaagctgagctctgctgtactgtggagcaagcagaagaaatcatcgggctggaagccacaggtttcgcctcaggtgatcagctagaagcatttaactgcatcccagtggacagtgctgtggcagtagagtgtgacgaacaagttctgggagaatttgaagagttctcccgaaggatctatgcactgaatgaaaacgtatccagcttccgccggccgcgcaggagttccgataagtgaagtgagcaggtcaacagtaggactggggcagaagctctgcctaaaatgaagtgaaagctgcacttaaccctttgtgataatgatgacacaaaatgaatattaatggaggatattcctcggaaaaacagactttgggaatgaaggagggactcaggatcattgttatcagtgggccaaagttagattttgctttcaagatttgcttttcgggcctgatgattttaaagcaaaaatcaccctctagttgaaagagcttacagctcgagtcaccttttagctatttgtctgctttttatttacccttgtatgttatcctcagagggaagatgataatatataaataatataatgaacacacccttagtttctcataagcatttgccctcaccatggtttataaaactttgggaaaacggaatattcagaaataggtttccgccatgtactgaaaggtctgtggccatctgtgaggtagatgaagaagcagcatagtggtctccttacatctaggcctaactgtccctcttcctgcccccgggtaccacagtccacctttagaccctactgtcgccccatcttctccgtggatgggccatgcgtcctgaaaacaggacatcagattcactggttctgtaacccagtagctgtgacgttccatctcttctaaccagccatggccttcccctcctctgccatacccttaatgcggccctcagattagatgaaaaacttgctcctggtggatcccaagggaccctcaaggacctcgaggttactgcagtcagatgccatctcatcccctgtgggggccaaagtttttatgtgggcagatgctgtggtcaggaactaggcatgctttctggcaatgcactcaccagacaaaaatcccttgatgtaaatcccatgttaatttattaaatttcagtcagaaggtcagcatttacatgacagaatgtatgtagagagttggggtgtctggtaggcaaactgcaaggcagttgagatagttggattaagaggctagacgagacatagaatactattggtatgtgtgcaatttcatgaatattaaattatgtttcgaagtccagttgtcattcccgcattcagatttcatttgctgttgctttatacgttacgtacccaaggacattgcctcagggttgcaaactctttaaaggaaaatttatccatatatccatgtattatatagaagaataaaaattgagtttacttcacccgacctgatttttttttaccagcttggaaattcctcttgaacctacgtctccatatgtcacatcatgacaggactagcctgaacaaaagccatgtctatctaagcggaggctgttgacttcattcagtttgcatattgtatatagcaacacaaacacttgacaggtatatactccagtcgccacatttgtcctgcataacagcttcactcacaggcctcaccgtcactttattttgtgtccaagcattcctgggctcaagtttaatgtatagctacattgttgttttccatgtagagaactcacaggatgactacatcacaaataaacccaactctcaggcagtcgaaagctttaactggatctgcagaagcccatcttcctccacatgaagaagtggggctccttcacctagagcaggagcttctctgcagtgtactgtctgtcgctcattttggagtcagtgtgggtggagacagcatcgtggatatgcacgtgctgcggggccctccagggaagtaacatttaccaaaaaaaaagaaaagttctgaagggcagtgttaggattgcagaatggaaggtcaaccccgtgggacttacgattgccccaggtgcgggatggacttaaatgtcacaccaaactcaaagtaggtacactgggttgcagggcatccagcctggcgctggcaccaccaaggagcaggactcctcatgattacagtgtccatctcaggcccacacaaccatgagagcctggactctggggtctacccgtcagtgccccccaccgctgtgcagactccctggttgatcctgggcttgtggcttttcaccgcacggcggggagccctgctcttgaatgtcatcgggctgctcagagctgattgctaggtgcctacacatttgcctcgacccacacagccccgtggtgatgcctcaaaacaccacttaggtttgggttcgtttagttcgagtttggggttttcatttgaacttgtttgatgtctgcagtttctgccatgacctgggtagaacctatgggattacccgtctcctggaataactgtttgacgttttccaaagttgtagagttagtatggcctctgtttaaagtggctggggccaaaataagggatgagttattatctcctactaaccttttagttttgtaaatcactaagaaaattgtttgcttggaagatataagttgaattggaaactcattactatctatttctgaactgctaagaaccctttcagttttcttacagctgagacacttttaaacagcgggcaaatgttatcaaatgaatatttgattgtgttttttctcttcacttccccttaaccactttagaaattccagagatttttttcccctcagaatattagttttggaagattgtgcccagctatatattttttagcagttctaatggtgcccatttatcctgacctaaccagttatttaaataattttttaaaccaccacgaataataaatggcatgtgaaactgatctgttggtaactggaagaaaactcagcatctgtatttatacaataaaattgattagtatttattttgagagttaaaagtgtatattatttccctgctatgtttgagtcctgtcttcattgttttgaatttcatattgaagctgggttaaccacgaaaaccttgttcttaaagagtcagccagcatttatctagcacacttgctctcacacgctcacacacactctctctgcacatgtgtgtaagggactgggctaaacaaggttaagagatgagtaaaccttgacctctgccacgttctctagtggggctcacaggtatgttagctattaatgataattccgtgtgctaaattctgtgatggagagatgtatagccattctacggaatgcagacaaagctattaattgtcactcaagggtcaggaaagatccatggaagtaatgcagattaaagatatgtaagatttcacattgtggaaca

SEQ ID NO: 15391 - DNA, 22131 bp, Human
atacaatttttggggggaggacactaacacctaagtcaaaaaggaccaaaagacataccatacaaagcaaaggccctctgccctgcaccttccctcttctgttctcattttaaatgtttctactttcatttcttctagtagattgtccctgtctttctaaatactatgctatttctatatcaactttctaatgttttcaactttagacattgctgacttcttcctatgatagatgagatcacttatccattcctctttttatgtacatatttttaaccttggattttggaaattgatcaaacctatacaagattacagaaaatagtataataaaccccaggtgttcatcaatgaacttcattggttatcaactcatgacaaattttgtttcatctctccctgccattttcccttctccttttactatatagatttattgccatttttaagttttctattgtttacttttgtatctttaagtaatatccctaaatctgtatttctctttctatgaactggggacagcgactattgatttattattattattattattatttttttgcgataggctggggcaaaggagacaatcctaaattgctaaccctaaattaatgtgcctacatttcctgccatctcccttcctcctcccagctttttgtcaactgttgctgcaggccaggttcccaaggaagctgactaagatgtagagtaatgtgcaggaagtttcttagggagtactcttaggatcaacacctgtagaaggggaggggagggaagaaatcaaaattcaacagacagagaaagtgggcagtctcaaaaaaggcttcagttaaccccacagggagctctgaagctgaaatggcctttcagagatgtcccaagttggggtaaggggctgcacctttgtaccttcaagttgaatcactgatgtgggcttcctgagaacaggggtgaccttggctgaggtacctatctttttctaagacaatttctgatgagggctaacgacagctaacagctctcaagccagctagggaaataaaatttttggtgttgaagggagatctgagcagtgcaccacagcaccatcacagctgtatttgtaccttcccattgtccattgttgtttagtcataattaagtcatctgggctttgttatagattgattctcaaagttgaaaatcaaactgtgtttgcagtattaggacggtataatagtattcagtacagtacagtgtagggctaggattccatctccccacaattgctgctctctctgtttggcgcacccttcttgcagacctcaatgcggcttgctccctcacttgcttcaaaattttgttcaaatgccacttcactagtgaggccctgcctggccaccccatagaaaataacaagcatgccccgcacccacgctttatttttctccagaccgggtatgcccaccgacactctctatatttttttattgttttaagctccaccaaagcagggacatagagccccagtgccaccaacagcgcctggtatacatatttgcgatacttaataagaattagttgaagaaatgaataggaaagggagtccctttagatggaggaagggactttctcaaaaggcctcatggaaggagaatggcattgaggctggcttacaagaagtgtgtcttttataaaaagaaggaagggcagggcttccaggtgaaaggcatagcacaagcaaaggcaaaaagacgggtaactgctagttgttaagggcagtggctgaatcgctatacccctagcagttctacacctaggggcctgcgggccgctgggtctgcgaagcttgcaaggcaactggcccgcccccgctctgcgcctgtctctcggccacgcctattgctgcaggatgacgcgcacctctagaacccgccccggaggggaggggacgcagggaagagtcgcacggacgcactcgcgctgcggccagcgcccgggcctgcgggcccgggcggcggctgtgttgcgcagtcttcatgggttcccgacgaggaggtctctgtggctgcggcggcggctgctaactgcgccacctgctgcagcctgtccccgccgctctgaagcggccgcgtcgaagccgaaatgccgccaccccggaccggccgaggccttctctggctgggtctggttctgagctccgtctgcgtcgccctcggatccgaaacgcaggccaactcgaccacaggtgccgcccacgccctccctgccatctcttctcccttcctccctcccttccttcctccttccttctttccttccttctttgtttatatccattctttttacccttcctctctcctaccattccttctttcatccatcattcgttccctccctccatttttcactccttcctaccgtcccttcatccctcccttccctctttccatctattcatccatccatctcctatccctccgtgcttcccttcctctttccccccatctttcccatctctatccatccatctttccccctcctttcctccctccattggtccatccgtcccttttaccttctatccattcatatttctctctcttctcccctccttctctccatcctttcttcccttcagctattcatcttttcctccttatcttcctccatccaaccatctgtcctttcctgcatacatcattctctttttttcctaaattcatctttcctttccaccatctttcactcactatctcgcttcctcacccaggttggaggccatgaccaaagcctaaccctgccacccaggactcaggcttcctcctcgagccccactcccacccttgctgaggcacagcgccctccctggctaggctgttaaggtgcagggtccagccttgggcctcttagtaacctagcacctaccatgagggagggttcagtgtcagtgcaggttacctcaccaaagcccctccctcctgtgtagatgctctgaacgttcttctcatcatcgtggatgacctgcgcccctccctgggctgttatggggataagctggtgaggtccccaaatattgaccaactggcatcccacagcctcctcttccagaatgcctttgcgcaggtatgtctgggaacctctagctgtgggtgtgtgctgcttcgtgcactgagggttgggggcggggagcttcagctattgtcagatggcacagattgtgcgggacatcttgttagagggaagcatagtctggaaaatggtagtggagaaaatctggttttccactcatgggaaagcttgaccttcaagggtggccttctccttgggtgcaaggtgcgccctggccctgatgtgttcatggcagccctggccagctttctcccagaacgggcgcttgcctggtgctcagaaggaaggggtgctgcagaagggcacccacaggtctgcaggctgggcctcaggtgagagctagccagggtggctctgctccctggaccccctcatggctctgcccccagcaacactggccgctctgtgtgcctggggaggccattgcgtaggaggagataagcaactgctggtttcaggggctgattgcttcccttttctctcccggaagcagtctgttgcctaggtgacacccaaatcccagtgtctggtttgagctctgcatgactcagctaccaagctgtttgctaggggcctcgggagggcggttgcttggttacctaagagatggcagacatgttttgctgtggcgatgcttacctctgcttctgctccctaacagcaagcagtgtgcgccccgagccgcgtttctttcctcactggcaggagacctgacaccacccgcctgtacgacttcaactcctactggagggtgcacgctggaaacttctccaccatcccccagtacttcaaggagaatggctatgtgaccatgtcggtgggaaaagtctttcaccctggtactgctccacgtccagagtctgggttctcttggtttgtggtgtctgaatccagcattcccatcctggggatggggctgtctttgcagagccctcttctggctgggcgagtccctcgctagtcagtgcttcctttctaaaaaactgacttgtcaacccagccacgttttcacccaaagtgaaaaagggtagaaagagctttgcttcctttcagaaaccactgagggtgtgctgttgggtctttcagctcctcgggtggtagggaggacacaggctggggaggtggcagtgttgggtggagtccagctcagggccccaccctctcccctgcagggtacctgtcagtaaacctaggggtggggtgaggacacctgagggcctcccgtgtggccagcattgctgttgctgacttattgcccaatgagggggctgtgcttaggtaggggctgctatccactctggaaattaagtcagaaagatgagtgtaatctggtacccaggatctatagggtcccagagacggacattccttacctcaaatgctgcctgataaactggctctctttaatgccaatatggggatagtgaaaagcaaacaaactttaaaactttttatttatagaagtaatgcatgagtatttgagaaaaaaaatggagaaaaaagtattggaagacaagagcaccatagggacaataatgcttatcatttgggaatgacgaatgttttcagtctctttccctttgctcagtggttacaccggcaggcttggcagccttctgcaggagctcagctggccagcccaggttgagagtgacattcagctctactaagtcaggccagtttcagaggtgaacctgtcaggaatcatattgcacagccaaaagtccagtgtcaggagaactttctgcagtttggtgttctcattaccataccccttgcccaaatgcagctggagggaagtgatgattttggagagaggaggaaacacagcagagggaggagattgtgctttgggaggggaaaccaggcaaggactgagtgatgttgcttgacctcctccctcctgatgattggattttggcaccaggctctaagcaccatgtccttctcagagaataaacctttccctgcagcccttgtgggaacacatttttcagctgaatctttgttctcaagacctttttctgttagcattgggcctgcttcaagatgacagtagccaccactgtgtgccaggtatgtaccgtttaccatgctggccactcctttaatcctcccaacagcaagcaaggtgggtttttatcatcatcatcatttcccaaggaagacatgaaggctcatgggagtcaagtagcttgccagaggttgcaaggatgctaagaggcagcatcaggatttggacctgtggttgttggcttcctgtgtgctctttccacagtgcttgctgtcttcataggccctccacccgctgccctctttctctccattcctgtctcttctggtactccctatgggagtcccactgtgtgactgctgctgatgctttctcacgaggttctgcctgtgatcccctccactcccagctaaccactataggcagcacttcccttcagatccctcacaggcctcactggctcctagaagtcctccctgccagtcctcacctgactcacaataacctctgtgcttggaggatcccccacttggcacttcgatgcttttgaaagctggaagtccttccttggtttccagtgctgttatactgtcttcacaaataaactataaactactaagcttaagggtgggtttctgcttcatgaatgagcacttgaacttggaattctaaaacaaggttttgagtcctggctcccttatctaatatctggttagcataggtaagtcacataccttccctgagcctccctctcctgcccccatcggctccctgatggtgctgatgcctctgctgcctccttcatagggtgagagataggtttcagcatgggctctaaggagctgactgatcttgtccttgtgggtcccttccacagagcctagcacaaatcatcagggcttagggaccaggaagtcagatgcttagttctcaaatagaaactagagagtttggctttagaggggacttttgtagatgaggaaactgagccccaaagaagggaggttccacttgcccatttgtttacagagttttaattatggggagtggggtgttgaaagactcatcatgttttaacaacctttttttttttccaagggatatcttctaaccataccgatgattctccgtatagctggtcttttccaccttatcatccttcctctgagaagtatgaaaacactaaggtaaggctgtgaaagggacatttctgaagaggaaccactttttcctttgtcacataaactactgggtatactgcatgttctgtgaagctggttatataccacgaagttgtgggtttcatttgtgataatgttttgacagaagtaagtgttgggatcttcagcattaggcccgacaggagcagtggcttcattctagaagctggtgggtgctacttgttctaaaaccttgggctctaacgtgtcagactcattgaatagctccccagtgctcacgctggatgagactgagagttgtaggagatgctgagacatgggagggagaaaagaggctgagctccaggagcctcagcccagaatgggagaaaggcatgccgtgtatctgtctctgacctaatgtgtatgttcagcagctgagacctctgataggggttttgaatttttagagcattatgaaaaaaagtaacctacaaagaaaatcttggtttagaggaatcccaaatgtataaatgaaactaaaacccacatttaagaaactcagaaaaccagctagggaactgagacatgaaatgtatctctgaggttttagtaaacatcgtgttgggaagggtgaggatttggaagtgaggtggaaggtattgttctaagttcttgacagctttccatttcagaatacagtgaaaactgtgagctctggcctttggcttgtggcttgaatagggaagatcccatcttaattccctgaagccatcttgcttctttttagtggcctcacttacgaatgccaggtccctgccctaacttccccctacccatttcttctcaaagtggtgggtctgacaatactaaatctccctcgagtgctgcaaatcgtgtatatatagatgatgaacaagtggtctgaggcgggtgctgggctgtcctgcccaagggtggggtgagcaaggcagggctgtgaaaaggcaacactctttgagatggaacagcagctgacacagcccctcggtctttgtggtatacaaatcatggtcagaactaactttggtctcacggccagcatgtctactttaggaagcaaagcaggaggtttcattctgtgcctagtgtagctgaagttctggaaattccatggactgtcaccttatcaagttgattgggaccctgtcacttacaagccttagcctgtctttgaaatttgaaatgggttttttttttctttttaaatttttaattaaaatagagttcatataccataaaactctcccttttgaagtatataatttaatggtttttagcatactcacggagctatgcagccatcacccaaatcgatcttagatcatttttatcgctctcaaaagaaaccctgtacccattaccagtcgttcctcattttgtctcagcacccagcgtgggacaacaactgaactatttttggtctccatggatttgcctattttgtccatttggtataaatagagtcatacactatgtagccatttgtttctggcttctttcacttagaataatgtttttgaggttcagccacataacagtataaattggtacttcattcctttttttttttttttttgagatggagtttcactcttgtcacccaggctggagtgcaatggcgcaatctcagctcactgtagcctccacctcccaggttcaagcgatgattctcctgcctcagccttccgagtagctgggattacaggtgcccaccaccacacccagctaatgtttgtatttttagtagagacggggtttcaccatgttggtcaggctggtctcgaactccttacctcaggcaatccactcatctcccagagtgctgggattagaggtgtgagccaccgcacccagcctttcattcctttttatggctgcataattgtctattgtaccacattttgtttatcagttcatcacttgatggatatttgggttgtttctacttttgactattaggaataatgctgccctcgacatttttgtacaagtgtttttatgggcatatgtttttaatttttttgggtataataactatgtttaactgtttgaggaattgccagactggctttcaaagtggctgcactattttacattcccaccagcaatgtgagagggttctaatttttctgcatcctcgtcaacacttgttattttccatcttaaaaaattataaccatccttttgggtgtgaagtggttttgatttgcatttccctaatgactaatgatgttagccacatttccatgttcaattggccatttgtatatcatctttggagaaatgtctatccaaatcctttgcccatttttaattggcattttttaattgttgaattagagatggatttttttttataattagtctatcggggtttcttttaattagttatgatctggagaaagagtattagtagcaagaaaccaagtgctagtggatttctggcccctgcctggaaaacaagaaacaccttttctgtcttagttctacttctgatgtctctgttcagtctgagtgactaacacgtgaagggctgattatgtgaacattaaatctgtgtgtgtagccttcatggcttcatttcttgcacttaaaaagctgatgttatattattttgttttgaaagacatgtcgagggccagatggagaactccatgccaacctgctttgccctgtggatgtgctggatgttcccgagggcaccttgcctgacaaacagagcactgagcaagccatacagttgttggaaaagatgaaaacgtcagccagtcctttcttcctggccgttgggtatcataagccacacatccccttcagataccccaaggtgaagagctggttgagggctgatccagcacagctgtgacagctgtgttgtttgttgagggagggatttgcacagggaaggtggctacatcctgccatcgccaggcaccatggttgcctgatgggcactagtgtcctcagtggagtaaagatgggatttagaggtcaaggccaagaacatgtaagaatcttgtaagaaatgcttggctttccgcttcactccactggagggtttgatttcctttccttgaacttattgagcagatgttgggttggatggtgagatcaccacagagtagtgaatcagagctggctgccaaagcctgtaataagggatggcccttccaaaacagccccagggaatgtgaaactctcttcaaaaactgcctgttccccctgagcctgtcaggttagatcatctaaacacaaagcactgcattgcttcttggaacctcaaatcctgtacttgcttgtatgtcatttagagcatgtagtcttttctgttttagaatccttttccatttttccctatcatgttttatgagggcctgagcatcccatccttttgactttgcagagaatgcccctcacatgtaatgagagtagagaccagcagtatgctctttgatgttgcaggtatcttgctttgattggcccaggggatcttgctttcctagtaggagctgtcagcccccttgatagaagaaggctgtgaggttcacctctcctgcctctttgcagaaaacagttaacaaagctggcctggctgtgattctttgaaaggcctgcttataagtctagcccttggctggcatctgggaactttgatttctgaagtgttctcactattcccagaattggcttactatgcttaaaccgtttagacaaacattatggttgatgataaacccttgggtttgtttttttttttctgggagcctggaattttgatatgttccagacagatagtacctacctgaccagccccaaataaaaactggataatgaggctttaatgagcttccctagttagcagcatttcacatgtattgtcacacaactcgttgctgggagaagtaagtatcctatgtgacttccctggaagaggacttgaagcttgtgcctagtttcctctagactttgcctcatgtgccttttttctttgctgagtgtgtttcactgtaataagtcatagctgtgagtgagactaaatgctgaatcctatgagttcccctagtgaattgctgaacctgagggtggttttgggaacccaacacctcaccacacttttctagccaggcaggaggtggggacaggaacagaagggcgtctgtttgtatgaaggaagagagttgttgctgctcagtttgtaggaaacagaagtcgtatgatttcattgccattggcatctcatgagagtaacttaaggctggacttccaggtcagggccgagcacgtggggaatgctagtgagccaccactcaaatgcatcccaggcttagagaaaaggcagtatagacagtgatagagccacaagcttgtgcttttgctaaaagagtgacaactttgtggctttgtgtttttccccaaggaatttcagaagttgtatcccttggagaacatcaccctggcccccgatcccgaggtccctgatggcctaccccctgtggcctacaacccctggatggacatcaggcaacgggaagacgtccaagccttaaacatcagtgtgccgtatggtccaattcctgtggactttcaggtatcaaggacatagtttggggatgtattggacactgatgacatagtgtcgtaggtgaaaccactcttctcagtagacacaactccacctataatgtcttattaagagctttctttgtgtgagttatcaggcaaagtgctggggtggaggtgtcctataggtatttaggacacaggcagtgttgcctggatcaggactctcccaaccagtgtcttactttctaaagaagggaatgtccagagagttggtgacttgttgtgtgtggacacagaggtggggaaccagcctgggtgaccgttcctaacccaggggatactgttcaggtgacagctcattaattgtagagtgatgggcaactcccgagcagcccagaatgcttggtttgctggtacttgcaggttccctctgtgggaaagcccatcctggctagctgtcactctcagggggtggcttggtgaacaggcccttggtgcagagggaactgggacaccatcatggccagtgccacccagctgtgatgtccggcattcctttgccatgatttaggggcggagcaaccacacaattagaatcctcacactgactcatcagtcaccctttctccctggagagcagaatacacattgactaatgctctttctggaatattccacacagaaccctgcccttctcttaccacatgaatgctgtggcaggcaagctatagcggatggaagatggcagtgttttcaaagtgtgcatcctggactacctgccttagaatttctgggagggcttgttggaaatgcaaagtcttggcccactcagatttacacaattggaagctggaggtggaacttgacctgacaaccgacatttcttaaaaaaaaaaaaaaaaagcacaccaggtgattctgattcatcagaagtttgagagcctctgctgtagagtattgtttaaagcaaacacagaacaaaaccactgcatacagatatcccttgctatccaaacttacttggcccctgagtttgcacaacaagagtttggttggtgagaggtgtacattcctcaaatgtatttgattcctgtttcactgagagtttggaaagcaatgcatccatctgtttgttttctaattttgtgtttctgggctcctgatggtgaagtggcttgaactggctctgaggctgcacctggatgctttattagtgatggtcacttaaaatgacccttcaaaatggactgtgtgccaggaagggcgctgattcatgtgtggtatcgcctttagtcctcatggggacttagtgaggtacctgctctctgttgtctaggtgaggaaactcaaggcatgggaggtgtgctgacttgtctgacagcacaaaattagtgctgggtggagccaattcatccccagggactgtaactccaaagccccatggttggatctgttggttcccagcagtgtgggttcgaattcatgttctacctcataccagctgcctaacctctgtcaagtcatgttacctccctgagcctccctgagttttcttctctataaaactgaaacaaggtaggtaaagtttttccatgataacacctactttagagattttcagcaagaaccaaagagagcatgtagaagtatctaggaccgtgtcggctgcacggagctatctccttcaagttctcttagtcccctccttacacacagtggacagcatgactcagagggcctccctgatgcctgcatgtgctggtctcagccctgtgttccccttgaactctggcctgctcactgtcctcttgtagctttggatgtccgcatccaagcccatctcactgcacccttgagactcagctctgggatctcttcagctccagccctctaactcagctctacatgagccagtgacctcaggggccacactcaggagtttgttgcctgctccttccgagtcaccatactgaccacaacctcttctcctagcacttcccttgctctacctcacggggattgctagagtatggatttctatctcccccttgtgtccaggtcctgttggctttgttgcttccctaaatagctaaggcctggtggcaggtgacttactgtacttcccagccgcccagctcaccatacttgtccatttatccttgcccctcctgcagtacctttatcgtcagacactccagccacaccctctgctctgtagtccaagtcctgaaagctgctggagaaaatccatgcccccacgaagcagggaggccctcagatgccccgcctccagccccagcagcccaggcaagctctctgctcagctcacctcacttgtcctctgcagctgctccgtttgcatgacctcttctctactccctttcactgctcccctccaggcctttgccacccctgtgccccatttctcagtggatagcacctttcctcttgtagaaatggaagctggtggacagccagaggtaggggatcggacagggtggatgtgggtacgcatcctggctgtgccccttatcagctgtgtgactctgggcaagttaacctttctgagtcttggagtccttaatgtgccgttcacaggatcagatgccacctagtgtgtacttgctgaatgggctctattaataatctctgtcactgagacctggaattttgtgtatgcatgttctgggctcgaggcctcttccctcaactccccaccactgtccctgcttcccacgtctgcaagcagaatgagcaagatcttccttctcacctacctaccctgcagcctctccatccactctcatccctcccagctgcaaaagtgccagcccccttgcccctgcctgtttctgctttccactccttcacctgacctccaaggcagagcgagtgcacactgggctgttctggctgtgtctgtggcctcattgtccatttgttcttcaccatcctctacacaggcttccacctccccaatccactaaactctcacctcagcactgaccttggtggccagtaaaatctatctgtgtaggtcctgaccttccttgagctctgtgtcacttcctcactgttggccagctccaccccttctgggactgttggcctcccaatcctttctgtgtctgccacttaggtgccacttcccaggccccccactatatcctttccacctcttcttcccctgctgggctcagttgagccttggcagatgactccagaactaccccttcagcccaggtctctcctgattttcagatatgtgtgttgacctgcctgtgagagccattcctaggcagatgaccctggagacctcagctccataggcttccgcgtggtcaggccaccacccctgccctgccttttctccttcctcctcctcctcttgcgccccctgcccccaaatgccagcgaattatgccaccagctgaatgtgaaacctggagtcacccttgggttcctcaacacctcctcctcctctgctccctgcccccatgtctgcttgatgcccctgaattcctctcacatccacacagtcctctggatccttcagcacattgttctggaccacctcagtgggccttgctttgttttgttcattcagcaagtgtagtgagcacctcttatgtacccagcagtggcctagtaccattttgtctaaagcctctggaatctgtgtctgtgtcctgttgcaacaggactcttaataacttgaagcccagatcatgtcaatttctcgccttgaaagacctcagtgactccattggcctagaacttggagtctccactccctggatagacccaccaggtccatattatctggcccggacctaactttctagtcacccctctgccctcccatttgattctccagtcacatgggcctttcattggccccaaatgcaacctgctctgtcacaactccacactgttccgtgccctgcagcccctgcttggagcatctgagccccatttgtctgactgcaggtgcttcttgtcaaattctaactcctctgtgaagccttccctgaatctcccaggcagatttgagggcttattcccctgtgtcacccctgggcctctgtgggggatcggtcagagtggtgggaaaaactatagggaaaggatgcaaaccttctgaaaggtcagaaggttctgcagagccccaggggagaatagctgttctataaccctgaggcagagggcaaggagtaggtacaagggagtgtgggagaatttatcttaaacaggcttgtttacttatgttgaccaggaactgacctttgatcgtctgtgcttgtgaggttccctgaaaggggaacaataaatgttaattacctgcaggttggctctaggtttttggcattatgcctgcactgaataaaagccagcagctccagcttctcggggctgctctctggccactagagccaggcagtaacctagctgctcttatgctgcatacctgtgtctgagtactcatttcatccataggccagggtctgcaggacagacccagcaggcctcactgataattaagcattttcttgtctccatgattgtgtcctcactggatggggtggctcatcaagggtgaggaccttgtctgcttattgccttacgtccaggggctagcataggaaggagggaatacctttgtataggacatagccatcctgacaggtgtctttcatccccaggaggaccaaagttccacaggtttcagactgaagacttcatctaccagaaagtataagtaggccagggctcagcataatcctgctggaaggctagatgtatatcttttctcttgactgcaagtgagaacgggtgagtctcatgattgtcctcaccctggcagtgatgagaagaagctggtgggtccagctgataagtcaggggctggtctgcgaagacacggctctcttctcacccctctttggggtggaagattaatttttgtccttagcatttgtgaaccaggttgggaatgagagtcagcccaggaggggccggtggctcatttacttcagggcatgatctggctgttcccaaagtgcctcttgggttcagggactgtgaaggacgtgctgctctctggtatctcctttgctcttctcctgcctgctgacagtttgttagaaatgagctccacgtaacggccatagttcatgaagatatgcagttgtaatctgctgttgggttagcaagtgatcagagggaaaggctcagtcagggttgctgttatgtgttaaattatgaatttttttttccctgaaaagggctgttgacatcctaaccccccagtactgctgaatgtaaccatatttggaaataggtttattgcagatgtaattagttaagatcaggtcatattggagtaaggtgggctcctaatccaatatgatcggtgtcctttaagaagaggggagagagacacgggaagaacacatgaagatggagacacagtgatacagctgcaagctgaggaatgccagggactgacagccaccaccaccagctagggagaggcaagattcttctacttagagccttcagggagagaatggccctcccagcaccttgatcttggacttctagcctccagagctaggagacaatacatttcagcttaaaacaacagagcagtaggtgacacattcatccactgtgatctgtgccctaaagtgaaatctgatttgcttagaaatgtatcttatttgtagacctacagattttgctgtgactctgtgggtgaagtgatgctgatggtagggaaaggagtgttacattttggctgagaaaatcattaagggcatcaactaaggggtagggattgggagagatgcacaggcaagcattatctctgtatgccttggcaatttaaattgcagtcactctcatttttattttttttcaatttgcagcggaaaatccgccagagctactttgcctctgtgtcatatttggatacacaggtcggccgcctcttgagtgctttggacgatcttcagctggccaacagcaccatcattgcatttacctcggatcatggtaagcattttgaaattccctggtgagtcaaaacatctgaactttcctgtgaaacatgctttgcaaaattgccattgacataaacatgggtgtgttctcttttgtgaaccagtggttcacaaacaaagtgggatcctggggcatttttatgatcagcttgttagtcctgagacctctgtcttagatgcttgacggataggtgtgggtgggtgggggagggtcttgtagcaacttttttttttttcttgatgaatgcagcaggaaccctccatttgtgtggcagagctcttgtaacccccatttttaacctggagggttggaggacttttagtttgggtggagaggatccagaacaatcctggcagagcccagcaagctcttcacgcctggctccagccctcccacccctatccccgctgtcttctctgccgagagcctgggcttttcaagtctttatctccccctaaggctgtttcctacttttccaaaaatgaaactatctttttaaaagcattttttaaattcttcaacattccaagagcagggaataaaacagcagctccccccgtttcccactcacatagtcttgttcctctcatcctcacccactcccccatctctgaattgtttcaaagcaaatcccagatggttccattttccgatcactgtctctgaaaaatattgcctcttttgaagtataaccataatactgttatacttagagaaaggaaaataattttcatatcatcaaatatgaaataggataatagtaaatcataacatgtgcttatcatgaaaagaaaaaaggatacagagcatgtaattcagggccagaacatcctgcccttttctcccacctgctcagggctaacagatgacaatggattagggatccatctgccagccatcagttgtgcacatatgcacacagggatatatgttatacatgtgtatgtttgtaacatgtatgtcacaagatgtgattgcttgttctgtgtgtactgttaacgttccctggttttgtacacttaatgtcataggcaatctctgtgtcatttctcagaagcctaccttttcccttagaaatgtctgtaatattttattatatatggaggtgccataatttttcacatattcctgattatctgccatctgcttctgagccctcggtgcccagtttcctcttctccacgaacacactctgttgtgaggcagttgccgtagattacaaatagcccatctcagagtcccctcctgggacatcctccatcagaaccgcctgggagccagtaaaacatgctggtttctgcaactggtctcaggagctcgcagttctgggcatgggaaagtgcactttaacaggtgtctcaggtggtctggccacctctccctgagctcatcattccctgggcctccctatgttgccacgtcctcatcttgggcctctggggcaggagccagaaacctcctgagctgcctgtcaaggtcatcgggcttgttcctcctgatctggagatggatccttggggcccacacaggcacgcgttctccttagccagacttccccgtatttgctcctggctgcagcagcacaggctgaggcccggcaccagatgttcaatacgatcttgcagtcaggcggtccacagctatttctgtagcatttgccatgtgtcagaccctgtgccaggcctgggggccccctctgcctggtgcagggcagctcacaaaagctggcagaggccgaaggctgcgtgccagtattcagaatgccacagagcgcctggctgctgtaccttcagagcctccacaggcaccccagtcagagttccgggagtggattcctgaggtcgcactgccaggttccctcacgttgccatcctgcaggcttctcgatccttgaccttttagattcccgccacactgaatctaaaagggacaatgtgacctctaagctggtggcctaggagcctgccgataacctacccattcatcagccctcgtgggtcaaggctgcctcgtcctccccgagagagtggagaggtcgagcagtggggatgcccctcaggccccggggcttactgactggggcgggtgtcagggggaactccctctctttctgagctccactgagctatctgaaagtccccaccatactccccagtactgacagccagagggaggaacggctcaccagaatcattgggcatctctgatgggcatcaagtctgctttgattattgatgagtgggtaagagggtcctctcaacttggggtctccttgggaaagcactgtcaactcagaacaggtttcagccctgttctggagaccacaggccctggaaggctgggacatcatttgcagccccagcgtcatctattagacggagccagcaaggtctcatgctgtgcggtacatttcaacactttctcaaatttacccgtggcagcttttggtgtgtttggttatttttataacactactcactgtacaatttctgtcatgcacattttttgtatcaaaaagggtgctgtaactttaaaagactgggtatttccaacttggaatattcaaaccatcttttgcaagggatgttttaaataggcatgaagggttgtttttaattgaggttaaggatctgaaatgagaggttttggtttaccctatctatggtatgtcttaaaaatcaacgaagatgtccttgtcttttttgaatttgccgagtgtgttgcagttccacagctcactgttaggtggcacataccccaaactgaaaacctgacctcgtagggcatgagtcaaaagacaggtaggcacaggacagggcagtggtgacactacagctttcagggttcccagcctgtcaagaatgagcatgtcttagcaggggaggaacgcatgtgtgggaaccgccacagagtcctacgttaggtatatgttgctagtagtttgttaagatatttgagtttgggaatttaattattttttcttttttaaaggtttcctcatgaggacaaatacctgattttgaataaagcagcattcagttgaaataaccctttctgtggtaattccaagtgaatatttttcttctaggtgatgagtttctacttcctctggtttttacaacaggaaatgaaatggtatctaaaataaacaagctgtggtatgatgattattcattttctgtcattctgtgctttttatgaactagggtgggctctaggtgaacatggagaatgggccaaatacagcaattttgatgttgctacccatgttcccctgatattctatgttcctggaaggacggcttcacttccggaggcaggcgagaagcttttcccttacctcgacccttttgattccgcctcacagttgatggagccaggtataaaatatgctgaaatgatattgcttgacagtaagatcacctttagtttatatgtgaaccactttattgaatcataggctttgggggttacacagacccccccttcctgccttgtgttggaatttcttctcaacattttgtggtcagcacacgctttctgaacatctcccatactctgggcggggaaagagtgacagaaccagaattgacaagtatggcccctgtccacaaggagccttgtgggatgatgatggacaaaggaacaggtgcatccccaagatggggagggctgtggtacagtctacaagagcctgctccagagcttagagtaaggggctgcccccgtaacagacgaggagaatcctttccctcgatgcgcacttttggtagggactcagccttctttgtggggggcacattttccattttgacagctcatcaatctagtgaaccactagatctgtaaaatctaccaggtgattctactctgccctccccagcagtgaagggcaagtttactttgacttccatgtgccagtccttcaaagctttgaaaacagcactgatgcccccgaccctgtccatccaccaatatcttctcttctctaggctgaaatccccagcccttcaaccattcgtcacaaggtagtgtttagacgcgtggttgtcctggtctctgtcttccaaaaagtttcagtttgagaaagcacttccagaataccagttggaccagatacccctcctggatgtgtgggcaacctgtatgggttcttgtgagttctatcctgacttgatctgcccagtgcatttcagggacaggttgtacactgtctctgaaatgacgtatgacgtttgctctttttggagtgcctcttctatgaactatgctaaaccagattgccccctttctggacttaagcatttaatccatccttaacatctaaatcttgtactgtatattgattcctgtttaaatttgtcttggttctggaccatcattcgggcctttctggatctttctgagcttgctttatactacccaattttattttttgcactttgatttttgtgcactgcatgtcctgtcttctttcatgtcattgatagaaaggttaaacagtttcaaggcatgattttagccctttgtttgctgggaaagatcttctgattggttgagaatcttttctgaaacttttgttgggaagtgttcagcaatttagaaattgatgtaactgcacggcctttcagtttatttccaaattttatctctagctgtgtcttttccctgaacttcagacttttgtttccaatagtctttcccacttagccagcctaacatatccaaagctggacttcacatctttcatcttcagcttttccttcaacactcttcttgtcctcaagaaatgagaatagtcactcatgccaaaaaatcatggaataatctcaacccctgttcttctcttactccatatgcaatattcagtctatgagaaagcctgtcacactccattcagactctgtgtaccacttcccaccacttcgcctgccactgtcttggaccagactgccactgtcttgtgctgaagtactgcaagagcttgctaaatggtccccttgcttgtgccctggatcccttggaggttttcctcctcagagcagccacagtgattccattaaaacccaagtcaagtcatgtcacagcccggcacaggagcctcttatgtacccttcttgatctgagtaaaagtcgtcacagtggccttacatgttctggccccattatctc

SEQ ID NO: 15392 - DNA, 22131 bp, Human; identical to SEQ ID NO: 15391

SEQ ID NO: 15393 - DNA, 194790 bp, Human
taatcatataaacatgttagaccagcatcttccagtatatattctgcaaacattcattgtgtggaataacagtagttattaattggaaaataaaacaagcaaacaaacaatcaaacaactaaaactaaaaacccaagactgaagccaaggaagttgggaatgtactttattaaaaattttagacaggtgtctcacagctttttatttgcatcatggatctccaaagggggatacaatatgggttgcagcatttcccatacttctttgaacacagaaccttccattttgcataactagtgtccatgggatggtcacctttttgtacttccccagagcttatagttgtgcattaactatgtgattcttcatattcaccttcctattgagcctgtaaactccatgagtgaggaaactgtgtctcctcttgcttcccattgtatctctgcctagcaccaagtggcacagcctttggctctccaaaattatttgttgaatgaatgaatgaattgtgctacaccaaatcaccagtggttctctatatgaaacctgtattttagattctttacaaggtatgcccagccaacttaagtcttttcttctactgtttcttctacctagtattagagtattattgttatcggaaggatgactgtataaatttgtcatccaaactggaggacatttttgagagggaaagggaatactatcaataattacacagataagaagtgtaacctggggctatactgggccatctagaattgatagcccttcattattggtgactgtctcaggctgtctcccctatttgggattttgggcctcttggagcagggacttttccatgtagaaggtcttcaataaatactggttgtaattaatgcatgtacagaagtgaccataatgctgtttgaagatttgctgtattgtttaacttgtagtttttacaggtgaggaaatctagtgccatattctgttcttcatttacccaagtatagttgagtccatacttaagtctgttggggagttaataatcgtccttgcaagaggcctgggcaatgtcgatgtaacggcagtgctctcttaacaggattgggctttcatctttcaaggcagtgaatgagagacccactgttcttaccagagcaggcaggaagcagatgtgatcggattgcaatcctggagagggtgaaggtgtgaaggggagttaggaatgtttgggggatgcctaaaacctgcacagataatgtagtgatcagcagagatttttctagatggttgcctgactctcaagttcctgatcatgcactgtcttacagctggttgcttattttgttatctcgcttcttgctttcactgactataaagcacctgcaggaaagggctatgggcctgacatggagtaaaccctcagtacatttctgctagtgacttgaatcttgattcattaggaaggtgtcacactgggaaaaatgcatcatgggattcactgagtatacttctgagactttttctaactgccaaggcaagcatgcaatttacacaggccgttatccttagtgttttgtaggtgcctagttggactcccaagttcaaaaagaactcaatttaatcacaaaagtgtttcgtataggccttatatttttaatgaataatatacaaaagtatgtcagagggtcaaagatgccttaaagatcacgagatcaagctctctttggatagatgagcaaagagaagccccaggggatgggggatgggtcagtgcctgaaagcaaatcagtgacagaacaaggagtcactttatttctgcaccatgcactgcgatcttaccgcttcattaaagtaaaacaaaattagtcatttgcagatattcttttgtatttaataggaaaaaaatgatagctagattttcttgctttacagtttgtcctacagagtaaactattatacaagaagaagaagtagattgtgcctaatgttttctgtttattttgtttcaggtaagccttcccagtgatccaagctgtgttgaagaaatcttgcgggtgagtttaaacctttatttttgtgccttttaataatgaagcaatctatctgcttaagctgtttaaagtaattactgttctgtttcaaggagtttcatgatggggaatcctgacattctacttcaagacccttctgcttattccagtggcctcatttcttgcctgtcttctttccattttgtaatcaagctagtcttctaatatcactaagcttctgccctatccattcctacatccttctcagacagagacttaccaccttctttaggaaacgttccctgttcaagcaccataccctaaacctttgccttttacctttctgggatctcagctcaatctcactgctgccgcccactatgtggaacatggttaccgagattgattgtggcctataataaggggaagagatgtgggaatgggagaggaggagaagatgagagacttgaaaatgatggcatgttgtggaaagtgttacttatggaagtgagtgtatgtgtgtgaatgccttgagggcagaacaaagttgaaagaatggctataatctcttctgaagtaaacaatcaaaccaaaagaagaaaccaaagttaagcaagaaaaacatatctgtctgctctctctggccattggcatcataaggcagtatggaatctcaagaataggagtcatggtaatgagctcctgagctcctgtcctggctctaccatttgtcacttctgtgaccttggacagatgactttatctctctgaatctcctttcctcgtctgtaaaagaggacaataatacctgccctaactcccttataggctaccaagtggtatataaatgctggctattgtgataaatgatgaccagtgtagtcatgtaaaaaccatgaaggctttctatctgggaaagaaaataatctatgtgccagtgaaaatttggcaccccctttcctcagttaccaaagtcactccaactccctcctgatccccctctcccagtaagtgccttctcagcagcccagtgtttgaagcaagccctgagcaaatgcagccaaaggaatagtcaagagccaaaagctgtttaccattgaaatggcttgccacccggagtatacctgatgtacacattcgtgcacctgtttcagcccaagaacattgttcttgactattaaagagatgagccagtcatatcactttgatcaacgatgagactatatggattagggcaggggttcccaatcccaagtcaatggactggtaccatgtgttcctcgtgagaatgtaatgccttgatgatctcaggtggaacagtttcatccaaaaccaactccccacccctactcccactccctaccccctcatctgcggaaaaattgtcttccatgaaaccagtgcctggtgttaaaaaggttggggactgctagattaggactatgctgactactttggtaagataagaacccagcaacccctcagtcatctgtctcaggggcccgacgttttgggtggagacgaggcagctgttatgagcaccacaaaaggaatgcacactgggaactcaggcctttcccattgggaaaatacattcagtccttgctcacttgtcaacagccttccttaacagaaggtaataacattgaaagaaatgtcttactctgctctagatagtaaccttgttattcctttcttctccgagtcacaagcataaataaactcagtggcctttttataaactcccaaaggaatgccaggcatatctcaaaatctcactaatttgtcacaatcgaaattacatacttaaaagcaacccagccctggtgcctaggtggttatgtgactaaatgcaggaaggagggtgaacacctggctgaggctggcgacaccagtctcctaaaggagccacttagagaaacaacagaatttcacttacacatggaaagaaaagaagcaggttgccttaataggctcacaaaagataacatgctttgagaaagtaacaaaagtccttctgttattcttgaaagagaatctagagaaatgtctcttttttttgaagggctatagattgtatagaattctttttttttttttccaacaacgctgttaatgagtgggccttcctttattaaagaaagaatgtttcattccccatgcttcgaataaaaataagctttctgaaatttgcgtccccaattttatgactaattgttaaatttttatagaccaccttgcatgtcacaatagagcatgcttgttgggctttttgtcttaattacacattcatgttccttttggtttgagggccttagaggcctgtgacgggttccgcagtaaatttgtcacctcattccccataaacccctttcttagggaaaagtacattttatctttctccctacctctcctggccatgctcgctgcttttcaaactaagcagaggcccaaacaatgtcatctctcctcactgaggggagctatgcagaggaaggagcactagccccggagtggaggagctggcttccagttgctcatgagattcccttatttcctagctgtgttgcttttcagtttcttcatctagaagcatgcgctagttattaccccgcccatctctctacccacctccaatgaaggaatatttaaattatacacattgtttgcatctgcaccatgaaaatctgagtccatttgctctcccaactttcccacctccctgatcccccttttttccctccacagcctggcaagcaaacacatacaaacccacttcatctcacatggggacagacttcttttattaaccaaatgcaacacaaccagcctttccccactctcagcccctcaatcctccaggctatggaaatacttttgccttatgtgttttgttatggccccctttctcaaaatgctgtccaaattcaagccagttggtttctcttgaaagcccctctcaccattcatctggcaatgttctcagctccccttcaaaccagcaggtccacttttctttctttgcccccctgggcaaagtgctataatatgctggagcccaccttgtctggtcttccagcaattttcttcttgccctcatgctctcacagatgcaatcagattataacaggctaacttgacctgatgtgtcaaccttattttcctatagcaggtgacagattgtcaaagcacttgaacctcgttgtcttatttggtcataaggagtaaggtagtttcttattatttcatgaaatcgaagtccagagaggttaaatgacctgcagtccagggtggggctggtatgtggcagaagtaaaatggtatctggcctttgttttctaaatctagtgatctttgcactacacccaactctcaatcaccctctcacaaatctagagtgagaatctctggatgttaaacaaacttgcttcagacagtagctgacatttccagcaactttaagaataccagcaaaccaacataatttgaacagatcttagaaattaattcttcttttttgtcattctttaatattttgaatctcatttcaaataataataaaacaatagcaaattttcttctaataataaaacaactgataatagtaatgtgttgtctattgcatgtcaggcacagttcataagcacattatgtctttgaacctttacaataaccctcaaaaattgtattattagtcatgctttacagaatggtaaagagtgaaagtcagagaggtgaagtaatttgcctcaagtcacagttctccaagtctctgacaagagtcatactatccgttcttctggtcctgttggcttatctgaattcattcttatttaacaggctccagtctgctttatgattaacattatagtggattcaaccaccaattcatttcagcttctgttgtttcctcaatttgtacaaattcagttatgccagaataatttaagtagttttttgaacaaactagaattcactggcctacaacaccttttcaccaaactgaccttctcccacaaaatgagctgtacgaattcaggtgtctttgctccttttcaggcatattatcgcttattgtgaattttacaaatcagaaacttaaaggcagcaatctgtgcaatgcatcccagcttttacacttgcttccgtcagcatgctgtttactctttagagtcaagctaccctcacgtgcaaacggaaatgaaaaataataacagctctggccacagtgatggcattttgcagttacaattcatcaatcatctgagggattcctaggcagctcatctgtaataatatgggtaccagcagcagcttcttttctgagctctacggggttttatggatcctagagtaatcatttctggaagagttaagacaaggagagcagcatgctctaaatgctactagctaaggatggatgctcaatgattatttgttctacagtagtatgatttatttgttcatagaaagaatttactttaaaaaatcaagaaactatgaaatcctttctggaatcaaaaatgcagatagagcatttcttttagatttgatgctaaacagattgtctctcctagcaaagcaccttctgtggttgataatttcataggcaaacatctgtaagggtaattcagtgtttatgagggatgctgaatttgctagctaggatttagggaacttgatttgataaactgtatcttcttacagatttcttcctgccatatggatcaggttggtaaacacctacttggccacctctttttgattacagtatgatctgtgtttacagcattctaaattatggcaattctacttattaggcttgtgttttagttaacagttttagcatggaaaaaaattaccaaatatttacagggcagtgcttgttattttatttttattttttaacagggaaataaatgaaaaagcccatcttgcaagtaagaaaaaaaatggatcagggaacaaaattggtcggacaattatgtctgaaaggaaatttgattatattatcataactatgcagcataatcaagcacctttcagtagaatttcttttataaatttaaccaataattaggcaattgattttatatcctgtcaaattaatgtataaataatgttcaacttggattcatgcaaacgattttctatatagctgtcttaaataggaatccttctggaatgtttcagaaagcatgtatcttatttggatgtggacttttaaaattatagtttcttgaaatagtaatatagtgttccgcccaagaaagacaattcctaaatataatttagactataattaatgttaacattgatggagtcaaatgaatgaactaactaatgatagtgccctttgctaatctgatgactagttcttacctaatggcactgggaaatatgtaaatttgtcagcaggtgaaaatgcccttgactgggtaaattatgtgcagtattcccttttctgaagctaattcaaagcactaatggacttaatacgtagcatgcatatgtgaggtgagctattcatggaaccaaattagctcataagagatattatccattatatgcctcctagtaatcatttcctcttttctcaaacacaaaccaacccagaagaaagatgctaaatttaattataacaactttatgtgaacaatgcaggtaagccatccagtgtgcttccaaatgcacttagaacctgtcaagcagtttaaatatttttatatggaatctaggggtttgcagctaatatatgaggtgaattttaaatgattttacagatgtcattgggaaagtgagtaatatgagtaatgaggtgactgggccagtgaatcatgggaacctgtcaaacatggggagatgtcagggaagagatgatatcaaatagaagtaacttagcaacccagcatttagctgtccagagaatgagcaagagtagcccctttaaaatagctgagtaaatttatcagttcctgtatatcttaggtatgctataaaaataagtctgttctctgtcaacctgtttctttttgtgaatatggtgatttgtgattttctattgaattggatgaaagccggtgagaatttaggccatgtgtagaatttacacctgttttctgtatcttgggtgtaaggagagagtaatgaaacaacacattgttttgccaaaaagcattctaagcttatctgaaagaagtaacagcttccaactgttgtctaagaaccagcatttttgtactagctttgctagtgggattgggctggggaaaggagaagtaatgcaaggaagttaaccattccacttgcatctgtgtaaaggtgaaactcgtgtctctgcaaaacacattgaggaagtagcctcttggaatccatttggtaggcatctcccagttttgaaatgaaagaaagaaggaaagaataaaacaaggcttgtcccttctctcgtttgtcattagaagcattcaggagaatgagaaaaataaactgaaactccatgattgatgtaaccaaagggtatccataagcctgactcacaatttattttgtgaaggtcaaacagggaagaagccaataagtgattcccatggtcttggatttgtggcatagtagatgtaagaaacactgattttcagaataagtggaacatggtgaaaagcaataacagtattagaataatgagaatgggcattaaagttggagatgggagcttccatggaccaagtttgggacacagtctcgagaagtagggaaggcaggactgaatgagaaattacataaatgatccatatttgtggaaggcactttgttagtgaggcaaggtggatgaatgagatgctgctttgcaagtagcctgtagggctgatgtttattgataacagagaagtaaagcctgaaagcatttgggcacacagccttgtattccgaagagaattcctgctagtctggaattcagccacagccctgactggtcctggaagaactcttgacatgaaaaaaaaaatagtaataaaaaagaatcaccacaagatctatgcaaaaaaaaaaaaatacacaaaaaagcatgtgagaaaagtgtaccagaaaaacaatatttttatggaaaaattaaagctgtgaccaacatagtggcatgaatttgttaaaaccatgaagcaattttatctgaaaagacaagaacaaaatcagtgatacaggaacttaaagatgctatttaaaaaatagataaatcaggaggtgtgaattaatgaattatgaacagaaaatcattataattaattaattcaagatccttttcccaaataaaacaataatacaataaaatagatacttggttacttaacgccatcaagaaaaaagggaaaacactaatacataaaacaagaactaataaacagaaataacctcagatacagagaaaactaagagaataatgagtagcaattttctcagctctgtacaaataaatataaaccggtggatgaaatggatggtttttctagtgaaatgtaattgacagagattaactccagaaaacacagaaaatctaaacaggcttatagccatcaatgaaatgaagactctccccaccccttaacaaaagcgtcactcccagatgggatttcgtgaggaaattaaactaaactttcacaaaatatgacagtataacttttacacgacatagaacaaaaagaaaaatttgcaaagtactttttagaaaagccaatctagcttttattttgatactaaaatctgacaaaaatagaacacaaaaaagaaaattgcataatagtatcatttatgattattgttgcaaagctccttaatgaaatactaacaaacagaatcagacagcactttaaaggatatacaatatcaccaagtgggttttattccaggagtgtaaaactggttcagtgttaagaaatccatttgtataatgccttttacaaagagaataaaaaaagaaaaattacacagtcatcttcatttagatgataaaagacacttgacaaaactgaatacacattcttgataaaatagaaataagtggaaacatatttaatgtgataaaatatatccaccttaacccaaaggctagtatcacatttcatggagaaactctcaaagcattctcattatagtcaagaaaaagactagatgttctttataccactatcattttatgtttttctggaggttagccaagacaattaaatatgtaaagaataagaggcattaaagtgagagataatgcttaaaatggttactatttgtacattatacatatattgttttcctggaaaccagaaacaaattaactgaaaacactattatgaataatacacaaattcagccaagttgctctgtgcaaaataaatgtatggcaaaaaatagtctttacatataaagcaagcaactataagatgtaatgggcaaaaaaatccttttacaccttatgaattgatgtaacaagaattgtgtcagagctgtataaacaaactaagtcactatgagagatgccaaagaatacttcaataaaaaggcatacaattcctgaaaaggaagacaatgtcacagacgtttgtgttctccctaagttaatcttggatccttacctcacgccatacaaaaacattacttctagatgtattaaagattaaaaacaaaaacataaaatattagaagtatatatggaagattttaatttatttttaattttccgatcaagtctcataattagatggcagggataagaagtagtcaggggaaagttcagaggttagaggagactggagaatgaaagagtaattgaaagagagagaagtctctcactctaagggaatatagtaagattatgaggcaacatcaaggctccaggtgatattgaagatattatatttatacaggtttcaatctgtagattatataatttcctccagcagtgcttatttcattacccagagaccacaggctaatgggtcgatgacagcctggaggccttagagaggttgaaaattgccccgaatcatatattcatatggttatgaagcagctaacacagaattggaactcatgttggcctgaacccaaagtacatactaatagtagtaccacttacctagcatttttttgtacctggcactgttagaagaatttcacatatagtaactcatataatcactatatcaatgccgagaagcaagtactattatcatccccttgttagataatgatgtggaagtactctgagcttaagtgactttctaagtttgacagctaaccagtggcagagccaaaatttcaaaccaagcagtttttggtgattatgaataatgtgggtattaataattatatacagatttttgcatgaacacatgttttcatttatctttggaatatacctaggagtgggatcgcagagtcatatgcttagagtatgtttaaatttataaaaaccatactaaattgcttttagagtggctgtaccattttgcacttacaccagccaagtatgaaagaccacttactcagcatgtacttatttcccatttgtatatcttttttgatgaagtgtctgttcaaatcatttactcatttactaaatcaggttgtctattaccttataaatgaatcttgagagcttttattgtttctggacataagtcatttgtcagatatgtgatttgcaaatattttctctcgggctgtggcttgtcttttcattctcttggtgatatccttctaagagaaaaatttcttaattttgataaaatccaatttatctttgtttcatgttatggattattattttgctgtcaagtcgaagaacttttgggttaattcaaggtcaaaaaaattctcccatgttttattctaagagttttatttaagtcttcattttggattaatttttatgtgtgatgtgaggtataggttgagatttacattatgttccagcacgatttattgaaaagattgtatttaatctttctccattgaattgcttttgcatttttgtaaaaagtcaattgaccatatttgtgtgggtctacttcttgactctccagtctcttctacttgtctgtgtccttgacctttcactaataccataatgtcttaatttctgtagatattgtaagtctgaaaatagcataatgtgaatcttccaactttgttcttttcctaaaatggtttagctatcctagttccttttcctttccatatgaattttagatatattatttatatttacaaagaattctgcttaaatgttggctagtattgcattacatctataaatcaattttgagggaattaacacctttactgtgtgcatctttcatctcatggatgtggtcaatgtgcctctccatttatttgggttggctactctatttttagagggacactggtaatttataatcccactttagaaaattcatgctatgagaaaaatccaagctcctagaaaaactatgtgaacaaaattattcattacacaattctttgtaatagcaaaaaatgctactatatatttaacagtgggagaatagttaagcaaactcagatttatacattcagaatcataaccaaccattaaaaagatggctttgccggtgatgtaacaacatgaggaaaaattatgagataatgtttactgaaataagcagaatataacattttatgtacttaagtattatatctctataaaaaatgactaaaaagaaactgaaggaaaatattttgaaatgatagttcttattttgttagagttagaattatgggtgagtttcttcttttttatattttctcaatttctataatttatattactttcataaaaatatttaagaggcaatttactcatgtaacaaacatgcatgtttaccccctgaacttaaataaaaatgaaaaaacaatttaagagttatattgctgaactaaaatgcacttagcaaagagtaaccaggatagtgggtagtttccaaactggaacgtctaaagagatagactagattaaacagcagaaaattgaactagaagagggagcaggctgtggctgcctgagagactaccctgtggaagcaagagactcagaggctgcatttgggatagaaggcctcaaatggtggaatccaacttttgaggggcacttatagagggataagtattagggcaatacaagcaagaatgttctggggggtggggcatcatggttaagacagtagagctcagctcttctcccttgctgaatgtttttgggtaaattaaccttttcgtacctcatttacaaaagtgagataatatgccctaattctcagaattatagggacaattaaatgagatgatgcatatgaaacctctggaatagtgcttggagcactcaattagatccttcctttctcccctgttctaattggtagatctgtccaagggtagaaggaggtgaggtctttgtcactgaaagtgttcaatagaggcactgtgctcccccagtacctagaggataaacttccaaacccagatcttggcagtcaaagtccttcctttatgtcaccactcatgcctacctcacatattgccaattctcccaactgtgtgcccttttccacatccactgcagacttctccccctttatcaaatgtgccatctcctcctctgcctctgtgtgctgccccctccctctgcctgtgatctcatccactcctgtctttgtctggtgacctcctatctacaccatgtaagatccaccacagagatcacagatattaatgaattaatttctctatctgtcttctaggtccccatagcaatttttatatatctacacttggcctttgtatgtgtgtatgttggggagttgcctcttatggtagaatgtgaggtccattaggtcatagtctgtgtggaaatccttattctgtctctttggccaattccagaaggcccccccacatacatgcacacaaaggtgacaagtgtaggtgcataaaaagtgcatagattagatgtaatgtgtttattaaatgacttaaatttttagaggaatggttagagaaaatgacctcatagtgttatttccacccaaggtacaataatgatttgattttccatgaaaatattacaagttaataagcagataatagtgcttattgagtagaataattatacaaatattaggcattttaatgactccatttcttatttctccaaatgatatattatcaccatttgtgtgctttttccattgccaatttctttttaagaagggcaaaatgctgcatgcagctccaatcgtttagatgtgtctggattcttggaaacttgactaccctatgttctcctagaaatggaccgtgagagcttgcttggaggttgtagcagggaagcacagctgctcctatacctttgacctaagaaggattcaactctatagataagcagtggtaagagcgagaaatgacacccatctagccagccagatcagttgaatcaaacctgacgttcagtggggtaacagatgtcgcagccagatagtcatcacatcctcaattgcaaattattatttaataccattgttatagtccatttttaatattgttcctcaaaatacaataatgctagcattatcagtgtaaacaaggtactgaataaagacagggccccatatgctactacaatgggagagattttcaaatctctcaaataatgttttggcactattcactgtgcttattatcactgtgatcacaagaaaagagcttccacaagatgtgttttcttccctaaagtgattcctccagggtgtgtgtgtgtgtgtgtgtgtgtgtgtgtgtgtggctgatagcctgtaagttgcttccattaaacactccattccccaaagcctttcattattggaatgaacacactaacacgaacagactcatcctgctcttttcctggcaacatgttaactggaaattgcagaatcataaaataaataactaaggccaatctaaaaccaaggtgtaaaaacagcatcctggctgtctgggcctctgattattttctattcaactcccttactacttctcaggacctgttgcgttcagaggatacccgaaaagctagtctatcctccaactttgcagcctcctcactgctctttaatccaggagctcccagcacatcctcacacccctagtgcttttgatgcaaaagtgaatagcaggtctgacacctggagaatccaccctgatgttagagcctggtctgctcctgtcctgtgttacagagtggagaccatgcagcatcggcctttgaaagaactgggattaagatgaaaacaatgtgccagtgacactggaccagacatcaagagacctcagagctagttctgaccctgccactaccttattctgtgacccttggctagtctcttaaccattgtgtgcttcaggttctccatctgtaaagtgttgaattttttgcactctccagtacagaaacaccaaccacatgtggctggctatttgaatttaaattaattaaattttaacaaaataaaagttcagttcctcatccatttcaagttctcattagttacatgtggccagtgtttgccatattagacaacacaaaactcagtatttccatcactgtagaaagatacagtgaacagaactgccccagatatctcttcagatttgctctaggtttttattctgagttttatcataaaataaaatcaaatatggttttaccttctagactgtgtattctagactgtgtttagagtatatctgattaatttatttcctcctgagtcttatatacaatacattgatcaaattcaactctggttctgagcagtgcccctactatataagacagaacaaaaaataagtctgagtaggtagaaaaagatacagcaagtattcccacaaaagagagaagaccagagaagtttcaggcatacgcctggtttgttgggcaatgcagggacccatgtactcctaactcaggcctcagacaaagtgtctttccctatgttcaataacattaataatgctttcatccctaggctctggaaataagagggtacatcagaccgttgaatggcccttttaggagagaaatggtactataaaaacccaggaattgattcatatttgcttcctctctctctctctctctctctcttcctctctcactctctcttccctgcactcttcagcttttccatctctttagacatccacctaaggtgcatcattaaaggaagtaccacagcagcacttggacagctccagtggctttaattgccccatttcttcattaaggggagttgcttacctacaccttgcacaggggcttgagatctggattattaacgttaaaatggactgagtcctgagaaaagccattcattgtacaaactttcagttatgtagggtaaataaattctgaagatgtactgtattatatactcaaaatttactaaaagagtggaccttaaatattctcacaacatttaaacaacaaataaaggtagctatgtgagttggtggacatattaattagcttgattatggcaatcattttacaatgtatacatacatcagaaactcacattgtataccataaatatatattaataatttattttgtcagttatacctccataaagttcgagaataaaaagccattacttggaatgcattctggtgacaagggaaatttaataaattcgtgcctctccttagggatcggcttatttttactgacttgccatttggattgtgtgaccctcacacttgccattgggttgcgtgtggcatgagtaagggcagtggtttcaaaacaattataagttgggttctgtggttcatgcctgtaatcccagcactttgggaggctgaggtgagaggactgcttgagaccaggagttcaagaccagcctggggcaacaaaaggagacccacatgtctataaaaataagttaattggctgggtgtggtggtgcacacctgtagtctcagctactcagggaggctgaggtaggaggattgcttgagcccaggagttggaggctgcagtgagccacgatcacaccattgcacactactcactctgaggtgacagacagagtgagacctcatctctaaaaccacacacacacacatacacacacacacacaaaatgatgataatgtacttcttataaccaccaaattataatggacttccagaaaggtgagggagctttgttcctgctacatgattggagttttcccttttggaaaacctgtcctatggagtatggtggtgcccaaagcctagagctcaaagccagacacctgggcagaggtccttgagctgcatgacattgtctccaaaactcagttatctgacctatgaaatgagaacaagaaaaactacttctctgtattattgagtggattaaatatggtaacataaatgaaacagtgaattctaacccccaaatacatacaagctcctattggattgttattgtgactcttcttgttattcagaaattccaaatattttcaaagggtcactttgaatttcatatttcgacccttcacagactctctatctgatttggccaaggagtttagattgcccctgtgattttcttgaatattaaatatgtaagctcctttcatgtctttaatagagtagtttttttttttcatttttgaccactccatagttcataaggcacattgcagcttttcaaattgtcaaatttgtttaattagcccagagaccctgcccggttggtttttgtcagctgtatagcagtctctgtgggtggcttgcaaatctctgaccagggttttttttttttttaaatcattttgcacatttctttccttctttaatacaaatcaaggagagactagatgagcaggaggcagtggtgggggtgggagtaggaaggcaacgtgctgtggcactggttgccaactggcttttggacaagagttacaaattgattacaagtaacagttggaatcccaggcctgagagatccaggtttgtgagtgtgttgcgggtggggtagagttctccttgagctatttatttacttcaagaccaatgtttcatttgcacactgaaaccttcctaggtaagggtttgacattgttccctttgaatcttctatttggtgctttgctaaatttatagccaggagtaaacgtattgatctggttacccaaaaagatgttttaggccaaaaaaaaggtagaggtttaaagaggatttagagacatccactggcagtggattctcagagggttattagggaagcttgcaaggggcggggggtgggggtaattggaatgcaccccttccttatggtgagtaaatgttttgaagtacaaatgtggatgccctaaaagatgtcaatgggaaactatcaataaaagaaacttttataatagtcttcttgtgtgattgttaccttttaattaaaaaaaaaaagacttggtagtgaaatccaataatcagattggattgatgtttaacaaatacttagtataaaatatcagatatgaatcaatagctacttgtagcttatgctggcaagtggctgtttatatcaaggcagagagggacctgctttcctgggtttaaaatagaattgaagctttatagcgtgcctgtggggccacatttttgtacataccactggcccccagtgttcatattgagtttagaaagttctccttcttcatcagtcaaatatccttttagaaaaagatatgcctctcacttgtgctgtgattttgccactgttaatatggaatacagatgctatttattttccgttatttggggaattgtagagaaaaacgaatctggggagaggagtgactgtccaggcattcagaaatactcaacctattaggggcttggaatacttggagggggctttctgaatcaatttcactgtgacttagtagtggttttgatgttgttaaattcagactactgcaaggaatttgatacctctgttggtttatttttatttttattgaggggtatctgtggatggggggcgggagagagggcctggtgttcagtagttagactgacatcttgtgatagatttgttagttaatttcatgtgaatgggacaaaccagttctctttcctgcccctggcactgtgattctaagattgaaatagctgtttcagaggaaagacaattccatgcaaatcatattggatggagtttcagctgtattagcggcctggtaccttatttttactgacctcaggaataatgagagaccaaagctatagccaagttcttaactggaggcttctttccacgaaaatagatattacttctttattccccagcaattgagcctttgtcccttctaaaagtagttgtcatgaactcctcattaccatttttcttaacgtgataagtgtaaactacaagaaagctatcatgtttgaaaagctacagcagcccttagaaatggaatactaacatgccttgtgtacttctttgaaaggacttagactgaggattgtgtgaaatgtatccttctgcccccctttgcctggagttgtcattctctagtacctttcacttatagcataagctggctttctaaaggactgctgtgttgttgcattgacaccgtatctctccaacaatgtgaaatcaacaaatccctttggcaatttctgaaacatataacaaattgtgcattattctctaaaaaaaatcaactttgatgggcttattttatttctacttcgaatggtaactggtaattgttattaccttactctcattccaattatcaatactctagctacagagagtaccaccagaccctgtaccgggacctagtctagcctcctggctgtcagataccttgcaaggagtagacactcaataaatgttttctgaatgaatgaaattaaatatagattattagaaatgctgctggaggagaagccaatgaaagtgtgtgagttttatcaagttggtttgcctgagctggtgctaaaggagcaaattggaaggtaaccattaagaaacatctcatgctgtgaggatatagcatgtcattccatcttttgaagtgactgtgaaaggaaaaaaaaaaacatggctgtagtattatgaaagcctcgcgaattatctcaaatcagtatattttaagtgatggtcattggatgtagttgacggcaaaataatttgaaacagaagagctggaaattcaacattgcaattaaaaatcacttttgaaaagagttacaatgatctgatgtcaaaattagcttaagaatgtaagaaacaatttcaagggttagaaatgttaagaactggccctgaagaaaccccagaatcctcacatacctgaactggaccacttagaaaaagccctctaccttgattccctttttgatactgctctttgcagaacactttctcagtggccagttcttacatttctaagctttgatattgtgttaattttgcctgtaccaaacaaggcaaacaattcagtgttgttcaatctgataacatttcctagtggggtgttcagtcttctattctgactggttcaacctaatttagacaaagacaaaggtcttaataaagattaaaatttacaaggcaatcgtgtttagggaatcaaataccattagttggatgggccgtggcctgaggttgctgctgctgaaaccttttgctgaactaaaaaggtctggttgaattctgcccagtatatcactatagtgttctgttcccttgtatttacctttggagacctttctttgcagtgtttgaatgtagaatgcccgaggagtaactgggccaaaaaaagttgcatgaataggccctgcacatggtcatatatgttcctgttgtattcagtgggtgaaatggaattgattgcatctggcaatggcaagaagatggcttgattgattgcctgattgagtacacagtggagattcagaatactgatcactatacttcccaattgtacattataattagggctctttttcaatggaaccctggtttgggggctgccaggatgaaggcagccaatgtgagctgaactttttgcatgtacagattctcctcctggatccgaaggagaatatttccagattcccttaaacaactgccagcactaaagagtttgaatacagaattccattatttatttgaagaaacatcgccagggtttttataccatgccatttaaatcataagttagtgttagaaacttttaaaagaattgcattttgcattgacccattgttatgccatggccaagaagttatgtttaatgtaaccgttgattttacacttcctctctatgagcacttgcatggaattcagaggagcaatctcaggagactgtcttaacagcattccaaatagaagaatattcattcaattgaatggaacagagttttgaccactagaaaagcttggcaggaatggctagtgatcaagcctaggaaagtctatggttccactgttgttagattttctaagagttcagcaaacaatcagacaaattgggctgttagctgtctcactgtgagacaataggctcccctcagcatgtttcccccaccccatccctgggagaatgacaaatttccttagtcaatttagtcagccgtgtttatatgtcatgcaaaacaactgctccagattcagttttgcatcttctcatatatatctttgactttacagaagtaaagtgtatgattatctgattaggtaaagcagtacagatgattcacaacacccactccgccaccttttaggaatcccttttcactgctctaggcagaggacatttcgccttcagagatgaactgctcactgccttctaagacagtaggctccatgattggaaacctcaaatgattggaaattctttagtagtttgagctaaaattggtcccctgataactttacccatacagccagtcctaaactcttggtccacaaagcaggtctcaaatctctttcatgtgaaagactttcatggatttaaagacactcctcactctcccttttctgtggactaaactttccctgtttctttaatgtctatgtatacatgagatgagctttccaagctcttaccattcagatagctgtcccttagaggtattgcagtattcccatgcccccactgagatgggacatccaggagagcactctgagagggccctgagaggaaaaagatcagtagttcttcccacatgccctacttccctctaagggaatttcgtttggaacagccaagctccctgaccctgagcaaagggcccctgtccttccgaagcctgcctgagggggcctagtaggagaaacaggtaagttcctgtgtctgtagaggctgcacagcagcctggctacattctggcacaccacactgggagcagcagcctgtgcagatcacatccagccccctgaatccttttacaaatggctgtgtggctccctccatgggcccatctattgggggaacctgcccccaataattcatcattatttcacataggttcttttctatttccgtaagtgtcggcctgtctgagaaataaagggaaagagtacaaagagagaagtttttaaagctgggtgtctggggcagacatcacatgtcggcaggttccgtgatgccccccaaactgcaaaaccagcaagtttttattagttattttcaaaagaggagggagtgtacaaatagggtgtgggtcacagagatcacatgcttcacaaggtaataaaatgtcacaaggcaaatggaggcagggcgagatcacaggaccagggtgaaattaaaattactatgaagtttcgggcatgcattgtcattgataacatcttatcaggtgacagggtttgagagcagacaactggtctgaccaaaatttattaagcgggaatttcctcatcctaataagcctgggagcgctatgggagacccgggcttatttcattccttatctacaactgtaaaaaaaaaagacagactttcccaaagaggccattttagaggcctccccttgggaatgcattctccttctcagggatgttccttgctgagaaaaagaattcagtgatattttcctatttgcttttgaaagaagagaaatatggctctgttgcacccggcccacaggtggccagactttaaggttatctcccttgttccttgaacatcgctgttatcctgttcttttttcaaggtgcccagatttcatattgttcaaacacacatgctctacaaacaatttgctcagttaacgcaatcatcacagggtcctgaggcgacattcatcctcagcttacgaagatgacaggattaagagattaaagtaaagacaggcataggaaatcacaagagtattgattggggaagtgataaatgtccattaaatcttcacaatttacgttcagagactgcagtaaagacaggcataagaaattataaaagtattaatttggggaactaataaatgtccatgaaatcttcacaatttatgttcttctgccatggcttcagctggtccctccatttggggtccctgacttcccacaacacccatcttaaccctactcctgctattgttgtccatttcctattaacacccccactgctgctgcagataagggtgctaatgccctgcctggctttgctctcctatcagggaggagcagagcatcctacaggctggttagcaattgatagcagattgaaggtcaaggaaggatttgtttgctgttctcctgaaccctagccccagggcagccctttctaggcatcctaagggcacttgcgccttattcccttgcatcctggtgcttagctgcttcattcccccttttctggctcctcacagaactgtcaggaaccatggatacaaagggtctaaatcattcattcaaacaaattaggtttttctggtaagtcattaacacctcctctatacacacacacatacacacacacacatatgtgtttttgtaaatgcataaggacctttagataaagaaacagattcagcagtctaataacaagacctcactcacataaatgttttcaggtttaatttagttttggtgacggaaagatgctgatgtttcttcatccttagtctgtggtgatttgtaaagctactcagtaggataccttttgggagtacactatctgtaaagcaaaactaaaaaataaaagaagaaaggaaaagaaaaactgaaggaaggaaggagggaggaaggaaggaagcaaggaagggagggcccctccaatggaagtcagacaccaaggttagttaccatgactcagttaccatgacttgtgagtcatttacttctgatttcctgtgaaaatattgataaacttgaacccgattttgcagatgtattcttctattcaaccatatttttatttgagccactcagctattcacgcttattcttaatcacaagaatttgtgaatacttccaaaattgcatttattacgttcttggtattttagtagagggaagggagaaaggtgtatgcaagctccatcttgagccttgggcagatcccaagctgcctggttgctaagccaaggcatgcaggctcatactgacaatgccatagccatacctgtggggctggtagcaatgagctttgaatgcgtacaacactatatggtttacaaagcccttacacaattattcatttgcttccccttatgccaagcctgtgaggtaggcagaacaggtagaatcagagatgaacggtattgctaactgggagaactagaagccatccaagtcaaagcccacatgttgtaagcaggaaagctgaggcccagaatggacaagcaacttgaccagggccacccacatagcttttggcagagctaggcttgagttaagttctccctatcttaatacttagtccatgttgcttttggggctctctctgactataacaacaacaatgaaatatgtgaactatcatcatcatttgcattcattaaggtggtcatttgaaaaatcgccctaatcatctcttcagtttgagctcttttacagtaagtaccttaatatttatgcttaacctaaacacactatttgagcagctactatgtgccaagtataatggtagcctgtaaaagggatacacacacacactcgcacacacataaacacacatgtgtgttcaaaaacactgctcctctcacttcaactattgaagccttttccaaatgcctagcacagtgactttccccaccaccttattctctgcacctttgctcattcccctctcaaggtgattcgcatgtcaggcagtgaacgcttcaaaaagaggtccttgactttatcatttccatgtcctagtgactggcttataatggctacacacgcctgtaatcccagcactttgggaggctgaggcagactgatcacaaggtcaggagtttgagactagcctggccaatatggtgaaaccctgtctctactaaaaaatacaaaaattagcctagcatggtggcacgcacctgtagtcccagctacttgggaggctgaggcaggagaatcgctggaacctgggaggcacaggttgcagtgagccaatatggcgccactgcactccagcctgggtgacagagtgagactctgtctcaaaaaaaaaaaaataaaaaataaaaaattagtagaacaaatgcaaagaatccaccaaacagatctgccatttgctgtgtgaccttggacaagtcactttacctctttgtgcttcaattccttgtctgtgaaaagggtgtgaggctaatccctgcctgtttagtttctggtacaaaaagaccaaccaattacttactacacactaggcaggagagatacaaaggtgaataaggtgaggcttgtgacaacatactagttacttgagataacagctattcaggtagctgtgtgttagatgagtacaggatccatttgagattagcaaagcctggaacacagactgtcttctgtccttcagcctgtggcatacccagctttcgtgtctaaattgggcaaagcaaggatacctgcaagtggttttggatttgttttgagtcctagccatgagctattgtttggataatatggtggaaaattgagccttttgtgattttgtggggtttgactttggagtcttcatatcacattaatataagtgtcttcctattattagaagttatgtagaatgctctatcacttatgaaatccattctttgccaaatactaaaagataaaacagtattccttagtcttttcttcattatccatgttagtcagtcttacagagggagacatatttgttatagtggaaagtgtgcactcttgtaccagtaatcaaacttcacttgctactaaatgtaaggctgtgtataagtgacctcacctcttggaacccccattacctcagttgcccgttgggaatatgaatccctgctttctgtctctctctgtctctctctcaaaggatcaaaggatcccaaacataaagcagtgcttccttgtggaagttcagaccagtctcagatgtgtgtgtgtgtgtgtgtgtgtgtgtgtgtgtgtgtgtgtatgtaacttatttttgttaaaagagaagtgattcttggtgttgtgtacaggtactcatcattggatcctgttataaagctgtggcaacattttgggagcaggggctcatccctacctgatgactgggtgaaggattagtaaagttgggtaagaatgcataggtgtcttatcttaggaatagcaagaacataaactagattaatatccttcaagtgttaatgaaaaggataacaatggaatatctgctgtgagtgtgccacactttacaagtctaattcattttgagaagtgaaagagcttgcttgctccaaagtcctttgaggaagatattctttcaggaaattatattcctttcaactacatcctgcctactgtaatcaaatgcatcagtggtaacatggactcagtgtgctgtttcatgaaatttcacattttcaaatacagtttgaaatcagttgtaattgaaaatgtagaagtttgtgcagttccatgtggattagctaacagggcagtgcactccactggtaattcaagataatcagattctgcctccgagtaaatacagaaaacctaggggaaaaggtacacttttgagaagtgactttattcttcccggtgtctgaaacaccttttaataaacccagaggcacacctctaaaatcagtggtgaaaggggataaaactaagcctctaatcaatttaggcatacccagtagttgctgaaaacagacaacactcctttttctggaagagacttacctgctgttttattgactctggctaaatatgaactatattttatttattttgagaaaaaaattattttaattgacaaaaattgtacatacttatggggtaaaacatgatgttttgatatgtatatacattgtggaatgattacatcaagttaatttacatatccatcacctcacatacttttttttttttttttttgagatggagtctcgctctgtcaccaggatggagtgcagtggcacaatcttgacacactgcaacctccacctcccaggttcaagcgattctcctgcctcagcctcccgagtagctgggactataggtgcgcaccaccatgcccaactaatttttgtatttttagtagagacggggtttcactatgttggccaggatggtctcgatctcttgacctcgtgatccacccacctcgggctcccaaagtgttggaattacaggccaccatacccagtccacctcacatactttttttatggtgagaacattcaaactctgtcttagcaattttcaagtatacagtacattattactattaataactatagtcaccatgttatgcaaccgatcttcagaacttactccttcaaactgaaactttgtactcttataccaacagctcccccatcccaagctatatattttaaatgatctgactattttggagaccagtcttaatcaggaaaaaccatctaaattgtaaaagagatcactgagtatttttaaaactcagagtaattagaattactgttgtcacatatatttactttgcagccagttttgatgaatacatgagtaggatttgtcatgaatgttatcaactggatacaaatgcacaactcaaaaacacttggaagtagtctatctcttaagtaggttaagcatctcctctaaattgtgtatgcatttttaatgtagttacctcctcctttttaaatagtgctaggtaaaattcaatctttgtcagaataatacttacaaattctgcttcagcagtgccactgtgaatgaatctgtgaagtatctccttgcattacagctcttcatacatcaaagactctttttgaactgagtaattatagaaggaaaaaaaccttgttttagtgctacctgagagttcttattaatattacctttgaaatgactaattatgttacttataaagactggaaaaaaacaagtattatgtaacttactcattaaaaaagactttcataaattttgatcccctccatccttccccaaatccctactttatttctatcatgactttttttttaatgcttaatggttctatatgaaaatgatgactccaacacatgctgactccctcctgcttcacaaaacttatcatctttctgttgctgggattttgagcatgtgattcaattatccttgctcttagcgtaaagcatgttggccacatgccctaagactcaagtaagatttgaacagcacctctttcaaactgagtatttgaaagagctgagagggtgtccctgctgataacacagggtgggagcctaaggggcttttcctgttttgagacttgaactcacagatacactgtctatgtgtatggctgtgtggaaccgagctaccaatcacatagtaaccttctctatgaatgagaaagaattcccctcagcggcttcatctttgcatggaaaaacccacagtatgtgcatcatgggtcactaactgttgggctgtatcaagagaagatgagtatcagaaggcagcgacagtactgtcctcccttgagctgacagatcacacctggaacaggataccatgagttacaagagccccaggcaatctggagttcctcctggaagcaccaacaatagtgacagtgtacagaaattgagcattagaagaaaagttgaaggttcccaataaatgaatgaacaagctgagaatgtctcagcctggagaagagacgatgccaggggataggattactatcttccaacaactgaaggcttgtcattcaaaagaaggagaagatgcattctgtgcagctccaaagtacagtctataagtagaagttcctgggggacaagtttttaactcacaaaaaaggaagaatagcctgatgatgctgtctcaacatggagcaggctacttcaagcagtagcaagctccctgtcactggcagtttgcaagcatctgctggatggtccaaatgactttaaattcaccttaagtattaggtcagttaagttagtatttataaaggacctacactgtttagtgctaagaaagggcttgattttttaattgccctgaaataaagtttctttatttttcctcattaggagatgacccattcctggcctactcctctcacttccatgcatactgctggacactctgagcagagcaccttttccatcccaggacaggtcagttctcttccttcctgcatttttgtttgtcttattttaattataccaatcttccaactggattctcagtggcaaaaatggccttggtcttctagtgccataaaatctagactctcttgcccctcagaatagcaatataaaaataatttttattgaaagtgagtctttaaaacaaaatacacacagataccggcatgcgtgtcttactccatagggtgttgccactgtccaagtcgctgtgcctagaacagatgagacagagattgaataactcgtcccttaagaaatatcaaatagatgatggaacagcaacgttcaagattttaaagttacaaaacctgtactctttaatgaactgattttcatttttatcaccttccagttcttgctcacaagcagacagatctttacaaaacaccacatcacactgacagagctttatcttctacagttctattgtcaaatgtttaatattatttttatttaccttctctcagcaagagttgctttattgccatcactttttaaaatgtctagacatggctattctaacatactttaaaaatatatataatgtcttcctttcttcctccattcctttcttccttccatccatttattcagaaatcatttactgagaagatacagtgggcttaaaggtaggggtgaagaaaaaccgtctacatgctatcacatagatcacaaaacaatgtagtaaatgtcttcatagagaagacaagactcagagtcgtatctaacactcccctggggagttgaggaagtgctcaccactgaggtggaaacatttaggggatgattaagactctgacaggtgaagaaggggccaagagaagaataccgcatgcataagactagtgtgagcaaggtcatgagagatgagggatcatgctgtagtgcatggtgatataaggtctcaagtggcaggattaaagtttgtgtgatggggagtggaaagagaggaaacctgggcaaataggtgcatatttggaaaacgccttggataccacctcaaggagtttggactttatttgtagaaggagaaacacccaaaggagaaacccttagattttagggtcatgattttgaaagtaacactgatctaaactttgcttaatgatcttccttcacctatgaaagaggtcagaactaaacgaacagctaatctcactgtcccagtatgggtgtgtgctattcctttttgcattcacacccaccctttttaggcttctgttctccttccccctggcatctccagcaaagggagttatccatccagttcaggtccaacacttgtacagcaattgcagtgttttcaggtgggttctccaattttgaagataatttgtgcaagttgcaattttgacatttgcaagtgtatacaatagaactgttgtttaaatgggcttttatagttaagtgcacactttgaaatcaggcacagtttgcattttctgccaattatctgtgctaccatcaaccccatgacaaaggtagaagcaagtggactaaaatggtgaaagcaagaagtctacacacccactcctgtctcatttgattcctgccaaaacgttggtttgaaagaaaagtacactttaaataacaaccaacacatacaatggcaccatgtgcctcacgtcattctaagcacttaatatatagtaaataatttaatccccactacaacccaaagagattggtaattttactaccccagtttacagaggaggaaacatggtagttaagtaatgtgctcaggattatccagttaataaataagggaaccagtacttagatccaggtgttcctggcaccagcggtcatactgtctctctgtatatcttttatcacacaggcccactgatgccccagttcaaattctatcttccaaaacatggccatccctatatgtaacaaaggtgatttccctttcctcagtgcttccaccagaattaggtgacagcatcctttcagaaagcatcagtttcttacatccatgacagagcttgcccagaggaaagagtgctgtcttaagagctgccttcccagctgcttttaatcctggcactgccatttgcttgctgtgtggtcctgttcaagttcctctaaacctctgtttccccatctgtgttggggcatggtgtgtgtgtgtgtgtgtgtgtgtgtgtgtgtgtgtgtgtgtgtgtatgtgtatacactatataatcccaatggattttctaggtaaaatagttgatgattctgtaagcttactaaaacaaatacagttgaaaattctcaacttacttaagcttacttatcagtttcaaattgaaaatgccatgttttctcatagacgatgaaaaacctcacaaggaagggagtaagtgcatgccaagtagaattgagagaataatcatatcctcaggagaagtttaataaagttttcctggaggtaaacatcctctagaacagaggttggcaaactatggcccataggtttttacatctttaaagggttaacattttcaaaagaaaaataacatgttattatgaataatattcacatgagtgtggaattcaaatgtcagtgtctataaatcaagctttcttggaacccagtcacacccacttatttacgcattgtccatgactgctttcacactacaatggcagagtccagttaattatgacaaagatggtatgtctcccaatgcctaaaacatctactgtctggccctttgcaggaaaagttagctgacccttgctctataatctagatcctttaggaacttctgattttaggattattgtcaaggctattgcttaaaagaacctcatataagtttgtgaaaagaacttggcatcattatattctactgcaaaaattacatatatgacatgtctatgaaagaaatgcataaagcaaagtcaggcatttaaaataaatttgtattatttgttgtgcattaacaattactgtgagaactgtgcagattatttctacaaccaagctatttccaactggggctggatatgtatgtaaagtaactttggtgatatacaaaggagtttcatttgttttgatttgatttgtagtttaagaaatgtgaaatccaatgcataatgatcaaaacatcatatgtacctcataaacatttacacctactatgtaccaaaaaattaaaaattaaaaaataaagtaaaaagaagtgtgaaattcagtttaacattaaaaattgtatcaagaataaatatcagttactccaattcagtgaataacacaatcttccagtttgctgtatgcattgttgcactgatggtctggaagaactgattgtttaggtgtaaagtccaaaacatttggaggaaggttaaaaattcaggcataagaccagtacaaagacggcctgcatgttttactctctgatcagatatttggcttaattgactttggaacttgtcatttaatttcctggaggtatacaagcccaaactcatcctgtacctttgtaatgaaatcccttaaatagtaacagataaaaatacttgtatatagttacagagatatacatggttaacaagtcatttatttgacactctggaaaatgagatgttctggataattaaaattattggataactgaaggttattattctataggaatcatgcagtataaattattttgaagtgtaattaatattttcctgacttcttttaaagattatatcaagcatgctttactctttcttgataacttatatattatgatgagtgtaagttattgtagtatgtgtaatattatactatgctgcaattatgttctcagggtctattaagacaggtgggaatgcttgcctctatattaaatgactgtagattcttgtgctttttaagttcagacttttctgtgtcatttttgtgggctcctttgctattggttttcacctgtcaattttctcagtgcctgtgcctctagaactatttccccttccttgccatctgtgatttgaaaatgagtgggaatcatttgagtcctttgtcaaaagacagttctctaccagggagagcacagaagcctctgagcagcaaactatatgggctttgtgacagacagttctttctctaagaggccttttctgcctcttgttgagtttgtggtaatcttctggagtggtgatcttgccagaagacaaatctcttgagcaacagaatcatactaaatagatgggaaatttcacttttgattaaagcaaagtgttatagttcttgcttactttttataaaagataatgctgtgagcctagttttcatctacagagggtcaatattaggcttaataaatagattacttggaacaatgattgatataactaattcttgtatttacttgaattcattgtctccagtttctggaatgcctgtattgcggtttgtaccatttctcttccatccacacagtgccatgtgtgccctgaacgttactgtaatgcttttgccttcaagttttgtcagtatccacacaggtgtgccacactccaagcaaggcagcatgtgcaaatctggatttctcaaaacagtgaatgaattgtgtatagtgtgactttcaaatcaaatttaaattcctttaaataacacagtccactaacatttcacattgctttctatacttcgacagacttgcaatgtagttttaagaacacttcttatatataaaatgaggtacatctgtgcacatgtgtcatagaaagttggatctgtttctataaaagggaaaaactgggcagatctattaattatcattttgtttacagttttacaaaaaacatgatcatctgtttgaaccaagtcctctttattcttttagaggcatcgttttccagctaagtgagaaattatacacttcaatttcacacatatgggtcatttgttcccatgttacacacatttccaaatagataccagtcttacttataattttgattaaatggcagttatgatcatgttgcataattttgattaaatggcagttatgatcatgttgcagcaggtttggctggcaaatgtttatccttcaaatagagctatagacaaaagcctaattaatggaattgttaacagcagcttcctatttgcaaacattagtcaactatatcttcagcaataattaatatacctcttactctccttgtgtcatttaactaatgtttgtgtcatatatattattccttataggaatcgcagcatctgaccccaggattcaccttacaaagtaagtggttttgaaaatccttcttagtccaaacatccatgtcctctgctccctcattttttcctttttcctacttaaaatcattaaaacatgaaagaacaacaataacaaaaagttattttaattgttaatttttagctctcagaaataagtgagaagatgtaaagtttgtctttctgtatctggcctttttcacttaacataatgacttccagtcccgtgatatatctaactggttcccccccttttttttttttaatctgttacttatctcaagaaggtaactcgggggactgcatgtttggagatcaatttaattcagaataatcatttgacagtaggaacatgaacagtaattgtttatatcttttcttttcagagtggaatgacccaaccaccagagcttctacaaagtcagtgtctttcaaatcgtgagtagttggatctccaaatcaggcctttttggggatatttggcaaggaaacagtgcctcaatgctgatctaatcttgttctctcctctgctccttgaaactatgaaccttgactcataataatatgtagtttggttggggtggggggagaatcaaatttcccattgtcttagtctacttggactgctataacaaatactataaacaacatggcttataaacaatagaaatttacttcccatagttttggagcctgagaagtttgagatcaatgcaccagcataaagggtatcttgtgagggaccatttcctcatagaaagctgttttcttactctaatcccacatggtagaaggggtgaggggtctctctcaggcctcctcttataagggcagtaatcccattcatgagggctcaactctcatgtcatgatcccctccccaaatacccatgtcctaatactatcaccttgggggtgaggattttagcatattaattttggagtaatacaaacagattataggacccataataagtaaataacagtaaaagttaatgagatcaccattaagttctctaagtttgtaaatacagaccaggtcaatacctgggatacgaaaacaactgtgatttcagtgaaaaaataaatctctagatggcttgtttcccacattttaactagttcaaacactgtatagtatcagctaaagacattattttacacaatattcagtcaccactgactaggatggacgagggaatctaagcagccatgattggacatgaaatgttgagtggattgctatggccagtcagcccaagacctcactatttgcaggtcatcaggcacctgtatattaaagacaaacaagggcatccaggaagagccggaataagatattacatgatggtagtttgaagttcagaagccagggccctgcaattcattcagcactgtcttcattttttattaatgctaactgaaggaggggtttggagaaaccaatttcctcatattaactattgtagattttctaatatccatttgtccaagagagtatcaagggagtattatttctctcacaacttctttcatacctaataatagaaaatggaagtcgatttttttgtgtaataggcacatacttggaatttttcaaaatgaaataatttatgacattcaagtggcctaatggcacacttgaagtgaattgctcaccttttggaagatcatgaataattgcataaaaaaactgggaatgactcccaaatagactgaggatttgagaaagtaagtggcatttctacgttcttggtgcagtgcagtagcaaagccccaaagccctgaccccatcactggtccatttatttgcttttctagactgatctgtgccttctaattcaaagttcaatttcaacaaccaagaattctcaattttaagaagcaagaaaaaacaagagaaggggataataaaaccataatcccgatttaaggaccgaattatatgaaaacacaaaaatcaaaatcatctttgatgctgtatgttttagcttttccattaatcacattttgaattgccctcccccttgttattctaggaaacaatagatctaatcctccctgctttcactcctgcctcacttcatccccattaaaaagtcaataagattcacacacatacacatacacacacacacacacacacacacacactcacatgcatttaggaaatcaacacaagtttccaaacttgaaaaaaatataaaaatagattttcctatgtaaaattatcttactcctaaagcaagagtattaggctcccactgtgaaatatgctgctttccatatataccatagaatgcaatgtttcagtagtttgtaactaacagaaataaactcgtcaattgtggtttatagttagaggctgcatttccagagaacagcacttcgtagcacagtaatatatagtgtagccaatacaactaaaatactctatatgaagcatcagtaaaactagaagacactgagtccattttatgaatgagctcctctctttttgtctgtttgatctaaagtccaagcaccatccatcagattttagctgcaataagttcccttcttactgtagggtatgggtttaacataggacagatcagaattgtaataaagttatttttatttttagcttccaacttatcggcttagccattactatcattctcccacatttaactacagtgtgctttttaaaccacctcctaggattttccatttggcagggtaatcctccaggtgattaagattattctgagtgcagacagactgctaatgcctgcaccttggtgagaagcagcccgtaagtcagccgtgatgcaggaaagacccaaggccagaaagtgtcccaagcacactcctgacacttagtgcagtaaagagagattagagtcttgtaaaacagaatcccttaattactgggacacttcattacttttcctcatcttggcctgttttccctagttgacaaaatgcagatcttccattggagtatgcattgtttataaggactatacacatgggcaccaggtctgaaaacattggccacagtgtgcctgagtataaacttgcaactagccagtctccctctttctttttgacaattactgctgtctctgagcctgaccccaacaatatgactggctttttggaaaactgggtattttccttctcagtatagtgcattggcatacagtgctttttatcagtgtccattcatgccatgacatcctacctgcttcagctggaactctgaatgcttatgaggcaagagtactgaattggggaagtttggagacctaggtttaatcccctcctttgtgtcagttgtgttattgtgggggaaagcactgacctagtatccagaagatatgaggttaaatcacaggagaatttatttttattttaaactatacagacagagtctgttaaagggaattaaacaaattaatgagtatatgtgtctacacatgcaggtacaccaacaaacacttgtcagtgttcaattttaagcagttgtactttttagtaattaaatctagcaacataaaaatacatttaactttaatcattaatactttctggaggagaaaagaccagaagttggtctcccacccctcagcctctatgattctgtgctatgttacagtcttggaacaggccccacctaggtcttcttaatcaaacggagtttctaatctcccccaaaaatgtctctgtcccaaaaaagagggtgaagcgtgggcataagaaggtgaaattgtagttctcagggctgtggagttgtatgtttacacagtaatatcatggctgtctattctgtctcaaagagatctttttatttcaatgacaggattcagactgtgaatggactcaccagacattgtgttgctttgtagtttctctttctttttctttgtttttccccaagatagagtctcgctctgtcccccaggctggagtgcagtggcaggatctcggctcactgcaagctccgcctcccgggttcacgccattctcctgcctcagcctcctgtgtagctgggactacaggtgcccgccacctgtagtttcttaatgaagttattaaagagcagtgagggagaaaacagaaaccaaggtgaagaacttggattttctttgttcagttggattgattcatctagtgtattataaatcttgccacttacctgtcagttcagtggccttcccaaatgcatgaccttgttggtcttttatgggacatcatacataggaatagataagatgttattaagttgccccgaaaaggactttcaggcaggttccatgaactcaagggtgtacatccagttagttcttaacttcagttttgtgaggactgttgaggagatggcagctccaaatatcaagctcctttgtaaaacttggttgttagcatttggactatgtccaggtggaaaccatccagacccccatttaactgagcagctcctgtgttttaaaccatgctgtcgagaatgcctggatagtttccataaaatcttaatatagccataatgttggttttttttaataaaaccagtttgccaacttatggtattaactatatgttttaaaacatccaaactctagatccagagagttgatggaaggtcttatggagacagattggttgaggccagcctgagtttacatgtgggtggttgttatgcatgtcacatgaagacatccttgattgtagcaatagttaggaagagagggcactatactatcacaggaatgacagacacaaataataattattgtgctgttgagaacaggtgccaggtgcttttatgtacattgccttattaaacttgccaggcatcgtggaggtgctccaaattattcccatcttacagatgagcaaagtaaagctagaataacagtccttcctcctgaagtgtacacagtccagtaggaagacagactggccatgcccacttattttgaatggatattttggctacaaacatacagaagagccctctgagtcataatgctcctcagtgagaaagtttgaatgcaggctaagggccctgtgagttcaaagctgtctctcatcctgctgagttgcctttcctcacgggatttgataagttcagggatttagtatgccaaagttttccttttgtacctggacacaacattcccacaacctggtgggatgtagtcccacaagaaattataccgctctgttttcgatgacacaaaactgggtcaaaattgttttatgtaatgaaaatgtcattatttctaaagttttctgtaagtgctatgaaaatttcattaccaaagagaatagaaagactgtgaggatgttttccagattgctataaccaatacaggaattacattatttttagatcaattttgaaaatatttttgctaaaaaacaattgatattcattacaaccctggccatccttttaccaaagccttcatcactggaaatgtttccttcgagattttgatttgaaatttaagaactgcaatgcattattgcagagcaataacccactttctagcaatttcatatattcttccccatgtagatgtttgatctgctacttggatgcaatttcggtagcaaattgactgtgtaatggggcaaggaagaaatgactgttattttcttaatcagattaattcttaatcagaatacatgatttggtacttggaatttaaaaatactgctaatcagtttgaggcttataaaagccaaactaactctcctgataaactggtaatcttggtaactttactagttgcagacattttggtttttaaatcaagaagtataccaactcttgcttttaacttgtcttgtatgccctgcatctctgagcttgccaaattttcctaaggacttaatatatttttggaagttctccactgcatcaggggcagccacctgggagcagagaaaacaaaatttggcagcctgttcaagctgtgaattaaaggtaattcacagtttgaaatgaatcagcgtgtggtccttgagaagagtaatcagacatcaagaggattttatgttgaggattgtatattggctaatgtgacaacaagcaatattggcatttggaatgtttgcatcaagaagcactgaagctgccggggcttgatgggtaccaagatctaaaatgggggctcccttcaaagagagctgtagatttacatttctatcacaaaagctgaaaacagagatgggttggctcagccatcatagttgaaagattagatctgatttttgtggtggtgttcatggacctaagtctatcataagatttgtgtatctcagatggcttttgagacacctctgtaatggaaagcaaatgtctctctctctcctcccccccccccccgctgaccacccctctctctccttctctcttttctgtctgggaaaaggcaaacatcgcttcctttctactagatttcattttttttttcaacaaatatgcattcagtatctactacatgtaaggttctgggctaaaacactggtaactcagggtgaaacactgcacatcattgtctcaaggaattcatggtctagtgaagataagactagcaccgacaatgccagcaacccaactaactcatacttattgagtgcctactatgtgccaggcacttcccatgcactttttctccttacaagcaatcccatgggtttcatcatcattatagtgtacagaagtagaaacccagctcagagacattgagtgagttgctcaaagtggcacagtaacaaagagggaggcagaacaggactgactccagaacatatgctcttaacttacactaaagccatcccatgagtcatttggaggtggctttactgatttgcagtcaggtgtgatcttgcccaggcattaggccaaaatggactaaccacaatgcaagccaaaatggcaatgccattttggtttaaatcaggggaagtattagatctaaatattataactgagttaggtcttgcatatactacacatgctgacatggacactgaagacagatctgtcctcaactcagggcctgcatccagattgtgtcaccaggactctagaatattcccttcagtgaggctgaaggatctattcctgcaagagacttagaccatcacaaaaataaaattcatataagattgattttggtggcatatcccttcagaaatgtccattgtgccacattaaagtgaagagaaaactaatatttgggtctatttttataagagactcatccattgcctttcatgcttaccaacttgtttgataattagaaagtggctttatatcctcatggtgaaataattttcaaaaatatccccatctgttatcaaccacagcggcatatttccaaattcttctcagcatttttaaacagtaactgggagtgaagcaaataatgctggtggaaggcactgaaattgataagcaagggaccaaagttaaaaaaaattcacttgtataattgaatgtaatgttgtgataacacacccccccacacacacacatgcatacatatgctctgtatcccagaacagtaggtcactctaatgtctgatctaatgagatgcacacatagacatatgcacactcttttttcagttattacattgtaaagtgctatgatcagagatacttttcatgtgcacagtgaatgataattttaacacactttcacacaatacattagcccatgtgagtggcacagcattcctgttagatagccaattgaaaagaaaccaggcgtagggaggggaagatattttcctaaagtcctccacctagggagtggcagggctgggactagaagccaggattctgcattctcagaatatgctgccttgtccccagattccccagatggctgcagggccagaactcatcagagtcctgacaagtcttccaggcccagatgaagaacatataacagcagtgtagacaagctccatggattatgcttagaatttataaagaaacaaacaaaatccaactgagactggagtagaagagaagaaatatctacttctgaactattcattttgtttttccctcctatcaagcatctcacaaacagccagatcctttaccacaattaggttactgggaatgttaggtttaaatagtctgctcttgacaccttctcagagttgcttaaagcccctccattttacactgacgagtagggagcagtgttggtagaatactgcagatgcacacaaaattacagctgtaaaatcagttgaagaatctgacaaatgcctttctttgtggttcatccacccactttaacaatgtggaccaaaaaaggaaaaggtctcaaagctatttgattgacatctacaaatatgctgccaagactggaacagagtaggtgggatggagtagatggggttggggtaggtcttctgaaaaccaaaagaataaaatttattttctttgctaccctgtggttttttgacactgaagatctacagtacaaccccatagtatactgccttgtccttgccaaaggttctagggtccctgagagagcaataagtgagagaaaagtatccagagaagagtagaagctaacgatttagcaacctataactctgacagctccattgcctaatttctggagttacttgttttggcataagaagcccactttataaaaattccagatggagatttcaattttgtaactacatagaatatttcttctttttttctttttttttaacttttattttaggtttgggggtgcatgtgacacggaggtttgttatacatattgtttcatcaacaagttataaagcccagtactcaatagttatcttttctgctcccctccctcctcacaccctctcctctcaagtagaccccagtatctgctgcttgattctgtgtgttcataagttgttaacatttagcttccacctgtaagtgagaacatgcagtatttggttttctgttcctgtgctagtttgctaaggataatagcctccagctccatccatgtttctgcagaagacatgatgtccttcttttatatggctgcatagcattccatgggatatatgtgccacattttctttatacaatctgtctttgatgggcatttaggttgattccatgactttggtattgtgaatagtgctgcaatgaacatacgtgtgcgtgtgtctttatggtacaatgatttatattcctctgggtatataaccagtaatgagattgctaggtcgaatggtagttctgcttttagttctttgaggaatcaccatactgctttccacaatggttgaactaatttacactcccaccagcagtgtgtaagtgttcccttttctccataacctcaccagcagctggtttttttttttttttttttttacttttaaataatagccattctaactggtgtgagtacatagaatatttttctatttttcaaaagaaaaatcttttaaagtacctattcctcataatatatggaaattgtctaggccatctaaaaattgaaagggtcattctaggtttctccaaaataatttttgtatatcacatggtacagaaagaaacgaagaaaacaatctggatgtgagcagtattcttgggtaattgcaaccaccacttttggaacctactatatacctggcaccatgaaatattttataagcatcagctatttcatgctcacagcaacctcgtgagatagatttcgctatctccatcgccatcgtcaccactatcatcgctcccaggattgtactctcaagggctcagagagaatgccaaacacctgtggctgcacagccaatgctggtagtcatatttgaagtcaggcctgcttggtgctctttccactgtgcaatttcactggttcacttgtttaatcaccttctaggctcataatgtctctgagaggttgataagattaaactgattttatggagaaggaaatttcgtcccagaacagttaaatgacttgctcaagatcacacagctagttgttgagggagatgaaatttcactccaggattcttggattacaaaattcaaaccttttttaataccctgtttgcctcacccacataaagtttcaactgaaatcttattaattgttaaatacgaaggaaaaataacaaaataatcttaataatactactttctagttctttggcattatgtgttttctacacatattgttatataacacataatatatattgttatattgttaaatcttttagatttggtcttcactcaatttctggagcaaggagacaggggagggagccattattgtcctagagaggtcacagatgtggggcatccatttctgagtggcttaagttccagcgctctcactcccctgtcatgtgacttgatgaatttatttggtgcttttctgagcctttgtttcttcatataataaaacagagatgatatattactcagactctgtagcgaattgtgttgtcaacagatgagctcatgaatgagctttgcagtcacctgctctcattggttctctttccatgttagaagtgaggaaagtcatgcccaggtgacctaagtgaggcgtcccagctcacacaggtaatagtgttgccaaagctcagtcctgtttcttgactcctagttgagtgctatttttgctaatcttggccattatttttcaaaagtgttctgtcaatgcagtttaaatcaaaagatcaactgccaatgctgtcagagagcgatagacttaaaatcaataactatgtgtgccactcctctcctaattagatatccccagcatgtttctggatgtttcatgctgctgagaagagtgacggcatttttccactcaattatacccaaggaaacattgttcaatttagtaatagttttagcacttgtagaagaatttgaaaactttagaaaaatctcatacgttttacaatctcactgtcttagagaatgggatttgggactaggtctaccctttatcttcatgcttttatgcagcgctttaaaattttgatattgaagagggcctgaaactgggtgacctgtgttgccctttactactggattaaaatttcaggttgctactatggtaaccgtaccttgaaaattagatcctgacagagtcactaagaaatgtaaaagtgcactgctgccatgaactttgaagaaaggttgcatacaattgtcagcgacagcctcttaattgaaataatctgcctttcccatctgctagaaagagtttgtgtgtcttggggaggagggacaaaaagattatatcttgatggatttttaacacaaaaatggctgtagttcgaagcagagctgttttctgcatgagatttaaatcaacttcagctcaatttatgctattcagaaagaaatgtgatactcagtattcacggtggcaagaagccaagatacacagtaaagatgtaacgatactaagagaagatactgctggggatctatcccagaaaaaccccagtggccccagggtccaaatggcaacctttttcaaaccacagatttctgtgcccaggcttctgggaagttggggaatgcagagcagccgcatgacagactttcagatcaagagggccagcagtcactgatttgcttagtggcataaaagctgagatcatattgatgctcccagagccagggaaatgaaacaagcaacatagggtctcttggctttcaggaacatgagggtgagtggcacttgcaatttcaggaattcctttgtgcatgtctttcccaaggcaagcacatcacggtgtgtctggctttataattagttgtggctgtatctgtgtttccataacaggacttttgttgttgttgttattgggcctttttcttttctttatttttttcgacattcttataaaaggattttgatttgtgcttctaatgccacacatagaaaatgactctttaactctctgaaggtctcaaaaatttcagaccaaaagtgatgttctcactctgagaatgttggtatactattttgcacaaaacagatatcaaatattaaatctgttggacaatatcaagtagttgggactgagggatgtggagccataggaattctcaccacctagtggtgggacagtaccttgaggggtagttctatctaaagactttgggtagaatcgcctctcacctcatttgcgagtctcttcattttggtttggtcagcgtgggtactaaggagactgtgatagtgacgactgaattgtgatatacttccaaacccaagcaatgcccatgaaagcccaacaaagacatatcaccagtcttctacctgtgaggactgtggaaccacaggtagcaggatgtttgactctcctgaacataatagtttcacaaatctatttacctgagtggaaggggtggtatccactcccctatttcttcagcagccggtacaggaagaacctactacacaacagataaccagaaaatattcttgagtgtaaagtgaaagaatgatccagaaggtgtcacttgctctgaagtaacttttttttaaatattgtattcttatatttgttaatccatattttaaaagtagtatcgtaagaagaaatataaatgcatgcatgtgtgcatatgtgtgctcatatgtatgtggctggaaagcaaatacaatgcagaacttgaagtggacaggctctgtgctggaatggctgggttcaaatcccagctccaccatcttttagccatgtgatcttggtcaagttacttaacctctctatcactcagtttcctcatctgtaaaatggtgagtagtaatagcacctacatgatacgattaaatgattgaagtgcttatcacagtgcctggtacgtaggaattttttgataaacacttttattaatcatgttcatgattattgcggtcatgatcactgagtcttttgagtgagtgctgtttgtactacattccaatcttcagtcacttgggaagcctttcactctcttccctgacttgtcccagaggtctccagttggagaaagacctctccagaaagagcaaacctggactacattgaacatttccttggctcacctgcctaccccagtcccagaggataaaaacaaagaatggctagaacgtcttaaatgtatagatatttggtactaggcacagtcttctcgttcttggagctcaacacagcatcttatcccagtcacaattgtactcttagtttgtagttatttctaaaaataaaagctaggacttattaagtgccaagcactatgctgagtgttttatatccactagctaattgactatttacaacccagtgagatgtaggcactaccgttacccacattttacaaatgaagaactgggtttcatgacttgaagctaaatttttatagccagtaatgatggattcattacttgaacttatgtctggttgactccagtaagagaccccttaaccctggccctcctgcctacccatggactctccaatctcagagtccacctggacttgattgtcttgggaaatggcaccacctcctcagaggtagtggagcaaatacaagaatacaagagggagaaaacaatggaggacaggaatttggccagagatattctctgctcctgagtcccaaaacatcctctcacattttgtaaaatcaccactgggataatttgctgagtcataatttttaattctgtggttcacatatatatgaaaaactgcttttgaaatatataacaagcatgttgtcaattttctaatcaggtggaacaaattcttttctttattcccagtttttgcatgcataaaggaagtcgtctgaataagaaaacatgtcaataaaatttcatggaatagcctctgccattctgtgaaataaacattccattcccttgcctgggcaaattgttcctgttgctgcatatctacttctgtttccttggtctaaaaagacacttcagactctgcctttaattacgataaggcttgactattaacccttgagaattaaccttatttttgctaggagggaaggtaaaataacatttaaattggttttaagagtaggaatggaatctcagaagacacactaatgtagaatacactgtatatcaaaatatataagtgcatagttgtaacagtggcttagtaaacatattgctgagtgaactatgaaaaataattcaccaaggtactgtttcccatactcctaagcactaagttaagagagtaatgccataaagtacatatgcactgtttaaaaatatttgtgtgttttttaaagaatactttcttcaggcccaatagacgaatcattttttcttcccttgctaaaatgtacactgtaaggaatttaactaagtggtatattaagtgagggtctaaaatagttgtagaagataacaattctgagcaaagaaatgtctttagcaatttgattctgaatgcaacataaattaactttataaaatagaattaaaagaagttcagttatagctttccaatttttcatataatttagcatttcatactcattgtgtttgctactggcacttttattataaaagcctgaaactgcaggtcaaatgagtacttatgtggatataaatacactgatttttgtttttcagagagagatctttctctgaacaacatgatttatccaagttaagagactacctctgtggaagagcaactctcttgaaaaccattcttcacataaggttttatgcaaaactcctagaaacctgttcaaaaattatagaataataggaggtgttcctaagctttcaaccctccaatgctcttgcttaaattttagatctcaactaaagtaacttgacttttcaaattatgtttcaattcaggtttgttgtcttttaattccatattaaaaagtttgatgagattaggatgagaagagaggggagatgataaggcagttcattatgcacatcaaagcatttcaaaacatatctggtttaaagccattaaataatttcccaaatttgaacctgtggtataaaactctttttttagtctaattccaataacgtaaatgggatacatgaggaaagatttcaaagcaacgtttcttataaatagaatttcaatagcttctccttttaaaaggaaagcaaggggtaaagtggatgaatcatgtcagtctcccataatgagaaaacagagaaaatgcacattcacatgcccaccctattatggtgtagtttggctgcatgatggttattactgaatgattataatacacaattttacatgggagataaaaagaaaatcatatatagatgttttcccacttgaagcaaacctctcacagaaattctagcatatatttccatacagataaaaaggtagtttttcacccttaaaaagaatccttcactttgaaaatgattcaccatagtttccctctaaatagtaagctcatctcatgcatttacaatatggtttgattttcaaaacatcaatttacatgcactttccagtaacaaatctattgtgccatgtgatgcttacttgtataggataaaaaagcaaaagtattttttctaattaatacacaatattataatgtacaacatacaaatatcaattcgttttgttcaaactaataataagtacttggaaatggagatgcaagaaaaccccacttcattcacaacagttatatggatttacattaaaaaactataaaataacaccgaagtacataaacaaggtttgaaagaactagaaaggtatatatgttctcatagcagaagtgttatagtgttatttctcccaaaattaatttataatgcaattccaattagaattcctcaaaatgattctttttagcatgagacaaattattgtatagttcatatactaaaagggtaaatgctcaaccatagtaaatgaaaagaaagaacagtaggaaagattttcattactagatatatgaaaaaactacaatacgctttaacaaaatcaatacattattagcatgaaaatagatactagatcaacagaagagacaattcaatctctctccctatatatgtatgtaatatgtaacaacagcattacattgattcaaagagaaaaaaattgatatgtaatgatgatactggcactactagatctccatttagaagaaaacaaaggtagtttcctatcacatttaaatatattaaagtaggaagagaatgagaaaaaataactaatggttactgggcttaatatctggatgattaaataatctgtacaataaacccccatgacaggagtttacctacgtaacaaacctgcacttgtacccctgaaattaaaataaaagttaaaaaagatacaaatataaaatataaaacaacaacaatgaaaatacctttagtaaaaatgcttggaactctgtttctacaatctaggggagagggtccttcttaattaagtcagaaatccagaagttctaaaagatgaataactataaacaactgaaatataacatttgtattgaaaaagatgccatgtttctataaacaaatggaattttcctacatacaatgaaatgaaagtttgtatgaataaaaattaagtttttatgaagaataaaataaaaacagaaaaacaaatgtagacaaatatttgtttaaaaattattaaaatgtataattaaaaattaaaatatttaattaaaaattaaaaacactatatagcacatctgacatgccaagcagtattctaagctctttacctgttttatgtcgtttattcttttttaattaattgatttatttttttattatactctaagttctagggtacatgtgcacaatgtgcaggtttgatgcataggtatacatgtgccatgttggtttgctgcacccatcagctcatcatttacagtaggtatttctcctaatgctatcccatgcactttccagtaacaaatctatggtgccaagtgatgcttacttgtataggataaaaaaggagaagaatttttttaaaaaatttgagtcgatagtttatagtttgcttgtctttaatattaactatttatagtccagcagattttgctaacacaagttgagatggagatgccactggctgcctaaaagctaattctgtaaagctcattcttgattatcaaaatgccgtatttcagcagcagccgatcaaatacggccttgttcttgttctcatgggaatctaatccttgagtcccttctttccccttaaatttgtctggttcacagacacattccatgagctgaaaatctaacaataaattgagaaaattagatcagtttgcataacatttgaaaaggaatgtagcctttgtttgcacagccaaggtaaaatggacagatcagtaactggaagtgtggtgtagcacctcacagaacatgaattctctaaagaaccctggcaacccatgtgaaaatgttacgtggaatcatcattttgaatagagcaaaatgacgctggaaaagagctagggctgagctgtgcagcatcatttgagatctgtgcatccagaaactataagcacatcttgaatacagaagacgcacctccctgctttcacggtaatattttaaatagtgtgctggctggctttgctttttaaaacaaatgtgtttaatctttgttagggtgagggtgaaaccacacaagaacatttacagcaatatgtaaattgacattatatggcttttctactctcctaagaaactttattaggggaagtcactttttttctgcatagaaatagcagcccctaaaatatatctaagcagttaaggcttcaccccaacagcttgagtaaacacatttttttaactttcccatggacttcaactttgaaggttttacataaggtaattctgaagtggttgtacagagttaatcctgggtcttttatttataaagcattaatttcagactttttaaaaaatgtaattttctcagataatgtctgagaacaaattgagcttctaagatttaaaaagaaaagatccaattgtgtttatttgtggccaccaagcaggtcagtgggagaatcatgtatgtgtcactaagtgattattttgagaaattgagtatactgactcatcttctaattgaaaattgcgttgctgctgtgcttttttaaaagttacttattaatatcagacaactttccttggaagcttaggctatatggtcttatttatgccatgcaaatgatgtgaatagttgaggcaaataaaatcagaggaaaagaaaataacctcatttttctatcaattatgtgtatgtgtgaggcaaaattattttaagtgtgaaatatttagattctctttttctaaatcctttatcatgaaatagttactatgaaatattaattggtattcagcaaaaaagggaattatatgatccaacatatttgggaaacagcgggttaaaaaaaactaacaagtcttttcattgtaggaattctttgagcctttaatatgcaaatgctcactgtgtttctacaagaggggtgtagaatatgaagtgtttttcaaactaacttggctatagaattttttttcccagaatctctaccaacatgatgtggaataatttgggcctctccaatctagataactacaccattatagagttctttgtgcataggtagactcagcttcaatatctacctggagtatggatgctcattatcttttatcttgccatcttcactccacctttactccagttgccccgccacatctgaaaatacattttaaatcaaatatcccttataggcagcttagtgaaattacagataatttgtatttcaaaattttgggggctttatttttgtattgataatatggagggtgttctgaaattccaccaactttcacccagatttcttttgtgaggagccttttgtctgtttttttttcccccctcagaccacctgcaactgtaagttgtctccggggtggctggctgggatcatcttccttcactgtgaagagaaaagctggctgaatagagacaaaaacactgcatactcactgaacattcttgggagataatttgctgccatgttttataaaaccaggggctggatgtgcttaagagctttttattaaatattgccaagagagataatagtcctattatccaggtgacttttgagaccattctgaatgctagtattattgaaaatgcagtaatgaagtcaactctcaaatctaagcatgtggatcgtccacttcagactgtgtcttccctagctggcttgttgaggccactcagcccagctctgggctgccttcccctgccctctgtgggaatgtgttttgagaatgcaaacacgcataacattagactgagaaaaaatgcaattaagaagatattttttaaaaaatgatgggaggaggtgatgcgttatacacaatccagagtctaaaggaaaggacttcccattatgccctcattttctgtgcactgcttggctctattaacgccagtaatccagagctgatacagtccctctgaaacagccaaattatattttcaacaaggccaagaatgtgtcctttatttaagcactttcttgataactgatctattatgagaagcatttactacatagttaaactggcaagaactagaatttctggttttctgatctacacacttaaagcaaatacgtttctgtgtgcacagtacttcatttaattatcattttaattactttattgacttaaacattagtattgaacacattttacaacaacaatgaatacacaagcaatttataattttcattatttcttatctcattcacattatctgaagcttgatagcagataattatttgattgaatatgaaaacacccaaaatattgttgggtagcagatatgagctccaattagttgactctttcttccctcaccaattacatatttttttatatttatttctggtatatacttaatatttataatacgcatgtttggaatttgtacacagggagatggctcagtgattgtatttggactatattgtaacagctaccttatcatatctatgaagacaaatattgaaatttttatttctggaattaacattttactttagagtttctcattaatcattacttttgtttattttatgtatggtgttagagacatgatttgaaaatattttttctcagcaaactgggtagggttaaatttagaaacttgacaatagaagaactatctacagaaaataccaaagatgaaaatacaaaatgctgagaggctggtacaaaagtacagtttacaagactgtactctccttgaggttggaagttgctggagaaaagtggctgatggtctcacacctcatctagctaaactcactttccattatcttggttacctgcgctatgaagtggccattcaactttatttaatgtttgcaaaatctggctgattgattgcctattcactgaggtctggggaacctcagattgaaacattatccaggcagtagcaacatgtactttttcaagggcatttaaaggaatactagtaaacttctggtgggtattcctagtctagatttatggttattctttgaggaaataccaagagtaggtagagatacctggcttatcttgtaaaattgaggtaatcattttgcagggatgcttttcactgttagttgagccttctcttgctgttgcaattttatttgtccacagggagaaaatgggtagggtgggaacaatgctaggaatccgggtagcagtgtgtgaagaaatgtatattttcatctacaaagagaagataaattaaattcttagaagtcagaagattcttatgtttgctgtaagataaaattctgctgacaaatccacctcaggtggacctggctttggggaggaaggtccttaatttgcttttctccccaaattctgatgaaagccaagagaaaaatcaattaaccagtatcaaactagggctcaaagatgccctgatgtggcactgcgtgttcattggtaagcctcagtgtactgtgagcaagtcgtcatcatttggtgcgtggctgatgagagatatttaactcaaagagaagtggcataatcgttgaatttgactctgccagttgacttaccctgaaagcccagagtgtattggcttcaaatggttaactgacacaattttcaacagaatattctcctccaactggttggagatccaactcagtgacttgagattagctgaaaggtggaaaggcttctctgcctctgtaacttctgttttagcaatggataactaggagttttgttggtggtatggttaatatagataacaggcatttcttttgggcaggagagccttgctatttgaggtgaagaccaatggcttgactttcccccaaattccacaaacacaaccatataaacagatttttttcccatgaactccattctagtgtcctagaaacaggtagatttatgcagattaatttggcatagtacagcaaattgctgctgtgagatatatcatagaattacttcctagctcaggctagctaatggctagaatgaaataaaacataaaaatacatttacatagattgttttataagtctgataaagctttttgttacctaccactggaactggacgtgtttttgcaagcagcataagggttgttcatgtaatactttcattatttccagcaagtgtaaaacaaaataaaaacaagaacattgaatttagccgccattaactaccattaactgtaatttttcctgacaagctctctctcatctgatgatgagtgaaacgctgggaaaagtcgactgaaaaattgtataaacgttgatgaaatatgcccttgtattttaagcatgcccagttcagacatttaaaatcgagcaatttataatgtgttagcagtcagaactccatcatgttttaaataaatttatttttctacttcttgtgagactctaagtcactctaagaagactcatgacatttcactgtacaaggcaggtcacaaattgaataatgtgaaataactttattagagaactgaagaaaatgatatggcaataatgtgttttacagtaaaatttgatagccctctaaagatcaatgagtgtgtttgtttactttgaagtgaaaggacaaaggcttcataatggaattcagagaaatgcctgaattaaaggcatcattgccagataaaatggctttcctagtctgtggtgaattcagaaaacctaccacgtactttgcagtagaaagaatagcctaggtactgtctgtgataatatgtcattataaagctgccctagaatgaatgaaagtcctcttgtggccacacagaataaaacaagctgcaagtcacaaggttcttgtcctgtcccaaacattgattgaaagggcactttataaagggagaaagaaacagcgggggcaccctcatttgcatcaccaaaccctaatgatggaggcgcttttatggacacactgtgtacacagaataggttcaattaaaaagaagccattttacactggcctttaccccaccaggattttttcttaaagacaaaacaaagaccatttatctgggtaacaatacattactttaaaaaatgaggcagagtgtagaacatagggtaggcaagaggcgtgggtctcccatggttttatctttgccacttcttttcttagccagtgcactgtagatgtcatgaaagcatatctttgtcaaaataaggtaaatatgaatgacgattggagtaggcaggaatcttgtagctgaccctgactaggaagagcaagattcagaacttcacttgagtttaaaatgaagttccattagcagggaccaaaatgaattgctgtctgataattctggcctcgataaaacgagttgggcatttgagttcaatgcctatggacagatgttccacagacaaaaaacgaggctcttaattggcactaattagcacccttgttggcagggagagattgacaaggttatttctatggcacttcccctgctgactcccatagctgttctttccaggataaggggagagcaatgtaggtaaacttatgctcttagccttcaaggattatttgtgcccccaaacaaagacagtcttcgcatttctaagctgtcaacttagtaagattctttgcctaggatatacattggcttttatttttaattaaataaagtgtaattagtaggaaacaatcaatacggtagagtgacaagcacttttatgttggtttgtttgtccctgcttaaagaagcagaagcaaaaagaaaaaaagaaagaagctgtattaaggatgagaaaaacaatctaagcacattatagatgttaacactagtagcgaacaaagaaggtgttttatactggcacaaattcctgcaacctgctgtgcaatacatcttttcaatgctttgtttataatcaccttcatctgtaaaatggcaaaatgccaccagcctcctgagagggctaaagtctgtaaagaacctggatgtcctggggcataaaggtgtcttataattataagctatctctaaaatgagtagcatgctgaaggaactgtggctgcattctaatatacattaagcagagctatatggaagtatgctttaagtttctgcaaatgcttctctctctataattgcaaagttgagaattatgcaaaagtagttattttgcatttattcaatttagtgctaataaggaattcaaagaatggattaaagtcatttttagtaacttgacagatttttgtatactgtagcatgatggtgtacattgctgaagagctggagaggctcttaaatctagactaagcccatttatttttctaggaaaaccgagggattcgatatccagaactagattcaaagaatgctcatcaacaacgcacatgtggtagaaatcatgtgtgggaatggggcagctggatggcaggttcctgagaagcagagcctgacataggcattcctgtgaattaactctaaagaaaaagaaacctgtaaggaagtgaagagaacaagtgggatggtgggcttggctgcagcttgatcccatgaggagtcctagagcatgaaccaaatcacagagttgtcccacattgaggcaagatggggccagccgtttggctggatactggctgaacgcattcccgtcatttggataggggtttcccatccaagagcaaagtggctttccttctgccaagggcaagtatctggagaagggcccacctggaggtccctggagaaggacccacaatagctagagcatctgtgcaccagtctggtaaaagagatgagggaagggccatgctaccagccttcactacagggctaagtttggtagagccaggtagcttcctatctaagcaaggccttttgtttcctgagcaactttcagaagagcacagtgttgactgagcagaataaagcccatccttagatagtgaaatttttaaaaagtatcctttgataattagcaacagtatacacatagatgagctaagcaatattttctttgatgcgaacagtccttcttgaagtacaagaaggcaacacagatgttcattcggcttcttatgtgttcagatactgtggaaacagaattcccagttcctcaaacaaaacatttcattcatacctgtccatacttgcatgtgcctcctgtgtcatgcctctctgcctgtggtactctggaatctttgtcttctattcacttctcaagattgcacaccagcataaattcctaggtgaagacttcctagaacacaggtccacacaatgaaaaagtcactacagaggctatgtaaatactccaagttccaaagacaaagggatttccagtacttcctcaaggccatctctcatagcttagatttcctgtccacaccctggaacctaaagcctaggctcctctcagtttactcacactctttgcccctgaaggcattttccttgtcaccaagcacctactacaattgaagagggtacagtcagtcccaagcagccctaccaggtttctcttacctcctcaccatggatgcctggtatcccttcctcatcagcattctctgatgctgacactggatcccatccaagagccatacactgtgctggtacatcacaatgccaaccaccctttttacatactcttaaaacaaccaccaccagattcccccagctcttcttcccccaaggccacaaaaatctgcagactccatgcatcccaatagtgattttcagagactgtgacttctgttgcccttgaagaatcctaattaggggaattgcctggccgaagttatgctttagaatgattactgaagccatagtgagagatcttgaaggcttgaaataggtagggatagagaagagaggacagactggagaaaggtatgatatctgtgttcccatcaatggatttgagtaactgacaagatgtgtgaagtgggaaagagaatagaagtgttaaaatgatcaagcttgcttgcttgataatttggataggtggtaatacaatagagatatcttagtcaatttgtactgctataacaaaatacctaagactgggtagtttataaagaagagaaattttatttcttcacagttctggaggctggaagtccaagaccaagacaccagcaggttcagttgtctggtgagcacgtgttatctgcttccaagataatgccttgttgctgcttccctaggagggatgaatgctgtgtccttacatgctagatagaacaaaatggcaaaaacggcttaacaagttccctccagccttttataaggcactaaccccatgtttaagggcagagccctcatggcctagtcacctcctaaagggtccaccttttaatactgttgcactggggattaggtttcaacatgaattttgaaggagacacaaacatgcaaaccatggcagatgcaaaagtaaagcagaggaattaacttctgacacattctacaacatggattacactcaaaaacattatgctaagtgaaatataatatgctaaaagccacatattatatgagtcccttcataagaaatatctagaataggcaaatcaatagagacagaaagcagattagaggttgcccagggatggagggtggaggggatagagggattgggagaatgatagctaaaagttacagggtttcattctggagtggtgaaaatgttcctgaactagatcatggtgatggctggacaacactgcaaagatactaaaaagcacagaatagtccattttaaaagataaatgttatatgtattttattacaaaataagtagatagattaaaaataaaacaaaataaatgaaggaatgcatacatacatacatacttaaaccagtaggagggacatgccagagatggtgagctcagttttagctttcttaggcttgaggcatttgtggaacattgtggtggaactggatttaggtgccaggagctcaaaagagcgttatagctgtcagggctgtaaatacattgcctcagcccacccattttggagagctgggaaggtaggaactggggcaaagccctgtattagtttcctggggctgctataacagagtaccacaagttggaaggcttaaagcaacaggaatgtcctgtcttcctaacttccagatgttagaagtccaataacaaggagttggttccttcttaggatgtaagagaaggatctgttccaggcctccctccttggcttgtagacatctgtcttctctctccctgagtctcttcacatactcatccttctatgggtgaccgtatgcaaattgcccctttttataaggacaccagtcatatcggattagggatcaccgtaaggacctcaagaccttatctccaaataagaccacattctgaaatactgggggttagggcttcaacgtatgagttttaggtaggaacgcaattcaccccctaacaagcccatttcctgaatttcccttttctgaatggcagcaattttaacgatcctccagttgcagtagtaatcagctgcacagttctgtcccatcctacgtagagggaatttaggggtacttacccccaaaaccactctggagcttccgtccattcttctgcaatctctcagaataacatggacttagggagctgactaagagtcatctgcctgcagtcattttcaaataacattgttattgcaattaccaagttgagaaaagcctgcccaaccactacttgggcaattgataaggtaatgaaaaaaacaaacagatttacttttttatgtgaagacaaaatgtttgtaggaagcagctctcacattctttgtaagcagctctgctctgtggattttctcagcatctttgaccaagcctggcttgtgaccatcttgttttcctatggtagttcattctctgtttctgtggtgggacactgtgccaagagaactcgctcaagaccaagagacagatcaggctgttgttccacattttctttccactaaatcacagttttctttcaagggaaggtggctgttgtgaagctgtcaaactagctgttaaatgggttgaagtgaaggctcctattaacaacagcagctatctctgtcacattcaagttctgcagacagttacaaggcaatttggtcctgataggtgggctattaaaaataacaaaaggcaagaagaatgagagaggaacaccctttttacttcctggtttcaaaactaagggggcaactgaatatttcacacatggacctagcctgcagttagtgtggccttcataatctcacagggacaaggcatcctccctccctgggtgttttcctttagccaggtctgggaatggaaggtggcagtgggggagacagcaacaaggtctctatcaagttcaaggtggccaaagagttctgaatgctgatcataattggaaacagtgtcactggtgagggcagtatgtgtgctgtgtgtgtgtggttgtggggagcgggtggggggcagtgatgatgccctctgcatgagaaaaagcagtgtggacagttttacagtgtcatatccaagactgtgaaggttagacgacagacaaccggaagagaattaaagggaaattatctctcagcttaagggagccccaacttaaattggatttgtgagttaacatttgccttactgtgggagttacatacccgtacagggccctgataggagcctggatacctaacccctcgtgtcatggtttggaaaatcaattagccagtgaaggacccggccttgcgtagactcagcagaggagaaactgctgcaacccaggcagtctgcacctctgaccagcaagaatggacacatttttcttctgttgaaatagattcagagtcccattttgcctgtgcttaatgaattcatatataacatgatccttaccccagcttcttctgtaatcactaaaatgtgagcctccttccatcagccctcacatcgtattagagcaactcatccaaattggcagcccacattaaccacatgcctgcctgtgggttttattgcgaatgggggcaggtgatttgtactgttgcgaggaacattgcacagacagattccttctttactaccctcaggtttggaaattccaaagtcagggaggaggagaagagtctttgcccacaggatcttggcttggtctccaccccatccagacagctgtctctttaatataatgctttgtctctcctggaaaagacaaagctcttttcccttggtgaggcttctgctggtcatatcaattgcagttttaatgtagggaaaaaatacagtgagaaagagattaggcaggaaaaaatagctctttttctctgtgtttttcttggcagatatgtctaggaatgcattggagaccttctgccgtacttcgttatgcaggacagtaagcagagtggttagggacatgggctttggaatcaggccactgtggattgccagaccagctctccgttcttctcttgtccagctgtgagacttttttttttaaaaaagacggctctatttagatgcatataacataaaacttaccattgtaaagtatacaattcagtgttttctagtatattcacagagttgtgaaaccatcaccactgtctaattctagaatatttttatcaccccgaaagaatcttcataacattagcagtcactccccttgccccatccccccaagccctggcaaccagtctctttcagtctctacagatttgcctgttttagacatttcatatgaaaggaatcatgtgatatgtggcctttggtgactggtttattgcacttggcataatattttcaaggcttattcatgttgtaccatgtgtcagtactttcttcctttttgtagctgaataatcattcatttcatggatctatcacatcatgtttatccattccatcagttcattgacatttgtgctgtttctactttatgtctattccgcgatggttaatgatgttgagcatcttttcatctgcttattggccatttgtctttctgtgtctgtcagtctgggctgctataacaagaatcccataggctgggtggcttaaacaacaaacacttgtttctcacgtaagtggtggttgggaagtccatgatcaggatgccagtatggttgggttctcgtaaaaaccctcatcctgatatcctcacatggtagaaagagaatgaaaggaagcaaggtctcttgggtctcttcttagaaggtctctaatcccatcatgagtattcaaccgttatgacccagtcacctcccaaagactccacctcctaatatcatcacattgtggattagagtttcaactctatatgactttgagggagggggacacacaaacattcagtccacagtggtatcttctgtggaaaaatgtctattcagatccttcagccctcacatcgtattagagcaactcatctaaattggcagcccacattaaccacatgcctgccttcgggttttattgggaatggggacaggtgatttatactgttgagagggacattgcacagagagattccttctttactaccctcaggtttggaaattccaaagtcagggaggaggagaagagtctttgcccacaggatcttgccttactgcaggagttacacaccagtacagggccctgataggagcccggctatctaacctctcgtgtcatggtttggaaaatcaattagccagtgaaggactgggccttgcatagactcagcagaggagaaactgctgcaacccaggcagtctgcaatccaggcagtgtgcacctctgatcagcaagaatggacacctttttcttctgttgaaatagactcagactctttaattgggttacttatcattttattgctgagtttccagggttccttataaattctggatactagatccttatcagatatatgacccacagatattttctcccattctgtgtgttttcttcttaacttttttaaacctgaatttcctcacttgaacagagaaaataccagtataacctcccaaatttcatggaaagagtcaatgaagtgatccattagcgcacttagagaaatgaatgtctggcacacattaagcttacctcaataagtcttagttattattagctagtattggctgacttggatttattgtgagacagagacaaggtgtaagccctcaagtcataattgtacatctgacaggtgtgatgtgaaaggttcaaagtgctttgattgaactaacatgttattcctaggatgattggagcaattttatttgagggactacatttttattctgaatagatttcctagttctagatattaaatactaaggcttggccagtattggggtctgctattctccacgtatctatatttacagttctttctgattctatctagacagctagttacctatctatcaagaaggtgagtctatgaataataggatagaaatagccaagttctggggcaagtactcagaattggcaccctcttacctgaagccaaatcaggaaagagtagagctccaatttcacaagatgttcatccactatatgtaaaacctactctcatgtctctctgttgttgcttaaactgctttcttcaaccagagacctggtgatttcctctacagtgattcttttaaggctgcttctaaatacattgatataagaaccaggctccagtttgccttaatatcagtaatagtggaagcagtggcatttatcaagtgctcacgacgaactcttttcacatattatttcagctaatctttgcaacaaccgtccaaagttgttataactagccttgttttagagacgaaaaaaaaaatggcgactcagagaggtcaattagtttgcccagatttgtacacttggtaaatgcaagagcacaggctggacctgtagtctattcagctcccaaccctttgctatttcctttacacattgttacccctaaggaaattgaattacagagcccttgattgttagacaactgagttatctccgtgtttcagaattagaaagccaatcctgtctaattcattagtatatggtaatacagaacagtttagataagtgtgtcatttgttgacagtggccctcccttttcttgagaatcctcctctccggttcagtttttctttatgagtcagtggcagtgctaagatgatggccttacatgtgttcagcagggtcacaggaataagaaagactcatggtatattggtgagctacagagaattcatttgccgcaagttgaaatttggagagagatggccaaaatgactcaacatggttggctttccacatcaatgtaattgtgccatgtgctataatttatagtgtaaacaagtttcctgcaaaagctaaatatatcatgcaactcatttaacatgcacagaaggagccattaaattatttcagtcccgttactcaaaatgttcagaaaattcctctgtattagagccagtgcaggattggctctgcagccaagtgcatcaacataaatgttgaattctcagaaggaaatgcatgcctcatactgttacttagggaaaatatatgcccagacattgtggagccccttctaaaacaatcctcattttgttaaaacaatactatcaaattttcaatcaggttataaagcatctctgcatttataaagcttgcagacaattgtgaatatcaataaaaaggtgatgtgtttttaaaagattaataatttatgaaccatggaaatggaaactgaggctttttatgtcattttctaattttgtctacctacgtggagagaatgccttgtggaagccatatgtgatgccttaaaactgtttaaattggagtaattatcagaacaaatggtgtcattggatgatattagtctgtttgtgttccttctgtctacccaatgaatcaacattaatacatatttttaaaaacatttgaaacatggtcatctgtggtttcttttttgttttaaagtatatgtttaaaaattgatctaaccttccatacatactaaaatataccttagattgagagtttgcagttacatattccttatgcaaaaagggagtatccttctctacttagctgttaaagagtttgggtgagggatggatataaaattttgtcaagtatatttttggcctctattgaggtgatcatctggttttcatcattttatttgttgatgatgtgctttgttctacaaatagacatttcattatcaaaatgtttcagcactcctggaatgatactagattaatatttgatgatatatagttcagttgcattttaggtagatttgaattttcaagatttgaaaaagttgatatagtaatattaaaaaggttctcattattaaaaacatgatctacttctgtttctggcatgcaaaagctatttgtggcaaatatacagttattttccttctttcgatttttactttaacatgagaacacatttctctagtttgccttgtttccaaataaaatgacatctgatgtgtcaggataattcaagctcaactatcttgagccaataatcacagatgataaagattgggtgattcctacgtgctaggggtttgaagtgagatattgcatttaatagttatagcaattctataagacactcagaagttcaagggatttgatctgaggtgacacagatagtcagagtttgaacttgggtctatctgactgcagtgcaagctctattgctacactgagcttttcagtgcactcagtagccacacacaagtcaattagctttgcaaagtggaaagttactggtctctgaggactctgaatattggctagttcttatggatgtgtgtgcccttggacccaacatgttacatgatgagctctggctagcttagcatgcatgcatcaccccagcagagaaacaagtccattcgctattgttctgtttatggtaatgatactaccagcctttgttagaatttaaatgtggacagcacattcacaatgagaccttagtaaatgagagttatgttcagcaggtcaccaggatatgaaactcaggtcttgtaaggagtagttatcaacttacagggatgtctggtggtgtaggggagcacttttaccatggcaccctggagaacctgcaggtatccaaataggccacataagcagaggcttgaaccacagctaatctgagccttggtggaacatccattgatcctcccagaacaagagaggacaagaagattgtgagatgtactttaaggccatctcccactcacttccctatctcctttggaatgctatcatgagacagtttcccatcacctcccaggttctgttgaggagttttctgtcctgccctccactgaatagaactctagcctatacaactgctaagccaaagtctaaaattgactcctcagctacagtgtgtcctataacttggtcttcagtcatctggcctcttttggttggtatcctcctttttggtgtgtgggacaagagtcgggggtcagctggcacctttggcaattcttcttttattttatttcaagcctagtttagtaagtactaaactatctgtatctaaaagtggacctgcatctttattggttgaattagccaggccttggccttgaccttgccctgtcttctatgtgtgtgttaacaggaggtactcatactcatctgctggaatgctcacaggggtcctgggctacatgtgcccaagaaggtctatccagctctacagagttaaaatactgtcaatatgggttagaaagcaatctacctcttcccctaaaccagagtgtggagagtgattttgatgcagccaaaagagctgagcatacaaatcaggtgggatttttataaataactgagcaacaatgctgtcaacattttagttgggcctacattgtcagtcctgaatgttttgctaaaataatctgaaataaaatgtgaattctttatgcatcagcataagggaaatcctatttcctgtgtcaattcaggtagacaggccttcttgacaacctttctctggaaatgggtttgagaaatggtttaaagcactccaagctaaagtgttctgttatcagcagctgaaaatttgccatgcatcacataggactaagaattggtccttgcccccattgagtttaatgtaagacacaatggctgtcagcaggtatgagttgtagtgcacttaacagcgacttagtatttcagttgttttggacagcttccttagatagatattaatggaccaactccataaaggagttatttccttaatcatttgacaattaggagctgacgtgaagagatgagtaatgaagtaccctctgtgattgtactttggaggtagccacaggggttttttatatctaatctgctgtagttgctctaagaagctgaagggagactgagaggggcaattccaaaaggaattctgcctttcctcatcacttgagaatggaagctaaccagtgactgggtttgtctccaaagagaatgctgagtactagagacactcttctgcctgatagagaaagtcctcacttggcatctgagccttatcaaaatgaagagacatttgatagacaggcagcctagtgtgagggaaggctttgatgtctggtggaattcctgatttaaattcagtgttcttagacaaccttgaatgttaggatcatcagtgtccaaattcagttgactccaattctgaaatgtctctagaatctggtctccactatttttactgtctgtgccctgacccaggccaccaacctgtgttacctggagtactacgatggcagtctaactggtttccttgctgcctccttctttcagtcaatctatattctttacttcctgaaatctcaccggcaaataccaagcctcgtatatggtcttgaatgaattcctattcctccacttgaatgactttccatatcacccagtatgactcaaaggaaattctttcaagatgacttgtaccgccctaccaaagagcagaacatcagctatcagggtccatacttgaaattttttttaaagataaaagattctgtgttctcctttggaattatccccgcatttgttttcaggcccaggttgatctactgagttatggtcttctctggggaaattcactcttagatgttttaacacacacacttctaaaaaatgatacaagactgtttcgttgtgagtaacattttcttgaaagccatctgaattctattaggcactttgtcatttgcatgataacttgagttcccacattgggaggacattgtataacccagagaaatatactaagaaaatgaaaatcaaatccaaaatagtgacagtagagcagaaaattggtattgtgatgaatgtatgtgaccaattctaaggaattccaaggttgaagaggtgacagttgattgattcaagtcatatacgtcagggttcatactattagatttggcttgtgtatacaatatagacatagattcatatgtatcacatatgcacccagacaaaaggatagttactctactattctcctactgttgtttgagaactcagcactgtaggctgtcaggctatgtggcactttctgaatctctgagatacatattatttttattcccattgcatagaagagaaaactgaggttcagagagggtaggtaaattaagctcaagttctcttattaaatcctatgcaatatccatggagccacaaccatctccataaaatgaggaatcttaactagatgagttgtttttaagctttgttcctgcaaatccctgggagttaacaaaacaaactactttaatcttatttgaggtttcctgtaaggtttcatttggctacacaagaaaagattttttgagtttaagagtttgaaaatcattggcttaaagcaagggtcagcaaactctattttgataaagacctagatgataaatgttttaagccttcgtttggtagcaactactcaacctggccattgtagctcaaaagcagccgtggatgatatataatgaatgggagtggctgtagtccaataacactttatttatggataatgaaatctaagttccatataaatttttatgtgtcgtgaaatattattcttcttttgatttttttacacatttaaaaatgaaaaaaaaaaaactgttctaaaatcataagcagtacagagacagacggaaggctgctttgggctgaggccttcagttggccaatccctagactagatggcccctaagggaactcctagttctcacactaagaagcccaattaatcttatgaaatacctattttctgaaccccttggaaggccatcagctacagaagacaatctttatcaggcccacgtgcccatggcaggatgcatgtttagaccttgcctgtgggcacagtggttggcactgggctaggggtccacccctgatagatcttggagatttgttcctatagagtataatacagattttcaaactggttgtcactgccacagccctcagacagggattctgtaggattcccagtgaggtggtggccactgaatcaaagttttaagttaaaaccttaggaaaattaaatgtagctcctcctaaggggaaaaaacagcctgagcacctttactgcagggaagaagaatgaattccctgaaaaatatcacctcctcttccttatcacctgccttcctaccaacaaatgattcaatgctgtggagactacaaagcactagataggaaaatatataactctctgagtaattctaaaccagtcatgttttatttcttttaggttactttatgaagaggaagtgccctttaaggagtcaagagggctaagttactatcctagaagagggaccagagtaagactctgcctaatgagaacatgcaagccctctctaggctgtgttattatcctcaaagtcaattgtgtcattcatttgggccatcagaaacttactctgattgccatgaactctggggtatttagaaagacaatgataatttaaaccagtaaccggaagaccccaaactcactgggccagaagttatagctctatgttttagttaagagcttaaaacctgagtgtaataacctcctccctctcctatatgacagaggtagcaacactggttctgtctccaacatcattacaagtctagtctctgagtgtggactatagagagcaagactccagctgcaaggtagaaggtacaggaaagcacgtggcaactcctaactggcagatcattctcacaattaaaggtattgaacaatagaaaggtattgttagctacctatcagaaaaaaacatgtatgaccatatgttaggaatgttgcagttctctccactaggtgacacagtgacatggtgaaagagatagcactctcaagtacttccaactggaagagtacatctgagaatcagtcaccagcattgcagctagcaccatagataccttgaagctggaatctagccagtatcaagtgctgctgtctgccaagaggaacaccattttgtagttcacaaaaaggcactgtgtaggcttgcaagtcctgagaacaactcagtgtcccaacggttgtttctgagcaaggattctggatcaactaggagcctattatgcccagtcttacacgcaaacttcagagacagatgtgtgttggaacagcttcctgagagtgacaggcctaaagacacggtgctcaaggtgagcacaacttcaactggggggtcgcccttggttcatttctctggatcagcaggtagcttcccaggtataaaggtcagaacatcggggccactcatttttttctgaactctcacttggtacggtctggatgtttcctcttgcaactgtctttcaaatttctgggataacttaagcactccaagaagatctaagaaaacccaagacagatctgatggatttaggccatttctagaagagtaaaccaaagctccgaaactttccaaactcctttatagtctttgaacctctccttatttggtcatggtttccaatgatgtgtggggcctgattcctctgccagcctctaggttaacacatcagcttttaaaaattattattcccacctctacaacaaaattcctttgacaataataataacaatatcaatagtaaccaagatgaaagtgatagctggtagctgtattggctcctaggcaatttgtataaactttattttctaattctaaaaattgtccagagtaggtattattattgcccattttaacatatagaaaattgagattcaaaaggtcttatttactgtattaaaaaaaaatccgttaggaattcctgtatttgaactcaggtctgtttggctctcgagaccttgctcttaagtccatgctgactcaaccaagggcttcttcctgccagccttctataataatgtttcaagccctctatttttccctcttcaaaatcatctaagcattccactatgtaaattggcaaggttttgggagagtgatcttatgattttctggttatcattcacatgggacctgtcatgtcatagtgcactagaatgtttcagtgcaaagagcccttggaggccactaggttcagcttgaagctcagaaaatcaaggacaaagatcttcttttggtccattccatctcatccaaatttcactatctgagcttttataggatcatctcctcagggcaagaacttggttttttgttcacagttttatagattattctatgtctcaatactacaaattataggtcacagtaaaactaaaaacagcatttttacaccaagatgaacattgtggatgactagaccctgaacagacaacagacttcactaaggaggtctaattggttctgttttcacctaattgaaaagttgaagaacaatgtctgttttttttaagatcacacacacaggcatacatttatatgagcaatttttttcacattatgtgtcatgaatttgtctatggaattataacctcatgaaaagagattaccatttttctgctgagacgaccttaactgcattgggtgtgaatggtgctgctataataattaaatctaatatctttcataatcctacgctttccctagagtaatgttcagcattagccaaggatgaaaatgcaaacaagtacatgtatattcaataataaagcttaataggtcagggaagaagtggaatgaaatgaatgcctagttcctccagagataactaatagtaatttgcttcctagttacttctttgacttgtgtttactgggacttaaatgtatgcatcagattttcctttattaacagccaaatccataccaagcttgttgcatggtgggggtgtggggaggttgtttaatgtggatcgctgtgtagattggctgcctatttccagaactgtacattggagtgcatttcatctccatgttaaaaatcatataatgttgattggagagtaaaataactgctgagttcagacctctgtgctctgactctggttgtgctacttctacctgaaggagagaaaccggaagaccacaagcacatttctacatctggccttgagatgcccttagacatttcccaagtcatcatggattaccttcagattgttcagaaaattaaaaggagaggagcaaaggcacacagaaacttctgcttctgattactttttaatagtattaatgaagtccattatttccaactgagatagctttccaaattaatggtgccccgcattattagttttgtgctttcataatgcactttcacatgcattagctcctgttatgctcaccaccaccctcctgtgatggaaccaaagtgttatcccattgaacagatgagggacacagatgaacctcagagctggtaagttaccccagatatcggggtttatgattagccagcaattgagtcccagtatcttgactccatgctaatgttttctgaggtttttgttattgctgtcaattttattgaatataccatcttttataagttgtacactctaggaaaaccttgtatactcccaattctagctggagatgatctaggttccatgtttgcctccgtgatttctagctgtgtgttcacaagcaagctccttaacctgtctaaacctcagagtctccatctgaaaaatgcagctgtaacatcatctccttcatagaagtattgtgaggaccaaattccgtgctgctggtcaaatacttaggactttctctgtctctgaaaattgaccctctaaatgcaggaattatttaccatttcttttgctgaatacttgaatataaattaacacatagacattccctagatgtattgagatacacacacacacacacacacacacggaaagtaaagccatttataataacaagcataggtagtttgtaaatatttgagttctatagcttatgagaatgatacagtcttcatttcccacaatgtgttgtaaagaattatttgttcagagtcagaagtctgcaactgcaaaagaaataccaagatacattttttctccttctctaagatcttcaaaacatccattagtctcttgaaggacagtcataaatcctgcaaatttagtttatccgaaagccactctaacagttgtccttcccagcaatcatcctttatatcagtctttggtttgccgacctcagtgtacacattctagtgttatgtgactgagcatgaaagtgggggagctgtgctttttttggagagttattggatatccgctctgccctgactctcctttcaatatttgaacataacctctgaagtaactttccccctatttatcaaattagaagcttccttttcccttctggcttctcttctggaaaaacacccaagtgggattacagagatggaaattttaggagtggctccagcactaactattaatagctgggtgagcttcagcaaagcaattcacctctctgaatctttccttccttgtctgcaaaatgaggccagtagactctatcatttgtgggaagatgctgtgaagcacagtgaggtgaaaatgctgcaccctctgccctcatgggaattacggactagtggggagagattcagtggaaagctgtgctgtgatccagctggagctgagggttgggtagaggaaaaaaatattcttcctgagatgagagttctttctagaaagcttttgtacagaaagtgggatcactgggctacaaaggataaataggatttccagagttaagaaagagatttctagccctggagctgagcctgatgcagagcctagatgcaagaaagagcaatatatgcataggaaatggtcattggtccagagaggctgagactgtcccttcttgaagcctaaggatgaggtataaagttatatataataaataaaaatatgaacaccaataggtctttaaagacagtgtagctggaattttaagataataagctattcgtcctgctgtagctcacacttggagaggatgccactggaattaatatccctatagaaacaaaaggctttgtggctccataaacaatcttgaaagtgctagttcatcaccaaaatccagaccactcatttttcaggtgccttgccttaggagagaaagatttcttatccacatcatgggcttacatctctcagatcaaattttacaggaagagatcggtcatatatcagaaggttaatgactagccatttctctcccagctcttttgcggccacccagctacccagcagcagagggcactgaaaggcagtgcaggttcactgtgccttttacctccgtcatccagagagacccagcaggctttgacaacagcctccagagctagggatggttatcatgcccctcttctttaatgggaaactctgagcaccttgtcctgtagagatccagtgccacatcccacatacacagtgattgatcagtacatttattgcacttttagtagtaaaaatgtatagaatccagtcatctctggagatgctgaaatagtattttccccttgatttaggggaaggtagagagggaagatatgtgcaaatatgatataaatataagagctcaaatatctaattagctgaaacaatcttggttccctctacacctttgaaggatttgcagctgtcagattgtagctccaatactttattctcattgcaagatgtatccgaggatgatttagaaaatatgccttctaactcaaacaccactctgatctctttgtaggatgcttgaggatgacctgaagctgagcagtgatgaagatgaccttgagcctgtgaagaccttgaccactcagtgcactgccactgagctctaccaggttagaagagcttagggctttgttttgggatgaaggggggagcaggaggaactggaatggctttgacatgctttgacatgcgcaaacttccccatgctttatctctgggctttggagagagggaaagaagcaaagatgagcatagtgttctggaacaggtcaaatcagttcaaactttcattaaagctatagtaaggagatgcagagctctttaaaactgctttcaaccccctcccatctctctctctgttccatacacaaatgctggtcagtggtaagcaatagagattgtcttgccctctcttggactacttattgtcttgggtgaggtataattttcatttggtgactctggtgtgaggcttggaacccatactcattaatttagatataaatgtgatgcttcattcacctttcccagatgcaccatttcagaatgcagctgagaatcaatacgcaacatcttgccattaaatgaacctttaggcagaagacatttggcaaaaacttgtggctgcccttgtatccttctatcccacattttaagcatttacagtattttaccaccaaatgagatggcaggaatgtgtgttttcagcatttcaatgagactggactttatgatttgaaaaggccaagtatcatgtatgactcatgagaacggcaacctagtgtgtggtgtcaatgatgcttgcacattttctccttgagagagaactgtctcgaatgtggggtccttctgggtgtgcttatcacctcaagtgaggaatgcagaaggattgcctttctttaaatccagtacctgaccaagatcttcctacagtgaagtctgctacattataaaacagactgtttaaaggaatgctcatgcactcgtatttcaagagagttaacaaatatggaattccatgttcattgaacatttcatgaggaagagcctacaaagaaaagcttaggaaaaattatcaaggctcagctactctattctcatctacagctgtttaccacactagaactcctaccattctggtatactttaaaaatcaaatccatcttcaacgttatgtggccaaaacttttgtctactttactttctccactttcttgtgcttgaattttaataatatgtaaaaaataattgcatctttgcaagtttagtgctttatcaagaacaaccacagggtaagtgcagactacatagtgctggcctaagccaatttcacaactgttccccaagggcttgctgtacatttactggatgcaagctgtctccctcctgcttgagttgggcttcatagcaaatgtaaaatgtacacttcatttccaaaaattgtcatttctccttcacacatttaatacgccaatagcaggagcatcatatttgtaagtaaaacaaaagcaaaaatgaaaacattctagatcattgattttgacagataaaaagttgccttttaatggaaatgtttaaagtagaattcaataataattgaaagtagattttgcacattgacttcctctttatgtaattatatgaatgtaatctactttttaacttataaagttattttctgtatttatctcaaaattggcaaagggtctgttagcctgaatcatctgagttttagggtatattcactgactttttgtaagtgctgagactctcagatgatcaggattggtgggttggaacctttttatgacatgttgccgctagtcatgatgtcttcctcaaaaaggcttaggttctcagtgaaaatttgatggggagattgaactaggggctctaaggtgaggcaaaatgacaacttattccctctagctgagtcctaggagcaagatgtaggcacaaggttataaacatttgcaaatgaaccctccttgtagagtttgaagatgagttacaaggcctggaaggctatagaccaaaagagaatgcttgtgcagtagtggcagcagtaatactagcaatgtttgcagagctctgcttttaggatgcataatgtctttttgtaaaagtaaatgggttgaaataattttctttttttattgcggcaaaattcgcataacataaaattaaccattttaaagtgttcaattctgtgacacttaatacaatcacaagactgtgcatccatcccagttccagaatttttcatcactccaagtggaaactccatacccattaaacagttcctccccatttccccctccccctaaccccgacaactgctaatctactttttgtctgtatggatttgtctgtttcatgtaactggaatcctataatatgtgaccttttttgtctggcttctttcacttaccataatattttcttggttgttcgatgtcatgtatcagtacttcattttgttttatggctaagtagcattccattgtatgaataaaccacattttctttatctactcatcatttgatggacattttggttgtttccaacttttggctactgtgaatagtgctacggtgaagatttgtatataagtttcacatggacatgttttctttctggtgtgtacctagaagtggaattgatgagtcacatggtaattctacagttaacttatagaggaatcaccaaaatcattttgttttagataatatagtgccatgcatataacatagtactgttcactcatctttgaattgggacagtcatacctccagcaccatcataaggaggagtactgagactaccatttttggaaccactcttgctctatgccaggcacaagctaggtgtggtgtctcatttgaaccttacagcaaaccttagcagtaggtttgggcctcctggctgagcaaaagaattgcggagtcattccatttgtggcagaatgattggggagaaagcatacagacaaatgaattggtccataaaactgtgctcaagagcccagacaacactgctggtttcagctgacataatagttagaaatggctcagaacccagtggctgcattcgtgcagacatagtccaataaaaaagccatttactttctggagacgtccccaaatcatctcatccataatcatcacaccttgactcatttgaagaaactcaaattatccaggtgtagtgagtacacagcaatctttttcaaacagtatctaagagcttataatgtgggcttagagcataagcatccccaagagaatacatttcaaatacatgtatgaaaatgaaacacaggatcaagttgtgtcagcctctaaactggcatttgggtaccgagtatcttacaatcagaacagcctcccctttttctgctacttctaccttccacagcagtgttagccatgctgagccaggtgacaggtcatgtgcacaaacacaagcagagcaagtagggtatgtttaaatgctaaatattattccctcaaatgggaaaatggaacatgagtccagaatgggggaattataatatataaattaaagatgccaaatggtcagccatagagactcatgatcataagaaaacatttttaacagaagattttaccttcaaatgactctttaaagtcagagatatgtaatcacacatgtacatggcttcaatgaagacacgatagtgattgcagcctgaaaatacctgttaaaactttgtgttttctctccagtcctctactgcatttgactttcttggttgggactatttgggcagcagacatatgcatgctgttttctaaggtggtgggacaatgctgggacagtgtaggagagcgtgtgagagtatagctgtatagttacacggacatggctttgaattctagctctgccactctgaaactggttgaccttgggcaaagacctaagtacctataaaatagaggtaaaaatagcaccttcttcattgggtcatactggggattcaatgattaggtcaatcaatacaggcaaaagcacctgatgctatgcttagcacatagtaagtactcaccactttacgtgataataatcatcattgttatgggtgctactaatgatctaaaaagcttcacattctttgagatgctacatatatttactttcccttttcttgtaaggaatgggatgttaaagacagctgctgggttttctatcctgtatatggcaaacttgaatgaaaatgtctgtcatcctaaagtttattagctgtgtgcctggccatgagtaattttaaatgtagatattaagaacatagtttttggaataaagaagcctggggtttaatcccaggcctcaaatactagctgtatactagctgtatggcattgggaaagttgtttaacatctctaagtctcagatctcttaccagtagactggaataaaccagccttgtctaactcatggagtactgtaaggatcaagtgaagacagtgtataagaaaatgccttgaactacaaaataggtggttactcttccttgtggtccttttaaacattaactggcagccctctctttaggatccatagggaaatagacatagcccttcattttggcctaggtatccatagggatctgttaggaactgcattgcatgtcttaactggcccccaaaggcagccatcagatatgaatgaccttaactttcctttaagccctgacaacttttaaactagagatcccagaaagaaaggctaggttgccaatgatctgcaccaagtcctccaggaaattatgtgtctccaaaagagtttttcttccaaggattggcgtgggtggagagttgattcatacccttctattgcagttcttaccttctctttctgagctcatgctgtcccctagagaaaggcttgaaggctcttctaggatgctatactcaccttggctgtctctcaggagctgtccctgaatgggagataaataactatttgaagttgacattagacattgcaaacatccagaacagtgttggaattagacatagtgctatgtacttagtgtctgaataaacatatgtgctgcaatgtattttttaagtttgatatcaatggcatggttgagatttgggggccacatgatgtctattacctggctgactgcattttttgcttctcagctgccactgttggcatcatagatataaaatccagccctggccttccccatgaaacacttattgaatttccattttcaagccagtcctccagggtaggcagagatggccactggggtttggctagggagtggcctgacccaggaggacagacgttttgggagtgggaatatgttatgttctctgtatgccctgcctcataccactaaacctctggtttttctttttgtcagtttttcttttcatttttctcggggttaaaggaacccctgaaaatcaggagttaaacctggaatcaattttcatttacagctgagaagcagttattgatgctatgcttgcagttcaataaaagatctaaagatatagaccttgtgcttctctttcaatataagcagcctaatcagtctcaaaggtttttttaacaaagaaattgtatggacaggtttattaaaattgctgtctttaaagttttaaactatccgcaatttgacttattccaaaggcttctagaatgtgtggcgggcaaactccaaagctccctccagcacatgttcttagagccaggtaaacatctgcttaatgtctaattgagtgatattatgatgtctgatttccacagccctaaacatgtagtctggtgtccacaggtagcgggatggcttgtgatgcctgggttctgaagcctagttagatctggccatggctgtctcatgccccagttagctcacattggcattagaagcagcagactttagaaatctaaaagccataaaagagatgggtcttgttagaaacttcctttagggcattataacattagtaacatcttattaatatgaattagattgaaatattagatgacttcatttagcacagttagaagttcagaaaacatttgatatgactgaaaatgttcaattagtgaccaggttcactaaaagaccctacttaaagcttggagtagtatgctagtgctttaaaaacagaactgaaccattaaaattttctttgaacacaaaacattctaatgtgttgtgtctgggcatgtgattgtgagtagctccagtgtacccaattttatttaaccccatcttatttctttttctgccaaagaagtatgctggtattctgtgaaatgttcacttaattgaaagcatattaattactggagatgtatggactttccaactagacactagtagcagagtcgcaccttaagcatatgagcatttacagaaaacaataatcttcttagatcttcccctccacttcatagttttgttttttctttttttaaatcttcagattactaattaccgaacacaaaaaagttgcttttaatccagtttctttaatccaggtcttatatttgatccattttgatttgtttgttgtttggtggtggtcatggtcatggttgttgttcttgttgagcgagcttactggcctggttgctatttgagaatttcaaatgaaataattacatagccaccgaagacccaaacattctgtcagctttgggatgtgttcctgatacctgtgatgcacgctgaactttcagaacctagtagccacattaaattgaaagcccgcatttatattttaagtttgctaatgaaaaagatgcaatgaattttactcctgctatcagctggctcttttgaagttggtgtgctgtatagaatacattagttgtgacaacagatactcttccctgctgtaatcggtcctattttgtagccacagttctccctcgtcatactgaacaagttgttacctccccaaggtttctctgcatttctatttactttgttatcagcagaaaggctggggaaagcctcttcagtaatgacatcgatacgacacacacagcaagagaggtcagcctgtcagagctctagaaacagcagatggattaggatgaaactgggtgcaaaataactttgatagagtcttttaatgtaaacagtttatctgtcattgcctttcattgaaatccctcacagaatgatagcatttgggccgttaaggttacagaatgtagctgaataaaacccatacattgtcatgctcaaactctccaccaattagagaatgagaggacattttaatttattcattaaagacaggagagtaaataggataacatataaggttaatagaataacattggccttcatattcccaagattgtatttcccatttggctatattagcacagagactagattaataagaaactgcttagggcttgtatgatgtggtttttaatatgcttgagacaagtctgtgactgtttagaaacctgtgtgctgaatttttttattacaattaggtcttctccttcagtaccaatttttttgacttgtaatctatatacaatagaatgctttgagcatacagagatgcatagaagtgtaatgtttttatgtattgtgcttatctcatggtcagtaatgaccaaatactggctagtgtttaataaactttatgaattatccaactatgagcatttcagttgcaaagccaatagctcttttgcttagcttagcacttttccacaatgaccttaagtcagacactggtgagggtatgttgtttgccccaagatccaaacagaaacaaaaatggatatgatctgtcatttcaaaatagataatgctcatatgtgacagggatgaccacagccttttcacccacaaagagcacacagcacatatatggttctgtaaagagtgtggcagtgagagagcagccacctctggaaagctggggaccactaagtacagacttcagttgaagtgcctggagaaaagagtcctcatcatgttgccctttctgggctggaggaagtgactggacatcactggtcctttcttcactcaaaccccaccctctgtttggtccaagcacattcttttccttaagtctcttcatcatcccaattagggtcctaatccattcttgcagcctggaagtttcactctggagtcatccataagtaagtcccaggaaatgcaccatgtgtgcctaacttcattggtagtttccaagccttgagtttaatcagggttctagaatatacctagaacagtatgcacatctcaagcaaaagttatataatgaaacactttgccactttgaaaaagtaagattttgaaatttatattctgtcttgaacaatttactggggctttggtttagggctcaagaatgcttaactctaccccctcccccccagatatctgccatctgctaaaaaagtcaccaggcaggctgaaaacaccaaggaccttgttctgcctggaaaactgaattgatattttcttaagcagctatatttacttttatctttatttatcaagagcaaagagcataagcattgtaagtgcacagaagagtttccaaatttgagattaaccaatccaacattaaccattcaaaatacaggtggatgggcggaaaaaagaaacaaaactttccaaaatgtatggggccacataactcgtatttcacacagcaaaaatttcataggagtctttggaacattttactaaaaatgtataaacttgctaaagctagtttattgttaatggaggtcgactaaagcttcatatttaaccctgaatcatatatatgtgtgtgtttctcaaaaaactaaaaatagaactactatatgacccaacaatctcactactgggtagttttccaaagtaaagaaaatcagtatattaaaggaatacttgcaccaccatgtttattgctgcacaagtcacaatagctaagatatggaatcaatctaaatgttcatcaacagacaaatggttaaaatgtgagatagatagatatatatatatatacacaaaattgattactatttagccataaaagagtataaaatcctgtcatttctggcaacattgctgcaaaagcaagtagggctttagttcttccccctcctgtggagtctgcagtccggattcatgcccttccccaagttctggccaggagatttctcaatgggttcaaattgttacaaagttcagctggaggtttccttctccctgtagccttttccgagtgcctctagcagccctcctaaaggacctctgtgaggcaaagctgaaattgcttactgggggggccagcaagcccacagggcttttcccactgcttcctctacccctgtattttgctagcaggggtattgtgcttacaataaaaatggctacatttttattgtagggatacagggaaccaagttacaattggcaacattaaattcacacagacaatgagggaaagagagtaaaagtgtacagtccaagtgtgttaatacccatgtaattttatttgaatattgacataagtgacacccacccaccaccttaaacacacacatataaatgaagtctgcaataacatccttttgtcttattgacaacaagtatggccatgctactatatgactgtatttgtgatgttctggctgtgaacagtgtactctgtgagtgagtgagtgtgtgtgtgtgtgtgtgtgtgtaagagagggagggggaggggagagagagagagagatacagagataccgaaacaaatagaaattctgtgcattactgattggcacaccactgccctcacctatggatgtgtctgttccaatcccatatgctctgttgtgttcctctgtgaagagtagtgcagtggtacttgtgataattcctcagaaaagtggaagaacctggcctcttatatcctcattttccctcttcttctcccctctgtatcttctcacctctcctgcccaaccattcttacctctctaatatttcttctcccagccctcacttggagcagaatcacagcatgagctcaggttcttaaagacagcgattaggttcaccttcaagcctctgagccacgagcctgcctggtaaagtggagaaaactttatagtgagtgagagcatccctatgaccaggcatgtcccagaatccccaagcctagccttcagaatcctctgggcataaacatggactcgagggtcattaagtcttagtaagtctttattcctctttactgcatctgcagagaaacaacgtgctagatacaactccttagctcaggggagcagatgtgttatgaaatgaggggaagggcactatcctgaagagggaggaatctgtttgggggatgatattaattcagcttccctcgggagccatgaaaacattgattttgtaccattaagtcttcacagtgtgaccatgaaactgttctcagcaacttttctgttttaatatatttgtgtaaatcctgacgtagtttcacaactgttacaattgaggcttcaaaagatgaaggagaagacatctaaaatagacacattagactctgtggcacaactctgtttattggcagtgtgcatgcctgcagataatggcagcaactatcttccaacccagcaagattctccttctcagtctataactaatggtgaacagatacagtatttggagagaggtttgcatgtgtttcagctcttttggcagaaagtgaagaaaattccacattttttttctgataaaacatattatattgtcccttccagccagagcagaagtagtgtttcctgagaggctcccttcctgaatgatgatagggtggacctgatagtactaccaggacatgctacagagcctggttttcctgactagagttaaaaatagactgagggaaaatttagtacattagacaattagatggtattttttgcctcctagttcagactattttgagttgttagcacagaaatagtaatgctgtctgtggtccaagagacattctgctttgatctgccatgttctcgtgttcattacttctcttttgattaatgagaaagtaactccctagcttcctgtttctccctcattgtgtccatcttccttattgtatccacatttatcttcccacatcaagtctgactctatccagtttctgcttaaaattccttcccttgaaccctacattctccattgcatactacagactttatgtaataaagggcaaacaccattgttgccaaggacattgttgccaagtccttcactcaatattcaatcacacatatatatgattcagggctaaatatgaagccttagtccactatatatatatatatatatatatatatatatatatatatatatatatatatatatatatgaaaaatatatatatccatatgtgtgtatatatataaatacatatatatatccatatgtatataatccttttagatatatgtgaaatactcctgtgtgtgtattaaaatatagaataccagaccttaaaatgaccatagagagtttttactctagctttctaattttctcaataaggaaactgagatacaaagcagtcagttagtatttagtatataaataaaaatgtagtctcattacccacagtataatgtgttccaaagggataggaagccttatcacactagcaggttaatgataaagatattttatcagtatttcctgccaattaggtttttgaatatgtaactgagtacctactatgtactaataatacacttcccatttcttctggttacgaatggtagggagaaaacctctattaggcattgattgtctctcactaaaagatacatgtcattttatgaggtgtgcccccttagcatcaggggcaagagggctcagattggttagggggaagaaaattgaattttcaaacccacaaaccccaggggaacagagtgaccaagtgccacttacattgggcctcctgacttggaaaaaataaacacctcaatgcaatactgaagtgcttggctggcatctgcatatttactccacttagagaatgattagtgtcaacagatgactttgtgggtgaaacatgcttcttcaccaaagacagtacatttttcattaagttacaataaaccaaaccttagttataaaggaaatttccaattgacaaatggatcttgccaaaggattttctatccagcaacatagccagagtgaagggagcaagtctttatggagtgcaggcacttctgaatgctgttatcacgtcatctttgggctggatgctcacaaaactctggcttccatggtagtgaaatgcacatgcaggtacaagtagtacctgctattcagtggctgttcaactggctgtggcagggtctagaatggcagtgtgagtgaaattgatatttactcaatgagcaatgggaagccatgaaggattatgacaatgagagcaatgtgatcaaagtggagccttaggaggattcatcttgaagtagaacataaaatagatttagaatagggagaccagtagagaagtgaggtggcagtggccatagtcctggtgagaggcaatagaaatcaagttagcagtagttgcaggaagagtgaggaaggcacaggtagctacaagccttcttccagaaagtgggatgggaaattcaccctgtgaatgctgctccagactccctcctcttcggagtgtaaacaagagccttacattcagttgcaggatgaattgagatgcacatcagcctggagctcagctcttcctccagaggcttattttttccctccatacagagcttactgtcctctggcacattttcatgcccagagcataatgtccaggcctatgagtttgcctagtcattcttgattcatttatctcatcaatgtttaagtgactattaagtgcaagacatagttctatccactgagaacaaattttccccaacctctgcctgtcaaaagtatgttcctgcctctgttacgtatagcaaagacctatttcattgattattagaaaagaatgaataaagttaaaatgtggaaagcccagtgatctaaagataggtaacatgtttttgcttcctagaggttcaaggttcaaatacagaatgtttccatgcacgttttcaggcatccataataatggttagtgttttcctgaagattataatccccgtatgacaagtcagaaattcaggcatccaggtgttgcaaaatcttgagtgacattttgtcctcttaatctgccacccttggctgtgtgtgcttaatgccagctggggtttagcctacaggatacattgtcttttgccattttactcattccagtgaaatctatttaaatgctgtaattaagcgattcatttttatatttaagcaagtgctgtcagtatatgtctcttcaattgttttagccaattctgttggtattgattttaggccatctgaataccctaatgatgagttcatttgttaatggaagagtttctcttctgaacttaagcaatcgatgcaatttaccaatacatgctgctaggttagggtatagctgtgccccacagaacaatcatgtgaaaaaaaattaaatccaaaacaaaacaaagaaacacaaaaccaatgcaattaattgtttttctgtctttttccatgttgttgaatacccagttatttgaaattatctgaatgattggattttcccttttgattaagaaatgtaaaaacccagtttggatgtatctgctagtagaatgaaaggaaaatgcatatgaaatggaaatgtaaaaggcatatagagcaatactaataaaatcacattttatgcttgactgacagtattattattgattatggaagaaatgaatacctgagtccactgccacaatatctctaggccatccaaatgttcactttgacagtctcaacatacaggaaacatattgcattagatttgttttctgtaaaaggagggggataatgtcataagtctgactgttcagagcatgcttcttataacccccaaaagattctcacattttctataaatatatatatatataacccccaaaagattctctacattttctataaatatgtatttttagtccaatagacatgtctatttatacatgtctattggactagaatagcaattaattgagtataatctctgagacagaattaccttgctaaagaattttgaagaagtgttatcattataaagaaaatggctggcaagttttctaagcaccttttatgtcatattttatccttaaggaaatgtgataccatgtatgccacgtggatgggactcaagagacagcaactgtctttccttccttccttctttctttctacctatttttttgtaatagtgctatatgatatggtttatgtaattcaacatggttcctgggttacttgagctttagtgcagcacaaggattctctatataaaagaaagacaagcttcttattttcaggaacataggtttagcgagtgagcaaatctgagcctgtctgtagccacatcatccctccaaaggaaataaatgtgctgataatgagagaggagtcacctcagaaatgctccttggaatcagagaagttccttcttccttgcatttaatttctcaagataccccatgacagaggtggcccatgtagaataggagcttcagggcttccccatcctcagggtccaatgttaataaaaaagtaaagagcccatctgatggagtgaagtgtggaaggaggggctactaaaggagagatcaactggaaaatatggaatcatcctaggcttccttggaaacacagagaaagagagagaaaagagagaaagaaaagtagagagaaagagaggtctgtagaatctaaacatatcaaagtcttctgtgaatagcactttccagacagaagcattctattcactccagaaccactactgatatggagagtagaagatagtggttcctataatcctcattggaataactacgtaggtttcataccacaatgtggcctctactcagtaagcccatagactatctggctgtaaaaatctatgcatgaacaactgtgtagaaagcagtcacaatcaaggtgcactgcatttgcatatcatgttgcagcttccagagcactgttgtcaatgttggctactcacaaccaccgttgctgtagaaaaggcaggaattattatcttcatttttaaaatgaagaaactgatgctcaaaggtgtttagtacttgccaatagggtaagtggcaaatctgggactagaacccaggtttttaacatttctggcacagcactctctccactctagcctattacctctcatcacaccatactggagtacattctctaacattttaatttcttttattgtttttttcttatactagagcttcctcaattgtgagataaatatcatgatagggaaccatggcacaaaataaggagaatataggtttttaaaagcatatagacgttataaattaaagcagcataactgttaactctccagcctccattttccaatcagtttaaattactttaatgtatgtttttaaatttaaaattagctgcaatcccaatatgtaactgtcttgatgtttggtgaattgtgctatgtcacttccttttaattttcctccttttgcagtgtgtctcacattctggcaagtgtatctggaacttgggatggtcttcttatgtcccatcatttcaaaagagaaattctctctttgtgtatcttgtagaataattcacatatcatttgcacataaataattcacttaaaattttttcctcaaagtctcttaatgtaataattcctcatagcatacctaaaacaacatcaaattacagtgaaagcatagtaacacattgcgagctttttctcatatggcaaggttctctgccatcatttactctaccatcatttacttgccatcatttacttgagagattcaaggtgatgagcacacaagaggatgacatgaggacatctgactagagctgttgggacatcagaatgatcacaagttaatttccaaagaaaagagaacctctcagcatagacattttcaatcaatagccaggcaacccagaaaaaataatttgaaggaagttattttcctatgttggctctataaaaagatgtatgtttcaaagaaactggcctcaaacatgatcacgttcctcctgatcagagaaaaataactgggtctaattgacagttccaaagcatagagcagagagggtattttcaaaaaacatgcctccgaatcaaagggaggataagcaatgtcactttgatttttccctcttcctgtctcctgccagtggcaagctcatcctatcacatccagcatgctttaaaaggaaaccacttgaacacagcacccattactttgtgataacctaagtcttctagaacagacttatctggattctaagggattgaaaaaagtggattcacatgatttccacagtgacatgtcttcagcctactagtatatcttattgcaaaccagccaggcttgggagagaaaagggttttttaaaaaaaaggcagatgtgagtgtgcatgtatgtacagactgggtcctgctgctgtaggaaagctgcatggcagtccccacttcttgccagcaccacttctccctttgttcttctgacatgggagaatctgcaggatgagtgaggttcacatcctctgtacatggactgcaaatggacagcaaatggacaagttttcatgtccaagatacatgtgacagatgagttgggccagccagacacatatttcttgttttctcattttcacctcttacctcattccttagcttttttcctattctagcacttgccaaaattcaacctcaggcacagatggtgagaaaatgatttttgcctaccaagccaaagaaagtgcccaaatattaatggttatttatctagaaacagaacctgagacttagtaaatggaagcatggatttccagcactaacatctaaaatttggaagtgttttattcagttgttatgcatagaggtcttcagtatgttgaatatcacttgtcaccgagaatgtcaagtccagagttagattatatgttgtctctgctaaaagtggttgcctctgtattctaatttacagcagtattctcttctctgtagcccttacccacctccaagattcacaaagatccccaaacagatacttttttaaaggatctgaacaaccctgaggttgtcaaatagctgcttcaatgctctttttatcaaacttaacgtctatagcctgaaaaagtctatgggagtacaagtttggttctgattacataattatgctacagaaatatgaaaaaaaaatcatcactaaaaccctccaggtgcttaaacagtttgatagactgtagccattctgccatcagcacccccagctgtgttgcttagcaacattttaattccagaagaatcgaaggagatgaaatccctgtggagaaggaaacagaaataagagggctgttgacagatgatctgagttgtttcttctaatatactgtgaagatcactagctcttttcatgaatgataaatggactgtacacagatcaatgggttcagcactaaactggaaccgggctccatgtctaaggcaatgcaggccgagaggcccagagatttcctcatttctatgatttggtgtatattttcttaaaggttccacaggaggaaattgatctgagtattcagtcattccttgcccttctgtggtgtcggctaataaaaatgattttagaaagggacactcgactttctatcatggtggaagtatggccagatgtcagtagtagtgctagggtgagcagttccctaccacaaatctaaaaatccaggatatgcccatgaccattccgtctgcatctgtttccctaacctgtcgttacaacccaagcaggtccaaacacggtaagattagagtgaaaggtgggaagagagggaccctagttatgcacccagaagtccacttttatggtccctgatgaactttctaggcagccctcacaatatccacctcacaatttccacctgtattggaaagctgcacttggacaggtaaccatgtttcccaggagaagaaaattgctttctgagtctccagtctgcttatctacagcaccctgtttcggttagctccttatgtttctgaagagcattttatattgcttattgttttggtagctagttgcaatgattatgcctgctaatattgtctaattgcattttttcttctgtttacaggctgttgaaaaggcaaaacctaggaataatcctgtgaagtaagttattatttttattagttgcaaatgttaattttaacggactcgatgcatgtgaaaaaataaggtcataaaagagaccttggattttgagttaatctctattcatgacaatttaaagacaaaaacaaaacaagccaaaaaaatcctccaatgagcagggaccagcttatatttttccctgtgctcctgatgaagaaatgccccaagttgtacccagtttacataaattaatatgtgcaatccatgaatagctgccaaatacgattataatcatattcaatacatagtacttcaagcctttgggttttgcacatgctaaaaagattacatttttaattgcaaaccttggacctatgacagagacataaatgactgaaagtgtgccaagtgatttccagccacgtggggaggtttggcaccttggcatcaaggcctcaatactctgttaatgaaaagctcataaaatatacttaactaaaggcttttcttttttgttttagctaacagaaagcaattcccaaggcattttatgagatactcttaaatcataaacaagctacacagacctcctttaaatatagtacatcttagacatcctgtctcttccagaagggagactttcaaattaagaaggatggctgtcttgtcatttggtttgtaacatctgattgcagtgttacaatgcatgctagtcctgccagctctgtggctgagggaggactttctctatttgctgggctattataggtctggtaatatcacatctcgaggaactatgtgttaatttattttggctgacttcctttatagttggtaccaaatacagaaatggagagtacatagatttttaagtttctgggagaatggatcagctaatgccaacaagaaatgtttttgttttgtataataaaataactaaatttccagagcaccagggtagcatttagcataccattaaatccaagccctagtacgtttttccaaaaggtgttgtgtactttgcttttaagtttcatttttcttaggccaaagaatattccctatcaggctctgtaacatctagaggggcatccgtagtctggagatatattatgttgtagtcttatggaagtatttgtagtagctgaggttttgtcaggtcgtgcagttgggggttgaaatcttctctgcagcctgatttcttttccgtctgaatgccctaaaggctcctccactgtgagcctgtggctggcaagctcggagaattagaggatggtgctaatgaggccagggtcagggcttttgtccctgggtgggcgattagtgatcttctttcctgcagttcaactgcactcctcccttcagtccgcctgcatgcagatgtgtgccccaggtcataaggagtggggctagggctggaggaatgtaaatcaaggccctcaatggcaaatgtctccaagctccagccctcccaataggaagtgattcccaagttgcatttttgcatgcatggaatagcccattggcagtgtttggggttgcatttaattctattctaatggcctagaagcaggacctgttttctctttgctccttgtgagaatttgaccctacagtaattgtatttttatgagttcttattaattcacagtgcacactctatctaatgtctagcgttttgaggaatgttataaaaagaaggaacagaaactagaagagtcaaaggattattgagctttgtgctttaaatatatttgaaaatctgcttagtaataaacctaagtcataaccaactggtaggtgtttagaattgtcttctaattaagtaagatactgttctcagaatgagtttgggttcatgataccaaactcagcacttgaagaaggagacttcctcaagacctcagctcagaaacaaaaactccacagcagggttcagttgctctgcctgacaggagaacagagtcaaagtttttaaaaagttttatacatagtggtccttttgccatttctgatgacatcaaaggcatccctcttgaggaaatctcaactgcacaaccctactatgcccccagttcagcaggaagcagttagagcagttgttggccaacctccccaacagcacttgggttttcccattgagagggggactgagagacaggactagctggatttcccaggccgactaagaattcctaagcctagctggggaaggtgaccacaccctcctttaaacacagagcttgtaactcagctcacacccgaccaatcaggtagtaaagagagctcactaaaataccaattaggctaaaaacaggaggtaaagaaataatcaaatcatctatcgcctgagagcacagggggagggacaatgatcgggatataaacccaggcatttgagccagatcaggtaaccctctttgggtcccctcacactgtatgggagctctgttttcactctattaaatcttgcaactgcacactcttctggtccatgtttgttccggctcaagctgagcttttgctcgccgtccaccactgctgaatgccgccattgcagacctgcccttgacttccacccctccggatccggcagagtgtccgctgcactcctgatccagcgaggcacccattgccactcccgatcaggctaaaggcttgccattgttcctgcacagctaagtgcctgggttcatcctaatcaggctgaacactggtcgctgggttccacggttctcttccatgactcacagcttctaatagagctataacactcaccacatggcccaaggttccattcgttggaatccatgaggccaagaaccccaggtcagagaataaaaggcccgccccatcttgggagtggccaccaccatcttgggagcttgaagaacaaagatccccccggtaacactagagaatttcagttacacacaatgcactggaactccaaatagagtaaaggttcaatacaagtttacggaatgaataagtaaacaaattggacatatcccagaaaacagggattcttccaggaaaataggtttcttccaggaacctagcctgcaggcttgataaggctggtggctctcttctagtagagtgtcaccatcatgttaaaagaacatgtgtattgtaactaaccaagtggtccagtcctgtcgggcgaaattcacccctgatatttcacgtaggttcttttctgttttccctaagtgtcagctggtctgagacataaagggaaagagtacaaaagagagaagttttaaagctgggtgtccgggggggacatcacatgtcaacaggttctgtgatgccccccaagccgcaaaaccagcaagtttttattagtgattttcaaaaggggagggagtgtacgaatagagtgtgggtgacagagatcacatgcttcacaaggtaatagaatatcacaaggcaaatggaggcagggcgagatcacaggaccacaggaccggggcaaaattaaaattgctaatgaagtttcgggcacgcattgtcattgataacatcttatcaggagacagggtttgagagcagacaaccagtctgaccaaaatttattaggcgggaatttcctcgtcctaataagcctgggagcgctatgggagactgggccttatttcatcccacagctgcaaccgtaaaagatagccacccccaaagcgaccatttcagaggcctcccctcaaggacgcattctctttctcggggatgtcccttgctgagaaaaagaattcagcaatatttctcccatttgcttttgaaagaagagaaatatggctctgttccgcccggctcaccagcggtcagagtttaaggttatctctcttgttccctgaacattgctattatcctgttcttttttcaaggtgcccagatttcatattgttcaaacacacatgctctacaaacaatttgtgcagttaaggcaatcattacagggtcctgaggcgacatacatcctcctcagctttcgaagatgatgggattaagagattaaagtaaagacaggcataggaaatcataagggtattgattggggaagtgataagtgtccatgaagtcttcacaatttatattcagagattgcagtaaagacaggcgtaagaaattataaaagtattaatttggggaacaaataaatgtccatgaaatcttcacaatttatgttcttctaccatggcttcggccggtccctccattcggggtccctgacttcccgcaacacagtccctgttattcttgactcatgccacatgtaaaaatgttcctccattgctctggttctttctagctgttctttttctgaccagttccttgtttgatctcatatcaagaaataacatttgattgtctttttgagcatacaatgaaaattgtgtacagttttactggaaaacagaggcccagcggcatcatttacaactcaagtatgaacacaaattggtaaatatgaacatgtgtgtggtttcatatagccctttggtgtagaatttggcaaatggttgaaaaaaataaaaagaagaacatttcttgacatgtgaaaattatatgaaattcaaatttcagtaagcataaataaagttttattggaacacagccacactcattcatttccatattgtctgtggctgcttttgtgctacaatggcagagttgagtagttgtgacataaaatgtatgtagcctacaaagctgtacatttttaccatctggccccttatagaaagtttgtggactcctgctctagttggtgaggcagaaaaaagcattaagcttttttgtgatgctgaaggttaaactatcaatcctttctcctttggcctttaaaacagtgagttttaatgagcccttattgtgtgtttaggactttctagggttgatgtgccacttaattctcattcagagcaaacagattcgctcttcactcactacctttgaaaatcatatggatatgagatccattgacagggcattgatgcctcagaaacaaatgaacacatagaacacatatctagggcatactgctagccttccaaattgtgtgtagatggatttattgcaaagggcatattaattttctaaaattctgtcacttccacatctaactaaggctaaattagctttcagttatggtgctggtaaataaacttattagtgtatggctaataagtttctaaaagttttgcctccctcccctatttcttaaccactctttcaatttatttttaatactttcatggttgtaagctgcttctttcattgccatagggagactgtgatatacagtaattatgctccatataaaaaagaaattaagtatatgcctagtgaatgtaagcacataatgtacctggatacactaatgccatttccttgaaacattaaatattacctctgagggtaagactcaaacatgagtgttcttaagatcactgatcaggacaagggaaacctggtctatttctcactatactggaaccatactgttatcagagcttgattagtatgttcaaattatggctctttaatgtgtcagaaagactttcacttgtattttaatgctctgcagcagtcatctccaagatttcattgtgacagcaaggcctgagagatgtacagatttctttcaccatatgtgacttatcacatacatttttttcaaaaacacatttctgttattaagacatatgtgatagtacatttctgaaaatgtgaattgcttttggctaaaagccatgcactaataagttgagttgaatctaaccaaggttgacatctgttaccaaaagagagagagaaagaaacagagagagagagagagcatgcacacactgttgtcaagcataaaattcttccctgcttttacactttaacaacattaaacaatgtgatgattgtctttcacaattcaggatcagaatccactctgcgtaggaaattacgtttttttaggacctgattcatcatagatatggtgctttcattagtgaaaatgacaaatagccacaaaaattttcctgactatgatatttgcacattattcatttattcatctgatgaatatttatttaggttctacaacattctgggaactgtgataggtgctgaggaaattaaaagtaaatctgacacaggtcctacccttgaggagtttagagtctagcagaaaagataaaatcggtttgtaaaaaattaaatacaagatatatggggagagaaatgtttgttaagtggggaacagataaagtacagggaggctctaagaacaaaaaatgcttctagttaacactgtcaaagatggaagggacaatgggggaggagaaaacatttgcaccaggattttaaggactgctggtttgcgacactggtgctgaggtatggcaagggaaagcaaggagcccaggatgcctgatggggtgcaggcagtgaaataccaggttggaaaccaaggctgagtagaaatggtagcttagggccctcagagctcacccagatgaaagagattcacatggtagagtcaaatggcattaaagagctcttcacttggtactaaatgtgaattatccatcagtcccctaattattaaacacaaagggttgatagacctgggttctagtcttgaatctgatattagtttgtagtatgaaattgcatgcgtcaactccttgttataggcctcagctagattatttacatggacattccacttctttaaaaaagtcaaagcctggaaatctgttttatgattatactcattttagaacaatattaaccctgttagttcgatgtagattcatgcatgcacataaattatatatatatatatatatgtgtatgtgtgtgtgtgtgtgtttatgtgtgtataatgcatctgtatttaactccacacacacacgtgcacacacataatgcctttccccaccatttttaccttttacatttgtggaataaaggacaagaagacacatcattagagtttaaaaaagatatcttaggtagaaaataagtgtggctccaaagacacttggtaaagcctttgaaatggcccccgaggaccaaaggtaattttgcatttggagtccatatctcttgtgatgttcttgtatacatgcacatcacagacatgcagaatgtcagtcagttaagtcaccattctgaataaggcagtggaatctgatttgtgttctgccagacaagttttgtgggattttctccttgagaataaaaggctccagcaccaagaagttttggcatcttctatcatatcccttccctggagcatcactgtgcacattcacataatgtaggctcaaagaaggagttctgtttagctttgtcttacctaaggattcccaaatgtgtttgaccagaggatatctttgtctggcagggcaaatgtttcatgaaacacaaaatcgagtgttgttgctaacaataaagtggcttcattccatttaaaaatctttaattccacatttgttggcaaggtcacagagaaaagggacacttgtacaccgctggtgggagtgtaaattagttcagccgttgtggatagtaatgtggcaaatcctcaaagaacttaaaacagaattactattcggcccaacaatcccatttttggatatgtacccaaaggaatataaatcattctaccgtagagatatatgcacgtgtatgttcattgcagcactattgacaatagcaaatacatggaatcaacctaaatccccatccatggaagactgggtaaagaaaatatggtgtatatacaccgtggaatactatgcagccataaaaatgaatgaaattatgtagtttgcaacaacatggacagagctggaggccattatcctaagcaaagtaatgcaggaacagaaaaccaaatactgcattattttttaaaattttactttaagttctggtatacatgtgcagaacatgcaggtttgttacataggtatacgtgtgccgtggtcatttgctgcgcatattgacccatcctctaggttccctcccctagccctccacccccccatcaggccctggtgtgtgtgttcccctccctgtgtccacgtgttctcattgttcaactcccacttatgagtgagaacataaatactgcatatttttagtgggagctaaacaatgagaacaatggacactacgaaaggaacaacagacaactgggcctatctcagggtggagggtgggaagagggagaggattagaaataaatacctaccagatactatgcttattacctgagtgatgaaataatctataaatccaacccccattacatgcagtttacctatataacaaacctacacatgtacccctgaacctaaaataaaagttttctaaaaaaagaaaatgaattgactgtaaatgcttagatttatttctggattctctattctgtgccattcttctgtgtggctcctatgtctcttttacagtgtgacactgtaagttgtttttatggattgtaaatgccctgagacacagtcctcaatgaaggtataggaaattttggggtgggtcccaccgagtgagatacatgaagctaagtagtccccagtgtgcttcatcagatcagtgggcaaaatgcccagtccactcatttcaagataatgaggcaccctcaacaatgtgcttcctacatcctccccaaacctctagtcaatctctaactggctctcgccaatttaaggacaattaatggagagataccaataacatctctctctaaatagctgcataaaataaattgggctcttaatgttgttcagatagacacagttggatgcaacaggttccagcaatcatcctcacagctaatgaaatttgcacaaatgtctgaacaccttccttttcattggtatttggatttgtaccatctaggcaatctcagatgagaaaactgagacccaaagagcaaactgcccagaaccccaagtttccaggaactctacagtttttaccaactccctctcaggacacacatgtccactttccatgcctagaaatgtgttattggttttttcagttgtattatgtaactttatttaacaatttattttcttagaacatgacaccaaatgtgtcaaaaattaatgaatcatcagatttgcaggttctttaacaattatgccaacttcaattatattaaatttatatctgtaaggataagtttcttcaaaacttcaaacacattagttgccaaattaccatcactcatctttccaaaagttttatgagaaccttttctctttaggtgttaaattaataccctaataaccatagggataaaatagaaacaaaaagcacccatttattggtgaatctgatggacctcaactaagccagcaaatgtggaattaaaccattttaaagggaactaaaccatgttatttttagtatcaacattcataaaatacttcctggtccacgtgttagtttctaactctgtccttcttagtgtttgctgtttagacaagaatggacaacgctgtttaatctgcccacataagtcagctcagttttgggtacataagagttacacctagaattttatttcaatattgccgtgtagtgatctttcagtaaactgtcaaaaatgtagagtcacatagctaacctgctagaattcaagcaagccacacatttgctcttttaacaaacaataatgatgtccctactatgtgccagacacagttaatagagagattagttaaataagatctctactgtgagagtccccacacactggtagggaaagacaaagccattacactacagaataggtcgtttgtatgattgaagcatgtgtagcattctatgggacagagatgaaggagggagtgactgctgagagtgagctctccctatctcagcaggagtcccccagtgaacagtggggagaggcctttcaagagagcagaacaacattttcaaaaggcactaagagaagaaagcagatgctgtgttgtgagcaatgtctggtacttagaggcagctggggcggggggtggcatttttcacagtagcggaaaataccaagtgtgtgagttgtagaatagaaaagaaaggaaagagttgttgcatgtgccagtatacctaaagcatcacactgccaaatattaatacttgggccctacttttggtattaggaggagagcagtgtagtgtgggtgaaactaacaaaatgctggaaaggattcttttattctagaaagttaaaggttagagttagggagagattataaggtgctctttttaaactgtttgcaaataaatagacacatcaaatcctttctgattatatctagctaatccttctctgtggacttttatgtaaacctcagctcatatagagttcctgtaagcattcagctgttcccttgtggcttcatgaacccttgattatttcttgcatttttcaaaatgtttctttcatacagttcctttcacattacacaaatgtctaggctacactaagatatagtattttaggcatgacacaaaacactattattttagcttcagtttctgaattcacttcacagacataaaatttctttctgaatgtatttttgtcagcccaaaacataagcacagtagggctatttagggctatttttatttctagggaaatgatgcatgcccccatggtgactatagacaggggtccaaacagtaaatcagtcctctgtcgaccgcagaatgcgttcagagtcaagagcctgaggtagtaagttattattcagttgactactagtttggggggactgagaactacagaaatgactcattttggccagggcctcaaataggaaacaaatagtatctgctttcttaaagcttttgcctaaatcaacaggagttaactagagagccaccattgaaaaagaaaaaaaaagtaaatcattcttccacaagaaaatgtttttatttgtagaatttacagcataggggtatattacatgtcattataatccagtttttatatgcacatgtgtttatatactctatatcagcataccctcatgcaccatggtaatttaaatccaagacagaattgttccccttgttggggcaggcagaggcagccataactaaaagaaggtctcaaatctttttctcaattctcattccttttccaatttgtttactgtcttctgcacctctcagcaccatactgtcacaacaagtgggtcccacgtacttggggaaagcatttcagaaaactgttgtggcttatattcctccatggaagcctggcaaagggagctcagggcagccaaagagctccttcgtactcattcatgtttgcattatcaaacgctgcagtgtggttgctggggatctgctaataatagcatctacatctaaaatcacaacttattcatctctctcacgagctggagatgtgtgtaacttccaacactggctaggtgaaagtttaacttgactcataccatgttgcgcaggtttaatagcaaattagacatgttagaaaacttgctttaaatatatatgtggatgtgtatatacactctctacatacacattgtacactcacatataatttaagcttcacctatttccaaacagggatgtaacataattgaaacaagattgtagaggagaatgtttaaagaaaacagaagaacctatttccaaacactacagaaacatctgtttacatatgtgatggaactagaaaaagctatgtgtttttaaaatcaacacccaaataagggccacccttacaatgacacagcagagcacagctgtgcccttcctgcaaggatgctgttgtggtgcacagcccgttgggagatccccttggagagtgtggtcaaaccatgtatgaggttcttctcctggtcttagtgatgggtaatagacttttgaatgtggttttaactttttttttttttttttttttttttttgagacggagtcttgctttgtcgcccaggttggagtgcagtggcgcgatctcggctcactgcaagctccgcctcccgggttcatgccattctcctgcctcagcctcccgaggagctgggactacaggcgcccgccaccacgcccggctaatttttttgtgtttttggtagagacggggtttcaccagattagccaggatggtctcgatctcctgacctcgtgatcttcccgcctcggcctcccaaagtgctgggattacaggcttgagccaccgtgcccggccggttttaacttttaaaaactaatctaagatggtgattcggagccatggatgttgaaaaccagttgtaaataaaagcagttaatgtggttcaaaataagaatgatttcttcttgcacatagtgaatgccttgaagaggaattttacaaggctttgaacaggaataacaatattggaccaccgctgtatacaaaatagcatacaacctatacacgctcactctctttaccctactttattttttctcttaagtactcatcattctctctctctcactctgtccctttctctctctccatgttttgaagtgtcacctcccacaagaatgtaaggtccatacaagtgagaatgttgttttagtcactgctgtaaccccagcatctcaaatagtagctatcatataacaacagctcagtatcttgaatgagtaagtgcaaacatctaaggatatcactttaaagttcaaccgtcctagtttagtttgagtatgcgtttagtcttagaataagtatgattttgtgctgccctttggaaatcatactgaactaattattaaccattgggtaaattatttgcttttgttggaaaggaatagagttttattttataataatctatgttccatattagctttattctgagccatcataaagctagttttactgttattaatagagctagaatttgaccctccaagtgattcttctggtgtatatccaccttcatacttttgattcattccctctacaaattgaaaagaggaggcacaggagtgaagatgtcggcctccctatgaatgggggttagtgcatgggtagttatatttgatgtatgtcattaggcattttcaagaatgatagaagtcaaattttcataacatgggacaaggaaacaaaaacatcatgaagttaacagttgaaaacacatgcaattttctattttggaaaggcatcttgatcctcagaaatctgcaggattggacacacagcagccagtttcagaaccctcacacttgtcctcttctttggagttatgaagtctgagatgcatctgatacttcccttttgtccttcctgcgatactccactgtcacaggactaaaaagcattcagcagcttttcccattggccagtagttggagaagttggatggctccaaagctctaagggagcggcccttaagcaaggcttgactcactgtcacggacgtttctagccacaaggtctaggcaatatctctgcaaagtggttaaactaaacaagctttctttaattttatatgcttctcatgaatatgtaagtcattaaatcccttggtcacatctcagtgatggggtaaaaatatccctctcttaatattgaagtgtacaaaacaaacaaacaaacaaacaaacaaaacccaagaccgtgttaaaggaaataacattgctacaaggttaattttgcctcatacagcatttcctagaactgaattgcctgatctcctccctcgggggttgcaccaatgcttgcaataaccaaggctgattttattggaaaatcacctctagatgaagaacatactccagaggagattttgtatgggacaaactggtttctggtgccagtgtcatgttatccaggttagcactctttgagctcccaatctttctgttcattcaggcagcacattcattagcaacccttaaaacagggtagaataactagacatatcagggaatttactttaaattgttttcaagacttattggctagcaggccagtattcaaattgtagctcttaacatgcacattgaatgttttactagtagtggtgagactcgcggtagtttttatttcaaatgcttaacagataactctttaacataatataggacactcaaagatcctgcctaattgggaagaattatggagggtagattgataggagagagtatgatggtactgagtagtgaagatctcatgttacctttgtaggcacagcttatcgaacaggcatttcctgttagttggcttttttaattataaaaagaatccatagttatcttgacagcacagcgtagcacaactcacccagagacacaaattcggaaatataccccagcttccaaacttcaccaagtggaaatggagaatattataaatggaatacattgagcctccaggaggaaggaaagggaggaggaaattgatagagaagccacacatctgcgaactctggtgaccttgggatgacattaattctagaggctagaggacagatactcaaaagctgatttgattcaagatgggatacttggagaaaaatccagaaaggatagttttatgaacaagagagggaaacagcatatatctcatcaaagtacagactgcatctgatcttccagcttcttaggcaaaacctacaataagaaggagagaaacgaaccccctgttgtcttccttttgaaagtctctctgcctgggccactcaccaaagcacaagaaaacttgttcagagacagtgtacctaatgcctacttctagatttgtaataattcagacattaatgtagaaagccaaaatatctgtctatgctgactcattggtaccttccttttatgaattttgtgtccagattactattatttactctaactgagagagggaaagtaaaacaattcccaagattcggcactgacacaaagctttttaactactgatataggtggcatatggcttaatacttgggttttcagcaatcaaaaagcaaccctgtgcaatatcaccgtagctcagttcccagtgggcataagagatgattagatatattgagttctttgtgtcattcaaagaataaagaatctcatacacattggtgttagcttcctctcacttcatttcaattttcaataaccagtgtcatcacttgtaacagtttcttcataatgaaacctcatgtcgaattggatttgtctttcaagtgaaagcatattgggaagccttctgaaacctcatccttgaaataattgttactgctataaaatttttacatatatatataaatatataatttatttatttcaaattccccaaagaagaataatatagaaaatgaataataaaaacaaaattatgacatttgaaaaaagttataggttcacttttcatatttgacaagtctgggggaagaagtgctctggttaatccaaataatttggttaatagagctaccacatatagagagaatgattttcaaggaattagaaggctatatacccttaataaaaaaaagaaacaatgtgatccataatataatcttttctaattcagaaagaccatataagactctcactgtgaatagttctcattgtgccatttgcacagaaattctgattactcaaaagttctaggtgcttggacacaatcatgctcagtctcattttccagaatatcaaattatgttcttggatttggtagtttggtgttaaatcacacctttgctctatgtggcttcctaccacctcaacaaaactatagtcaatcacactgtgatgtaaaaaaaacatacggtagtgtctgcacaaattctacagtgtccaggttaagtcaagcattgcctagacattttgtctcctactttcccaacaagaagatagttgtattggggtagtttttctatagattatagattattgagagtagaactcccccaggctttttagtggtatagatgactgaaatccagacatattgatccttgtaacatttggagtgacaaggggtaggagccctgaacctcttgactgcaaaccatcatgttagtttatcctgacatactattccaattctttcctttgtgggccaagatttgtaaaaggttaggaattactatcctagggatttaggtgttgcatatccatgttcatttttttgaaattaaaattctataaagcaaggtaaagtactcagatggtaaaagctttaaagtcatggttctctcttccttcagccaatttgatgagctaaataagcatttcttaaagtattgtccatgaatggtgttttgagggatgtcaataggtattgtgaaggacaaaaatgtgtatgtctttggggtgtgtgtgtgagtgtgcgtgtgtgtgcgcgtgtgtgtgtgtgtgtgtatttggtggagggtggttaaataagtatgggaaattctgagttttaaaatttttcttctaagttgaattttgagcccttaatattacattgtgcacctctaagatgggggacatagtttattgttgtgtttccatagcttatttgaccctagaagctttttgcctatggaatatcagaatcaactttgagacatgctggaatgagtaaagttgagttgtgttggtgatttcgacgcatcagtgggttaaggaaagtcattgttgtgtaaggctacccctaactgagccagaagcaaaaatgtctttaggcaacatgtttctggcatatggagccgctgcagcaaaccctggaaggttcaccagcctatcaatggggccactaagctggacagtggtcctaagcagggagtctttaagccacagcctcattgcaagcaggtaaattgagctaaaaagttggagatttatggttcaactaattaggtgattatgaatactcatattggctaggtcagcatcgttagtaatgtctattcctctcttaaactttccccatggtagacatataaagtggggattttgagatcattacacaattttaacagctttattgagatataattcacatatcatacagttcactgatttatacaattcattggcttatatattcacagatttttgtaacaatcaccgcaatcaattttagaacatttctctcaccccccaagggagccctgtacccgttaagcagtcactcctcatttctccctccagtaagccttgaccagtaaactactttctgtctctatggattcacttattctggatatttcataaaaatggaatcatacagtatgtaaccttttgtgtctgtttctttcacttagtatgttctcaaagttcatccatgttttagcatgggttagaaccactagctgattctaactagggaatgttactaggaaaaaaagaatggtcttcccttttctacattctaaatgtatagggagaaggaatttgatggcattttaagaacattgagagatattgaaacaaaagtaaatgataacttgatacattctgatgcttaagataaaatgactctattatgtggatccttctcaaaagcattgaacatcttgtggattagtttttagtaagctggtgttaagtatgaatggtgttcttcaattctgtaaactattcgtcctacttgcaaaacaaggaggtggtgtggctattgtatcacatatctatggcttcccaattcatattcttacatctggcaatttcctattttatgaaatattttaatatggcaaactcattccaattacacagtcattataagttttgccaaggttgagtatggatcgttttgtgttcattagagcacaaaattagaattttcattgctgcaaccataaacaccattggcacaaaggatttgagcattttctcataaaatcttggacaactgataattgttgttttccctgtttttcagcatattttaattttttgaaactattttctgtatttcctcccctggtatatttcttttggcctagaagtgattctcttccaaacggatgatgtcgcacacgatgcatgaactagtgaacacagagagcaccatccctagagtcaggggaaggagcataaattatttctttaattttctcagctttagttggtccaaagtctggcagttagacctgagtaagtctggaaaaaccgtctggcacacctacatctgttctcacatttgccaatcaggatttatcaaaaatcaatggctcaaaaacatgaagctcttgagaggtgctaatttgtggctaaagaataattcaaatgcagcaccatttggtcttcatggaatatggtttcgattttgggaaattcaatgactgtttcatcttgctctcttatattctctgttaaaagaaggaaaactggaaagtagttctaatctaaggactttatttcccctacatttgtccctttggaaatttggaataactttgccaaggggatttagatacatcagtgctatttatttattaatggtcactcatacatccctgatctcttcctacttatcaggatgttctcagcaaaacaccaacacttgattctgtttttcacttaccatcccttttctccaaccctctgcctgatattcgaagtcaatcacctatgaagaaggtgactcccattcctctccctccgaggcagcaaagaggagataacattcattattcattgcaatgtttccactttgccaagatgtattctcttacttcaaattcagaacagtttattggcttctgggagttcaacagccatgggtggaggaacatgttcattagaggaagcacatgactctgccagatttaactaacagattttgaagctggagcaagcaattggctggcactcttcaggcatgaatgtcctttggcttgtgctgtgctcattgttacacaggtgctccttataaagtacgtgcacatttctaacataaaaccaataatgtcattcacataccaaaaactatagagagcttatgcccccgtgacaaatttgagatgggagcaatctacactatgatgtatatgtatagtatgatgcatatgtaactgactagattatactttgatacagttaggttgcgtttatcagactttgtagatttggagattaaaatgatttgcttttgaacctcatatgcttgggacaagaggttttgtctctgaaagccaaaagcgtcttgtcaaaaggccgcttccttaatattgcttctaaggtcagctttatgatgtcaggtctagagtataaacattaaactctactactgtttgcaaaaattttgaaacggaaagataccaaaccatatttagctcactagtaagtaaaacccaaagtgtgtgtgatagataaaatatgggcatgtgttaaaaaaaaaaacatgatgtatattagcagagttgaactgggtcccacagatacagcacagagaatagaaaaatacttcgacttctaagaaaacactcaattgtttgctttgtaggatgtatatagtctttgcctagaagagttttattctctgtgagggaatccacagtgtaccaaatattccctcttgcaggatcacaaatcactttctgaatccaaccaaaagcttctctgattgcatgtgtttatgaggctggtgagtgtccaggcctttgaagaaggaagactgtttgggtatatttgttacagaaaaaggaagttatggaggtttctctggagctgtttatcttttgtgaaaaagtagaatatgtcaaaatagagccacagcttaaactctggcagttcccagcaaataaacgaggcctaattatatgtaggacttcagctctatttaaatcaataataacaatggaaatgatcaccagatttttaatttttctataaaaagtgaattgaatgtcagcttcatatactttggatgaacctcaactcttcctagagtggaatagcaactataggaaatcaaaatgtaaaacctttttactatatggactttgattttcttcagggacagaattaaccaccaaagataatgattaaacctaccagctaatgaaaagacaatagtgagatagtgagatttgtagaaaactcatcatgtatatgcatgggtgtgcatgtgtgtgggggtgtttgtatacacttttagcaaacatcggttttctttcactggaggcaaatctgcctaaattcagggttcttacctgaagcctatgccttccatgcagatgaacaatgctagatgttatgagattatgaaaaatggagataacttggacaattagtatctcttccaaggaaaacattctccttaatttgatgcatgtgaatggaaatgtgttgagcctctactctgctagacacagtagggaatttcaaaatgaggaagccaacacctgcctataggggcattagaggttaggtggggtgggatcagggaaaggaggaattcagacacacagcttcttctacttccagatagatgccaacccaagtatgacacagaataactcttacaatgttagaattaggccaaaattccccacaaatccttctagtttcaacaacctttgggtaatataggcttacactgcttctgttgagttctaatgtctacacactttatctacctcacattttgccagaaggttctttgtaggctgaatatcagcagacagcccagccagatctactcaataagtgaatgcatataacaagacacttgcacagacttctaaatctaaccattccatcaaacagtaataaaaagtaaatctgcatgatattagatcagattattttaatgatttccttttaagagcagctgtccagtttgcatacgtcccttcctgaatcaaaagaaggggggaaatgcatgagcactgtggctccacacagttctaatcctgtctaatctgtaaatccctatctgctaatgtgtagcttcctgtcagtagatagccatagggataaacttaagaatattcagcggtgttatcccaaatcttaaagaaaccattataccgatgagatgttatcatctttatttttagagaaaattttaaagaccagaaaataatttgaactttttaaccagcttatagagttagtggctagaacacagtaggtatttaatatttgtttaaatgattgaatgcaagaaatattaaagaaaacctcagcctataggacaacatttccacagtgtgtgttacaggtacacttgtcccaagggatgctaagaagtcagcagtttggtgttccaaacagttacttccataacagaatgctggccgatggctctggccttgggagttcaagcctcctgtaaggctttcaaagaacctaggttacaagaggcatagcctggagtagtgaggggcacagtgtttgggttcaaatcccagctctgtcacttcctcactgggtagttttgggcaagttgctttagctctctttgtttcccttccctcatctgtgtaatggggataatgatagaatgtgccttatagtgttgtgatggagattaaatgaggtgatatgtgtaaggcagctggaatagtgtagctatgcaagccttcggtatgatgttcattcccatattggatagcctaccagctgggttcaatggcaagagttccatacctggtgtaagaagacctggatttgaaatctggttagctttgtggccttgggcaatttctttaacttttcttagccttagtttccttgtttctaaaatgaaataatgcttcctataactgctgtgaggattaaaaaagagaattaaatgagattctatgtgtacaaaaatccctggcatatggtaagtgctggataagtatcttctgagtctgctggatgagggtccttagagcaatggcccccacacccagccacgcttaagctgatctgacattcctggtatttttcttgccttatcttgcagctctactgcttcccatgtactgtgcattacgtagagagtaagtccagaggtggggaagcatcaaggctgtactggaagttccattttaggccgaggcttgctatgtcataaaagaaaataacaaagtatgtgttggtatcttttgccaagagcgacctaaacacatcaaagcctgacagttctatttatttggtctcttctgagatgaaaaggggtgaatggaaattctcgcactccacctcacactggttgcatgagctccctctccaccaatgacagtggccgactgatggtatagtttaggagggagagtctccctccactctagtcattactcttgttggggatctgtgtgaaatcaatttcattgcagagcagcaatggaagtagccgtgaattccatagtttctaaatgaagacacagcatatggagaatacagagtggaatttatagctcataattacacaggatatgttgtcggtcaagtccatcttgctggtgttcacagcaatccactcctgcccacattaaagcattgccaaattgcaataacctcctggccattttcccagtgattgaaccttgcacaccacttcaatccatattcgttgattttcgtcaataaaatgaaagcttattggtggatctatttgggtgacctcttagaataaaagcctcagtgtcacatggaaaaaacagcttatgaattctgctctgatgctctaatagaaagaaatacaaagcatttaacaggtgcccacctcacagttctacttttccccagatattttcagattttccaaccctgagacctaaggcgtcactttctctagtgattgtgtttgaggttttttatgaattctcattattggtttaccttttggtgccactctgagtaatgttaggattttttcttatggtatgcctgagacttaaactttacaatttatccagaaagctaatacattttggaaaaaagagaaattgggaccttgagcatggacatttatcagtaactactaatgctatgactagtgaattatttagagagaggcagggagtatggctgaggcagggttcaaggcagagaatatgtgttggcagaaaccttatagcagtcagactaaataagcttaataattttcttttcttatttaaacaaataacacttttactgtaaatcattcctccctgttttcttctctccctttctctcttttatcttgtttttcttttttgctgcatgtctgcctcgccttctctttcctgtttcctcacagtcctctctttcttttcctttccttttttttctgtcgtacattctcacactctacccaccagggctcaaactccactatagtctcattagactgtagtttatagaaggaaagtaaagatacctggaggctaggttaaagggaagggtcctccagctattctcttgtgttcgattattattttgaacactaaacagcaattcgctcacaggcaagagggatgtggcgttctgcattctactgagatgttgacttctttcatggagtgtcatgaacactgtttattaccaaagcactgtcaaactccctatttttggagatggaataaatgatgttacaatgtttttacacattcactattgaattgtactttatttaaataaaacaacatcggggaaggaatcattaagtatatcaaactggcatctttcaggtggtatttccatgtgctgagttactgaaatgaatgcaaagatgatcagggattttcactgtattcctgaagatacagatggtatccaacatctcctcaatgaagcctttggctctgtttttcgtaaggttcccactctgttcatatgaagtagtgtatcttaaatataaacctatcatcaggtttagcaaatcaataccataagagtgtgaaatgttccccagaactctctacaagggcatttcacagtaaaagcaattgaaaaagaagctgcaatggaatatcttatgagatagccatttagatcacaaaagggccataaaagtcacaagcagtttgtgtgaagcaaggttcataatataaccatacaggactggaaagaaagaggaaaattgcaaaccaatttgtggttatagctttttctgtcaattctactgggatttaaaacttgtaaaaggtagaaacttctgccagcttacattatgtagagagactgtgataaccataatcacagtagccaaacaaacaccaattatttgaagccaataaagtctttattaacttcaaagcaattagtgcttcttggatttattaagccacagaatgagaagatgccacccaagaccatttgtcagcaacaaatttgggagtcatcccgggatgcttcatttacacatttcaaaatggttttgcaattgaaggatgaatactttgaagttgagtagaagaaagagtggccctgctttggggagcccatagaggctccaagatggcactcagaagcaggccctgtttggtatttaatgctgtcagacaacctaccatgtccatcatttcaggctctgcagacccagctagctttctcaaagcaattgcagtaataattgctgtctatactgagggcctgctgggcacaacaatttctatatgcatcatctctaatcagttcatcagctctgcaaggccttattctcttcttatagatgaggaaactgaggctgagaaaagttaattactagtagttgagaatggaacccaaggttgcttggttacctcacttgtgatcttgccaggttcctccttcatttgatgagtcagttgatggccagagccacaccacacacatttttctacttgagtcacgttgacattaccaaattgagactaatcttcatgtcctcttagactggaggcaggagctgacagatctcctggctatatgtaattctgtatttcttgctctagctttaaattaatctctccaaaacagtaagaaaactaattagattacaattgcaagtcttttagcatgtatctttatgattcactgttgattataagctgatgcacagccagtctatccagatctttatttccatctgagcaataaaagtagtttctggtttcccttcagttaacatttctctttaaagagcagcattccattaatgaagacatatgaaatgaaattttgttgctgctgtactcaatctgatttctgcaaacaaatgaaaagtattactgcctcatttaatatcattaggaaacctgacatctcataattatctttaggttgtagtatagctgaggcaagagtcctagtatttttgtgccacttgtgcatcactgaagttctttcctcaagtggcaaaacagattagaccggtgttcttgtcatcggtctatgtagtctttctgagaccagacgaaaatgtctatttctgtgttttgcaaaatcttcactcaccccaagaattcatgcctgtagagcactctcagcagatcactcactagtcgtagcttagctaagagtctggaacccagtaggtattatcccctttcttggcttataaaaaccaaagatgggaggaaacccagattcaagttgtccagaggagttctggaagtccccagggctcaaagccagctctgaaagatcctacaaaatgagtcacactctagtacatggaagtcggtgggcatccactacttgctaaatttatgggcagaaagcacactttgcctgagtgtatgctgcagcatcatagccttaggcagaactgtgacacaagaagctggagatgagacagacctgagccattctgacactgctgtgtttctaactctgtggcctcaaactagtctagtttccttcaagagcatcatgatttttaccggcaaatgggaataagtaaatggaagttacagtctctgcactggctccctcacaaggtcacttcaaggaacaaagagaggatgttctttgtccaaattatgtataagtgataagaggctataaattaacatgagattattctcatcatacagtatccaaagaggcaggtaaaacatcaggtctcaacatgccctggcctacagtaaacattagaaaatatcctatgaatctggaaaatctttcacactgaactataccagcttccttcattaaaggggaagcaaaggccaaaggggaagccctggtgggggctgaagttgtgcaggacacttgccatttctacactggaatggaattactcaggggatagcagaagccctctgtgtttctgagccagcctaggccattgtgaaatgtccactgtcccagcattacctccctggcatagaaactagtgatcacctcaaatagccagggccaattagcaacagaaccttgcctgcaagtcactacatgtccaaatgctctgttctccatccccattcactactggcattctaaatgtcaaatttcaattgcgttggtcccaaaccacgtatgtgtatcacaaataaagcaaggactctttgaggcctctggctactcaacctggaaagatgtctatcaccttgctaatcactgacctgaagctgatgagggtttaaataacacagtgctcctggtcccatggccactaaggcagtgctatttctgcagcttctgctggctgacttcagatagagtcttgggatgagtgatatttttgcaaactgcaaatgcctctgagtaatgggtttcattcatttcatcaaataccacattttacaactggttgtgctaagtggacatttaagaattcatatgcagccgggcacggtggctcacgcctgtaatcccaacagtttgggaggccgaggtgggtggatcacgtgaggtcaggagatcgagaccatcctgggtaacatggtgaaaccccgtctctattaaaaatacaaaaaattatctgggtgtggtggcacacgcctgtggtcccagctactcaggaggctgaggcaggagaaccgcttgaacctgggaggcagaggttgcagtgagccgagatcacgccactgcactccagcctgggtgacagagcgagactctgtctcaaaaaaaaaaaaaaaaaaaaaaaaaaattcatatacaagccatgtttgtgatttgcattctcaacactgagttatttcatagtatctgcccattgcagtgcactgatattttaagtaatatctctgcttcttagagtaaaaattttaaaatgtgatggttattatagtcactataacccatttatcagagtggtacagttataaattgtactgctccaattaatttgtaactttagtcactatataaacacaaatcacaccaactagcatcatcttatttgcatgttttacacaatttttatcatctataatgacttacattgttgaaatagatttgttaatgttagaaagacaaaagcaaattaccttgttttctcttgtaactgttaataaggtgaaggctgaaatgcatgtttttattctgctgtaggtattatgtcatatttggaaaggagtggggttctctttctgaaaatgcattgggaaattctgattttgactgggtgagtgctggagaactagttcagaacaccattatgggaagaatccactccagaaagaaaagagtgatgatcacagtctgttcggtcttaaatccaacaatttggactgttcatttgctacttacatgtaattggggctttatattttctttgttgctgttgctgctactgctgatatcaggaaacacgtcttaggctaatgtcatcctcagtatggcagatatgtagtagactccactgggagccaaaagactagcactctcccaccaaatctgcctccaactcaggatttcactgttgtcaattccctttcctctctgggcatcaatttatgctcctgctgagtggaggaatagatgagacattctccaagttcagctctaaaaagtttgatgggaaattttataaatttggatctgcttgtgaggatgaatcatggaactgaaggtaccgcttaggttgagatcaggtatagcctgtgcaacttaatcttctgagaatttctcagattggaaacaagctagaattattctggatttcctggggattcacaagaaactataggcctgctgagaggctactgctcctttgtgggtttgaaaagaatgattttcttgggcatctaccactctatttgttgttcccttttgcataataggaagagctttggagtgaggtagacctagatatgactgctagctcttccaattataacttgtgatcactggcaaacttacttaagctacctgagcctcagtgtctgggaaccagctacacattaagaagcctttcttgcccaccttccagcatcaaactcataaacacagtctctctccggttgggttaactgggttccagcattattcctatctcttcaaagaatgactgtgaagattgagaacacttgtgtgaagtactcaacccccctaccactgagtagttgctcaataaataggttcttttgttcctgttttctgttattagggttcactttgtcagtcgttgaaaccatcaagcttaccataattttgaaaacacacacttttacatctattcgcattcattcatttgtgtattaaatattcattaaatgcctactagttctcagggactgttctaggaactagagatacagcaaaaaacaaaacagtccaaagctctgcgctagtggagtttatattctcttgggtggagacagacaataaacaatatgaaagtttaatgataaaatatattggaaggtgataaatattctagacagaaataaatcaggggattgtgctagagatggatgagttagagctgtagttttaaatggggttatcagggaaggcttttctgagagctgcatcgagcaaagaccaaaaggaagtaagggagtgagccctgcagaaattgcagggaagaacatttcaggaaaaggaatagcacgtgcaaaggccttgaggcaagagtatacctggtgtgccttagaaacagtgaagaagatagttcagctgaagcagagtaagcaagggtaagaatgttggggaaggagatcagaacttgcagtgggaattagactgtacaagagctggtaggccattaaaaagacttggcctagattgagtgaattgggagctgcgagagaatttcgagcagaagagagatatgatctgaattatgtcataatgggatcacactatacctattgtcaaaggactatgggaagggagcaggggtagaaacagagagaacagtaaggaagctattaccataagccaaatgagaaggatggtggcttgtatcagggtagtggtgatgagcggtgaagagtggatggattagtgatgtattttgaaaggagaacagataagatttgctaatggagtaattgaatagggatacagacaaaaaagaaaagtcagaaacaattccatgagtttcagcctgagcacttggaaaggtggtatttgctattagctgagtcatttactataattattatttacaggtagcatgataacaataagaccatatggaaatatttaaataattttttttcaataaacagagtgggagaatgttagctgcttgttatctattaccaatattgagggggaatgtccaaaatatgtgagatcatttctccttacactgaccagtgcttcctcctttccttcccacctggtcattcctttgattgactttcataagtccaggctagaattacatgcctcaactcagtggttctcaaacttggaaatcaactatggcgcttgttaagaaatccaggtatgagatcaccctctcatatccgtgaaatctgactgctgacgcataaacacacagcattcacacacatcaagttgtcacatatttttacatgactgaatcagtcaaatacctggtttgtggttgatcaccagtcagctttcaaaataaaatagctgggtgttttaaagaaaacattttttctgtccaggttatctgtactcatcagcttctgtccaccatcaaagtaaaatggccataaccgatcttatccagatgggggtttaggcagttgatggactcactcatgtgacctttacttccgtgaatgcagttttgtttggcctccattccgcttttgacagtttcaagagctggattagtaaatcttcaaggtcttctacacccatatgattctatgatactgcgattctgccacgttgctatgaaattgttattagaaggccatttaccccttaaacctgggtattcaaagaactagaaacctaaatgatgatgacagatatcttacttaaatttcatataagaattaattccaagtcaattcaacgtagcatagtagtaaaagatcatacagcctttgtgattggaaagagtctcattcgaaccttgatgcaagttgcttaacgcctctacacctcagttgctcacctgtaaagtgaaggtaataacagcatgtgcaccatacttgtattataaggatgaagtgaggtttcatgaaaagtagttagcatattacctgacacacagtatgtctcataaaagtagctatcaccatcaccatcaccatcatcatcatcatcattgttattaactgaagaatcatagataaacatgcattttcaattgtcattgaaaggcggagagaaggctgcaaataattttatgaaagcatatgtttaaagattttaggactagctcttcaatgggtttgtctgaatatacatatatggatgggtgattggttgaaatagagcataatttttcaaagtgtgtttaggcaaaacaaaaacaaccgaaaagcctaatttttttttttctagccatttactggctgtgataccttggacaaagtcatggcacacattaagaacttaacaaacaaagttttattggtattatcattattttacatatatatatatacacacacacacacataatggtgacaaaagaaccatgttggacaaaaaatatttatatgcatgatgtcctaataactttgttaggtcttacactcaagcgttagactcagaagagagaggaacataacatattttgaaattaggtttatataagactttctctttataagctacagattgttgataggctaacaataagcttaaacttgtgtcatttgaaactacacacacacacacacacacacacatatatatgaatctgtgcattcttatacaattctatgcccaaatttcatattcctatcatccttttctatatcagtagctcattttcagaggtaatgttattagtgctcttcactctcatggacaaattaagtccaaatcaacacataccagaccttcctgaagctctcagcggacacccaacttcgtgatccttggtttcgtgtgaaattgcctcctcctaaaggccagacgggaaatcaggacttggaataagcacagctctccagctctgctcctgccttggcaattttgatatttcacaagaattgctgtgttttttataagaatgataaaaaggcagatataaaggcaaatatcaagaagacttctggctgacaaaagcagaatttggagagaaatgtgaaaatagtgacttacttcagcaacagagggagtattttttatactttaggttttttttttttttgtaaaatcatgactttctagtaaatgacatcctagaagatatttatcaaagcaggaaagccgtggaaaagagcacctcgcattcactttaatattttgccttttcttttgacattttcttgcctagagatctaattccattaaatatgtactttttttgactggaagtcttcttcgtggatctttcagataaatcttaaaagtacataaggtctgtagggcagcttttttttaagtgcaaatgagacacacaatagaatattgtctatgagggtttccaaattatttatactcctgcagaaatttaccttgcgttttctgtgataatgataagggaaaaggtaagattccaatatgccttctgtggagcactgtcaaaccatattagtcctatttaatatctgacatgcaggaatttactttggctgatacccactttgattggctttattaggcattgtcaaggctgtaactttgtctgatggacaaggtaaatagaagtgtaatcaagtgtcaagttagcagcgcactcggtaatattccatcatgcctttgcaaagggacatggcttcactactctgcttcaccatgacacttctctaggactttggagtgaacatgtttgctaaattggaagattacattcccactgtggtgaattggaatgtctcctagtagacttccaagcatatactgttgcatccgtaatttcttctgttgcttttatttatcattccctatgcctccaactatttttctgcattcatatgaaatcaaactcccaccacaggattcacaaatgtaggtttttagaatgtcacattttatggttagtcactgtgggaaacgggctacagttgaggggacccaaagttggagttgagggtaggagtaatccagatttgggttatgctctgcagcagaactactacttcattactacatatcttctaggtgtgatcttttcagtacgtaagagcttcagtatatcaagggaaaatgcaaagtcattgaataaagtgagtaggagcactgagaagctacggcagggctgaaatactcaggttaatatgtgacattactcagaggctcagtaatgcagtgcaggctccagccttctcctgcaaaccagctcaactgatggctgccggctaggctggtagtcctatgggtcctatgggataggagaggagaccacagttaagaatagtttttcctttgcattataaaggcaggaaaaaagtctgtgattataaggttctctgcttccaaatgatccatctaaaaactatgagaatagacattagaaagacaaatatgaggacccagaagaaagaagaaaagaaagggaaataaagaaaatcttctagccctaaacacaactaaatcatatctccagtccaccttagacctctggtttgttaaaaacaactttgcatgagaagagttgattcatttttcccccatatatatcttacagctttgggtcatctctggtcattagataattgtagtagctttacacaactaatttttctattgccaaagacaaagatgtgttggaatttttgcatggtggaggagatagtgggaatgaaggaagagtgcaaaatatgttgcctttgcaaaattgtcatcgaaaggatagccagaacataaatgatactgttttggcttcaaaagggtaagcaggtgtcttcaaagtcccaaatgagctgtgtacaagcttgtacaaacaagcgcagaatcaggcctgtttgttattcacacaaacagagtgtaaaccatgtgaattccacagttcccaggattcagatggtgcacaatggtccataatgagcagcacctgtgcttacctcaattaccagacagttctcaacagcagcagaaagggctcactagaattgtttttcaataatagatttagttatgtctttcataattggattcaaaagctcaaaatttcattttgcaacttgttcataaaatttgtatgaaaaagtctggcatttattcaaaagaaatagtctatgaagaaaaaattgcaaaacagccaaccgctggtaactaagcagccaaattatagtccaagcacttggcaaatacaccgtctttttattatttcagtaattgaatttctgttaaagcatggagcataatttaacatgaggaatttatttatagtacaatagtgtttcagtaataaatgcattatgattgtcacttttaatggagtcttatgtattccctctgagactgtgtggcagactttgagacagccactgcaccagtgttgtttgtagacaattgaattaattggagacatggtcattaactcgacctgaatacctctgattgcttctgtaaataaggttagagagcaaatggctaatcttcgttgtcattatagattcctcttacattttcacactgccttgtatattaagatcattttgctaagcagcttttgagactctccttatatttacagtattgtcttgcgtggcacataaccataattgtatcagacttatattacattctccatatctttataaagcacgatactaaaaaagaacctatgttgaatcacaactcataaaaaccatcagaccaataaatgaataaaccacagtgtataaaccatcgtattaaaggaaagtaaaaccacaccgcaaaagttgctttggtctcctcttacagatcctcttaacacaggatggcctcccaaagatgcaatcactaaagaaagagcacaacaaggaaagcattgattaaaatatctttatgtttcagttgatgtcatgccctttcttgcccttctgtaacaacattagtaacatgcaaatcacaggaggttaggttctttctccttgttcattctagaatggagttacataagaactatttcaaatacagatattaaaaacttttgaatatttgacttaccatgttatttttgtagcttcatcctgttataggtatgcaagatatttagaggggatttggagaaaaaaaatcttctccctttatgactcaaataattcaaaaagtgcatatactggaaacatctctaaaaatggactttccagtcattttataattcagacatattataaaggaccattaaaactgtacagcattatgttgaataatgagacatttacaagtaggataccacaaagagatgaaaaagaaggaagaggaggagcaggaggaggaggaagacaagaaagaggaaggaggaaagaaaaataattctgtgcttttatttttcccttggcaagactgaaatatactgaatatataaaaacgatcatttatactagctctgtataaattatctatactactagaagagtagatcacttcctcattgttgtaccaagccactggaagcctatcagttttcatgagttccatgcctaactgaaagtgttgacattttctttggatattaaatgggtcatgcccaaaagagaaaaataacgaccatttcaattatttcagactttttgcctttatatattcttattttaacactaatctttgtgtatatgatggaaatgttacatttgactctcatacatatgaatgtgcatatgtgtatgctagtaatcatggctagaacccaaatgtgggttgttgtatatacattggctggcagcaatatcatttttaataaatgactaatggccaacatgtgctgcagaagtcaacatttctgtccttagccagctaatagtaacattatttttaaattaatgttatgcacaccatttgaaggatgacacttctcccaatgttttcacttcttagccagccatctcaattagtgctgaaatgattctactttcttggtattagccatcttggattttaaccaacaggtgtacacactctcacatatacactcactcaaatgcagactggcacacgtgcattcatacatacatacatacacacacattcatccattcatgaggcgcaggtatatatacacatgcacacacatattatctcttgtttaaacaccttgaatttaggcacagttacctgaaatgagtattgaaatataattatagtgaaagggaacattttggcatataacctttctggaaaatatctctctgccagtgttttgcccaagtttctaactggcacagtaacatacccaggttttgtcattaagaagctgtagtagtatgggactcacagaaactgcactggattttgagatgttgataccatcagactagaaattactctcatctcactaaaagtacatgtctcccatgctttgcaagtgagaatattttgtttatttgtttgttttggacatttaaaccccaccccccaagttgtcaaagccttgtctacactataatccctaagatgtgcatttgtttgaatttagtaggtagggaccctgtagcattgtgatttgctgttgacatactaaaaggggatatgatgtaaccttcagaaaatgcagatttctagatttttctgatgaagtggttgaccacaaatgtaatctgcttaaccccagaaggtattttaattcctgttttaaatccattttattctaaattcttccttctttgaaattgctaaatttcctaaatccctcttaataacaaaaccaaacatcctgaccttattaccacctgcctgtttgtcatcatcacaggtcctgccagttcttggtgaaatgcctaagtttgtttccatttctttctatgtcagcatttaatagactctgtgttcatttgtaactcaggattgtcattcctcttgctattgatctagttgtaagccctgccattccacatacaggagtcagtgttgagtaaggctgcctgtcctcagctatcttatcactagtggccatgtacagacttcctcttgacgtcaaaggcaagttgggtacaatatcaaatgagttcccctaacatgaggaaattgtgttcctcttttcttctcccatttgcacttggcctccttcaatttaacattgatgagaagggagactattagctagaaggtaagattttcaggcagactaaagatctagtatttcctatgctgtcattcaaaataacaggcataagaacttctgtttaaaatagctgggctttttgactagagggcttttgtgtagaagatttaagatgtcagctttaaatatgacattgatagtctttggcaaagaatgggagtgaatttttgtagaaactgcctttttttctgattgtttattaatggtctttgtgatttatagtaaatgctggggaggatttccaggcccatttatcatgagaagggaacaccttcttgttcttaatgtgagtgtgtcataattagcaatgcatgtgggccaggagatttaactctgccttttctgaaagtccttcaacctcatatttaatcccaaactgactgaatattttttcttctttaaggaaattaattatgccactggaaaaatcatcaactagagagggagttgataacaggcacaatgtaggctgggttggctaatgtatcaaaatgacatgattagagtaactcacatcttagacaaattggaataatggagtcatcattctaattaaaaacaggaaggtctgtttgtatgtagcattcattttcagtaagaaccacaccatttgtttttcatgttcatgcatgtttgtacactctgcgacccatcaatggttgttgctctaaataccaattacattaaaaatatccatccagatactttgcattttgtcaatgaaactgaagctgaagaaggagttgggcactgtgtcatatggccagcatccatagaggcagttgaaaggttacaaatccatcatcatgcaacctatttgcctgattattttcatcaaattaacttatgcttcatgatgtttttgtgttccataggctggcctaagtactggcttctgttgataaccagtaacacatacacatttcacagttaagtattgttctttaccaggtgactctgtttgtgcttcatttctatatattataaagccatctgaagtattttcttataacaagaaaattatatacaatttatcatgccggtcaccctgggatatgcaaaatgactttacattctggtccctgccatcaaggaatgtacaatttagtggtgcaggttagcacaacgaaataaaatcatctgagattaatgaagtgataaactgtgatgcaaaacagggagatatctgtaagaattaaaaagtcattagcgatgacttcatattatttgaatttgagcttgaaagataaagatttaaccaagcagaagagaggggaaacgtgccactgtagatagagcaaacaggataagcaaaggcatggaggcaatgtgggagcagagaggagacaaaagtcgcatttctgttgggaataacaatcagaaataaaactgacactaaggtagggtgttgatagagatctaactctgaaaaccttatagcaaagagtgtatatatctgccagaaagtcattgtgaattctgaaatagagagatctcatgatacaacatattgtcacagagggtgagtataaaagagcaaagcttttagttcaccagggaatgaggtcaaggcaagtaagaaaagaacattggatttgcggccaggcacggtagctcacgcctgtagttccagtactttgggaggccaaggtgggtgaatcacgaggtcaggagttcgagaccagccttgccaacatggtgaaaccccatctctactaaaaatacaaaaaattagccgggcatggtggcacacacttgtggtcccagctactcaggaggctgaggcaggagaattgcttgaacccaggaggcggacattgcagtgagtcgtgatcgtgccactgcactccagcccaggcgatagtgtgagactccatctcagaaaaaaaaaaaaaatagaaaagaaaagaacattggattggcaatgatgagtcaggaagagaagggttgttgcgggcagttaagaagcagttttagtagccaaaagagtttcaaagcctaattactaggcctgaagaagtttccagtggtgaggaagtggaaccaataagtgttgactttgaccacatctttaagacattttcatggtggaagacagtcagtgactttttcctgattaggaatgtatgggctagtctgggtgaccacccagcagggctgtctgtacatcatccacttctcttggcaatatgttgtgttgctgccttgtgagggttagatacagcaattttgcaagttacagtttttgccattcacttagatttctgatgatcgtgtttacaatacaattatgaagtaagattcattcagtaaggaaactatatgacttttatttcagaaattgcgtatgtgactttgaataggctgactgcaacaaggttttcctagcacacagcgttggtgtccttcagtgttttcagcaccaaattcttacaaccagattcattaggtcagctgaagaaaactttttggattaattttgagtcttattgctttctgagatgattagaaagatgagttttgtagtgggttttgattgttctcattgcctctagcttgacagtgtttagtcgatggtcacagtagcctagtgaataggtatccttcgataactgttccttctaccttctagtgttcttgtggcaatcaaatcatgggagttaacttgcttgaaaactatcaagtgctctgcacttaaaagtattctgatcttattgatccaatgatgatgatatcctcttggaaccatagagtcacagagcaatagggatgttaagtgcctacccaaaggcagaggatatgtctgtggacagtcctccctgagatttatagagaagacttctttgtggctttactctagggtgtattaagcacactaagcattttacagaatatgtggttgataaagcctctggtcttagaagcttaccttctaaatcaagtgtctgtgatacatcaggtaacagatcagacatgaagggaagcagacaatactgataaggagaatggcattgaccaacatcacaaaagagatgtagtctaaggagagattggaagagcaatgcccacttcccaaattgagcagcaggtctaagtacattgagtaataggaaagaagacataaagcacggaaaaaggcggaggcttatgctaagccactgtgagactatcttcaggaagacctgtgcctgtctaagcatgctttgtactttcctagggaattcagcccgccatctgcctgggttctcctgacaagcagttgggccccatctccgggccagcttttggaacacagtggaggagattcctccatggaagcagtttctgggtttaagacacccagtggaagtacacagcctgctccacctacgatttgtaactgatatgattccttgtgggaaggtcttgaccttgttgtagactcctggaggctggccctttctgggtttcttgtgaatgcaagctgccactcaatcattcattctcagctttgcagaggccagagctcacgggagtcagtgttcacatccacttgcccgcctttcttctctcctttgctcccatttttaaaaatgggctttaaaggcaaaaggtacaaaaatacttggctttatatgatttttttcccacctgtttggctgtttgattgaaacagctctgtctcatgccagaaaagtcagtgtgattttttaaattatttccatagaaaccgaaatatcagcttattcttccatatgcaaattgcaatgctttgaagacataatggtccattagccaacgttggccagtcttactgggaacatgctgacatcctccatagtgtcacctcaccatgtaccatggtgaggttgaatccaggtgcctttttttcattcaggttgaatccaggtgcctttttttcattcctttgaaattgcaatattgaagttaatctcatagtatccttaaaactatttttcaacttgatatggtttggtgctacatctccgtattctcagctgtaaactggaagtagtaagagtatctaatttatcgtgttgtggtgcaaattaagggagaaactgcagggaaagtgctcagtagcccagttcctggcatataatgaacactagcactaccaggatgaattatgccctggatccccactacggccatggatatagcctgctatgaccctgacccttggcttgggcagtggcaagccacctttgaacgtcattagtgatccataggacgtgctcacaggaaagaaacatacattaagtgaactgctggtgtgggcaagtaggttcaggaaagtggtaaactgatatcccagcttatcagaaggaatctgatagaaattgttcaggaacaattgcctaaagaaagcttaaatttcaccaagtcagattaaaaatgatacaaggtagtcaactttctctgttgctaaaggaggacagaataattatgaaaaagtgaaattcacagttcaccttaaaattgggttttagcctttagtttcaaattcgtaactcaccaacttctttttctcccagtggctcccatctgaatagccccatgtagatattagccttgccatgctcaatgtggtccactgggagttatctgcatcacctgtgattatattggaactgcagaactcagaccttgccctaggcctacctaattagaatctgcaggttaataagatctccaggtgattcctatgcacattaaatttggagaagcatgggtttgtgagtttcctcacctaaattacctcatccagccctcttaaaaacctatgtgatatattatccccattttacaggtaaggaaactgagacccttatgttaagtgcctagcctaaggtcatacactgatgaagtatccaaggtgacactcaaaagcagatcatctgacttccaaccctatgctcttcccattgtactaaaactgactctttaaaaccagtaaggaaaatgcagctgtctagatatgtggcagtggattgaaaatgggagacggggcacaggtaggaaaagaagaggccaagtgcctgagtctggtcaatctacagaaaggacaaccaagccctgattagttgtgagtcaaacatggtgctgaaaagccattgccaaaatcactcataattatcatctcagaaaggaagtaggggttgagtaagttagaagaaataggaaccaacagctggtgatcgaaaaatgtaaaaagccggtcatttacagttatcataaaagttccaaacggtctgtttgcagcctctctggaagatgtaacctctcattgcaccattgatgtggcattaatctactagcgtctttttactcagagatctgcttcccagcacgtcatttagccatcaaggttcccttcccagggtgggcttatatgtttggacttctctgaagggaaactaaattttacaaacaaaagaaaatctgttcaggtgtaagagggtgcactcagaattttaattatttggatcttgtattaccttcctattgctgccgtgacaaattacctcaaacttagtgctttaaaacaacacacatttgttatcctagagttctggaggtcaaaagtcagatgtgggtctcacatggttaaaatcaaggtggcagcatggctgcattcctttctgaaggttctaaggaacaaactgtttcctactcaagtaagttattagcagaattcaattccttgtggttataggacagaactctccattgtcttgctggctgttaactgagggccagttccagcttctagaggctgccacattccttgacttttggcctccttcgtccatcttcaaacaccagcatagcaggtcaagtctttctcacatggcatcactctggcctcctcttctgcctccctcttttacttgtaaggatccccgtgattacactgggcccacttggataatccaggataatctccccatctcaagatccttaatatttacatatgtgaaatctccttggctatataaagtaacatattcagaagttctatggatcaggttatggacatctttgggtcagtcattactccatcaaccacagatcacttcagtcattcagggctttaagcaatgtcatgtatagtaacttgtctgagaaaatgaataggaatgaataggtgtggacctccttattactctttgcaagtaaattgaggcggctctatttcaaacatcaggatgagataacaggacaaacatcctagtgtatacatgttaggcaaagacaatctttttatgaagttatatcagggtgtggcccagatcacaactggaccataatcgactgtctgctcatcaatagcatcagagaattagcagaaaatatatttgattgtgacttgcttgtgatgatattgggatatgaattattttattttcaaattgtgctcagggggcatcccaaggaggtagggaagctgctggggacataggctccctcccctctccacatcccttgtttcttttttccaccacagcaattctgtttttatcggttttatatattattcttctgtgtacactttctattgctttctatttctgcatacactatttgttgcagaaatgggctaagtggattttcaggggacaggggagatgggggaagatttcaaaactgctgacacagacaaaatggaatcttcccagtctctagctagaataagttcagggttcagagtgtctgcctctggtggcctaatgtgatgaggcaggcataatgctccagttctggaacccagagttcagagacaaaaacgaaggaggaaggaagataagatcagctgcggatgttgattcctttgcctgaagttcatctgattacagcttaatgatgaaatcaaatatgaaaccattctaaattacctaatagacattttatcccagtaaaactggaacacagtcaagctgatgaaattcatgcaagtcttaactgaagaggagagtttcatgtaggactctcccattaaacatgtcttgctccatgtctttggcaagttctgggccttgtgaaatgtgttgccaagatcaatatgtggacttgcttatagaatcctcccatgtacatttcctatacatagtctggatgcccacacagcttgttggagcagaatggccaattcatcatctctgtttatctccagagaaagggatttacagttaaattagaattagaatcaaacagcactggtgcaggtgtttggctttctggaggctgttaatctgaattagtaaaaagtctgacttataaaatagcctacagaagtgcagttttaatcctgtgaggtttatacaataaccctgtgactgatagagtactgtagagacaggacattcctagacttgccttaaggagcagattggattgcacaaatgcctcctcacatgtttctcataaagtccataaacagcctcacttaaaatccccaatacactttaggttcataaggattataatctttgaattggaagacaccttaaattttgtgggtagtggggccagtggtgcaagtggtaaaggaatttaccaatacagttgtaggtaaagaaaggaagatttattaaagtatgaaaatatgttgcaagtttgcaacagcagagaaggggctgtctgcaaagaggcaggggctggagggaaattttacagggtcatgctggagggggctatgtgcagaatgaggtcattttgcccatgaaacaggatcattgtgcctgtggaatgaggtcactgtttgggattagccatctctcagaacaattgttcattgttcttccccacctgggccctcctacacctggggccccttcctcatttttgcttacttatcaggactccatactaaagatcatccaaccccacttcagacccacaataaggattcttctcccacattctttatagccactggctatctgctcacctaaagtgcagggttcactggcatgcaaggtagtgcattctttctgtggtcagctgtaagtttttaaaagtatttcctgatgttgaggtaaaatcttcctgactagatctccaactcattggttttgtatttaccgtggaagttcagaacaagcccactctttccctgctgccagggcagacctgcacattgtttgaaaattttcagtatatgtgcctctccccccatccccaacccagagtcttcttcaagcagaatagtcggtttcttcaatgtggcctttggcctctccatcttatctgcatctattcattaattatggtgctacacattaatccctttattgcagaagagtctgggtggtgtaagcatagaaagactatcacatatagagtctagggtgcccagactatctcttaaagcccatttttttcccctgtcactctcaagctttccaccagggtcaaccgtgtctggagaaggcaccttaaacgcctccccagcttctctcccactggcctactctctgatcgccttccccagctttggattcccccactagggtcactgacttgctaagccatcttctctgcccccagtctggcctatgaccatgaagacctaatgaatgggtttgggattaaaataaagcttagttctacttggtaaagatgaatgatgaatacgatagcaaattctgatgaatatgatagcaaaatctgatctttgagaaggttgagcagttgactttgaagtcattacaaatgtgggtcctttgagaagttttgttacattgtagtgaagttactgagtacacttttaatatttacagactatagagtggatggcttaatatagcaaatgttaattatttttagtatcagacattatgtttgttgtaatcactagcattctttttaaaagcagtttattgaaatatgaaagtaaatgatgtgtgaaaaataacattaatacagtcttagtgaatgaagaatatataaactgtgcattagtttttcatctcctaggcagaatcaagtattacatgggctagctttactcataaccactttcatgtacatctggaaaataaattagtaacgtatgaaaataaatgtagcagaagtggaaatttaactagctgaacagctaacagatttcagtgaagaactgaaagtgacatattatgatgctttgccaacttgaaagttccatggtatattccagacaagaatgtggccttaagccaactattcagacattgatgtttgtcctgcttttaaagacaatgtttcagttttgtactcactttttgtccctgggagcagtcccaaccgggcgcaaggtaggcccagaggaaatgaggcccagactcagatgtaaagcttacattccttagcagactggctgcatctacagtctccagcaagcccatgagcagaagatggagagtagaggcacaggaaaggtgctggtgagagcaattttgcctccatttaagcaaccattattcccttccacaaacgctggctctccatttccaactgtgcaacttcccggagaaagcaattccttttcattaacacactgaagtccttcacccctagtttgagttctcatggtgtcctccctgaattaaagtccaccctccttcttatccccatatctgtatgtgtaagtataaaaagctgatgtacttcttcttgttcttcctatactaatttcctctaagtgttcattgtcaaaattgactgtgttggagtcccacctgagaacacagaaacagatttagctataaaaattcttaggatacataatttcaggtctcatttcattgggtctcagtcaaggttgcccttatgtttaaaacagttttaatttcatgtctttctttatatctacttataagtattgtcaaattttcatatatgatttctatttacatccataatttcttacacttctgaaattcaaaaagttctgagaaccaatattttttctaaccttgagacaaactcatttgatgataaaacctgacctaaactgttgtaaagatatttatttaaaacatttatgtattcctcttactgtgaatgttactgcaacaatagtaacaagttttattaaggggtgcttatccagatcccactgagaatattatatatggtatattcagcatagtactttttaaaattaaaaacatccgaatactaaaatacatctgttctcagaagggctttagataggaaagatatatacaaaacacatacacgcacacacacacacacgcacacacacacacaccccaatttttctactaaatccatggaactttgatttagctgaggaataagttgattttggtaaataaatcatccctgcttcatgtgtatcaccttaatgtatttggttttgaaggagtaatcccagggatttttttgtttcttacagaagttgctaaaaaattatctagtaagtggaactctatccagaaatattccaaagtcaacctagagtctattttagcttagtaatagcaggatgaccagcttcgtattaaaagaaatgagtgcataaatgtgaaatgatactaggaaacagccttttctcttgagaatcataaatgtggatacaaattagattttatccctcaatccaccacccagtattctcagtgttgcagatgctctgtgttatatttaaaacttcacttgggaggaattgaggccaagttagcctaatctctggattagtctcacttagatttctgttctctcaatctttatttagtaaccgaagacaaaaacaattgattagatttaaagagaactttgcataaatagggtatcattactgacactaaagagagatctacaaaggaatgcagggaaataggagccctgttataggtctcctccctttcccccccactgctggagaaagacacacagttcccaggagatacagtagtctccttatttcttgtactttccctaatctcttgatgtacttgacagagaaatgtacttgtagttcacatttactaagcagatagcagtttaaaatgagctttcactatgttaaagaaaatgtctacctgggagattaaagggccagtctttaaggacacacggcacaggaagtggataggccctctgcactgagtagtgactgatgaggagcctgtgctggctttgaagggatcctattccttcccaagcagcagctcagtatggctccagctcagtgagtgagagttgtaatgttggagaagaggctctagtgagggcatagggtggggtcatgaactcgtttgggttcaggcaatgaataaaggtctgtgctccttgagctgggggctggggaattcttgcggatcctctttctcacatttgaacatggggccacaggaccaggtgacctccaggaccatactgggctctcttgactgagctgctgcttcagatttgtggaatgcgagggagagagcaagtcaggttgctgctgcatgcaagaggctgcgaaggcccagtagatggcaaacagacaaacaggccccgagcactcccctccccatgagctaaactgatctccaaagaggggttaggctgaagacacagagggagattagaaccttcccccaaatttagagacccatttctgagagaaagcaaaattcagtccaaagcaacaatgagaaaaagaaaggtgatggcataccccagtgtaccaagatgcagctgaggctgacttgttataggacgcagagagcaaacgatcggtatggaggagtattatttatcaataaaggcagagtagcaaatggtgtcactttccaaatgctttgcttggtcagctttacaaatttaaaatcaatcattacagctggttgctctcttatgatcataactccttgtaagagttacaaagaggttataaaaagtatggtggaggaggcctagaagtgtgttgtctcattcccttattcatgcacccaacagacagaaattgaggaccaactctagtcactttggggctgagcgccaggccctcagcaatgaatatgctcagcacagctagtgccctttgaaggagctggggggccagggtcctaggtgctagtcttggctctccaactagctgtgaggcagagaccagctccaccccctttctgaacctcagtttcctctaattaaaatgataattgaactcactccttcttggtaatagaactatataccatatgtttagctaagatcagagccccttgacgaacctgtggggtattgaacaagggggcaacaaaaaatgaaaaactaccttaactgaaaaaaatgggacagttcaacatctaaggcactacatctatatctgcatccagaaggcatgcaaacttggcttaaggtttttatgttgaatgagggtggcaaggcttttctggaagacaaggcagtgtgatggaaagccaaggaacttgcatacacataggcctggttctcttcaaagctttcaacttgggccagtcactgggcctcctaagcctcacgtttcctatctataaaatgggaacggtaaaccccactctacctgcatttcacagaccacaggcccttcacctgaactgggctgttttccatcttatttgagagtaaatgaggcaatgaattatgttgtttttctttcagcccacccttggccactccccagcccccacctgcagtgcaagccagcgggggttctggcagctccagcgaatcggagagcagctctgagtcggattcagacactgaaagtagcaccactgacagcgaatctaatgaggcacctcgtgtggcaactccagaggtgagtgaaggtgccagggccctaaccatgatctgcctgtcccacaggcagcaccctcaacacacacacacacagacacacacacacacacacacactttcagcacaataattaataattaatttagcatgataaccacttcagaaaagtacccagatttttaacagcacttttaaaaagcatatattcacatactcctaacatgcatacattttttgctgtgtgactgatttgctgtgtgactcacttagcttctcttagcatagtaaaactagcatagtaatgaatagactagcagcttgtcttctgagagaatcaatgaagccagtcaagatccaattctggccttggggacactaacccttactctagattaaagtgattaaagtgtgaattgccacttggcaagtaagacccaagaagtatggctttccttaacggtaaaatgattatttaaatgttatatgttctttattttaatatgcatccttcaagtgtgtttgataataattcaccaaaacatttaacacagctccatgaaatactaaaataataattttgaaataaaagaatttgcttcacatcctctctgagtccaggatagccgctcaatttccctgagcctgcatttggtatagcaagtaaattccaccctcaacccccggctcttcatacacttgtttttcaataatcagaaaagaaaaataggagacaataataatattactgctattaataatagaaatacctgttgaacatggaccatgcatgtgccaggcactgtgctgagctcttgacttgcattttctcatattatcctcatgacaaccttacagagtacttattattatttttgttttacaaatgagagaataaggttctaggaggttaaaaagaactttcccaagacctcacagatagacagtagtagagccaggactgaaaaccctggtccatgtgtatccagagctgatgttctcaacctgaaagctccactgcccacagtggctgctgatacaacttcctcaacccttgcctgccattgtcttgtgcaggttgctatcacaactactcaagtgtttttaattctgtcaccctctattggctggtaccataagcctcagctgatggctttcaaaggaagagctcttctaataaaactgatggcagaactcagagttaggaatcaaggacccgaatagtatgtatcattgccatggtttagtggatgctaatgtctgcatgcatgttcctataaattggttattgcccatacaccgacgaaagctcagtggtttctattttttggaagtaaaatctttttgtccttcagtaaaaatacaaaaggcctgatttgtttgcagggaatgacagcatcacatagaaggcactggcactctggcagctggaaagcctttccttttgaattatacttgaggtgtgcttacattcctttcaggatcagagactattacctttgcctcctggtgagaggttgagtgatgattcccacaaaggattttggaaacaggtttccctcattggcatccctgccaacccactggaacatctctctgtgaataattcttttcttcctggccaaactagagaatattttcagagaaggagtcgaaatgagcttaaataagtagactgcagctggtttgtatctggctatttaggtcatttgaatattatggatagtgggtatgtgcaggtgtgtgtgtatgagtgtgtgtatttgtatatgtgtgaacagtcacttgacatccaaagcttttagtactagtctctgtactcagggttctcttgaatccttcccaagtgtaaaaatcattcttgctgctgtttctcaatctgcagcctgagccaccctcaaccaacaagtggcaactggataaatggcttaacaaagtgacatcccagaacaagtcttttatttgtggccaaaatgaaacacccatggagactatttctctgcctcctccaatcatccaaccaatggaagtccagatgaaagtgaagacgaatgccagtcaggtcccagctgaacccaaagaaaggcctctcctcagtctcattagggagaaagcccgtccacggcccactcagaaaattccagaaacaaaggctttgaagcataagttgtcaacaactagtgagacagtgtctcaaaggacaattgggaaaaaacagcccaaaaaagttgagaagaacaccagcactgacgagtttacctggcccaaaccaaatattaccagcagcactcccaaagaaaaagaaagtgtggagcttcatgacccaccaagaggccgcaacaaagccactgcccacaaaccagcccctaggaaagaaccaagacctaacatccctttggctcccgagaagaagaagtacagagggcctggcaagattgtgccaaagtctcgggaattcattgaaacagattcatctacatctgactccaacacagatcaggaagagaccctgcaaatcaaagtcctgcctccgtgcattatttctggaggtaatactgccaaatccaaggaaatctgtggtgccagcctgaccctcagcaccttaatgagtagcagtggcagcaacaacaacttatccatcagtaatgaagagccaacattttcacctattcctgtcatgcaaactgaaatcctgtcccctctgcgagatcatgagaacctgaaaaacctctgggtgaagattgaccttgacttactctctagagtacctggccacagctcactccatgcagcacctgccaagccagaccacaaggagactgccacaaaacccaagcgtcagacagctgtcacagctgtggagaaaccagcccctaagggcaaacgtaagcacaaggtaagctgtctaaagtggcctgccaagtgcttgtgagcagtgtctgtttgttgtctaacttgatcttgagcctcatcttcaaggaagccaatggcagtgcattgcagattttggcaaaggtgatgatgctttctgtgggaaatgcagtatttgacatgaccagagaggaaaaactaggaatgatctgtagccagtggcaagagtgtccattatggcatatgagggcttatgatgtgtaggaaagaaaaatatgaagaaagtctccttacttaggcaaggcacgcaagtgccctcaatgtccaaatgcatcttctagggctttttaatttctctggacaaacattagcatctccacagtccagttatactctaagtctcctgggtcctaccaaccacatgttcttcccagcctgctgggatcactgatctatgtggtaggcttgacttgggaaaattttacctgcagaaggctagagctgaattccaaggctataaagtatactcataaggtgaaatccagagtggcccttttcatttgaactatgtctagagaaatggtttggtatccagtatgctcattctgtcgtatctccacatctcagggtactttttttagagtgatgttatctcatgatgatattcaggtaatcttatttctaaggctgccacagtggctagaaaggaggttccaagtcctttcttcatttattctgtccctttccaggaaagacttaagattcctcattgaaccgcagcccccactgtggccaggccatccgactgactaggatgatgcaaaaatgatggcagtcatcattcagcttgactttacaagttccaaaacagaggatattctctcggagttgcatacctaatgagagtacagtttgagcatcccaaatctaaaaatccaaaatccaaaatgctccaaatctgaaactttttgagcactgacatgacactcaggagaaataagtgttcactggagcattttcagattttggatttttgaattcgagatgctcaactggtaagtttaatgcaaatattccaaaattcaaaaatattcaaagtctgaaacatttctggtcccaactattctggataatggctactcagcctatattccaaaatagggaccaagaagtcaaagacctttgccctaccactgattctccacatttagtgatgacaacagtacaaccacagctgacagtgtaccttcaaaacagcacatgcaaaagtccaaaggtgtgctttgaacgtggttcatttccttacgtgatgctcattgtgtaagcaacctttatatgtcagccatgatccccatgctgcttggacaggatttatgtcacattcaagttacaatgttagtttctaaactactcatttgtgggggcattgttgatgggagaagtgtccaaaaattgtattaatagattctctttacttttgttgtgagattcccatgccacccagtctttacacagaggttcagatcacacagttgtactctctcaaatgccaacttctttgtaggactcggctaggcaaggttgattgcttttctgtctgatcaaaggtgcacatttaactcacctacctaatctagaagttaaaataaaagcaaactatgtatcttgctcatttttagtgtataaaatatggatgtctgaatggtgccatgcatttcaagctctgtgtatttttttccctgttaaagccaatagaagttgcagagaagatccctgagaagaagcagcgcctggaggaggccacaactatctgcttgctccctccttgcatctcaccagccccaccccacaagcctcccaacactagagagtgagtttgccctggccctgtctgatggcttggtatgattgttcagactcctaagaaatcctaattgaacctgtttgggggatcttgccccagaagactttaaggtaaaaaacaggagtctctcagtcaaggcctgacagctgtccctggccactggtctaacaagggtgtgataaggggtagaacatatgctgccagaattggggtgactccatgagcttttagcaacatttctttactctaattcagatttatcactaaaattagtcaaaacgaacttttagcactcagtgaagggtaaaaggaagtaaataaattaacaagaagcatcaagagaacccctatcactttaaccagatcacctgcttctacccaacattcagttctgatggtgattactcagtttccctggaaaagcaactccttgatcttgacagaacgaggcagctgcttcctctttgatgtcattacttaacattcatatgaatcttgaggaccagtagctatgtccggaactccacagaagccaagggaatgaaaaaaaaaaaaaaagctgtcttttcctgacacagaactgtcccaggaggagggccactcccagacagctcatctctctggcctcctcaaacatgtcattccaaggagctggcacctgttcttccttctctctgtgtgtggaaggttccagagtccagcaggaggcctcctggcacctcctcactcaaacagcttgagtcttcttcagagaagtcctgccttctgtttctgccaagcattgtgaccaagttatttctgtcttataaatatcacttaactaacaatcatgtcagcaacttgaaccattctgtctgagtaattattgccataaattcattcaacattagagattacttccatcaaagccagttttggagcctattagcagcccagagcagagaggcaatctggctaactgcagctaacaattgatttcacagattacagtttaacatcagggatatggcatcaatctgctacagataagatgtcggaaataagttatcagcttacatttgtctggatctttgttgttttgagatgaaaggaaagaaaagatcaattaccactagatctggtttaactaataaggagatttgggtcctgggctgccccctgcccccaggatcagtagttattggtgaggttcatcagtattctctgatataagtttgctctgaaacatcccttcacatacatacttgaagttctcagaactagagacccttccagtggagcaagctgaccccttcacctcagggtagaccaggcatgtgaggaagcatgctcccctgatggtaagacgtggtcattccagagccctccttcgttgtttgcaaggaggaaggactaaaatggcatagctgtggtggcattgttccctcagtttccaggcttggaccagtttgggccatccagccttgccacagcctttggtccccactgctacactctctaggtgacccagtggcctgtcgccttccccatcttataaaagagagatgaccaagtattacataaaggcctagtcatttgagttggttcttaccaaatgtcacactcagggttggggtccacccccagctgaggtctgaggggagtgtgtggatgtggagcagggagcttggagaacactcaagagacagcaggtaaatgacacatagctttatttagcagctccttcactgggtgagtgttacatttatacattacacaaacaatagtggctgagagccaggtggtgagcttctctgtgttacgtcttcatggctatgattatataagacatgggactgtgcacttgtgccccaatccactgagtcatctaggctgtttacctcagcctatgcctgctgccctatgcctgcttggctgcagcacagccatgttccttacaccaaatggtgtctttaatccactatctttacaatgtctctgcttttctagtaggtgggaaagcagtgtttcccttgtagcctttatcgttcagaaagagcctcaattagtttcttacgcccatcaaacagatgagttttctctggaaaactttctggagttgaagaagaatgaagcaatgactgacctcttaggggtctcctcctgggaatcctctcctcaagctttgcacctttgtgccttattaacctttcaaacaaaatgggagacaacattcacttttctaaatgactattctaaacctaacaaagattccacaccagactatgacagctatagttccccatagttcaacagaaggactctcctggacctccccttcttctttagagctggtaccttcagcaggccctctgaggaattgagtgcaggtggtgatgctcttcttttgtctcctgttctactctggcctattggaagaggtacccaaagacgcaaaagctgcttttctagttgtaagtcataacaatgactgagtggtctctagaaaatgctccctaggtgtctttcaccaagaaagtccttaaagaccccgtggttccagatcatgaccaggcagatgtaaagggggccaggtcacgggtgctcactgtacagaatgcactgaatccccgctggttgctttagtggcagacaggcaggcattgcatgactgtagttgccaatggcaaattaactgcctctcagaagcagctctttcccttgaagcccccagtttctcctcaggcagctcaagtagtgggggagtatttacagctaatgaaccaccattcacctcctgtagatgccacagcaatgcttgacatccacacgtataaattcccaaaggcctggtgcctttgtaattattacacttaatgtgatctgcttgttgtggagcttcctcatggacaagaatcttaatccatatgttcaccatcattttaatcaggcatcactactattttaaaatggttatacatgtcaaagcaatttttcaaatccattggaaagtatttttaattaattttaatcaattgaggtaatgacagaaacagttgcgttttttcagtttcgctacacaacaaaaagtaacatagggccacatttatgaaacaaaagatggagaagatgacacatattacaattggcaattttgtgcaacacagtggaagtgggccaaggagtctgcattgacttctatttcagggaatcagaccacttgaatgcttgttcatctttgatttgttgctttgagatattgtaaatctatatttctagacactgactgaaattgaccaagaggaaaacataaattcttgttgacttaatttgccattgaaaattgtagtcaataatcatgaaaagtaaatagctgcacagtgcaatattagttgtctaagcaaagattaaaattcaagtaatcttcattgattagtctaagacagtaactaaaatgaaaatccatgacccaattaccatgttaagcagctagcataaggtttcagttgttctgtttcatttgaagtctcagactatttggtggtgcccatttaatgggcagataaatcagtttgaaagcacgggagtacttttaaaattgcagatgtctagtgtgaatatgacaaaataacatttttaaatggagttttgtaaagtggagtacatcagtacttcagtataacaatttaaggtcagaggctcattatgcttggcgttggagtagaacattctgtatatacaatttgcaatgtatgtcgcaatactatttagtgcattatttatttctaagtaatgcgtaagcataatatttcttaagaaagtattcttccactgattctttattgtgccatttattgcatgattgtgcagttaagtcctagggcaaaataagtaggaaccatcctgaaaaatgatgggattaaagtcctcattgtattttccataaaaatctaattaacagcaatcttgaaaagttgaaaatatcctactgtagcacactccattaggcatttacatttgtcatggagttctgctgcaaagacatgagtttattcttggatacatatgtatgcatatatctatatttatatagagagatatctatatctataaagatatctatatctatgtctatatgcatttttagatatgctcttcaccataggtagagggacagcaattaaaatatgacttcagcttacagtactagcatcatggggaaaatcagaataaagagagagaagactttatgacaccctacacttcttgtttttcacagaaataattcatccaggagagcaaatagaagaaaggaagaaaaactatttcctcctccactttccccactgccagaggaccctccacgccgcagaaatgtcagtggcaataatggtccctttggtcaagacaaaaacatcgccatgactggacaaatcacatctaccaaacctaagagaactgaaggcaaattctgtgctactttcaaagggatatcggtaaatgtaagcatcttggaagaaatattattattgtcaggtagaaacaagttaaccagctcatctaacttgatcatttggggatgttgcaggaggaagggaggaagatgcagagaagaaatatgagaggcctgtgtatacaaatacacaaactttccattatttctttttgtatagtgcctagtatattgtcacaaatcattagggattataaatgatacagatgttattatgacaatgataatgcttaaaagaatctgcaaagtcatttccacaagggctaaaatctactggggaaacatgataaatatattaatatttgctcctagaaatatatcatccttcttagggaaatcactaggcttctctgatagcagtgagcaaccagtgcctcttcttgggccattctttctattaatgatttgaaatctaggagactttgtggcataatttttgccttagcctgtgattaagacacttaactcttgtatagtgctagcactgcaacaaatttgctcgataactctgggccaatcatgaaacatctctgagataataaaatgaggggatttgactagatgatctataaagcttcttctagctccaaaaacgtttgcaattttgtgctcgcagagtcttctctattccatttaggcatgaagtcctgtttattgactcaacaggtgagtgagtgtggaaagatgacatttttatgtaacttacatgatcatggctgaattcagccatttccagtcagatgtgccaggactgacataaatgccgtgggtggtggatgtaatgtttcagggttcttgccacatatcttggccatagagacaaatgacactgtcttgggctggcctaactgtttggtctaggccaatcgggctgtggcagtggagacacgaagctggcttacaagttttttacggctctgtttcctttaaaatgtttgggttgaaaaaaaatctttattttcttcgtatccatcataacaatttgtagatgatgcataggttctcagcacatttatatcagtgagatctaggtggtaataattattttgtattcagaaggtccaggatgaagtgtaaaagatccacagaaatataagaaatacatttcacatttggcttttatctttaaagtgaccctgttgactatggcaagtgtctgtgcatatgtgcatgcatgcactcagcaaacactgagggcactgggctgtggggtggagggacagtatcgtaaatcagagatggctccagtgctcaaagaactctcagtctaaagtgagcaatgagacatatgctcaaaggactagaatataaaatagctggtgattggtgtcttagggcagggatagagacaggtctctgaatggtccaaggaggattaaagtacttctggctgtaggcataaggtagttttcctggtggaggaggcgtttcctgagttgatccttaatagatgagtagggtttaaaaatgaagggaagtggatgaagaaaatgtggtctatccacacaatggaaaaggaaggaaatcctgtcatattatgcaacatggatgaacctttaagacattatgctaagtgaaataagccagacaccaaaggccaaaaccatgtgattccgttgacatgaggtccctggagtagttaaattcatagagacagacagtagaatgggggttgcaagcgcctaaggcaaagggtaaatggggagacactgtttaatgggtacagagtttccgttttgcaagatgaaaagagttctggggattcacaacaatgtgaatgtacttaacatgactgaactgtacacttaagaatggttaagatggtacattttattatatgtgtgttttaccacaattatgaaaatttcaaaatgcaataaaaataataagttgaataaattatcaccaggtggtaaaaaaagaaacaaatgaatggaaggctttttgaaatctaaaacttcacatgtatcatcaaatcaggaaagtgaaaaaagcggggacatgttcagttcagttgaaactaaggttcatggaagggaacagtcagagattgggcagaaagctgcagccaaatcaggtagggccttgagtgccagcaaaggagcttcagccttgagtttgcatttgagtgcagagcagggagatgctaggaactttgttcaggaagctcaagctagcagacagcagattgagggtggagggagaagctagctcaagggctgggagtccagccaggagactctttgttagtctcagtgagaagccatgagggcctgcattttgaggctttgagggagaaagggacaaattcgagagatgttggggagatacaattaataggagtaattaactgcaattaactggtaatgttgagggagaaaaattaaagatgaaatagaggaattgttttcaagaagagttctaggagcattatcatttttcaaaatgaagtaatttacagaacttcaatatataaagctgattaaagcagagcagctcagatggaaggaaaggtggggagtctctaccttgccagtttcagtgccactagcccagatactactgcagttccctgtgtaactgtgccaaagtcagtttggaaactctttattgacacggagaaattcagctttgatgacagggaagaccatcctgccattaacagaaagacgaaactggtttgattagtgatttggtttgccaaaaatttgaggcgctaatggccatgttggtagaattgtcctaagatggtcactgtaggctggagctttggagattgggtaagattgaggtttccatttgggtgttacctacctactgttgaatctgtgccaacaacacacaagattgacagatcatatcaagaaagaagagaactgcggagtgaactttggggaacaccaacgttagagagataccaattcagaagagcagaaggaagaggaggcaccatgggaagtatggtcagacagagaacagtcaggagagtcccacagttgctgggggcgggagggcagagtcagccacttgaacatggcaggtagtcttgtgataccacactgtcacataattacagatcttaccacctcctttctccatcctctctatagcaatgacagttcaaagcaaagcccttgtaagtatcttacccatttgattttggacctggtagaaatgaggcttcaccatcctaagattgcaaaacaaaatggagacacactcacatttcacttagctagaaaccaatcaagcgcctcacatgaacaaaagggcggcttcaacctcacttcagccagggcagggatgattagagtacaatttcctagtattttgctggactgtatctggtattttgcagagtgacctgaggacgttacttaccctagagaaagcttctgggttggttcccttatcaaaaatacccacagcggggtcaagggatttatttaatatctctatctctccctctcgttgtccatgcatctcttcctttctccctccctcctcctctctcctctctatattcttccttccctttcccctcacatttatcactagatttagacctttgctgtggctgtcttaatgggatggtggagctatgtaatggcagcacccaattagcttgatgtttggtgtcataatagaacaaaagctggtgattcatggcgttcataaaatatccagggtcacctatttatcctcaagctgtgtgcattgttttctttctttttttttttttgccttctttcgtaacgtgcttgacattcaaagcatttatgacaaggtgttttaaaaagctggacctaatggaaactatttgtcctcctttttcccaggagggagacactccaaaaaaggcatcctctgccaccatcactgtcaccaatactgctattgccactgctactgtcactgctactgccattgtcaccaccactgtcacagctactgccaccgccacggccaccaccacaactactaccactaccatttccaccatcacctctaccatcactactggcctcatggatagcagtcacctggagatgacgtcctgggcggctctgccccttctatccagcagcagcactaatgtccggagacccaagctcacttttgatgactcgtatgttgttccagattatcatggacagtttggagtagtgaatggggggtgggggtagcatggcttttctagtgctgtgcatgtgtcaccccaaataagacctcagcatcaaatcctatacccttaaaagtccaccccaccccctgcatacacactcaccactctgtccccaccaagaaatgtttttggcccattttaattaagcagcattgttactgttccaaaggcaggttgttctgtcctttcctatccatgtcctcacatataaccaacacacagatgtatagctaggttttgtttgatctatttggacaactgtaatggttggggttggagcatgtggttatttatcctaatgggccattatgtacttcagatttcatttacagtattatttcaaggttggttatgatatgaatgacagcattagtctgcctttttcaaggcattatatgggaataaatttatagcagaaaaggtttgatgattcagtcttttactgaaaagatgaagcattggtttctgaaagagcttgttttgtttatttagggttcacaatgctgattattacatgcaagaagctaagaagctgaagcacaaagctgatgcactggtaagtttcctttttctcattgctttgttcctattaaggatttatgtttcaaaggaaaacaaagaaagcacttttccaaacaaattttcagtatcacagcccacacctgcctgtcaacacattgctgccctgacatagggagatttgaactagtgaattacttagttctgtaattcccaaagttctcagggcttggttatcatgtcatttgttttcccactgttcttccccttaccccaacttcagaagctcaatggcatataccactgtcattacctttcaagtgattttggaatgacttatgaaacttccctggaaatgatgtgcttttttggtccagtaagccagaactcgtgtgggaatgtgagagttgtttagagctgtctaaatggcctcaaaaattggctttgggaaaactaggcctgaggaaaaactcagctccttgctgcatttgatgacatgttttcagagtgagccccacagttaggctggggccccaagcagagaagagaaatgctgtcatctggatttctcaagatactttgcccagctgcctccaagggttttagccacctagatcagtcataagctcaacattttgagttgtttgatttggttgaggctcctaacagtgggtctcaaccacacatcacattgaaagctttagaataactctgatgcctagcccatatcccagaccaatgaaataagaatttctgggactgggacccaggaatgagtattaaagctccccaggagattcccaattgcagatatttgagaacgactgtcctagggaaggccctaaattcaggcttctcactttgactaaaccccattgggttaaaaaatagcatcctcaaacattgcattgtgtcctgctaggacttagttgtcccagtggtgtttgatactgggaatgctgtgatgaaataccatgactagtgtgtagccaacatcaactgtccatggtccttacatctgccttttccctactttctgtcatttccccactgtggtacaaattgcttcgtgtctgcaggtgacctttctgtggtgtaaattgttccttagaagcaattttcccctgctcctgcagacaaaaatgacaaggcaggctgggtgctagctccattggagatgccaggacaacagtgcctgtgaccattgtataggtgatgagagatttgaaaggcactggatggtaatgctgctccctcaaagaccaaaggttttctctaaatgtcctcaattctgtgacactacagagcactcaagtgctcctagggtttgccatctgtcaaagcaggggttagggagcatacacatgttccattgacaagctgttacatgagctgatgaagactgggatatacataggagaccatgtaaatgaaatgtttgaagaactgagaaaaatcggtaccacagacatatatacatatgattatgaactaacatcactctacattccaaggttgtgtttatatgtatgtctttcaagggatcacatttggcctaatccatttagaatatgcattcccaattggggagatgctgcccctatgggggtaaaaattggttttggagatggggtgaaaagatcttagttattgcaatggggtgtgaccctccaaagggccacagggcataaagagagaataagtatatttcttgtattaaaatttcattgggggtacgtgaaaaaatacagtgatccctccgtatccatagaagattggttccaggaccccctcggacaccaaaatcctcagatgctcaagtctctgatataaaatggccatttgcatataacctgttcacatcctctaatatacattaaatcatctctagatcacttataatatctaatacaatgcaatggtatgttaagagttgttatactgaattgtttagggaatgatgacaagaaaaagtctgtatatgttcagtgcgaatggaaccattcatttttttctgaatatttttgatttaagattggttaaatccatggatgcagaacccacggatacagagggctgactgtatcttaaaaattccttggtggtggtgggggggtgatatggaaaaacaaggttgaggaacacttagaggaatgatatttttgctaggcttatgcatatattagcctgggaagcacccttatagtttaagccactcattttatggatggggaaacagtcccaggggtggggggcataacttggctattaattggcactatagtcatgtaattttctgtctggacatcagctactcctagggacgaaggggtttaggctaggtgatctctacagatctctccagctattgggttgtgaatgaaaagtcactttcagaaatcaggatctaagaacaatttccaaatgggagagccagtggagccagatgacctaaggaaattgtcctgtaaggcaaaagagaaagtacctagtttgcatatatgtacacaggttttcacaaaatccgcttgaatttgattgaaaccgatatttctccacagtagcttacagaaagaaaaccacagaattcctgcagctcataaaagctggagaacatttattgtaaaaagtcatttacaataaaagattctgcaggacctctaactaatcattttatagttgtacttaatcctttgctagagacagctactctgccattttgagaattgaaactttcacagttgcatagaaaatattttgataaaaggtatacaagaaaattaaaacagctaaatctgcattatattccttcttttacataaaataccatattagtggaattcttacatcctgctatcaaaaattgaaaatgttaaatcctgttataaaatactcactataaaagtgtcatgtataatattcattacacataaaaaagaaatcagtatgtctaagtcagtttaatcatgaccattatcagggctaaaacctttgcaataaaattttaccaaactaaaatatttagtagtactatattttttggctttttgacacactatttcaaactatcatttataatgaaagtgatgggattattgtcaacagtcatactacagcttctcatctttcatgacaatagcatcaatttgttaatcttctcctgagagtgaaattgatgtcctcacaaagagttctaaagcaaaaatgtatgtgttcattgtccatgagacttctaaaaagcagcccttagttgcaagtactgtctataggacactacaatgagcagatagtttagtaaatttcatgaatagaaactagttgaggcaatgatttggattcaggtccaccaaaaagatagcaataacagcaacaacaatgccacaaaccacatatgataccctgcctgcatttttctcttctcaactagccttggtgtcatgatgatagaaccttaagccggtaacttcattgtttttttttttttttttttgaaaatagccaatcaagtttatttataggtggttaactggaatatatattaagaatagttgggcattgaaaagtatacataggcagataggtggcatatagttggctaagtgttgctaataagtttgaaaaaacagttgcagacatgtcactgtccttttgtctaagtgaggcgatacgggctttatgcccaaaggaaaataggaaattaaacttttttttcatgagactaggtatcggaaaggccaatcaatatctttcaggtcaatggtcttctctgggatttgagaaattgactggtcctctatgtcatccagatttatcagacaatttctcccctatcttgcttattaatttggtggaaactgagacatgctttgttgtttcttgcctctggaggggacagacccttaggtagaaaggaactgtaaagtgcctccatcaccttcccgcctctcatttctccctgcctatattaatgaaagaaaattgaaggcagggtcccaaggcatgtcaagaagaattgcagattaagtaatgttgttgtgttattttaattagacaggctttttcaatcctagaaaatatttttttttctatttcttttttttttttttttttaatttttttttttttattatactctaagttttagggtacatgtgcacattgtgcaggttagttacatatgtatacatgtgccatgctggtgcgctgcacccactaactcgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttgttaaatagggaatcctttccccattgcttgtttttgtcaggtttgtcaaagatcagatagttgtagatatgcggcattatttctgagggctctgttctgttccattgatctatatctctgttttggtaccagtaccatgctgtttgttaagaccaattcatacattgtcttctgtatcagggtttcttagcctgggcactgctgacattttgggccagctcattctctattgtgggagctattttgggcactgcagaagtttataagcatttctggcctctgttcaccagatgccccctctccccaggggtgacaactgaaagtgtctccagacattgccaaatgttccctgtgggaagggggcaaaactaccccccagtttcaaaccactcttttatatgaaggagaaaacagagagtattatcttgacgagtcatcttcctgtttcagttcgagaaatttggcaaagctgtgaattatgctgatgccgccctctccttcactgaatgtggcaatgccatggaacgcgaccctctggaagcaaagtccccatacaccatgtactctgagactgtggagctcctcaggtgaatggcctttctgcaatcatcttcctacactcatttcagctagaattagaagctatgttttaaaaaatgtatcatttccacttattaataatttgtccaagccatcctcttagaagtcatcataattagttcttgccattttattaatatcatggaaaatttataattgatggatgctgactttataaattatcccctccagaagttataatgtgagtgttataattttcaatattcgtaacattaaaatggaaatgtagtgggtagaaataagtataatcattttaccatttagcattgacttgtcttttcaaaggtgcagttttataattcaaaaaaatggtgctctcaggatttctattacaaaccatgttttctaagaatttttatcttggttattaaaaagggaggggcactgttccaactcagagttggtgtttaaggctgcaggtgtggagtagactttccatgcatctggaattagggaaatagatgaggtggtagtaggggctggcggtacagatgagaggatgagaataagagaggggatattaactgcacacattattggtttcatttacattttaaatgaaattttctggctgttggtcttggtggtgtagaaattctgtgttatcaaaaaattcatagaagaagaggaagaagaggtagaagaagaaataatccattctggtgttatccagtgatttgcagatatttgtacaataatttaatccacccctgaatagtggataagcaccatcgttcactagatggactaaataatcacttttgattgattgagtaagcagttttttacctgaaaagtccttatgtccagtcccatctggcttgattaatcaataatgccaggactggtttatactatctatcttgcttgtacctgcattaactgttacaaatctgaggatatttgtacctaaatcttcagacaaacactggacagatttagtgtgcatattttcccagtgacacattccaaaagataaaaagaactatttttttaaagcaactctgctcacatagaatcagaagtttagttagagccacaaaagtagggtgattataagggcagctctagccttgcctgctgagccaatcagccatctttctctttgcactgctctgaaatgtaggcactgagaaaagtgtcaagtatttctccttgacttattttatatactgtgaaaagcaccaccaccattctgtagctttcaaggagaaattgattgcccagtgtctagtcaaactacctgtgattttcaaagatacacaagatgaacatactggcaaaaatcataaggattcaaaactgaagggaaacattagtgaacaaacacagggacaattcatgctctctattcattcaaaaatgcaaattaaaacaaggcactttttaaattaacaagaaaacataacaatgataatatctagcactaaaaactacagcaaaaaaaggcctagcagtgaactagacctctcctatgcagctgatgggaatggaaattgattattgtaaattgagggcaatttggcattgtgtagggaaagccatacaaatgagtattcatatcttttgatccagtactttaactgtggaaatctgagttttctctcctgaagaaaacaattgtaaagactagaacaagtaatcggtatgatgttcaatttgacattatatgtaatagcacacaattggaagcacaccaaataataatagaacagtaattacatagtaggacactcaacagaatactttgcagcgattgaaatacaacaatgacagagactatgcagccgcacaaaatatatttattatatgatgttaaaataaaatcgagctgcagaataacatgcacactacaattatgatcatgaaaagtttgtatatgcatctgaaccaaactggaagggaaatgaaatcatagctgtaataagtcagtgagattatgggtgatttccctctctgcatattcttctttcttattttcttttaagaagacacatgctgtcttaaaaatatgaaagtaaggccgggcgcggtggctcacgcctgtaatcccagcactttgggaggccgaggcgggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaatatgaaagtaaaatacaaatttcattttatggtaaaagtgcaacgtgaatcattaagtaattttcttttaattattcacgaaaaagttatttagggaaaaaaacatgatttatgttttattatatgctattttacttcccatagaagtttatttcaatgaaatctgaaagtcaatggagaatttacgagcattcactttaaagtcagtgtttttaaactttattttgaggtaattgtagttgcacatgcagttgtaagaactaatacagagagttcctgtgtattcttcacccagtctcccccaatgggaacatcttgcttaactatattacagtatcacagcctgaacattgacattgaaacactccgaagacttcattcagatttcaccagttttgttttgtttccaacttcaccatttttgcatgtacccatttatgtcttctctatgttttactttttttatactttctgtaaattacatgtgtgtataatatttttttaatgagaggaatttcagttgggaataaaatgagttaaagcaactaggtcttctggtccacttaagcaattgaaactccactatcaagtcacttcaaatgtggttgcaattagagggtgagtgtaatgtgaacatagtttttagtagtgcaatatcatgttgaagaaatttttattactctctccccgacagtatgctggctacagagagagagccccattttcttcattcaagtaattatagttgctctgagctctgggaatctgcaatagaaatgtatttgtgaaaacaagtggggcatcacaatgacttgacatttcagtgatccaactgtcaaagaaagctagatttattacataataaaaattcctttgcttaatattgcaacaaaggaagggacccacgttaaatgtacaagtgcctttcctggaaaatgttcactcaacagaactagagcaataaccaggagagcaaggcggctagaatgctgaggaggccgagtctcagggggtgagcctgggctccccagtgttctgcgggggaaggttgctgaaagcgaggagtcaggcatgccagctcagtggccctgcaggctttctgtcgccttcttataaatgagaactttcaacttccttctgccacactgaactccattacttattctactacaagtacctgtgaaattgcattaaagctcagacaatgattttatgcaatgaattgattttcaagagtctaaatgctctgaatggaatgtacttggctagaagaaaaaaaaatgggaactactcaaccttttatcaccccagtgcagaacagtaacaattaaggagaatagaaagacaaaatatacaagcatcataaattaagggtgcttagaccttaaaatgctgtgaaatcgaccttcctttaaaaaaaaaaaccaaaccactttcaataggaatatattcaaaacctgagccattagaaaagaccttttagctgtgtgattgaggtctccctatgctcatgtcagacatagttatatattatttacctaatctgtcataaactgaactgaaactgacattcttgtccacctctcattgaaaaccagtcatagtatttagctacagtgttcctagaaacagtattttaccagcatttagacacacacacacacacacacacacacacacacactcacggtaattccacagcattgtcctaaggctcatgatttcactgctttctccagagttcaactctgtatttcacatgagtcctcttatgacatttttatcctcattttgtgtatgttttcggggaagcatgcttttgcccacatgtaccagtcagtcctcttgcccagaacaaatgtgggaataactcattcaggcaatcagaataccagtgactttaggcatttctgaagggtaatacagattccactttagcttttcttttctcttcaaaggtatgcaatgaggctgaagaactttgcaagtcccttggcttcggatggggacaaaaagctagcagtactatggtgagtcccatggaggccacaaggaaattgctgaaatgtcatggaaggatttgaaaactctagatcaacttaagctgcttaccccagatcattactcttgttttccattaaactattaaaggataactaatggatttcttcagtcactgactaaacatttactctcctaacttatacccttatcaaaatgggattttaatgcttgccccttccctctttagaatttctttatttacttatgtttctcaatctaaccataggaaagtaactgcaaattgtgaatcagcagtcttcttaacagtttataaagtttcactaagcactggcattaacagaagcctttcctcatcaccacagctaccgatgtttatcactcctctatttgagaatgtttaagctgaagaaggaccatgctatgaagtactccagatcactgatggaatattttaaggtaatgcttattttgtataatttataggtacaggatgataaaatcactaataagacacgacatgcaggttatcgaatgtcaaatgctgccaaaggcttaacctctctcctccctgctggccatggccgtcctacccttccttaagggctcagcaaggagtttatggctgatttggttccagggagagaaggcacgatggtgcaatctgctgacttttttccagactcaccaaatgacccttggcagtctcctggttgcagtgaggagtatgtcacctttttgctgctctgtgaggtgggcacagcttgtggctataggtttggccagtcttttgttaaatgataggtcagcccaggaatctctcagaagtgagagaagtcactgtggccaccctggctctatgtgcacgtccacaaccctggaaggcctttgtccatggggagtcttggagtgcagtagttgtaattaaaaacaactgattgctttggttaccaaaacaaacaaacaaagccatatcgtagggagctggggcttttaacttataagcacaaaaaatataggcaatctcaaaatgcaacgccaaaatttgagaatgagcccaggtaaaaattgcaaacagcaacttcatactaggcctgatcactgtactctccaacaacagtcatgatttagagttggggagactcaagctccttctgttgggcaggtctaaaaagaaaaggacatgattttttttctttcttgccaagtgcgtgagacctcttggctaaatcataccaaagtagttgtttgaaatgagcgaaattatggccttatgtgaaacatgcagtgagtggaagtgcacagctttatgacgacactgtggcacagttgggaaaaagagcatgtttcccagctattatgtggtgtggccataatgccataaggctagtattgatgtgggtaaaagggagtcatatacaacaggccctcttctcttcatatgcctacactcttaacttctgctttagaaagttctttattgaacttcagtgggcatcagaatcccccagagggcttgtgaaacaagaatgccttgccccagctcccagatacctgattctgtaggtctgaggtatggcccaagaatttgtattgctaataagttccctggtgatgcttctgctgctgttcttgtgatcacactttgagacccactgatgtaatatttgccctctttggcctaccctctatagtttacagggtattgtaaaattccaaacaaatactaaataattcattcatccaggagtatgttgagccttcttgagattaaaaactggagtctgcagaatgcaccttaggtgtgggtctacaaagctccagagaagtattccgttctcactggactcccgaaaatgctgactctttccctgaccctcctttcgcaaagggggctgggctagcagcaaagaggcagaagatgagcatcactggggatgtaacttccgagagcaggtctgagtcaggcacagtgccatgagtgtgagttgtggccatctgtgctgcttgaccttccacctggctaggccattacaatgagcctgatccctgtcctgtagtggtaatgctgaatgtcagttttccctctgatccacaagtgtgtggtcttgaaaatacaaggaagcccatcctttaaaccagcccacttccatcagaggaacaaaggcatatttagtatttgattgcaatgcagccctggaccagtcactttgttaaatagggaagctctttagccatgagggtttgcatgtaaatagagcaaatcaaggtgattcctgaaaacaaacaaacaaacgaaaatactgcttggctctgacacattcttggattattagaaatgacagctcactctgcatcccagggaaaaagtttgcaactggagctaaaggtgaaaagcttacttgcactctgaagagcttgtttggcagaataaatttcagatgaggataattaaaccacttcttggagaaccgagtctgatttcactgggccttttagtatataagatctttcatcaagtgactttcatggtcctgattggagcccactaattatcctaaccagctattttcatcgagtgtgcgtcgtggtgtgctgacgtgcacatacatcccagctctgcatcccgaaatgctgcaatcaatattaatgtactctaaatcacacttccatctgtttctgaattaataaaacacaaaatagatgtccttatttccctttctcttctctctctcttttagcaaaatgcttcaaaagtcgcacagataccctctccatgggtaagcaatggaaagtaagtattttctgaaaattgctttttcgtgaagatgagtgattcaatagaccccaaatattttgcattgacaagtcaggagtgaaggtcaattctagaactacagtcatttttgtgcatacaaaattccagccaggcttcggctaatggcaagacagaaaagtttaaaaagatgtggttcagagttatttaactatttgatctttaagccaaattatagccataaaaatatctgctaataagatggcaagcaccatgccattttagggaggcaggacaaagttaactccactgcagtgatttttcaatgattcactcaataatgaaagaccaatgaaatattcattgatatatggtaagtgctgtttaataaaaccaaaggcataatagtgctgaaaatgtgaaggcacttgctcagccaattatccaagccttcatgataatttttatattaatactaaaatgccctagcctaagatagaaaagcatccactataatgctgattggaggctcagggaactcacctgcgcctgaggccttatttagagttctatctgcttgggacagctcagtcttaatagcagtggagtaggggcccaaaaaccgttgacctggtgctgaagctgcccttggcttccagggtaagctaagagggccccttcctctatctgggcttgttctttatcgctaaaatgaaggggttggacccaatgccctcgaagtcccactgaagagatgtctcttatagagagtgagttcgaatcccagttctgtgtcagctgtgaagttagctaacttgcctgagcatcagttcctcctctgattccaaaataccccttaccagcccaagcccacacccctcagtgatgggaagggaaactagatgactgtggacatagaccgctttataactccaagctgctttttcagtttttcatcatttcaaaattcctgcatctctgatcaaaataatttcttcaagaataaaacagtctctactgccactttataaatatctagaaaacgtactccaaaagcaacgggacaatgaactctactttgaaatcataaaaacattcagtgcgagggaacagatccattgaaaactacacattaactcaattacttcactgaaaggaagcactgtttaaaatgttgaattaggtcttactcttatattgacgaacaaaagagaaagagtgcttctctcttaagagaaaaaataagttcagaaaataaaaataaccggagaaaggcccagctctgttttccctgagcacagagtaaagtaagggcaagggcaggtaagcagctattaaagaatcactggggaaaaaagcgtttttttaaaaaaaattctgaaacgcaagaactcaaacacaacctaagcttgggaagttgcatgaaaagcctcctgaaatgattcttaagcagattttgcatgaagaaagcacattccctttggtaggccacagagcttttgactgaggcaactcaaaacagtcactcaggggttatgtctcgttcattcagcaaatgctttgcgtgcatctgtagcacgatgggctggggacagaaagctgaatttgatatggtccctgcactccagaagcacacagtccagtggaaggaggtgacaggtatgaacaaggtgctgtggaagcctaggagaaggagcttgggcctccctgcgtgaccaggaagggcttcttgtctgcaagcaagattatggccttgtttctctgtgaatgagggtggtgtcccccaaggagggctctcacagcaccttccaggagcagcaccctctgacttcaaaccctcctaggctggctagcaattggggaagtcagctgcccagaggtggttaagggctctgcaggaaattatatggagagatgagcagagggttaagaacagacattcaggaactgcttccatggaagctggagaaagaaagtgcaaagaagcaattggaaggagaagcagaaaaatctgctgagtttacagcaggggccaggaaactttttatttaaagcaccagacactatatattttgggctttgtgctaagaggtgaaaccaaggctactatgtagaaaaatatgagagaaaacaaattttcacaaaatttttactgataagattcaaaatataataacaattacatataatttttgaaatacaagtctattggtgagaagaatgtaaatctttttcataacattttgcttaattggggttcaaagttagtgttccctctcaacaaatcgattgcaaatgttcatctttcgcaaactattcagagcttacaggccatacagaaacacaagatgggccagatttgctgactcttgacacagggttctggaatccacattgtggagagtttaaaaaggctgagcaacaatttcgaatgtcacagagagataataaaaagaaagaagctgggcaaacatggatggcaggactttgaggtgacatggtggaatggaaagagaatgaagagaatgggctttggaggaaaatggacctgctattagatcctggctttttggctctctgggctctgtggccctcaggacagagctgaacttctctgaggccagaaacagtggcagcagaactttccctgcagagttatggtgaggcttggacagaatattggtgaagccctgaactatgcttggcacatagagactgtgcaacaaatgatggctgctgcagctactgttgccatgattactgttgtaattgttacctatttaagttagaaaagataatgatcctacctctagaattcccacagcacttggttagcaccacagttttggcacttactccagattgccagaaaagaatgtaatttgctcctctagtatactctttgctcttttgcaataagtagccatccatcctatcattccccaaatatttattgagtgcctaccttgtgtgagacactctgccaggccttttgtagacatatcccctatcctcatgctatatatgctcttctccttctaccttccagagcactttatatgtagtagatactaaacaaagaatagaagcaagtcattcatttattcagctggtgttcattgagaacatatacgccagacactgttctagatactgaagtatggcacagagtgaaatagacaaaaaaaaaaaaaaaaaaaaaaaaaaaaaaactgccctcatcaaggtcacattctgttgaaggagaaagataacaacaaacatgtggcatactaggttgtgggaagtgtcatggagaaaactgaaacaaggaaggcaggcagaaagggctgctgaggataggggagggagcagtggtaccatgctgaatcttgagtagggattttagagaaggatgatggtagagaaagccatggcaatgctggaggagtttcttccaagcatagggatggcagctgcctctgaagcaggagggagcatgcctgacaagttcaaggaacagcatggcagagtgtggcttagaggtgagaggatggtgggttggaccagggtggtagtggcggaagtggtgggaagcatgtgcttctgtgtgcatgctcatttgcatgtgccatggaaatgtggaaaaaagggtgagatctgcaagcagatacacacaaagaacaggaagggaaaccccacgcagtgatgagagctaagtcagagttggagagcacactgaagtgagtgggccctgcatcagccctctcttagccgcagtcacaacttcttaggcaggttttcatttaatgagcacaaggtagtgtgcagacatgtgcatcagaatatgtcagaccttagagcctggtgtgagaacagtaacaattgaaaacagacacttatcctagctgttcttgcctccaccactgagtatttaaaataaataaattagagaatagtagggagaaaagtccccaataacacttcagtgtaataaagtaaaaagggcttttcaagatgtatgtggtaaagagagatgatttggtttctcctgtgactcctggacatgattggaaatcattgaatccaaccttttcttgcagtcaagaaaagtaaggccgagcaaggagaagggatatgctcaggggcacacagcaattttatggcagggccagggctagagtccacatctcctgggattccagcacctctttccctgcaccatgtggtctctctttcccttttgttttctttttttctgtcttttttttgggagatggagtctcactctgtcacccaggctggagtgcagtgtcttggctcactgcaacctctgccttctcagatcaagtgattctcctgcttcagcctcccaagtagctgggactacaggcgtgtgccaccatgcccagctaattttcgtatttttagtagagacggggtttcaccatgttggccaggctggttttcgaactcctgacctcaggtgatccgacccccttggcctcccaaagtactgggattacaggcatgagcccctgtgcctggccttttttttttttttttttttttttttttttttttttttttatgatacagccttgctctgactcccaggctggagcacagttgtgcgatcatggctcactgcagcctcagtctcctgggctcaagcaatcctctcgcttcagcctcccgagtagctgcaactacaggcacacgtcacatgcctttctaacttctttcgacatttgtggcacatgacaactttgtcattttctctaagaattacagacgagaaagtctttctttcttgccataaattgacatttaagagttaatgactaacactggggaaaaagactaggaaatagcttttgcaacctaccacaacaaagaaacccagctttcactgcctttttgtcatttcactgtcttctgtgcctagaccccttagcttggacatctcctcatcccactcctaccttaagaataaatctttctatcaagaagtgacgaagtagctcagaaattataaacatagcagaaacactctcgaacccattcacaccagacaagcacagagcaagtgtgaggatgaacttgctccctcagaccagaccagaacataccagaaaatagatggtttgcagaaatggtccaactctgtcctatagctgtaggcacagcctgtgtgagtctcaagagcattgcagttgtaattgttcccagatctagtcagcagcatttcagcattttggtatgctacaattgctgtttccccaaatcatctgtatgtgctgcccgtcagggtgcacatctgttctgggagccacactggaaaactagagttgccaacaatagcaactggtaagggggtggggggtggggcagaagacagagttccttgattgtgtgataaggtgtgttcagaggaataatgaagagattctttcaaacatgcagactcatggagtcctaaagacatcttccctccatttcatttactcactcattatgttctgtcctgaaaaattgatgcgtttgcctgggcagatgttcatagtgtgactggaggaggagagagaaccagaggggcacacagaccttgctttagtgactgttcctgggcaagccttcaggttccttaggtagccagatctaaccctgggccctggaagaaaaacgacccccatgctgtatacagccagcaggtgactccttgttgcgaatattaaagaatataatgaaaatgtgtgtctaaacactggtactctctgaagtggaaaccctgaagacttctttttataaatcagcatgcaggtaaatagtcagcaattaacagcccatctctgtagcatgtcttaaagaatcctaaagagagagaatactacttttcccagcttcccaaatactgctccttggggggctgtaagaattgcactttgcttattgtggtaacagtatttggagcaaactgacattgtggtttccacaaaacactttgatgatagaccaatattggacatcaagtgttttctaactgctgatagccgttccggcagcaggtagagaaatcatcatagctctgagctgtttctttctctgaaacatcacaacacttgttatatgtattcaaaggaagagctatatttgtgggtagaattaatgccagagaaatatccacccagccctctctggtatttgaagacaaaagcagtggtgtgcatggagccctcggtggtggtcaaaggcagtggagactttggtgtttaatgttagaaaagaagaagagtgggcctcattctatagtgtggcactgtagctctgggtggcttggtcagatgaggcaggtatggggtggtaataatctctgtatccactagagcccctggaaaaagctattgtgttgacaaaagctattgcattgacaaaagctgtagctgtactgtgagaagagtcagtgggatgtcagaacaagctccactctgatggggcttcacatgtgtacgctatgctaaacttcactccagcaaatggcattctgatgagatcccagcgtgatggggaaggcctagaaccccactgtcactctttcctaccagcctaacaaggcttgtctctttccatttcccaggaacactccatccccagtgtctctcaacaacgtctcccccatcaacgcaatggggaactgtaacaatggcccagtcaccattccccagcgcattcaccacatggctgccagccacgtcaacatcactagcaatgtgttacggggctatgaacactgggatatggccgacaaactgacaagagaaaacaaaggtatgctcatctgttctacccatatagctcacagaccatgatggagttaacttcactttgaaggacttgagttgtacttggtggccttatatctttctgtctctctgatttccagaacttagataagggaagacagagttcgctcagggctgacacagtgacctattattcctgagagcataaaaaagccccggaattttgtcctcctttaaagcttaaactcatttgaactgtgatgtgttttgaatttcactcactgacaaagatcaacacagagaaacagaggcaaagacaaaaataatggtttacaattaattatgaccctgttggctcctgttattattgttattattatttttttgagaggtgaggttgaactaaggccttcaaccttcaatataattattagctccagttgagtacacgataacgcagcttgcatttggaagcaagggccaaagttcagctagtacttttcacacaccgatggctgggatgaagaatcagggtgctgttcatgatgacacttgaactttgctacaaaacaaatgcaaagaggaccctgctttaccagagtgaatccgtggtctttggtgactcatgcagacatctgtgaccttagctgtcattgaggatcacaacaaagcctcactaccctaatgaaggtgggaagtaaaattaaactgcacatttgtctcagccattcatttgacttggctgattctggcccagcagtcacagactgctccacaccagtcaaggtggggacaaatgtgggctacccattactactgtatcgctgagcatgtggggaaaccatctcattggaataggaaggatgcagattttgcaacccaatcatttaagtttgaatcctacctgggtcatgcattacctaggcaacctaggcaagttaattaaatctgtgagctgcttcctagcttctgtctctataatggacgtaatggtgatgatgatggtgaaacgtcccagatggatgatagagatgggttgaattaaataatgggtgtaaagcacctagtataaaattctgagttcaaggtagaaattctacaaagatttattatctttccttactccataatattatgtatctatataactcaaagattttgtggctcacaaagcacattccataatttgagacctcacccctcaacgcagctataaatttacactgactcctgggaatatctgcatgtattggttccacaggtttgtgcagcaatttctatgtgccaggaactgcactattgctttatcatttgttgtctcatttgcccttatttcatacatgaggaaactgaggctctatgagattaagaaactcacccatgttatcacagctcttgcttgttagaagcagaaatctagaagtgtctgattccagagtctcatttcttaatcaataggctacactgcccatctagagagcaagattaatgacaggtcctcagagacctttggtgagatcccaaaccagttatctgagcaatggataattattaaattgtctacttttctacacctctggaaactcagagacaactggcctatacaaccagactcatccaggggttctagaattgcaagtgaagatagacacatcttaagatttgcctagcatgtctgcctctgctatttctctcttattttgtattagtaactggagggcagttcaatatttatggatttcctttatcattgcatccattttcaaaatctgttaaaagtatttccttctaaattaactaacttcagaactttccaggagcaatgtgatggctgtgctgatgttagggtgaaatggtgttaatcttgtcattagcacagtgtgtcaaagagttgctaaattccctgtgtcatcttgaatgaaaacaactccgtcactctaccagcagagagaaaatgtgtcctgttaatgctgtcattggggttttcagcggactggggagaagactagtgtgaaatcttctgctcaaagcctggagtttcatactttgtcatttctgatctacttagctttggggattctattcacatctaccttgtctacatagaaaagagagaactgaagagcttcccttttggttgcagctctgcatctcactggagacaaccacgtatttgcacgttttttacccagtggagatgggtgaagttggttctcccagtgaaaggtctccactcctgcctcatactgcccacaatgcagctgcagatggcttattgtagaaggttctggtgctgaaatgagccaatggcacttatgctgccctctggcctttggtctagaagcttacctgcccagctgcttatactgctcatttggagcagttattaaaatggtgtctaattaagaatgccacagagagctttgtacagaatacccagggaacatcctggctcatatgaggctcacattcattcaacaatgactaggtccttaaatgttttccttaatactgtattacataggaaaatattttagatgccagaaataatttactcttttatcagcagaaattattttattgcatagtacaggttaaaaagtatcatataatcaaatgaggttgacacctagagaaggatcccatatgttatatataacatgaagagtaaatgcattgtttgatgaaattccatctgctgagcaatcaagcacatgtaacccatgcatggaaatcactttccaagaaggcaggagagcatcccacgttagggcagtctccagtcctatcccctcaccccaccccctgacacggattccttgctgccagccagcacatagctgaggctgcttcctttgccagagagctctctcataactaagtgccaggcaaatgaattcgtacatgaaaagggaacacctagctagtttttagagatcatatagtttttcccacatagtacttctatcgcctaaggcagacgttccaaaactccagtcgcgctagttagtagtgtagcctcagggctgcccccttccctaagtgaaccaaggggaaatcagctgggcattcttaccattaatgtcctaggtcaggggctggaaaagttgttaagtgacagatacttgcaggccattttccatccccaatgaaattggtaagaagacttacagaatcaaattcctcctagatgtttatttagctgtggaggctgacggctactattaatgtccagattcatgggccttgtctagaccatgccaagaaaactcagtaaactcggttcatttagacaaaaggaaaagaggatattttcaattcattaacacattgaatgacaaacagcttgacattagatagaccatggctccctacaattttgtgtagaaatacccttttctaaatataaatgtataatctatgaaaacataaatgtattatgtactgcagagtttttggagctcactaaagattaaaataatagggcttgataaacttgtggagttttggtctcctagtaggcactctataaatgtttgttgaatgaatgaatggacaaatgaatcacatttccattgtccatgtggttgtggtgttgtgtgaaagcagcttctcaatgtggtgcatattttcatgatatcatataaaggcctaactgagaactgctctgcttttcagaattctttggtgatctggacacgctgatggggcctctgacccagcacagcagcatgaccaatcttgtccgctacgttcgccaaggactgtgttggctgcgcatcgatgcccacttgttgtagtgggtgttctcagatctctagcatcacgacccatcactctacctctaccagcgcactgatggtcactggtggaactccactcactggggaacgttctctttggttatgtttgtttttatgcttcttttgttatctgtaaaaaacagaagtcattgtaagttgacactacaacttaagggcagtgtacgttttattacttagtcattttttttcttttagcatttgatatgcatttctcagattccaccatctttttgtgctttatggaatgacagtccctacaatattgttttaagcccacactacccaaaacaaagaatgggaagcacttgtgataaagacaggctcctgagaaatgcaacaagtggtcttacatatacatgagaacttagacacaagggaccatcccccaaactctactcttatacccagaaaagaacatatttcagaatctgtcaaacttttgtgtatcccacagattcaatcttcaggtgagaattttcattgtcaaaacccactggttagatgttgtagcaacatcataaaatcaagagtatcaagaaaataaatgagcatagcaatgctactcttaaaaagatgctatgccacacaaccagaggactttcttgttagcatccctttcctgattccctattttgttaattttaatgataagaagaaagggtgacatttattttgacaagttttaggcatcagctggcatcagtgtttttcaactccattatttgaagtgtaaatcctcacctggggttctctgtgtgcaaagctgtccttttgaagaacagtttggttgatgcatgccttagtagccaaaatgctacactctagacttacaagtgggagttaagagaggtctggaaagtgtccaacaaggaattcacacctctgcctcctttgcaacaacaacatttacacagttggtaagtgggtccataactggcaggatttttaaattgtattttgctcaaatctatgggaacaaaagtcaaggtatcactacctagaagtaatgatatacagttttcttcctagtggcttgaaaatctggacttcctcaattattattcacattttctctcttataggttttctgttttctactttcttttttctcttatctgtgtttccctttcctttgtttggctcattaacttttgactgaattacaattactccttttattaaagtccatattattgtgaatcatttccatgaaaatttctaagaaaactccaaactctctaaatagtagctaacttttatttttttaaaatgagtcgtggggtagtgcttcaccttgagatgctttgaaagagccctaaacattgggaaccattcacctaatttggagacatttctcactggttgtgactacccccttatgatccttcacattcattttatgtccctaaacatcacaatgtaaatatcatttttgatgttccagctcaccagaagattcttacacttggggtaaacactatccatgcattacttactggtaattacctgctggtatataattccatgtagcctttaatatgctgggttatcaaattctgttcactgagttatgaccagataaataatagatatgcacatgaaagatgcaaacttgtgtgattattaaagccagccatgcaggtccatgatagaaacagcaggtgatgactctgcactctcattgtcaaggttagatatatccccagttgcaaaacagccagacttgagctgtgctctggtcatctttgagtttaaggccttttgttgtataaggctgtggaagttgtactccaatggctgaagccatgttgttaatatggctgatgggagcatccctgcagctgaacccagcactttttatgctcccactgtggttgagctttatgtttacagtctcagcaacaacacttatgcatccaaacactcacaaatgaaacctgaaagaatcttttctgagcctcttaaaagaggaaaatgatgataacattaaagactctgaacacccaaggttggtgtcacatataaaaattaagctgatgactttgcagtgactcaagttgtctctttatcatggtttaccaggtagagtgcctggctattactatataatgaagcccactggcttgacttgtaagttcaacctaaaccacaatcctagaccatcatggatttaggagtagattcttcttgaaatcccacatccagaaactagacattagaatgttgaggcagtttcccagagaaacaagcatattgcctcatggatgaaagacttgtagttctagtttcagtgacttgttatatctacttacatacaacagggaggcaagaggattctctgtcatctctggtgactgagtgtaaaatatgtgccaagtctgcagcacagtgaccaaatctgacaatcgagctctggatcaccacttgattatgtagtagactcatttataaagcagcttaggaactaattaaacatggaggatgaattaccttcctatcccttgagataagacatctttcagtttcatgattaaggattgttgctgttttatagttactctgttcatcacagtgtaaatggtgatgcgtgtcgtaggtgtgcagctatttgagggactaagggatggagatattctgtcaaatgaatctcttcagtataccagtttgtgggagggatatgagacatgtggatggcagtgagagatcgtgcctctagatcttgatggaggcttggtgagacacacttaaataagcacgtggaggttagaatagagggcagagtaaaaggaagctccatctgagcaagtacaccaaatgatctcagccctgcaacttgacccaggtagggccaccactacgccttcacttgtcacccaagctccaaccacagagagtttgacaagtttgtgttatgatgttggcttggctttgtatttttaattaactttggatttttagtggttttgtcatataactgtctgagtttggtaggtaggattactttgaaaagggtttactagtgtggtcctccgggtagaatttagctgtaagcatgttgttagccagcctgtagactgttaattacttaataatctcattgggaaaatactagtagttttatatttggatgacataattggaaaagcagattagctgctactacttttaaaagacttaaggtcgggatgcctttttttccatgtaaggaaatgaaaagaccaaaatcttcaggcaaaaagcaagttgcaaaattagaaaccattggctaaaaatgtgttttgttgagtttccaaatggatgaattttcatttggacattacatcactaaattcattagattttgtctgcattggaaagatactcttctagcatatctttcccaaagatatctaatttggattctgtttcatgcaaatttgcatcccggaggttgaagttggagtttgaggttggaaaatatctttgaaggcagaatcagttgagttgtgagggtgaagcctcacatacttctcaacagacatgataaaattcacctgcatgagttggcaggtgggagaaccaaactggatcactgggtaagactactcagtaaagcaatgaactgcttgcttagagaagcatcactatccccattgagaaaaatgtgtggcaagatgatacagctacacagtatcaaatgaatgggtcaattcagcacccccaaatttaattctgtggggaaaaattattgagccagttgtcagtgttctgttacatgactggcagactaaattcttcatcgttgttgttattgttgttgttgtttctcattttcactcgcacggccttattctcataattaaaatctaattcattttctctttagtgttagtagactccaacaacagaagtggcatctgtgtattcataatcagcatttaccctggcaggagactaatcagataggccggtctcagacattaatcctaccatctgatatttttggtgaaggaaaaagtattaattctctttccatcctcctcctcagaaatatagaagccctctttaccaaaatcatcacattttactctgtaatctaccagctaaaagaaaattgcattgtggggagggcagaaagggggtgggggtgggggtgggggggtggggggtggggaagccccacaaagccagattgcagttcttgcccctttttgcgtctgacatgagatgttaaagaattattcatagtgctcacattgggttaggggacactgaactgctttttagatccatgatcagtcatcattcttctaagagattggagctttgctgtttcattaactgtgcagtgtagactaatggtgtttaataaaaatcattcaaaatttcaaactcttttgccagtgacctcaattttgttggctctgtgatttgtatcagactttgaggagggaagggggaagtgaaggaagcctacgtccaggcccctgacaggatgctgcagtagcaagctcaagctcgcctgcctgccagcagttgctggtgagcagcagcatgcagaccagctgtgggaagcctcctgaagaatgccccagctgatgctttcagctgggaatagtttgttcctattggggaactcattgttctccagtctctgcagcaggaagccagctgtcatattcggagggaatttcagatgctttacctttttggttttgtcctgcatcactcatgtggctacgaaagtgtctctgagaatagagcccaatgtggtgacaatgggtagtcaaatgcaccccagatgctcaagccctgttgtggttctgcagtgtttatgaaattgggaggaaggagaccctggacagtaagcaaaattggagacactccaacgaggctaagttaatgccgtgttgcccagaacaagatctagcttctcatttggtcagcctagcatgcaaccagtggtgtgctggtaaaatgtttaacaaccagctcgctgagaatagaaagcacctggtttgcaccatttgccaatttccatggcataaatactaccactttagatgattttaagctaccaactgtgatgtcactgaacacatggttggaaagagatgcacgcagttggctcttgcaagcctgggcaaaaatgcttcaacacgccactggatgcagccagtcagagggttcatatttaatatatgtgttcatgtggacacacacagacacacacacacaaactcacccttacacacacacttcgatgactaaaacaattacatagttttaagatatgaatcaatgtgtgaatgtagaaagcttatgataaggccctagaggtatgggttgccctggaagcctaggttttaagcaggagaatagctgagaagaatgaagccctcctgagctgaaaggagagatggatcaatggagatggttccatcatctccttccatatctcacaggtaaaatgggcactcagaaaaccctcacgattgattttttaaaaagataagtgagtgttttttattttattattattgtcatcattattttgatttacaaatgctatttgtaacttttacatgtaactaggataaagtatttacgggaactctatggagaatagcacaatccagaatttactgtgtttttcttttatgtgacgtggaaactcagtaattctcccaccttcacattgttgttcataagaattttactttagttattagggaatctaagttttttgttaacatttgtttttagttaaaagtatctacttactgttttagctctgaactcaaaccagaatatctctgtatcaattgcatgactattcagaaacaataatccaaaccaaaataattctttttccacccagtacgaagaaaactaagctcagtaacaagaaggcataaactaaagtatataatgaggctttcattaaatacacacacacacacactcacacacacacacatacactttttaaatttttaaattaggcctccacacataaatcattttgaaagtagaatagaaaatctcaaagaattcattctcctggtcctgtgcatcttctgcagttaataagaggtttgtatctggaaagatggaagaacttgttctaaaatcttatttttcaaaaaaaaatttccattttctctctgggcctgtatccatggttgaatgttagccctggaggagatccatgtcttactcgctctttctggcccttctgtcttttgcctctgcaattctttttgtagctggcacgatagcagggactgggggtctatcctttcatggtattgctacaatatttgtccttactggaaaatggtaacatccgggtctgatttaattggcattacacttacacagggactctgagcacccccgtcaccacaccagacagtggaccagttttcacagctacaaagagctagaaatgtgtttaacatcatccagtgcatcccctaattcaaaaccatcctcactaatcaatcatattcacccataaatattacaaatgagattgattccatctcaagacaatttgtcaaatacttaattttcttcctggatgattctacttactggatattttagaaagagaaatgtctgagataaaatccctcacatttactcaatataacaaattactgtttctactcctattctgagtagtgcttctgaagattgtttgctgtagtgttgtctttgataaaatgaatgtcagtagtgagccttttagagataccatgctcagacatcctctttgggatcagaagatacctaaaattctccccttttgcccacttggttagatgagtgatatattctttggatcctgcaaagaagagattggtttcttttcttttctggtggtggtagtggttgtatctgtggctgtgatggttgttgttacttgtctctctctctctctggctctggcttttgctttcctgctagtgttctttctctttccaaacaaatagttaaattaaacgtgagcttctgaattgtacttgttcatactttcaaaacataacagattaataaaaatagatgtgtcctgatttaaaacatgccccctggaaaggcatgctgtattatgaaatcgtgataatataactgcattattacatggcagtataaatattagtctgttgaattcatttgtccaattgtataactttgtggagcagtgttttgacctttgatacataattctggagcaagtggagtggttgcaggcagatgagacagtgttatatcaggatttttcaatcaactttagttggaggcctggcaattacaaacatcttcagatgtttctgtaaccattataaatatgaaaaaaacctcttcaaaaaatttcccatagtacttcagtcaagactttttaggtttatcttttttttttcatttctccttttccttttccattatttttcgatgggggggttgttatcattgactgaagaaatattttgattgcaatggtctctctctctctccccctctctctctctctcctctattctttcctccttccctctgtccatcacccctcattaaaatattgaaatctggagtctttgataaatctgcattagaccaggctatatgctaggaatgaaatctgggcaaatatcgatgggttttcaaagaatgctccatgttcattgggccctttcacaccccacagtgataaatgaaaaggatagaggtagttttttcaaaagagcactttaataatatcctctgagacctaatgcagtttaacaaatgactccacctatttttccagtaggtaaattgactgagacttgcaaaatacccctgagagttgtcaggggtgtcttctgcctggtctatagcgtgtgtgtttgctttgtatctaacaggcacattcacgtctcgtgtactcatatgaagtatttcctaacattcccattagcctgtatataagaatcagaaagataatcccaacatgttgtaaatgaagatgtgactctataacctttctcttcttcctggaaaaaaaaggacattttcatgcatattttaaacagaaattttgtatatttaagtgtcatagaaaatatttattgagtaactgggacacaaatgggaatttaattgtcatcatatgctttgtgtgtggggatgcttaccaacaccatgtcgctggaccattgtggcaagccataactgcacaaagagtacacatcgtcagtgtgtgtgtgtgtgtgtgtgtgcgcgcacgcacgtgcgtgtgtgtgtccctgcatgtgcaacatgtctagcttgctgtccttcatgggattttagctttcccttcttgaaaaacattattttacagttccaggaggccctggttacattactatatgaaggcagtgatttgaaatgaaaattcctttcctcttggaagctttggtcataatatcatggttcaattaaacggattccaccggactttgtgatgaaaaaggctctgttaaaatccaattgagtttccaagaggaaattgtagtaggtcaagatgcatgagagggaagatggaggccacctcagctggagaacatgagctgagttgagccctcagtgttgaagttgacttgctccaagctgcagtctaaaaccctggggcccgtgcctggcctatgctccctcccaagtaagtagaggagcagaaccatcaggaacagcctgcctggctcctatgaagaaaacttcctgacgtcctgtccccaaaggaagaccctttccccaagggcaccccaggtggccattaaattgtgatgatcattcagaaagtgcccccttggctttatgagaatccaattagtcttctgaaccaccttttcttgggtgcagatttccaacattcatgctcattgcagatccaccaactgtcactgttcttaacaagcatgctcgtcttgtcagaatttcagtaagttccaatttcctgtacagaccagggtaaactgttctaaaatcaatcaattaatgaaatgttatctggtttttaaaagctggtttcatgtgctttatgtgtataaaactatatctgcctgtgtggctttgcatttcaaatgtgtggcgcacaagcgttttgttggtgctttgttctcagtacagtaactctgtgtacaaacattttaatgtggttttgttgttttccaacaagatgtctctgtaaaaatgatattggctgagctggtgcgttggtttctctcatagaggcattaactatactgccaatgcattgaattatttaaaaatgcaaaataaaatttttatgaaaatctcattttagacatgtagatcattctgcttagagactttccaagccatagtaccttgttatcaactcttccacattataatacatagccagtgcccccgcttacatcaacagccataaaactgatggccataaagaaaataactctcacaaagccaattcattttataagagagacccttggaccatcattcaaagcccatttaagagaaaattgtaaaatattagttatctggattcctagtacacagcacaaaaagcttgcaaagtataaagttataactagtagatgctgacaagagagagagaattataaaactagactgaaaacttaaaaacacagctggcaatggccacttactgcaggggtatgcagccagtagccctggaaggacagcacaagcaataatttcgggtcacaataatgtctgaaagtcatcaggaaaaggttaagtatactcttaactaacacaaaaactcatgccatatatgttagaactgtttccttcaaaaagatttctggacagttaaagggtaggtttcaggtatctagaaatttcatttacatgaaatgtattctctggccatgtaaagtgaggaattgcaatgctaagactacacggcacaaaacacctgtcagtaaatgcaacattaacagcttggctagatttcctgtgaacaaatgaactacacttggcttgaccagatattttgactctgcataatcataatcataatcatagtccaagtgtaagcacgaatatagctaaatgtgattgaaactgatagttgtaataccgccactgtgaattccaaatcctttccaaaatggaaaggccacaatatctgtaaatatgaacatttttattgtgagatgatggggaaatatttgagctgagtaaatagagctaaatgaattataaatgtgttctcaagcaaccaagttgttttctgcttctctcaaaacaaacagataccataaatgatgaccatgcctgggtaaaagtatacacacatgcagagaagaacttagaggaaatatagagaatgacattttaaaaaattaggagtgctggcattatgctaattgattagtttttgtgacatttacaaccagtaaggcactactggccaggcactgttttagcactttcttatatattaatgcatgtaattcttgtaaaagccctatgagataggtactagtatatctctgttgtatagatgacaacatggagacacaaagaggtcttcaggaaagcaactttcctgaagtcacacagccaggtgcgtgaccccaatgtggccccaaaggctttaatcttaaccactatcctctactacttgttgttattattaataatgctactgattctataacatatattattttcattttagaaacaaaagtaaagaaggaccacaggccctcaggaagtgatttccgctcagtctttccagaggtctctaaaggaaaggcattgggccaatcttcagaaacaccttttcctatgaagacagaccagggcacaggaggagtcagcaactcagaaaaagtttggtgaggtggggccccttagtcttggaagtaacaaatagaagaagagatggcaccaccttaccggctgtcactctggctgagataaagatcaggcattggattggcagagctatttatctatgtatttatttatttgagacagggtctcattctgttgcccaggctgcagtgcagtggcacaataacagctcactgcaacctccacctcccgggatcaagtgatcttcctgtcagaggtgtttgaaccagagcagctctatcttgaataggggctaggtgaaataaggctgagacctactgggttgcattcccaggaggttaaggcatcttagtcacaggatgagatagcagttcggcaaaagatacagatcacaaagaccttgctgataaaagagtttgcagtaaagaagctggccaaatcctgcaaaaccaagatggcaacggaa

SEQ ID NO: 15394 - DNA, 16520 bp, Human; identical to SEQ ID NO: 14710

SEQ ID NO: 15395 - DNA, 30371 bp, Human
cgggagccagtggcgggccctgatccaggtcagagctggctctgctttctcttttgtccgagtgaccatgcctcagtttcctcatctgtaaaacaggagcccaccgtgatgcttatggtgggatgagatcagcatggatggaacaaggccctggaagggcccatgccatggtcatcgacagcaaagccactctgcagacagatgcttcagtgaattggtagaaaattctgcaaccagaatgcccggggctcctgagggcctaagcccagcccagggttctggaagccgctctgacttcttgggagtggaagttggcaggactcttcctgggaagaagcggagggtggggatgagaggacagttcaggagcccacccagacccacaggaggaaactaggggagtcatgcggggtcctggtggagcgccagcctcccttcctgccaatgggaaatgcaggcgcccacctcatggtgctgccggaggagggggcccgggactccccagaggcttcgctgaagggcctgggcgcccccaaaggctacatgtttcatatgggacgtgccacctgccacggctcagctccagctttctgtgagtggcgagatagaatacggggaggccactggccatgggcctgggacagggtgggatgaggcggcaggcttgggccaccaaagccagcatcgccacccagcattgatgacaaagactgcgtgtctgccatgagcatcctgctgttggtgcacacaccgcattggtctctccatacaaacatgcctagaggcgatgtcagagggtggagaccaggagaggcaggagtcagacatctggtgccaccaggaaggcccttctcagaggaccaggctgtgcgtggtgcccgccgtgggaggccagcctggcgttggcatccagcatcatcagtttgtgcagttgggtggggctcagtgagtgcctcctgtgtgccaggcacaatgacgcacaatgtgtgcacaccaggctcatgtgcaggtggctgcgagacagggcgacccatcaaggcagatgcaccatgaggcagtggccagtgctgtgggtgttaggggcattgctccccggccactacggcatagcaggcagtgatcgccacactggccaagctttagaccatttattccagagaccccagaggcaaaaagcccggctgcacctcccagtgactcccacagccattgagcagagacgctcaggaccttgtgatgggaggtttctgcactggagaacgagcccagaagccctctcagcctcggaacagtgtggccagtggtgggcaggtcaggaggggcttcagacacagcctgtccctccagatggtcacgggaaggtcactccccacagaagtacgttttggggccatgcgggcacagaaggtttgggggtgggtggggcaggtgccagcctggcctgtgggaggccatggtgcagatgccaagcccccccgtgacatgagaccacctgataccacccagagagtggctgtgagcggaagggcccgcccagaaacaagcagggccttggggcagaagtcctgggctcagatcccacgctcactgccagcggcctcggctcaggcttctgcgctctctaaacttagttttctcttctggaaaaatgatggggaaaatgatatttgtatgtgattgtgaggactgagagttaaatgtaaacatctggaaactacaaaatgagcacgaaatgatgtttttattcttagaacagaaagtccccacacccgcggccctggtgactgatgaggatgaggttccgaggggcctctctggccgcccagctctgcctggggaaggtggggccagagtggatgtgttcccagcgtggtcactcccctgcctcgccagcaggtctcggctccaatcaggaggcctaagccaagtgataagcagccagacaacagccatcccagctggggcgtggactttgctccagcagcctgtcccagtgaggacagggacacagtactcggccacaccatggggcgcccactgcacctcgtcctgctcagtgcctccctggctggcctcctgctgctcggggaaagtcgtaagtgcccctcgcccttcagacccaaaagcagcgccagggagcagggaggggcggcagttggggaaaccctctcatctctgcagcctggacggtgggtgccttgagtgctgccagaggctgggctcggatggctgggcttggcctttccagccaacggcatcctcaaggccagctgtggctccctggggctgagagtcagacgggcggatcagaggtcacagagacaaaaacacaaggacagagtcagagagagaaagggagagggaaggagaaacggagacacagtgagatgggaggccaagaggcagagacagaggtagaaagacggagacagagagagagggaggggttggggcaggcagagacaggacagttagccatctgccaccacagggaggcacaggacgaggggcacagcagaggagctcccagggaggaggaggctgagccgagccagtgccaccactctcggactggctccgtcggggaaggagctgcctaatgcacagctggacaggtgggggcagcagggctgtccaggacccccgggtctgtccaaaagcagaggcccagacaggacagaagccaggcaagcctggggacagcggaggaagaggaggcccctctggtggggacacgagagacagggaccctagacttgtttgcatcctggacaaagtggacaggcaggggcaccaaggggacccaggcctgggaagggaatgtgtgagggagagacggagcagggggagaccctcgtggggtggaaaggggagacccctgggaaggctgagtggatcctcagtgcatcactgacctaaacggcccctccgcctggtgacttggagctccagtcacatcacacgggggtcttctccatcccaccctcaaccccctgccctccccagcctctgtcccctgagccacatcttcctgtctcccacgcggaacgggactcccgtcttcatggggtactgtgtggctccaactcgcccagccttcttcctccccctcaggccacactgccccctgcaggagcccactgtgatgcttgtggtgggatgagatcagcgtgggtggaacaaggccctggaaggacccatgccatcatcatcgacagcaaagctactctgcaaacagacagatgcttccgcgaattggtagaaaattctgcagccggaatgctctaggatcctgaggccctaagcccggcccggggctcccgaggccctaagcccggcccgggactctggaagctgctctggcttattgggaatggaagttggcaggactcctcttcctgggaagaagcagagggtggggatgagaagacaggccaggagcccacccagacccacaggaggaaactaggggagttatgcagagtcctggtggagcgccagcttcccttcctgccaatgggaaatgcaggcgcccacctcgcggacctctgggtccacagggtattggcacccttagctgtgtgatgcgggcctggctcataaccatggcctgtggtgtccccgggggccggcctggaccctgggtggacatggccagccccggagagccagggccaggccatctctctcccctactctgcctcagaggcctcggcagctgcactgtggggtgggtggggctgaacacaggtcccagaaggtcccactcaggaccctgctgtgcacacttttgattttaataaaatcagaatgcgcacagcatctgcagtctagcctttaaacgagcacagctgtcctggcagtcacggaagttcttctggggcggtgggacctcagcattcctttgctggtactgctacaagaaaggacaatggaccaagtagcttaaagcaacagaaacatttctcccacagctctggaggctggaagttcaaaatcaaggcgtcagcggggctggttcctccagaggctgggagagagtctgctctaggcctgtttcctggcctcggggtgccagcggcctcacagcccatggcttgtgggagcattgctcccatcgctgcctccatcatcgcatggggttctcaccatggctgtttttctgtcttcttttctctcagaaggacaccagtcattggatttagggctcactctactcccataaaatgtcttcctaactaaatacatcacaaaagttctatttccaattaaggtcaggttctgaggttctgggaaagacatgaatttggagggacattattcagccctgtcctgccacctgtgagtgttttctgcaatccaactttttattttaataaaatcagaatacgcagagcacctgcagtgccagcctttaaactactgctgttgtactggcaatcattaaagctacgtggcttcagtttcaatctttacattcaacaagtttaaacccattcttcatgagtttggaccttactgactgaaaattttgcttgctggtaaaacttgctcaaatgcagttgctgactgtggaattcactgatgttgccaaaacaacaaacacaactgtgtgctcgaggattgcaatgctcccaacagcttctgaagaaacaaaccacacgacaaatgtctaccaatctggatgctccatatcagagttctagagtgttccattaatttcttgagacaagtgcctaaaaaccttgttttaatttcgttttgccaaaatcccattttactcacatcagaaagtgtggccacgtggcccagacccggcctgctcagtctgactgaagcgttgatgcgactcagccataacagatagcagaagcgcccagattcagtccagagggctgagccaggcacgccatctttccttcattccctcaacacatattggttaagttccggccgtgctaggcacgggcatacagctgtgaccaaacacgtcaagtctttttccagcggagggaaggataagcctgtcagcatgtaatgtcagagaggggttgggtgctagaagacaaatagcacagtgtaaggggatgaaagagacacgagtgggggcaacgtcagagggcgtggtcagggagggtgtctcggagggcgctgggcctgagccacttgggtatctgtggaaagaatgttccagacagggaggtgactggtgcaaaagtcctggggtgtgagtgttgggctcagccagggtcagcgcagagcccagtgtggcagagagaggtgaatgagggcagagttgaaggtggtgaggcctgggaggcctggccatgggaagaccctgggctctgttctaagaccactagaggcagattctgggtagtccttgacttccttgcatcaccctttccaccccgtgcctgccacctgtaccctcttcctcacacagtccagctcaaccttataggccgtgtcctacccccatgagctggggagagctgagcaggcttcagggagatgggaaaaggcgggaactggacaggggctgcaaaggaaaggtgacttcttactggtcaatcagcctggggatgctcgggggtggatgccaaggggaacagagctgtggccgctatcacagaacagcgagttcctctaagaggtcagaggaggcgcaagggatcgaccagagacagtgagggcgtcaggctccagttgagtggggaccaatccttgtggcaagtctgtgaaccatcactgtggctctagggtagcagagaaaaaagcaggcatatgtccatctggccacaaggaaggagaccaaggggaagagagaaggtaccaagagaggtgttcacatggaggtgcgtcagaacaccgagggcaaggcagaacgcggtcttcagaccccaactggagcccaggaggcccgcgagtcccagtttgggaaacactaagccaggcttggataacttgtctgaggctgtggtcatcccaacatgagagccagaggccccaagggagatgggcattccccacccctcagcttcctcagtgccttttgtggagtggaggtgacatgaggctgcaggttgcagggagccacgtgtgggctgcatttcagagcaagtgtgtgggagtggagcagacacgcagagtaatggggcagggtcaagaaataataaatctaagtctagcgttggtgggataatgtcggtgtcactaaaagaaatggggaatttggaaggtaaagtaactggaggtaggaatgaacccaagatttactaagcaccttctgtataccaaactcaacactaggagtttatacaatctttaaaacagctctaagagtagatattataattcccttctgccaataataaataataagtgactaaggtgtttttgaagctcaagattgcttgattctgcagtcttgttttaaattttggacatggagagtttggagttctgagatgagggaaggcatctgtcatagtgagagagctgaaaacatggagctcaggacaaaagtcagtgctagagagatcagttggaagagttatctttattgtagtgagacattgaatttttcagtggaaaaaaagcacagaaaaagactacagagggccaagaaaagaaactgaggctgtcaaaatgaaaagaggaggaggagtgggtgagagacaaaggagacacaggcagagagatgtggacagcacagcccacagacacacactctacaagggacacagactctcggatccagggcattttaaccagcagatcaagactcatttgccagtcatgaaatcaactcagtatttttttttaaaagagtagaatcaaatagaaaactttgtactaagtactgtattttaggaaatactaataaatactatttcttgaaagttggcatgtatgtgtgtcctggcacttcataaattgtactattatagtttgtaattgaaacagcatcaccaatccccacataacaaagagcagagaccttaaagacgagtggggccaggctgaaggggcacagcttgagccaaagcacagaacagtgggctgaaagcaccctagggagggagaattcaaggaagggggcttgggtggccaggctgagccagcgtgagcatgtgaggaggctggtgagctgattgggtgggatgtgtctacttctccagagaagggtgcatgggtctagagcaggtgcctcatgctgtacctcatagagaactggggggaggggggaaatgggcatttccctccacagcccccaaagtgcctgaggaaagtgttgataaagaagccaaactctgtaaaatatttgaagagatttattctgagccaaatgtgaggaccacgacccatgacacagccttggaaggtcctgagaacatgtgtccaaggtagttgggtcacagcttgattttatgtattttagggggacagaagttacatacagacaccaatcaataagcataagttgtacactggttcgttccagaaaaggggaaggtgggggcttccaggtcataggtggcttcaaagatattctgattggcaatcagttgaaagagttattatctaaagacctggaataaatggaaaggagtatctgggttaagataagaggttgtggagaccaaggttcttgttatgtagatgaagactcataggtggccacccttagagggaatagatggcaactgtttcctcttcagacctttaaaaggtgctacacacatggccaggcgccttggctcatcctgtaatcccagcactttgggaggctgaggcaggtggatcacttaaggtcaggagttcaagaccagcctggccaacatggtgaaactccatctctactaaaaatacaaaaattagccgggtgtggtggtgcttgcctgtagtttcagctactcgggaggctgagacagtagaatctcctcctgaggcaggacaatggcttgaacctgggaggcagatgttgcagtgagctgagattgtgccattgcactccagcctggatgacagagcaaaacaccatcttaaagagaaaaaaaaaaaaaaaaaaaaaaaaaggtgctagactctcagctcagaaaaagacctggaatggtaagggggttctctacagaatgtggatttccctgagatagctttgcagggccatttcaaaatatgtcaaacaaatacaatttggagtaaaatcatttattttagggcctgctatatgtcatgtgatcctatactagagaagtcaggttggaaactggtatcttattgctacaaagactctgtttggtcagcctcaaggtctcttaacgtgaatgctggtcagctgtgcccgaattccaaaggaagaaataatgaggcgtgtgggacctgcttcccctcatggcctcaactagtctttcaggttcctatggaattcccttggcagagaggacgggtccactcagtgagttgggggcttagaattttatttttggtttacaagagagtgatccgccttttgtgatctggatatggcaagggacatggcagtcagggagcataggtgagggggagcctgggtgagggtgaccagagcttttaaccctgtcctccctgccttccagtgttcatccgcagggagcaggccaacaacatcctggcgagggtcacgagggccaattcctttcttgaagagatgaagaaaggacacctcgaaagagagtgcatggaagagacctgctcatacgaagaggcccgcgaggtctttgaggacagcgacaagacggtaagggctggggatagcctggctgttggtaaggagctcaggccacagcgccctcgctggccccgctgctccgtccatccaggggggcggcctggaggaaggggcagcgtgcgcgaaggctttcaggggcggggcccagcaaatcgaggcctcggcggagtcctgcccacagggacatcagtgccgcccccgcgctgactccttcccggcgaggactcagcggggagggatgcgcccaagtcccttgagggtcacagggcttctgccagagttaagttctatttaaaaataaaatgttaacctaaaaaccaatagtcatggtctcggccagcgcctcgccgagttgcagtgagctgagatcgtgccctcccacgcccgcagcccgcgtcctgccttggcctccgtagtcgctgagagccacagcctagagcgccagcgcgcaggcgcacaactgacgccaggccacgaacccagtactgcgcctgcacagcagaagcactagcactgaggccgggccgcgaacccggcactgcgcctgcgcagcaaaaggacacgcactgaggccaggccgcgaacccagcacggtgcctgcgcagcaggaagaccggcatccacaccggacgacgaacccagcatcgcgcctgcgcagtaggaggagagcaatgccaccaggccgcgattgcgcagccgcagcagccccgcgcggaagacgctaccctcctctcccccgaagaggcggggcttcgaacgaacctggaaatggccgaggggtctcgacttcctcaccccaggcatcaggaaaggtgcctgcaggacagggctctgaagtggaagtgggcggtggtgatgccgaactgacaagaatgagctgaagagaagaaagtagccgagaagggggccaagccggagctcagtgagcaacagctaggccagccgcggctggtgccatcagccacaccactaactgtggacccaaatggaaactttgaggccccttacaggtcccccagcgcaggccaccgccgaaggttactggggaagacccctgcagcttccatgtggacattactctcttgcttcatcccggagtgcagtcacctgcagcctgggaccacctgactgatgtcaccctggagatccatgccaaaagagctggggaaagttcaccttctaatgacccctgcggaccagggtgaagttacaagttatggccaggtcaaggaattataagtcaataaataaactgcctcagggagacgtactcagagtccaggaaaatctaggaaacaccaagaagggcgagcgcagcatcagcccctgcaaaattgcactgctgcctcctggctcacatgttgccccatccttactttagcctcaaaggcaaggagacccaatattatttgagtacttggatttgatcctgagtgactttctgagaaagcagtgtatcatctgccctaagatcaccacatatatgacaaggtttttggatgagttgagatttctagacattgaaaccctcatgatgaacgtcatcccgggtagcaggggctaagcctttcatcacctgctacaacaagctggacattaacttgtatttgagaattgctccaggactctaccttcagatgctggttagtagcattgactggatttatgaaattggatgccagttaaggaataagagaatgtatttgatttgccaccctatatggtctgtgcagactgtcatgatctcattgaaatccaagaaaagattatgtcagggatgaagcacatcacaggtggttacaaggtcacccaccatccagatggctcagaaagccaaacctatgggttgacttctcctcacccttctggagaatcagtgtggtagaagagcttgaaaaagtgctgggtgtgacgctgccagaaactaacctctttggaactgaagaaactcaaaaaattattggtgatatctatgtaacaaaagcttttgaaagtcttctacctcagaacatattcaggcgccttgataaacttgtcaaggagttcctgaaagtgacttacatcagtcccacatttatctgttatcacctgcagataatgagctctttgaccaaatgatctctctaagagggtctcactgagcactttgagctatttgtcatgaagatagctgaatgtttccatgcagcaacagcagcagctgttgacaaacaagacaaggccagcaaagatgatgaggccacattcatagatgaaagcttccatgcaaccctggaatatgggcttccgcccacagctggttggagcgtgacaatcaaatgtgttaccatgtttctcacagactcccacaacatcaaggaaatatttctgactcctggcatgaaacttgaagaaagagaatgtagcagccactaatacaatggaaagcgcaacattgacacgtctatctagaaaattttaattgtctaagttgtgtgactcagatatctttgcatttctgcaaaagatcaaggtctactctaattcttaattaaattaagaattcctttttattacttgttagcaaataaatggcttgtctctaacagaaaaaatttagaattttcggaaatattttcaaatacttcttatatatacatatatttttttccactggtagaatttttctttagtaaaagtaaataatgctgatccaagtttatgtttcactcagcatcgtttctcaaacactcttctttacttatatatagctaccctatagctaagctatattttattgtatgatgcatttactcttttcagagtttggccatataagttatttctaaatattgctattaggaaaacacatatgcatgcatttcttctagattatcatctaagagtggcttctccagagagagacgactgaattaaaggttatcaacaagttccaattccagataagatgaagaaatcacattccacactgcctctcccactgagtgtagctccaaaacatggatagaatgcatgtagcagctatttgaggaccctaaaaagtaaatcgcagtgtattgcagaataagactacaattagatgtatgatatgatacaactggctgtgagtttatcattttttcctccagtcttccagacatcacttgacctgaatctaatggacatttataggattctcaacaatagcaaagtacactttccttccacatatggaaaattcctcaaggtagactatatcctgtgtcttaaagcatacctcaataaaaagattgaactcacataaagtatgttttctgaccataatggaattaaagtaaaaattactaacagaaaaataactggaaacttccctaagtactcggaaattaagtcacacatgtataaataatctgtgagtcaaagagaaaattttaaggggagtaagaaagtattttgagctgaacaaaaatgaatatgtaacataaaatctgtgggatgcagctaaaaaagcagtgtttcaagggaaatttatagcattaaatgctcacatgggaaaagaaagacggtctcaaattgtttatgtaagcttccactttaataaactagaaaaaaagaaaaaaataaaccaaaaggaaattgaaaaagcagaaatcaaagaaatttaaaacaaaaataatagacaaaattaataagctgatgaaactcaaacaagactgacaggaataaaaacaaacaaacaaaaacaagaaaaaggacctatgttggaaatggaagagaggggacatcactacagaaactgtagatgttaaatgtataataagaaaatactttgaacaactctgcatatataaatttgcatgagatttgaacttggatgaaatgagcctattcttcaataccacaagccaccaaaacatacacaagatgaaagagatacctgccaattcaattcttaatttaaaaccttctgaaaaagtaatgttcaggtacagatggtttcactggtagaattttaccaaacatttcaaaaagaacaccaattctatacaactcttccagaacatagaagagggaacacttcttagtttgtcttaggccagcattaccctgatgtcaaaaccagacaaatactgaaaacaaaaaccaccctacgtaacaatatctctcatgaatctagacataaaaatcctcaacaaaatattagcaaacggtgcagcaatatatttttaaaagagtaataatacaccatgaccaagtgagtttttctggggcacacatgactggctcaatatttaaaaataattatgtaatccaccatataaacaaaagagaacatccacataatcatgtcaattgatgcaacaaacaaatctggcaaaatttaacatccatttatgattttataaaaaacctatcagcagaatatgaataggagggaattttatgaacataataaagttcatctacaaagagtctacagttgatattatacttaaaggtgaaaactgaaggttttctccctgagactggaacaacacaagaatgtccattcccaacactcctaattcaacattatactggaagtcctagctctaaggaaggccttcagtaagtcaagaaaaagaaataaagttatcactatttgaagatgacatgatcatgcatatagaaaatcctaaagaatgtgaaggggaaaaaagcttgttttagtcccttctcacgctgctgtgaagaactacccgagactgggtaatttataaaggaaaaaaggtttaattgactcagttctacatgtctaaggagacctcagtaaacttacaatcatggcagaaaaggaagcaaacgtgctcttcttcacatggctgtaggagggagaagaatgagagccgagcaaaaggggaatcctcttaaaaaaaatcagatctcatgagaacatactcccacgagaacagcatggaggaaccaccctcacgattcagttacctcccacttggtccctctcactacacatggggattatgggaactacaattcaagatgagatttgggtggggacaaagccaaaccatatcaatgctcctaaaatttgcaaatgagtgtaacaaggtcacagaatacaaggtcagcacatgtgttaatcacatttttatgtaatagcaatgcacagttatttgtaagccaaaaatttttaaatgccatttacaattgcttcaaagaaaattatatacttatatgtaaagctaataaaacatatacaggatctttatcccaaaatctacaaaattccaatgaaagtatttaaacagacctaaataaatagagacacatacagtgttcatggattgaaagactcaacatattaagatatcaattttcggccgggcgcggtggctcatgcctgtaatcccagcactttgggagaccgaggtgggtggatcacctaaggtcgggagttcgagaccagcctggccaacatggtgaaaccccgtctctactaaaaaaatacaaaaattagctgggcgtggtggtgtgcgcctgtaatcccagctactcgggaggctgaggcaggagaatcacttgaacctgggaggtgaaggttgcagtgagccaagatcaagccattgcactccagcctgggcaacaagagcgaaactctgtctccaaaaaaaaaaaaacaaaagaaaagaaagaattgtctttttcaacaaattatattagtctcagtctgtttgtgcttctataacaaaatagatcagactgggtaaattataaacagaataaggttattgctcacagttatggaggctgggaagtcctccaagatcaagaaaccagcagatatggggcctgatgagggcctggtctctgcttccaagacggtgcctcatggctgtatcctcacctgacagaaggcagaagcacagaagggacaaacactgtgtgaagcctcttttataaggacattaatcctattcacaagggcagagccttcatggcctaatcacctcctaaagatctcacccttaatactattacattgtcgattaaattttaacatatgtatggggggcatgttgagaccatagcagtgttggaacaattatatatttatatgcaaaaaaatgaacctgacctaaacttcacaattatacaaaaattaacacaatatagataatagatccaaacataaaatacaaaactataaaacttttaggagaaaatacaacaaaatttatgacatggagctaggcaaaaattcttagacattgacaccaaaagaatgattaataaaagaaaaaagtcataaattggactttatcaaaattaaaaccttttgcacttcagaaataaacactgttaagaggatgaaaatacaagctacaaactaagagaaaatatttgcaaatcacatatccaacaaaggaatcatattcggaatatataaagaaatcttaacagatcagaagaagaaaataaacactcagttaaacaaaagaccttaacagccaactcgccaaagaggatatatggatagaaaataaacatgtgagaagatactcaacattattagctcttacagaaatgcagataaaaaccacaataagaacgactatatactcatagagtaaaaaacactgacacagaacagcgctggttaagacacggagaaagcagaactttgatacactgctcgtgggaatgcaaaatggcacggccactttgaaaaggaatttgacagtttcttataaagttatataaggttaccacaggactcggcaatcccatttctgggcatttaccctagagaaatgaaaacttatttccacataaaatcctgtacataaatgtctatagcaactctagtctttttttttttttttaatttttattttttgagacagagtcttcccgttgcccaggctggggtgcaatggcacaatctcggctcactacaacctcctcctctcaggttcaagtgattctcctgcctcagcctcccaagtagctgggattacaggtgtgtgccaccatggcaggctaattcttgtacttttagtagagatggggtttcaccatgttggccaggctggtctcgaactcctgacctcaagtgatccacccgcctcagcctcccaaagtgctgggattataggcgtgaggcaccacgcctggccagcaactctattcttaattgccaaaagctggaagtaagataaatgtcttttgctgggtgtacccatacaatataacagttgtcagcaacaacaagtaagaaagtattgatacaacttgcatgaatttcaaaggctttgtattgaatgaaaagctagtttcacaaggtcctataataaacactttcatttacatgacatgctcaataggttgttatcattgtgataaagaatagattagtggtgggacagggtttgccaagggttggcaggtgggggagatggcatggggtatttgggggggaaggatggacctgtactgcatcctgatgatgctggtggctacagaagtctctccatgtgttgaaattcatagaagtgtacaccaaaacattggttttgctgtgtgagaattttaaaagtaaaaaagtaagaagatagtgtatttgcttcctagggcaaccataacaaagcactacaaacgccttaaaataacagggatttattgtcgcagctttggagacaagtctgaaattagggtgtcagcagtgttggttccttctggaggctctgggagagtctctgtcccaggctctctgctcgcttccaggagcacccggcaatcatgggcatccttgggctgcggacgcgtcgctcctgtctctgctttcatcttcgcatggccttctctctctgtgcctctgtgtgactttttctgtctcttataaggactttctcctttatttagggcccacactgacccagcatgatctcatctacagccttggcttagttaacatctgcaaagacccgatttccaattaaggttctattctgaggctgcaggtggacctgaattagcagggagggcactattcaaccaactgtagagagttaaaaaacaataagcctgtggacattttttagcgtaatctaggctcttgatgacctgttttaaactaatcagcaatgaatatttttcagctaacgtaatcactattgacaagcacgtgacccttgtctgaatgttaactcaggcatagcaactaaaaaccatccattgaccagctcgggagtagcaaacagagcaagccattcttggtgcaacctgtttctaggtaattaacttgaaaatattttcaatattcaacaaagatggttcatttaagatgactgaagccacatcttcacagatgcagaagatctgaatagctttcctctttagattgaatagttctagaacaattcattcctaaaagtgacttccattggggaaaatatcctattcagcttgagtcacttaattatggttgttattggtataaaatgtctctgttttccctaatatatttttaaatctcttttttccttttagaatgaattctggaataaatacaaaggtcagtattttttctgttttaaccttcagtgagaggggttcatcaggatatttgaattttgaaaatagttcctgaatttcctttctgcttttgttctaattttactcatttaagactttttccctcagggtgtttccataatagttattgtaaaagagtttttagagtaattttatactaatcctagttttgttattgagttagagatatatatttaaatcagttcattctcatttgaggataccaaattccatgataacttttcttaaataaaagtgtattcggtaaaagcaaaaaacagagtctgaaagattagattcccgactaaggtaaccaccttgatttaatgcttaatagcatctgaagtggcctcagtcatgactacctggtaacagtattcacatttctcaaaatgacaactgggcctatctctaaatgagattgtgtaaatcctccaagaaatgggaagccccgtgttagtgtttgccttctccttttgccccaggatgatttggaaagaggaaccctaacctcctctcccgtcaaggcccagcccagaaatgagcatcaggctctcacctttcctccatccttccagttggtccctgtggtcacctctgactgtaaacacactgcaaaacaccggcaaaaatcaaaaagctgggccggtgatccacctagataaaggcatcacgtacacatggccacaaaagggggtggatcaaataaagtccaaagagggggagttgtttacagagaaaccggaagactcttccagttatctgaacggcagggccaaggttagcacagcaaaactgtttccatgatgccggaaacagcttgcagactccagtttcgaaatcctctctttgcagatggcgaccagtgtgagaccagtccttgccagaaccagggcaaatgtaaagacggcctcggggaatacacctgcacctgtttagaaggattcgaaggcaaaaactgtgaattatgtaggttcctctgcttggtataccttcagatcagatgcccctgaagagtggcaggtgggcgggggaagaagtgaaaacgcctaatgaaacaatcttaagtcatttctgatttacaaagtctgggctctattatacctattatactgtgccactatagcaatagaaaaaaaagccccaatatgtcccccaaacgattcggtttgggggcatgatgagagagacacagtcacttctctgctcctccgagagagactgtagaacattgatgaagcgtgtgatccattcatgtgtaaacaggagtggactctctgttttccttggggccaagtgcattgccctgttattcctgctccttgtgaccctgtgcagtgattctaaatcacctcttatttatgtgtatggatgcaggtgtcaatatttgtgaatatttgtgattggccaattataaaaatttgatacatttaattagttctacgtggaaaaatcactaagtgctttctctaatgtggtgattaagttttaaataaaaagttaggctactgttagatcaatttccctaaggaaaaagatttgcatttcttttaaagtacttaattgatcatcttttttttttttttttttttgagatggagtctcgctctgtggcccaggctagagtgcagtggcacgatctcagctcaccgcaagctccgcctgccaggttcacgccattctcctgcctcagcctcccaagtagctgggactataggccccggccaccagtcccggctaattttttttttttttaattttttagtggagacggggtttcaccgtgttagccaggatggtctcgatctcctgacctggtgatccgcccgcttcgacctcccaaagtgctgggattacaggcgtgaggcacagcgccggcctaattgatcatctttagactgtgttcttagattggattacttttgagttttccctgatgagaatatcaattacgcatcattccattccaagtccgcagtcgcctccctggaacaccatttggtaacttatgaggcataaccctgttcaggctcccagggctattatgcacattttctaaaatttcaggcatgttgatctttgcactgtgattactttttcatcaaaagccacacagagggatgtggagtgaccgtaatgtgagtgctgctggggcagggggtaccggccatcccggaggtgtgaggggcaggtacctggagcctggcttctggctacaccgggcactgcaccatgagctccccgtgacccgtgaggttgcccttcaaggcaagtgtacctgtcgcctggctctggccctttgctcaacccaatggccgctttgtggctgacaggcaagtggatgtagctggcacccttgggccagcccagcctccatttctccagctgtccccagagccaacgtgcctctcctttgcagtcacacggaagctctgcagcctggacaacggggactgtgaccagttctgccacgaggaacagaactctgtggtgtgctcctgcgcccgcgggtacaccctggctgacaacggcaaggcctgcattcccacaggtaggaggcacgttgggccacagccacccgctgccgctgggccgggccagggaggacaagcccgtgccagggggtggggacacaggcatgttctgggcgggcctggcaggtaacagtgacaccaagaggacaggactgagccctgggctccgggcccaggtggttcaaacatgaagaccatgaggtttggaaacagacccattatttctgtaagccagatctgctgtttaacctcagcttccccatctgacaaatgggaccaacactattgcctgactgcttgggtgatccctggagcactttgcacgatgcctggcccaccgcaggccctcagtctgcattgggactgtggggggatccagtgcaagggctcaaagcaccagggcaggcaaagggcagagctggcccgaggaactggagctaaggtgcggggctgggataggagtcaggggacgctcaggctctgagctccttttaccaggaccagtgttcattgaacgtagtttttcttttccttgatgaatgtggacaacaggcggccagagggcagtgagcacaggacaggcaggggactgggcagggtggggacgagcctccctgtcctgaccccgtgggcattgcctacgctgggcttgcctggctgccggcacttccacacggccagcacacatgaggccctcgaaggcggggcctaggcgtcacagctgcaccttgcacagcaaccccactcccactcatagctggcccgacccgcagcgttggcctcacccgggggcatattcgaagggcagagttccaggcccgccttttcaagagcctggtgacccagctcaccttccggcttcaggtgcggctcagcccccagaccgtgttctgcccccggctaccatgactgtcccctccagacacaggttactcccgagtgttctgtcactcttcctttcatatccttcttaccgaaaacaatttacttccaaagatgagtgatcacgaaaagaccgggttccatatgcatccttcaagcgctgcttcaattatgtgcctgaaacatctcagcaagtgaaagacactgtggctgaccttgctactggcaatgacattcaagcttaagctggttaaaaaatattttaactgaagtcatttcttgacatacacacgaatattttttaattctagaaacaatcacaaatccatttaaaaccaagtgtgggccgggtgcagtagctcatgcctgtaatcccagcattttgggaggccaaggcgggcggatcatgaggtcaggagatcgagaccatcctggccaacacagtgaaaccccgtctctagtaaaaataccaaaaaaaaaaaaattagctgggcgtggtggtgcacgcctgtagtcccagctgctcaggaggctgaggcaagagaatggcgtgaacctggaaggcggagcttgcactgagcactgagccgagattgcgccactgcgctccagcctgggcaacagaatgagactctgtctcaaaaaaaaaaaaaaaaaaaaaatcaaaaggcaaatgtgatgtgtgaaaataaaattacataatctactttgtagtgcaaaaagttcaggctgggcaaggtggctcacgcctgtaatcccagcactttgggaagccaaggtgggtggatcacctgaggtcaggagttcaagaccagcctggccaacatggtgaaaccctgtctctataaaaaaaaaatacaaaaacttagctgggcgtggtggcgcacgcctgtaatcccagctactcgggaggctgaggcaggagaatcgcctgaacccaggaggtggaggttgcaatgagccaagatcatgccattgcactccagcctgggagacaagagagaaactccatctcaaaaaaaaaaaaaagttcagttccaaataatggatgaactcagaacttggaagggtggtgactgcacacatggacagagctgaggcacggcggggtggaggcccctgcggctggcagattcaccggagcctcctcagactgcgcaggagcacagcaagtaaacagctaagctgtgcccatctgaccccagacacgtgtggccacagagaagccccttgccatccattcccccctcctctcctctcctgctcccccacacccctgccttcctccaacatgtttcagccattctcttggccttggtgccctaattggccgttatacaaaaggaagcttcctaacatctcggcgtggcctctctgggagctgtgctattccagacgctctcctgtgcctccagttgtttgcgtgcgccattccttctgcctgaaaacttttttttcttcaatgtttcattaggaaaagttttccaacacacagcacactggaaagaattttgcagggagtcgcacacgcccagcacttgggttctcctgttggcatcctccggccagatgcattcatcccatttcgcccggcccgtttgtctctgtccatccgtcaagctttcttgacttcttggtgcattttcaggcaaaccgcagacgccaacactcccctcgctgcctgggttgctgcctggcgtccattgttcacaggcggtcacctgaggggaggccaacgctcggacagctgcgctcacctgcagatccgacccctgccgacgacgtggggcctcgccctgcaagcccgctgcccctccgggtgcccctgcgctctgcctcccggctctctgactcttctccctcagggtgagctgtgcaggctatggggagcctctctctgtgctgaaggccccggccgtcctctttctttcagggccctacccctgtgggaaacagaccctggaacgcaggaagaggtcagtggcccaggccaccagcagcagcggggaggcccctgacagcatcacatggaagccatatgatgcagccgacctggaccccaccgagaaccccttcgacctgcttgacttcaaccagacgcagcctgagaggggcgacaacaacctcaccaggatcgtgggaggccaggaatgcaaggacggggagtgtccctggcaggtaacagtaggatgtcccctcgggcctgctggagagaccacctgtcccgctgtgcacctcggggaggccagcctgacacttggaatagcaatccgggaaggaactgttccgaactaggacagaggggctccgccacccaagcctgcctgcctgtcccctccctccgggcagccaaggaggctgtgagctccacagggaagtggccggggctgagggagaggctgggcccaggcaacgcccccctcagccccttcccactgggcatttccatggctgcccgtggcatgcccaggacgatgctgtcctgtgaaacagaagagagggagaaggcgcagccacacgctcaagtgtcctcaaacctcccctacaccaggagacaaggctaaagccagggagccacccacactgcaggggcatcagcgggcaggaggacggtgccgggtgggcaaggcctccatctgctcttctgtttgacgggaggcagaaagagttggtgtcctcgcttcatttctaattttggaatttttttacccaaacacctaaatcctatggaggtagatagtaccttagagaaaaacacatctacttattttcaaaggtaaaaaagaaaatcactctttgaggcttttttgttaagagacagtaccttgctctgttgcccaggctggagtgcagtgtcgcgatctcggctcactgcaacctccacctcctgggttcaagcgattctcatgcctcagactcccaagtagctggaattacgggcgcccgctacttacgcctggctaatttttttttttttttgagacggagtctcactctgtcgcccaggctggagtgcagtggcgcgatctcggctcactgcaacctccacctcccaggttcatgtcattctcctgcttcagcctcccgagtagctgggactacaggcgcctgccaccacgcccagctaattttttttgtatttttagtagagacggggtttcaccgtgttagccaggatggtctccatctcctgacctggtgatctgcccacctcagcctcccaaagtgctgggattacaggcgtgagccaatgtgcccggccatgcctggctaatttttttatttttaatagagacaggaatttcaccatgttggccaggctggtctcaaactccaggcctcatgtgatccaccctcctcagccacccaaagtgctggagttacaggtgtgagccactataccaggtcctaatctttgattgttgatttggactaatgctgccagattaaacaaataaaagcacaatactttcaattaaatttcaatttcacataaactagaaatacattaaacaaaagcacaatactttcaattaaatttcaatttcacataaactagaaatactttcagtgtaagtatgttccaagtatcgcatgaagcatacatatgcgaaaaattatttgctgtttatctgattcaagtcaaactaggtgtattagtcagttttcacactgctgacacatacatacccgagactgggtaatttataaagaaaaagaggttgaatgaactcacagttccacgtggctggggaggcctcaccgtcacggtggaaggcgcaaggcacgtcttacatggcggcagcaagacagagaatgagagaacaagcaaaaggggtttccccttagaaaaccatcagctcttgtgagacttattcacttccaccagaacagcatggggaaaccgccctcacgattcagttacctcccaccaggtccctcccacaacacacgggaaatatgggagctacagtttgagatgagatttgggtggggacacagccaaaccttgttgctgggcatcctgtattttctctggcaatcctcacttggacttgaattttcagcgcccaaaaccagaatgtcctctcctacaagcaagaatctcagagctgccagcgcccccatgaattcccccaggtcttcccccaccccagaccgtgtggcgggtgagcctctgtctaactataaagagccaagcgagagagggatgcactgaggtggctctgcaatgcatgtttgttgagggccttctgtgtgtcaggcactgagccgggtgctgtgtaggtgggatatgaaaccatgaagcctctctgtgaccaatacacagaaatctcaacctagttagggagctgagaccgaaatcctcccagtcccaggcactgtgtggttggggcaagaacctcgatgcaggagaccccaccgaggatgagcaggaaaagcctcttgtggggctgaggagctggacttggagctgcaggcggggttttggagggggtcctgggctgggggaccagggtggggcgccctggagggctcactggaggggccctcgcccagcctgttgaggtttgcgattcttgtttcctggttcgagtcttggcaagtgggcctcatctgcatctttaggaagaatggttggtgttcgtgtcttagaaagcctgactttccctcatgtaagctggatgatgagttgacaaattatgcaaaaaagaggcaaaaacatgaccccttttctagccatgaatgttttaagaaatgttttaagactcggtattgtcagtagtttcattggtctgtacatgtgcccagccactatcacaggacgggaaactccccagagaaaagaaaaccaaaatatgcccgggctccaaacttgcaagtccagctccctagggacagcatgtggcacccctgtcagtgcttgctcccctgggaccgtgttccaagtcctggcgggtaggagacccttcacaggagctgccacagggacccccaggaagtcacctgggatggaggtgtccgtgcaccatgggggacaggctcacactgctgaaccgtcgggacaccaggcaggcacaccggttgaggcagatgatgtttctgcacagactggcgtctcctggtcccaggtagaaatcctgccacagagacgggaaaggctgctcccacagggagcatcttttccaaagcatggacagatgtgtcgtgtgcatgagactttagagagctctgtgatggagttggtagaaagaagagatgactccctatatcagtgagtgtgtggcacaggcagagaaaagagacagacaaggaactgtccttgggtggatggcaggagaccgaagaggacagcttggcatggggagggccgggcagtgccacctgaagagctggcttctcagtcaggcaacacctgtccacctggccagccacactgagcctgtcacgtctgtcacaggccctgctcatcaatgaggaaaacgagggtttctgtggtggaactattctgagcgagttctacatcctaacggcagcccactgtctctaccaagccaagagattcaaggtgagggtaggtaagtgaccaacagcccccagggccgtggtggggggcaccgtcactgtctgcttttcagaaaccactaaagctgatggaatttgttgggaacactggttgaaatcctgaaatcctatttgtaggggttaggggcatttcacagaggaagaagatgaggaagcagaggaaggggaagagtggggaggaggacggggaggggaggcgaaccagcccagcccttctcccactgggtgtccaggtctcgggtctccgagtctctgggtcccgggtctctgggtctgcatgtccagctaatgttctgtgtctcagtgtcttttattgggagccttccagacctccctttctctttaacatactctgaacaccaagcacctctgtctcttctatttttatttgtgggattgtttcattaacatctgtctttgtccactagaccctagagctgctcagtacaaacccaacacaagctacaaatgcaagcaatatatgtaaactgatatttttctaacattaaatgttctattatacattttaaaatataaaaaaacaggctgggtgtggtggctcatgcctgtaatcccagcactttgggaggctgaggcgggcagatcacctgaggtcaggagtttgagatcagcctggccagcatggcgaaaccccatctctactaaaaaatacaaaaattagccgggcatggtggcacgggcctgtaatcccagctacttgggaagctgaggcaggagaaccacttgaacccgggaggtggaggttgcagtgagctgagattgtgccattgcactccagcccgggcaacagagcaaaactctgtctcaaaaaaaaaaaaaaaatatatatatatatatatgtatatatatatgtgtatatatatatacatatatatacacacacacacacaatttccataatatatcttatttaactcaacatattgaaaatattactttttccatgtgtaatcatgttaaaggtgtaataacacattccgcacattttctttcatgctaagtctctattttacgttcatggcacaactattttacactctcagccagcggccacaccgcacaacctgggtctgggatgccaaaagccttcggtcctgggacgcctcgttggtgcccacgactggcacagacgatgcacccgccaaaggacacaggagtggcggccgtctaaagaaccaaacgtgtgagacaggaccagtggttccctgggcagcaaggctgacaggcacttttatttgctgctttgcacttccctctatttttcaaattttcaaaagtgatcacgtgccatttttaatttaaaaaaatatatataacttccttaaaaagcaacggatgtgcgagagcatgtccctggctgagctgagcacagtcccactcgtctgtcccaggggaccggaacacggagcaggaggagggcggtgaggcggtgcacgaggtggaggtggtcatcaagcacaaccggttcacaaaggagacctatgacttcgacatcgccgtgctccggctcaagacccccatcaccttccgcatgaacgtggcgcctgcctgcctccccgagcgtgactgggccgagtccacgctgatgacgcagaagacggggattgtgagcggcttcgggcgcacccacgagaagggccggcagtccaccaggctcaagatgctggaggtgccctacgtggaccgcaacagctgcaagctgtccagcagcttcatcatcacccagaacatgttctgtgccggctacgacaccaagcaggaggatgcctgccagggggacagcgggggcccgcacgtcacccgcttcaaggacacctacttcgtgacaggcatcgtcagctggggagagggctgtgcccgtaaggggaagtacgggatctacaccaaggtcaccgccttcctcaagtggatcgacaggtccatgaaaaccaggggcttgcccaaggccaagagccatgccccggaggtcataacgtcctctccattaaagtgagatcccactcaaggcctggtttgtctctcgattgccgccttgccctggcttctcccgccctgttgaggtgggaaggtgaagtgtctgtctggaacaccagcttccgcccttcccagctaggctggggattcctccagggaatattctagtctgtgggggcaggatggaggctccagggatgatactgtgccatgactgccatgggcattcctttccccagataccttcctgcatctgggtcacgcccagaggcagatgggagcctgtgcaggccccgtggcgtcgggaggggcccacacgttggcgcagcctccccaagaccccccacttggcctggtctctcttgttcctcttgggaattggacacctccccggtgactgcctatgacccgcagactccctgggagggaaacgtccagaaagcttctcattggggcggacattttacattaacttaaacaaccaggtgctcttcaactgcacggtgccaggccccaccccagctcaggcttgtgtggtgggggccacaggcatcccccgggcaggtgacctgctcaccaggcagcgacctgacctggcacagttggcccccaccgtggccacccttagaaccccctgtgggctttagcatgcctgcatccaggccacagcctggccactgaaatcagtctctggagtgaagctggccaggagcttctggaagcttctggagctcctcaggtgctgagtggtggtggcgtggcaggcggggcttcggggggctcctcctctcctagggtccagatgtttagtccttgccctgctgcaatccggcactgtccctaggcctcaagttaactggccatgaaaatcaaatgaactttcggtaaacagaaaagattccggacaaggcctgccgtgtgtctcccaaacgtctcctgcagtttgcgtcttgtgtaatgtccctaagcaaagttcaacagttctagtacaaaaactccccaaaaaagtcatgagctgggcaaaaccgttcgtaaacagatgttgcgaagtcagggaaaatcaaagtggacaggtgttcgacctcccagaaacggtctgaggaggggccggtctcccagggtgggcgggagggcattcctggcctgcccgctctgaggccttctccgtggagctggctgtcgggctcctcgccggcccttcctggagaaaaggcttctgcctcggagctagcctgctgttgggctgcgtttcctaggcagccacgtggtccccagggccccagaggtaaaccctggacttggattcccgtttctggaaatcaaaggttgagtggggtccagagagaactctgggaaaataattacaattgaaaccccccatcgccatcactgtctgcaccctggttcctgccgcactgggtgtctggtgcccgtgcccgtctcaggatagaaaggaaactggaggctgcagagagaaggacctgatgggtcgtagctcagcatctgccgaagccccatctagaaataggttctcgtcctgggaggtgtgggagggagcctcgggagggagacagcaggaggagaggccccagtcctggacacgcgctgggggttgaagtctcggctctgcaggctcctgtgctgcgtggcagggattttctctctgcctaaatatcgtcttcataagtaaaggcaagtgggctaaacctatgtcatctccgtgttaactcagaatagtctaggcctgggccaggggacactttgtgatctgagacccccagaattccctgagggaggcccagctctgtttcgggaaataactgaagcggctgtttgtgcgaggtgagaccctgaggaccgagagcagcaggaggtcatggtggggagcaaaaacgggaaaagtgattccgcctgagactgagggagagagaacccaggtgagaccctgaggactgtgagcagcaggaggtcacggtggggagtaaagatgggaaaagtgattccgcctgagagtgagggagagagaacag

SEQ ID NO: 15396 - DNA, 28791 bp, Human
gagtttcgcgtaattgtctcattccactgcaggggagaaaatataatttctcttctttctctctttattagttgagacattctcctgaaaacaaaattcagagcaacaggagaaacaagcagaagtttattagcacttgctgtacccatcgtgtgagaggcctcagttcagaagtatttctctctcaaggcatgttgtgaacagcacaaggtcagacataaccaggtccacacacgtttatgtctttccacagggtgggaatatattgatgctatttcaattataaaagccacgagctacgaggagttgcctcgagacaattcccttcagtactacttgttaacttggtagagccatgggcaaaggctcaagccagtccacgtgtcagtcaatactgcaaactatacatcatagtgtacttaaaatacaaacgctatggtttaaacattccccatcaaacaaagtaacattggacatcaagagaaagaggataggaaaaggggttaatggatcaatccaaggaaagcaatgacgggaacaaggagtgtattccagcctgatccagacagaagtcattgtcttccaaggaagtccttgatgtgagcagatccttaggcagcagatgcagggtgctaagcacaagtgacagcaaggtggggtctatcaaaatgccagtgttgaattggtcaaatcccgccctttttaaggtcacagtcctctggtgaggactgatagtgagtgcctggtcctgtctttatctggctgagtgctgtctctattaactaggtgcacatccagtccccgttgctatgatgccttttgaaatgtaagattaaatctttttctaagatgtaggtacttatgcgacgggtgctttatacaaagcagtagcgtaggggccttaattaaatagtattttaacaaaaggccataaatcctatatgatgacaagccaaaaaacagagcatcttcagacttctaaaatgcaggagccaggcgccgtggctcaggcctgtaatctcagcactttgggaggccgaggcgggtggattgcttgaggtcaggagttcgagaccagcctggccaactggtgaaaccccgtctctactcaacatacaaaatcagccgggcgtggtggcgcacgcctgtaatcccagctacttgggaggctgaggcaagagaatcgcttgaacccgggaggcggaggttacagcgagccgagatcgcgccactgcactccagcctgggcgacagagcgagactccgtctcaaaaaaaaaaacaaagtgctcgacaggaactttctgtaagccaaagagtatcgccatcgcaccttcaccttcaccttgggcagcctggtgccgtcttccctcagcccgcgattaacgagcggaaggccgcactgacccatttcagatcccttatttccttcctaaaaccactcaagagtttgggcacagtggcctccctgtgtgaggaacttgcttcccactcaccaaaagacaaacccttcgcccatccctggccgcgcacccggccggtcacccgcgctgccacccacaccaccctcctgtccataaagagcccgcgtttgggacgcctcgcaggctgaagggaggcctgggcgtccgcgatccgtctgccctttctcccctcgcgggcttcctctttcctcactttctcccgccactactcttcctcttccttttccgcgaacccagcccacttcccgtttcaggacctcggctcggccccagtcccccggaccaggccgggtcacgtgggtccagggtcacgtgccgctgcgggtcacgtgccgctgcgggtcacgtgtcggcctgcatcacgcgtgagggggcgcgcggtgctggaagctgccgcacctgcggggagccgagccgccggcgctcgacgcgcgcgctctcgcgagacccgcgggatcacgtgacgcccgggcgcggcgcagctcacgtgacaagcgctgccggccgcggtgtcttcttcgtgccggcgtcgcagtggccgggcctcttgcgtctggtaacgccgctgtctctaacgccagcccttggcgcccgcgccccgccaccgcagcgcccggcagtccgcggcccaaccgccgcccgcgcccccgctccccgcaccgtacccggccgcctcgcgccatggcggcccccggcagcgcccggcgacccctgctgctgctactgctgttgctgctgctcggtgagggggtcgaggcggggcctgggagcggcgggaccgggcggagccgaggtccctgggtcttgagggcgggggactgccgggtcgttgtcccgcgggtcgccccgcacccactgctcctggtcccggccggctctgcccgcgggcgggtgtttctctcggggtcgtagggtcggagcggagctcaatggcaggtgcttgggggaccaggaggtctcatcccaggacctggctcctctaaggtctgtctcactgaactcagtttttctgtggtggtgagtgcgaaagggaacttccgatggcttgctcggcggtctggtgctttcaggtcgttaagtttcctggcaagttgaggcggtgagatctagacgaggctgcgccgccgaaggtggcagggacgtctgtggtctcagctcccgggtgggtgacctagatcaagctcttcccaacatggatttcacccaggacagggagaagccggtgcgagcattccccacctttgtacttgaacctttctcctctttcagcggtgtggaggagatgcgagtgtatttatgttattgtgaattcacatgtatgttaaaataatttttaaagttatctttgggatttcacaagattccgtagtagacaagatgagggaaagctggcctcagactcacggtggcaatgttcatgtctagtaagtagtttaaagagcgccgttcctgtaggccgaaatgcgggaccagggaacacgtggggaagcacccttctcttctgtcagtttatagagctcagatgggcagtaggtgctcaatattgtattgactagtgaatttcgttctcatttattgtcttaataagaggatgtgtgctgtctctttaagacagtccggattgccccccgccaacactattctttcacctcctccccccgccgccctcccccgtaatatgagaagattatcttaaatgccaggatctgaaaggtgatgtagaatcaagctgggggagtgtgtgtgagttaagtagatatagaaatacactcctgtacacatctgccttgacttctttaaatccctcagtcccatccagctgtaaaactctgttactgtgagtgaatggatcttggcttcccttttttgttttgcctgttgtgtaaaatgaattctttgaactgcctgaatagccacagagatgaacttattccaatagtaagcctgaagccttgctcagctcctgcgacagggtcaggtgtagttaatgaaaggagttgcagaaacaagttttgtcatgtcacagcaactgcattgttctttgttacagatgctcacaagcctcataactttgatgttttgtttcatgttttaaaaactcacttcaggccgggagcagtggctcacgcctttaatcccaacactttgggtggccgaggcagatggatcatggcgtcaggagttcgagaccagcctggccaatatggcgaaacccggtctctacaaaaatacaaaaattagctgggcatggtggcgcacgcctgtaatcccagctacttggtaggctgaggcagaagaattgcttgaacccgggaagcagaggttgcagtgagctgagatcaagccactgcactccagcctgggcaactgagggagactccgtctcaaaacaaaaaaaaaattaactttaaaaatgaagagaaaaaatccataactccctaatattgtgattggaatattgcttgtgtaatcagtcttctaagatctgttccattatatcttttatgtttacaatcttaactttttttttttgaggcggagttgctctgtgcccaggctggagtgcagtggcacaacctcggctcactacaacttctgcctcctgggttcgagcaattcttctgcctcagcttcctgagtagctgggattacaggcacccgccactatgctaggctaatttatgtatttttggtagagactaggtttaactatgttggttagactggtctcgatctcccgacctcgtgatccgcctccctctgcctcccaaagtgctgggagtacgggtttgagccaccgtacttggcccaagaattttttttttttttttttgaggcagagtctcactctgtcacccaggctggagtgcagtggcgtgatctccgttcactgcagcctccgcctcttgtgttcaagcagttctcctgcctcagcctccctagtagctgggactacaggtgcgcgccaccatgcctggctaatttttgtagttttagtagagatggggtttcaccatgctggccaggctggtctcgaactgacctcgtgatccacctgcctcagactcccaaagtgctgggattacagccatgagccaccgtgcctagccaaaatccaacttttaaaaaaggccttttaacaacttgcatttaaagatatttaaaatgtttattttaatgtgcgatttcaccaaaaatccttttttcttaaaaaaagaaactgctcaattacaaatttccactatattaataattaggcattgtttaaagctactgtgtttgaatacttagaaagctcaaacatgaactgaaacttgtcctgatagataggattagctgtgattgcgtaatgtgaccctttaaaccattgatgtcagcaggatgaccgccttaccctttccacttgaacaactgtcacttaggaggtttgaacaattttatactcggctgggtgcagtggttcacgcctgtaatctcagcactttgggaggcccaggtgggcggatcagctgaagtcaggggtttgagaccagcctggccaatgtggtgaaaccccgtctctactaagaatacaaaaattagccaggcgtggtgtggtggcaggcgcctgtaattccagctacgtgggaggctgaggcaggagaattgcttgaacctgggaggcaggggttgcagggagctgagatcgtgccattgcactccagcctgggcaacaaaatcgaaactcaatgtcaaaaaaaaaaaaaaaaaaagaaaaagaaaagaaagaaaagctgggtgtggtggctcatgcctgtaatcccagcactttgggaggctgaggcaggccgatcactaggtcaagagatcgagaccatcctggccacaacatggtgaaactccatctctattctttttaaaaatatttttaaaaagttagccaggcgtagtggcacaggcctgtagtcccagttactcaggaggctgaggcaggagaactgcttgaacccggaaggtggaggttgcagtgagccgagatcgtgccactgctcttcagggcaacagagcgagactccatctcaaaaaaacaaagaaaaaaattttttttctactaaccgatgttacctttgattgtgcagattgtcagttatgcggtggaaagaatgaatttgtcagcagatttgaggtcagaatgtctttgtagccctgtaattttgaatttgtattgcattagccccatcccagacaacgttaccctttcttctctgtacccaagacttttattgcatgtgcttctacatggtaacatctgttcggctgcactgggattatttttgcctgtgtatctcccttccttaactgacaggtagtaagtgctgagtacatatatgaagaaaggatcaattttatagcagtggctctcaaccaaacatatgcacggatccacacgatcagctttttagaaatatacataccacagcgaggcacagtggctcatgcctgtcatctcagtgctttgaggctaaggcaggaggattgcttgagatcagcctgggcaacatggcgagaccagtgtctctacaaaaaaaattaaaaagaaatatacggccgggcacggtggctgtcacgtgtaatcctaacactttgggaggccgaggtgggtggattgcctgagctcaggagttcgagaccagcctgggcaatatggtgaaatcccatctctactaaaatacaaaaaaaattagtcgggcatggtggcgtacccctgtagtcatagctacttggaaggctgaggtaggagaattgcttgagcccgggaggcggaggttgcagtgagcgaagatcatgctactggactccagcctgggtgacagagtgagactctgtttccatttaaaaaaaaaaaaaaaaaatatatatatatatatatatatatatttacacacacacacacttataccttgcctctagaggttgtgattcagtgcctgggatggtatttttttcctttagttcttcataaatgattgtgcatcattggttaagtagaataaaaataccatatttaaaagaatcaagccaagaaaaactaagatgtgatttcttttttttttttttttttttgagacggagtctcgctctgtcgcccaggctggagtgcagtggtgcgatctcggctcactgcaagctccgcctcccaggttcacgccattctcctgcctcagcctcccgagtaccagggattacaggcatgcgccaccatgcccggctaattttgtatttttagtggtgacagggtttctccatgtttggtcaggctggtctcaaacgcctaacctcaggtgatctgcccacctcggcctcccaaagtgctgggattacaggcggtagccaccacacccagcctaagatgtaatttcttaataaattgttttttcttctttttttgagacagtctctttatgttgtccagtctggagtgcagtggcacgatctcagctcactgcaacctccacctcccgggttcaagtgattcttctgcctcagcctcccgagtagctgagactacaggcatgcgccaccatgcccgtctaatttttgtatatattttttagtagagacggggtttcaccatgctagctaggctagtctcaaactcctgacctcaggtgatccgcctgcctcagcctcccaaagtgctgggattacaggctgggattacgggctgtgcccggcctaattttttaaaatgaagttttttactcatttcttcagatggtaatctttaatgtcaaaagcgagtatttcttaatttttatttattttaattcaaaaaaattaaattttttttttaagagacaaggtcttgctgtgttgaccagcctggtctggaactcctaacctcaagcagtcctccgcttcctcagcctcccaaagtgctgagattacaggcatgagccactgcacccagccagtgtttcctcattggaagcccgttccctcagtcatcaagtgctggagaggcagcgtggctcagaagtggcacgtcctgtgagtcagaagaccccttctagatctaggtctccgccactcactagctgtgtgacctgggtgggttagttgacctctctatgccttaatctccctatgaagagttgtcatgataactgggatgtgcttagagcagcacctggcacaaagtaagtgcattccaagtgcttgttaaatgagatagtttttgatgttttgtgtcagatactgaggattgaatgatgaacttgatgggaaccctctgtacctgtgcagatgtttaataacagctgacatcaaagctggcgtcagtgccgggcaccaaatgctcagctgctccgacagccctgaggccttggcactctctcctcctgctcgtgggtgcagagactggggattgggctctgctactggccatggttgcacagctagtaagtgctgcaagaacctccaagaactgagggctgtgactcagaagcacgcatgcttcccacagcggcacttgtttcagagaacagaatttctcccaagtgggggtattttgaagccacagttactcctttatgtgatccctggagaagtggtcctgttcgtgtctgagtacaggactgccggagatagcagtcaccagtaggccagggtgcccaccttggagatgctgccaacggctgtcctgttgggctgtgacacctgtcaggttactggaaacattgtaacttacttgaggttttttgtctttttttttttttgctacccagttgccactgttgtggaggtttttaaaaaaacttctgacccttatagcatacatacatttcctcctcaagctctgtgtgctgatgctcttattttcttctataccaaaattgccttctgggggtaagtttattttaataactcaaaattcctgggtctctccagagtaatacaggcatcttgtgctgccaaagcttactttaaatttatttaaatgatatttctttgttttcctctgaaagctgagacctggctgggcatggtggcttacacccataatcccagcactttgtgaggctgaggcaggtggatcacttgaggcgaggagttggagaccagcctggccaacatggcaaaaccctgtctaccccgtctctactaaaaatacaaaaagtagccagacatggtggtacaaacctgtagtcccagctactcaggaggctgaggcacgagaatcgcttgaacctgggaggtggagggctactgcactccagcctgggcaagagtgagactcagtctctaaaaaataaaaataaaaaagctgaaaccctcagcatatttactaagtgaaaaaaaaattgtataattgaaaaatgacttagtttgaaatatttcctaatgaagtgcttcgggtcagtgaaaagtgtttgaggaaacttataaaagggcagcttaataaaagccagcctatggctgctcccatgtgggcatccgggttgtcagtggtgactgtgggccctgtgactcctcacctgagggcggggtgggcagtctccctgtccacgctgagctccagtcaagtgttaagtctctggcgtctgctgtgtctgcctgtccgctgcttctgccttgctggcgtctgctgtagcttctgtacactcatctgatctttcacaagagtgagaatattttgtctgtttttagaaacctttactatgtcaaaaataagtggtagaatcttccctagattctctagattcattggaaatgccgttagtatgatcctgcctcagtgttgcagagtgtggcttgaaaaaccaagcaaagcagacagtagattggaggtttccttgcacgccctactttgtttcattgtcgtgtagcaccttttctttttctttttttttttttgagacagagttttgctcttgtcacccaggctggagggcagtggtgcaatctcgactcactgcaacctcggcctccctggttcaagtgattctcctgcctcagcctccctagtacctgggattacaggcgcctgccaccatgcccagataatttttgtatttttagtagagacgaggtttcaccatgttgggtaggctggtcttgaactcctgacttcatgatccacctgcctcagcttcccaccaaagtgctgggattacaggcgtgagccactgtgcccggcagcaccttttctttatggacatagattttggtatttcctttaccaaagggaagataggtgggactacttctggttatatgcttcgctttaggcttgaagaacagttgctgtaaagattttattttgtgaaagacccaaggttgaaatgagtcggattcattggaatccattacttttccagggaataggattttaaatgaaaagctaagcatcctctctttcaatatctgccctcacagtgtgcctgagttgcatttacacttagagtgacagatgagactcgggtgtgtgtgtggttggaaggctgtgctcacgcagtgtgagatcagcccctgggtggtgagtgctcactggactggcatgcacgaacttgtagtggcagagacaagtgaaagcatgtcatttctgcacggattccagtggtggcagataggtgtttggcgttagaacaggcagaaacacctgttttccaatctgtaatgaaagaactgtgtaataacgtgcaatttgtacaattaccagtgtctctaccatagtgatcagattacatttgttgccaaacatcttgatcagggaagtggagtatgagtaagtcagagaggaaatatttagcagtgaccactgtccagctggaaagacctatagagcttccattctgtccctttgcttcaggatggggaagggaagccactccaccgatgtgtagtgctgtgaggacctttctgaaattgggcaaagagctcagcactttgagtccatgagaaataaaactgaccagacgttaagtagcaggtgaggaccacagtgaaagatcctgcagcctctcccatggatttctgcagatgggtgagttgtgccttcaaggcaccacgtcttacagagatcctctgagaaaggcggaacagcgtatgcctaggatgatgcagaaattgacatgtgccttcctgataagtgttctggaataaagcactaaatagcaatagactaggttggcaaactcaatcagatgggcttagagataacaattccagaatagtatccgaaagggacagggcaccaggtgaactggctgcgtaatccatgtgtctggttgttcattgaatttaagaaacacagtggaggctgggtgcagtggctgacacctataatcccagcaccttgggaggccaaggtgggtggatcacctgaggtcaggagttcaagaccagcctggccaaagtggcaaaaccccgtcgctactaaaaacagaaattagctgggtttggtggcacgtgcctgcagttccagctacttgggaggctgaggcaggagaattgcttgaacctgggaggtggaggttgcagtgagctgagatcacgccactgcaccccagcctggcgacagtgagactccgtctcaaaaaaaaaaaaaagagaaacagtggaatcttgtaataaaagccatcactgctacagctgtggaaaatggaaatactcggtcgtattttctggacagtttttgatggtctccgtcttccctggaattgacaggcctcatgcattgtgcgtcagcagcaatgtttatggtgaaaaatggcaacgggaccgcgtgcataatggccaacttctctgctgccttctcagtgaactacgacaccaagagtggccctaaggtaggaaacaccagggcacttcatgcttcccttgtgtgtgtggaaagatgatttttaacatttcaaccaagtctttgaaaaatggccccatctgaacatggtgcttttcctatctgcatatctccttctggtgttgtcagtaacctgcgctgtcatgtgccatagccacaggcacagtaacaaacctgtatatgtgctgcacctcactgttcatcatgaacattttcctttttttttttttttttttttttgagacggagtctcgctctgtcacccaggctggagtgcagtggcgcgatctctgctcactgcaagctccgcctcctgggttcatgccattctcctgcctcagcctccccagtagctggggctacaggcgctcgccaccacgcacagctaatattttgtatttttagtagagatggggtttcactgtgttagccttgatggtctcagtctcctgacctcgtgatccacccgccttggcctcccaaagtgctgggattacaggtgtgagccaccgcgcccagcctatcatcaacatttttctagttttctttttttttttttgagatggaatcttggtttgtcgcccaggctggagtgcagtggtacgatctgagctcgccacaacctccgtctcctgggttcaagcagttctcctgccttagcctcctgagtagctgggactacaggtgcccaccaccacgcctggctgatttttgtatttttggtagagacggggtttcaccatgttggccagggtggtctcaaactcctgacctcaagtgatctgcctgccttggcctcccaaagtgttggaattacaggggtgagccaccgctcccagctctagttttcttcgtgattgtcttttataatcataatgtaatactttattatgttaattcaccataatttgttacacactcccctattagtaattggtaagttgtcttgaatctttttcatgctctgtgaatgtggcttttttgatttagagagttatactgcaagaaatgtatataaatggttggttgacatgcaatgcaaacactgtactagtttgattaaaatgttccttagtggttttgttgaaatggctttgtgtttctttgggatgactaaagccttttggaataacaaaatattttaaaaatccaagacatagtaagatcttatctcttttttaaaaaaaaaaaaaaaagccagacatggtggagtgtgcctgtggtcccagctacttgggaggctgaggtgggaggattgcttgagcctgtgaggtcgaggctgcagtgagctatgatcttgccactgcactccagcctgggtgacagagcgagaccatctccaaaaaaaaaaaaaaaaaaaaaaaatccagtctcaaattataaatacttgtcaaagcctttttctcttttttctgagacagagttgcactctgtcccccaggtggctggagtacagtgccaagatctcggctcactgtgtcttccacctcccaggtttgagtgagtctcgtgcctcagcctcctcagtaggtgggacatcaggtgcatgccaccatggccagctaattatttgtatttttagtagagacggggttttgctatgttggccaggctggtcttaaactactggcctcaagtgatctgcccaccttggcctcccaaagtgctgggattacaggtgtgagctaccgtacctggcctccaagcactttttttttttttttttttttttttgaggcagagttttgctcttgtcacccaggctggagtacaatggcgcgttcttggctcactgcaacctctgcctcttgggttcaagcaattcttctgcctcagcctcccaagtagctaggattacaggcatgcgcccagctaatttttgtatttttagtagagacagggattctccatgttggtcaggctggtctcaaactcctgacctcaggtgatcttcccacgtcggcctccccaagtgctgggattacaggcgtggcccagcgtacctggtctccaagcactttttatttaatttctacatcacttttttaatgtttggttttggtggttggattttttaaatattctattataaattatgtttcacaagtgaggtcacctatatgctgttatgcactttgttatttcacagaacatgtctttatcaccttgtgtagtttcgtgttgttttttggcccacgttagtatactgcttcactgtagttcatttgacctatctagtttactttgatgaacattaagtggttttccagttgctcgttttgcttatagtagtaaatttaaacatttctgctataaacaccttctttgtttaaagaaacattatttaaatgaacatttctatagtaaaaaagtagtgatagcttttctcaaatatatatctcaccctgaagctggtgtgaattgtttcaatttcaagacgctttaaattctgttataaattatattaacataaaatgaatttatggggttgttttgttttgtttggagacagagtcttgctctgttgcccaggctggagtgcagtggtgcagtcgtagttcactgcagcctcaaacctaggctcaagcaatcctcctgcctcagcctcctgagtagctgggacgacaggcagacaccaccatgtctgattagtttattttgtttttgtagagatggggtcttgctatgttgcccaggctggtcttgaactcctgggctcaagcaatccccccacctcagcctcccagagtgttagcattacaggtgtgagccaccatgcccagctgcaaatttttgattatatgaattattaagccaactttctcttacacctgaaatacttttcagtcttttactgacatgtaatactaacctttttttggtttatattaaaaatgagtacctcagtagtgatatcttagttggaaatgaagtataagtttatatcagacttacagaaaatctctttctttgaacttttaataacctgcatcccaattgggttacatttaattgtgtttattctagaacatgacctttgacctgccatcagatgccacagtggtgctcaaccgcagctcctgtggaaaagagaacacttctgaccccagtctcgtgattgcttttggaagaggacatacactcactctcaatttcacgagaaatgcaacacgttacagcgtccagctcatgagttttgtttataacttgtcagacacacaccttttccccaatgcgagctccaaaggtaagaaccaaaatgggccgattatgaagtgatagaaaattgggttggaggattgtctaaagttacttttacctaagaagtacaggctgggtgtggtggctcacacctgtaatcctagcactttgggaggctaaggcagacagatcacttgaggtcaggagtttgagaccagcctggccaacattgcgaaacactgtctctactaaaaatactaaaattagccaggtgtggtggcgggcacctgtaatcccagctactcgggaggctgaggcaggagaatcgcttgaacccaggaggcagaggttgcagtgagccgagatggtgccactgcactccagcctaggcgaccaagtgagactgtctctaaaaaataaaaaacacacagccaggcgcggtggctcacgcctgtaatcccagcactttgggaggccgaggcgggcagatcatgaggtcaggagttcgagaccagcctgatcaacatggtgaaaccccctctctactaaaaatacaaaaattagctgggcgtggtggcgcgcgcctgtagtcccagctactcaggaggttgaggcaagagaatcacctgaacccagaaggcggaggttgcagtgagccgagatcacgccactgtgctccagcttgggcgacagggcgagactctgtctcaaaaaaaataaaaaacacataaagtaaactaagtactataagtagtttgcaattgtgattttttttttttaatctagaaatcaagactggaatctataactgacatcagggctaaaataaaaaacacataaactaagtactgcaagtagtttgcaattgtgattttttttttttttaatctagaaatcaagactgtggaatctataactgacatcagggcagatatagataaaaaatacagatgtgttagtggcacccaggtccacatgaacaacgtgaccgtaacgctccatgatgccaccatccaggcgtacctttccaacagcagcttcagcaggggaggtaggacgctgacccttggccctctggtgctagtggttgggtagctgggctgcagtggctgcgggtgacctcactgctctgtgtcctggtgctgggctctgcctggaacgcgtgtgcacacagccggcgacgtctctgcagaacgttctcatccttcttcctagggcaggtgacttgtagatgagggtagacacatgttgattaaaaagggtggaatattgaagtgaaatatcccgggacagagacagatgttgtgtggtctcccgtgggagctaaagcagtgggagtcggcggggggcgggtagagagagaggtgatcaccaggggctggggttaagttggtcagaagatagagcgtttccggaagacaggaggaattagtacagcatgtgactgcagttaataatgtattctggcttgaatattgctaagtagattttaactcttctcaccataaaaaagtaagtgtttgattttagctgtcacacatgtaggtgtatttcaaaacatcctgacacacatggtaaacgtatacaattattacttgaaaatgtcagaagggcaaagcagttgaaacctttgtgcttctactggggcagagatgatgggaccagggtcacagatctcttgcagtttgagccagttgccttcacacagagacatagtcttatctccatccagctctggccggccagcttagggacaggtgcagaaagaccaacgctgcctctctgaggaggtcagggctgcgatgatgtacctgctaacccagccgccgggctctggggtcaggcagggtccaggccacctcctagccctgtgatcttgagcagggtagtttacctctcattttctttgcatgtggcatgagattaaaagcctgtcttcaaaggttgttggaattaaaagagaaatgtatgcaaaatgtgtatctcagcatctggcacagagttaagtagcaagcacctggtaaatcctgttacttttgaggagcttctctcccgagcctcacagtccaggtcataggttgttgtcattttgctgaagcgtgagggcctgtgatttgccttagggtgagctttcccggctgatagaaatatgtatggagacatcccttagggtgggctttcctggctgctagaaatatatggagacatcacagccttctctaatcttgagagctactgtggagacctttggtttgcaacattcctcagcagtcttgcttaaaggctgaggagtgactgctgggctccacaggaggatcgtccgtctcactcctccccgaggagcaggtactcttgcaggtcggcaccccatggtgctgggccggtcttgcccacctccaatttccatacagcccatgagctaagaacggcttttcgatttataaatgtaacataccaaaaatcagaaaacgaatatttcttgacacataaagattatgtaaaattcagtgtccataagttaaattttcttggaacacagccacactcatttatttacacattatctgtggctgcttttgtattaacagtggcagggctgtgttgtcttgacagagagccacggcccacaaagtctgaaatatttactgtctgtagctttgcggcagactttgccttccctggtgagtgggtgaaaaggagcccaacttggaaaccccgggtgtgactgggacttgatggggccacgtgggctcccataggggaggcttggaaggaaacacacttaggagctgggtcctctgtaggtgctgctgcctttaatcctcaacacagggccccgggggccgtggtgacagccgctttcctggtgcagcctctgttcacacggagcctggagtcgtgtctgcttcatcaggaagagcgggctagagtcctctcacatgggccgcgtgtgtctgaggacggacgcctggcagcctgtctaggtgtgttcatgctctcagacacacctcagccagagctaaagataacttcagctaggggcagtgctccctaccaagtgggagttagcgtaacacatgggggtgactagtgttcacggttatcgatttccaaattatctgggctccacacctagctggctacctctgggctgcatcaatgtggcttgaagaggaaaaggaagggcacgcactctctgtcagagcttgggaaatgagagagaattggatgctgaccttgtccggggactccctactggctaggcctggacacggttgcagaacgtgtctcctccccatgtcgctctgtgaccgaggggtgcgcatggcatgaccgctcactcactcctgcctggaagtgaagggctgctaggtggaggtcagcaaggatgttgagtgccctgagacgggtggcaggattctctagatgaaaaataaggcttcacaggtccagagaagcttgctaggttcttttgagaaacctgtttcttcaggttaataattacttttaagatagactattttttagagcagtcttaggtttctgtgtattctctgccgctgcgcatgtacagccttcctctgtgtccagatcctggacgttggttccttttttaatggagaacacgcatgtgattccaaatggaaaaaggcccgacagcccagccctggccacttgcccctcctggaggcagccagtgtggagatgccagtgtgcctggggcgtggcctcctagagggagtcagtgtggagatgccggtgtgcctggggcgtggcctcctggagggaaccagtgtggagatgtcggtgtgcctggggtgtggcctcctggagggagtcagtgtggagatgcccgtgtgcctggggcatggcctcctggagggaaccagtgtggagatgtcagtgtgcctggggtgtggcctcctggagggagtcagtgtggagatgcccgtgtgcctggggcatggcctcctggagggaaccagtgtggagatgtcagtgtgcctggggcgtggcctcccggagggagtcagtgtggagatgcccgtgtgcctggggcgtggcctcctggagggagccagtgcggagatgccagtgtgcctggggcggggcctcctggagggaaccagcgtggagatgccggtgtgcctggggcgcggcgtcctggaggctgggcttcctgcctgggtggcgcttcaccagaaagcctcatgtatcttgtctttttttttttttttttttttttttgagagggagtcttgctctgttgcccaggctggagtgcggtggtgccatctcggctcactgcaacctctgcctcccgggttcaagcgattctcctccctcagcctcctgagtagctgggattacaggtgcacatcaccacgtctggttaatttttatatttttagtagaggggggcgttgcaccatgttggccaggctggtcttgagctcctgacctcccaaagtgctgggattataggtgtgagccaccgtgcccggcccatcttgcctttcaatacatcatcttatctaaaaaagctcggggacctcatagattttattttaaaaggaaatgaagcacaagccacctttgaatggactttcctgttggttttgtaccttccttcctgagtatcttcaaagtagggcacatgtggctgggcacggtggctcagtcctgtaatcccagcactttgggaactcgaggtgggtggatcacctcaggtcaggaattcgagaccagcctggccaacatggcgaaaacccgtctctactaaaaatataaaaattagtcgggcgtggtggcaggtgcctgtagtcccccctactcaggaggctgaggcaggagaattgcttgaacccgagaggtggaggttgcagtgagctgagatcatgctactgcactccagcccagctgacagagtgagattccatctcaaaaacaaaaaaacaaagtagggcagatgactgtcactccagagggtctgagtgcagctctgcctgaggctggagtcagccagatatccatccaaaccggatttccagcccaggcccatatggggttagcagatctacagtgaggctcagccaggcttttgggtttatgagttcaccgggaggagtggggtgtcttcgtcttttatcctcagggtctgataggtgcacgcttgttgaatgaatcagaggactgcctgactcctgttaggagttgaaaatgaaggtcaccgtgtctcatctcccacccaatttggcatgatttttttttttttttttgaggcagagtcccgctctgtcaccccaggctggagtgcagtggcgtgatctctgctcactgcaagctccgcctcctgggttcacgccattcttctgcctcagcctcccaagtaggtgggactgtaggcgcccgccaccacgcctggctaatttttgtatttttagtagagacggggtttcaccgtgttaaccaggatggtcttgatctcctgacctcgtgatccgcccgcctcggcctcccaaagtgctgggattacaggcgtgagccaccgtgcccagctgcagcatttttttttcattcctaggaacagagtctgactcctagcttaaatggaaggaatcgatggtaaaacattggaggtggaggttgcagtgagctgagatggcgccgctgcactctagcctgggtggcagagcaactgagactctgtctcaaaaaaaaaaaaaaagaactaccatcagaaaggcggagaggatgagagtccctcaggacaggtgaaaggggcaggagaaggtcagaggcctgacacacccaacattgtcacaaaaaactgtaagagaggctgtgggagctatgagtcgggaacctgggtgcaaaccaatctcatcctcacagacacccttgagggtctgaattgcagcttgcaggttgatgtgagtatctgctgttgccgggagaggaggaggggccttcagagcacatgagctttggaaaggcccggctgtgtgctgctctccggagggtgctggaggaggtgtgacagtggaccctcaggtctccccagaggctcctgtgccaccatctccccccgggcagcgcagggcactctccagtgcgttccgtgatgagctctccgtcactgtcctccgccctcagcaggaaagactttggtatttagtacgcattcagggaaggagagtgtgggtttgcgtttgtaattcaggtagaaggacgagggcattttatccacacttatttctcaagttccagttttttaaactggtggttagacctgatgatgttttatttgtgtttccagcttcttgtgaccactctacagaaacagggtgggaaatgaatgtgccacatggatcacaggtgaaaaacaattgtcaaagcagcgtaggttacactttttctgtgcgtcgtgtggccatctagactagaatttggacaagactggccggttttgcacatttaacttttgcctgtttaaccctggtctgtaacattttataaaggaaccgtgaagctgcttttttttttttttttttgagacagggtctcccaggctggagtgcagtggcacaataactgctcactgcagcctcagcctcccaggctccagtgaccctccctagtcagccttctgagtagctaggactaaggcgcatgccaccatgcctggctcattttttaaaaaaactttgtggagatgggggtctccctatgttgcccaggctggccttgaactcctgggctcaagcagtcctccttccttggcctctcaaagccctggaattacaggcatgagccactgcgcccagcaagtgaagctgttttggaaaggactggtcaacctgcagcttcgccaagggcagtgagcaagggtccctgagcacatcccaggttgggacggctcccagtggccgtcagtgcctctcacttcagagtttggtgtggttactgcagctcctctctgccatcttgtgctctgtccagaaggggcttttacaccggggtgcgggggcactcctgtgtgtgtctcagaacccgttggggtgcagtcataggcgacgttgcctgtctctttcctgccctgagtagatgggatatgaaggtgggaattggccactgaatgttgagatggaagcggaagcagcaggtgactgatggagttatgagtggcagattccctgcagggttgcccaccctggatatgtggggctcacgcgtggtgactcagcctagcagagatgtggaaaggatcgaattgggtggaaattatataaatattattcttgagtatccacagaaacaaggtggtaaaagaaagaacctgatttcaaggttgatggtgtgttagtgagagtgttggccacagaagactcggtagagctctacctagggttcagtctgtcttgactttgaatataaatttgtgttgtgaacatcttggtgggtgaattgctgaaggacagagtcacattcagactgctgggcattccccaggggtgccatgtgcccccccacccccacggattccctgaactgtgccctcttgtctggggatttcagacgcacccacactcactgccttctccctcgtgaggatgcttgcccatcccccacagccccctccccaaatgaagacccaacacagctggctagccttgcccgcctttgagtctctgctcacacgtggggtcctcatggagactgcctgacccctgtcctgccagagggcctccttggctgctctgcgtcccacctggccggtctgtgtgtgctgcagaccctctgtttccctctgggtagtgtttccagcacgatcctggcgctcacccgacagctcagggagcagtgtctgagtcgtcaccatttcccatggggtgaggtggccggccacgcagcacagcttcctgcgtccactccttcgtgacagcgttcaaggctttctcaccctcactttaggaagagggtggcacagtggcccctgtccagccacggggcttggggtgtggtgggcggtgcctgctgcccaggcagaaccgtcctgggtagtgggaggtggaggctgagggtgccccacgggcctgtgcctaccgccctgagccgtctgcaggacccagctctttcctgcgcgtctagaaaggcattagcgagagccaccttgggagactgagaaaatagtcaccaaggacgccagagtccacagatgtagttttgtttctgagtttggatcttactgtaactgctgatggttatgagaaacccagacctgaatctccctccactgcacctgcagagacacgctgtgaacaagacaggccttccccaaccacagcgccccctgcgccacccagcccctcgccctcacccgtgcccaagagcccctctgtggacaagtacaacgtgagcggcaccaacgggacctgcctgctggccagcatggggctgcagctgaacctcacctatgagaggaaggacaacacggtagggctggggcctcacctgggagagggggacggcacggtagggctggagcctctgctccctgtgcactgagaacacgcgtctctgcacgtcatgctgttaagtcaggatgggagcttagcttgcaggacgtgaccctagaggacaagagctggcgtctgtgtcagtgagtccattttgtaggatcacagccgtcctgctggttccatcatccaaggctggtgtcccagcatggcctattgggcagtgtggcccacagagcctacaacttggcccctgatagaacctaagttttctttacatatttatcatggaaacatttaagtgttacatttttatagttttcttttgaaatagtttttctcccctagtagtgacaggctgtggggttgtgggggtcgacttgcgtgccgtggggtgagtttgcagggctgactgctgcagggggaggtggtgctgctggttgccctccacgcggggacgctgcactccaagagcagctgtcacggggtcagggagagtcatcttgggatcccgaaatctgtactagtgtggtctttcagtgttttccttctggttttggttaaaacaaatgtggccttgaattcacggtttcaggactgtttgtcttttcgagagtgtggaggacctgagctagggtggtgacttgcttgcttgtcttatgcagacggtgacaaggcttctcaacatcaaccccaacaagacctcggccagcgggagctgcggcgcccacctggtgactctggagctgcacagcgagggcaccaccgtcctgctcttccagttcgggatggtgaggctggggcggcacctctctgggggcgcccactgtgtctccaccacatctttttgtgccctgggtctgctcatgggaggcagcgttaggaaggaggcggcctcacttttttctgccttccctttatcctgggctttttagttccttggttcccctcccccctttccattccattcatagatgcagcagatgatgtgggcggggctgctgtgcccacagttggagtggctgcaggggagggcatgcaggccgtgcggccttctggcttcagatgctgctgccctgtggttccgtggtggcatttctgcctgggaggactcctgtgcagttagcaacataagacatgaagcatataattgtcacttgtcagtctttttaaatcgctgtgcaaatgaattaacagttcagtttcttataattttagctttccaaatcatgctttcctgtgctgtgatagctcctgcagtccccgttttccagagactgactctcaagaggtctggaaggaccagcctgggcagcacagggaggctccatttctgcaaataataaaacgagttagctgggcgtagtggcgcacacctgtggtcccagctacttgggaggctgaggtgggaggatcacttgagcccaggagttaaggttgcgatgagccgtgatcactccactgcactccagcctgggtgacagagcaagactctcagagaagggtctggaaggaactaaccaaaattttcattccccagagatacacaacgccttttatagacaagatcttttgcagttttgttctaatactagaaatgtaggaagtcaggtttattacccaatgaccattcacgtttgatgataaatgtgtgaatctactggggttaaagatcatctttctatgaatctgctccgtgattaaagatcatttttctttttaagaatgcaagttctagccggtttttcctacaaggaatccagttgaatacaattcttcctgacgccagaggtgagaacccacaatctctgcgagccccgcccccgcccgcgcgcccagggtattctggagccactagacctctgtgtgtgttgcagaccctgcctttaaagctgccaacggctccctgcgagcgctgcaggccacagtcggcaattcctacaagtgcaacgcggaggagcacgtccgtgtcacgaaggcgttttcagtcaatatattcaaagtgtgggtccaggctttcaaggtggaaggtggccagtttggctctggtgagtgtcaccgagggcagctgtcgcggggtgtggaggacgtgcttcagactccgcctgtggacgtttagtcgcttccgtgtgggctggggcgacgcccctgttcctctgcaaggagctgtttcttcttgccggtctgagattctagaggtaactccccctgctttagagaggcccagcgtgtctctcagctgggagcccctggtaccatttgagagtaagggaatcattttaagaaacagtggtggcgcttctcccatgaacgttgaatacaacactgtcatctgatgtgcacagaggccctggacgcagcacagctgtccggccacagcccctgattccagacgggggagagacgtgtgtggtttcctcgccgtgcagagagcaccagtctctgcagcggcttccccaagtgacaattccagctagagctggaaccttccgccagggttcctctttgccttttggctgatgtgggggagtggtggggagagaggcctgtttgcaggcccctgtgtgagcagagccctgacaccatccgtctgtcttggcagtggaggagtgtctgctggacgagaacagcatgctgatccccatcgctgtgggtggtgccctggcggggctggtcctcatcgtcctcatcgcctacctcgtcggcaggaagaggagtcacgcaggctaccagactatctagcctggtgcacgcaggcacagcagctgcaggggcctctgttcctttctctgggcttagggtcctgtcgaaggggaggcacactttctggcaaacgtttctcaaatctgcttcatccaatgtgaagttcatcttgcagcatttactatgcacaacagagtaactatcgaaatgacggtgttaattttgctaactgggttaaatattttgctaactggttaaacattaatatttaccaaagtaggattttgagggtgggggtgctctctctgagggggtgggggtgccgctgtctctgaggggtgggggtgccgctgtctctgaggggtgggggtgccgctctctctgagggggtgggggtgccgctttctctgagggggtgggggtgccgctctctctgagggggtgggggtgctgctctctccgaggggtggaatgccgctgtctctgaggggtgggggtgccgctctaaattggctccatatcatttgagtttagggttctggtgtttggtttcttcattctttactgcactcagatttaagccttacaaagggaaagcctctggccgtcacacgtaggacgcatgaaggtcactcgtggtgaggctgacatgctcacacattacaacagtagagagggaaaatcctaagacagaggaactccagagatgagtgtctggagcgcttcagttcagctttaaaggccaggacgggccacacgtggctggcggcctcgttccagtggcggcacgtccttgggcgtctctaatgtctgcagctcaagggctggcacttttttaaatataaaaatgggtgttatttttatttttttttgtaaagtgatttttggtcttctgttgacattcggggtgatcctgttctgcgctgtgtacaatgtgagatcggtgcgttctcctgatgttttgccgtggcttggggattgtacacgggaccagctcacgtaatgcattgcctgtaacaatgtaataaaaagcctctttctttttggggtgggccttgtccttctgtcagctaaaatgggagctcatgagagaaggacgtcagggaaacggggttgagggtggtctcggtgcagagagaagggtgtcagggaaacggggggtgagggtggtcttggtgccagacgtagggaatggtgttgggagtggcccgagtgcctggcacagttgtctggttcattcatgtaacatgataatttttaaatcattaaaaaaattacctttcatacagataccatggaatactatgcagccataaagaggtatgagatcttgtcccctgcagggacacggatagagctggaagccattattctcagcaaactaacacaggagcagaaaaccagacaccacttgttctcacttgtaagtgggagcttctgatgagaacacatggacacaaggaggggaacatcacacactggggcccgttgggtcgggggcagggagagcatcaggaagaatagctaagggatgctggcttcatacctaggtgacaggatggtctgtgcagcacatcaccacggcacacgtttacctgtgcaacagacctgtacaccctccacctgtacccagaagttaaaagttgaagggagaaaatgatctttctaaagagaaatcacctactacgtgcagaagcctcacataaactgcacgctctgtcacagaaaggaatggaatattgacactgccgctgtaagacctcagtgaccactcactatgttaatttccagtcagctgagaaactgatcacaaacacaggtgttggcatactttattagatacaaacccacactcacattttatatattattgatctctcaggtaaaaataagttttctttaaaaagtatgacttcatagctaatcatcaaaagctggtagaatgacctgattttaaactgctcttttaaaaaattcacaactaaagtgtagtgatgtcaagtatttacaacactaaaaaggaaagcagtgaaagttggtccagtgtcaactctggaaaggggcatcgtcagtgtagagacgagcaacgcaggggacaggcacgctcacccctgtgccagcagccgggccctgcagctctcgcggagcttggcgacggtggccatggataagcttccaggttctgaaaatattttctggaaggcaaacagttagtttaaaaacaaacccaacaacccatttctacgttagctctcccagactggcaggcagacagacaggcctcgtgtgaggtgagggaggagcagtccacatccaagggcttctggggtgacccacagattgtcaccatctcactcctgccctggggcctaggactgcagctttgctgctcagaaatgttaaatgaatcaaacggtggaagaaaaggccatctgcttccattagactttttttttttttttgagacagagtctcactctgttgcccaggctggagtgcagtggcgcgatctcggctcactgcaacctccgcctcccaggttcaagtgattctcgtgcctcagcctcccgagtaactgggactacataagcgtgagccaccacacctggctaatttttgtattttttagtagagacggggtttcaccgtgttggccaggctggtcttgaactcctgacctcaggtgatccacacgccttggcctcccaaagtgctgggactgcaggcgtgagccaccgcgcccggccaacatggtcttctctttgatgaaggcccagctgctgaaataccgcccacgtttgccatgctgcacccagagtggccccgagcctccactccctcttaggaaactactgactcccaggcctgagcctctcctggcgtcttggcttcctcagaaggcctgtcaggtacagctcccacaacgccctcatcaggacctgagtctatacggcctgcgccaggtccaggacccagtggggaggccgggcctcgggaagccacacttctggcaccacacacagcagatgagtacagccattagg

SEQ ID NO: 15397 - DNA, 59978 bp, Human
  misc_feature (1)...(59978): n = A,T,C or G
gtccatcctgggcccagcccctgtctactctctctacttgttccctgggtcaccccttcccttctcagtctttcccatcatgtgactacgaaggagtctcaggtttgtatctttaacccaaatctgtctgtttaaacttcagtttacacacatagagtagaagctcgcttatcagtctcactttaactgacttgaattggaaaaatgactctctccaatccctccctgaaatacatgagctgatgcccaaggtatgatgacgactttcagcaagtaggcttcactctaatatatcgcaagcttttgccagctaagttgtatgtgttctcatatccagatgtgtttgttctcaaatctatttttgctacccgaacctgttatggtagttatgtacttttaagctcatcaatgaaatatgaatgcaaaaggaaacagttgtttctctataagctaagttgtatgtttttaaaaggctcacttgagtttgttaaaaaaataattaggtatgggggaaaaattgtaaaagattaagaaaattctaaagataatcgtatcaaattggttcttaaatgcctatatccttgtttaactttaaataaacttatattggaaaatgttaagtctgcaaagattaggccaaaacagacacagcctaaagaaaaggccctgggcttacatcaaaagattggcaagtatagaacttgaggtaagtggtgtaaaaaaaaaattggcaagtgaatgtatactttcatgttttaagttaaaaacatacatccatttcttcgtgattcctgttttaaccagttttctcaattaaccaagcaactgctgggcccaatcatgtcagacttttcagctatcaagtacgtatctttacccagttgtcaacagacacctcaaactcaacatgcccaaaactttatttctccctccaaatccactctattcatctttttcccagattacaagcctgggaatcattcttaactcctccgtgtccctcagcccacccattcttattcaccacgtcttggtaatgtttccttcaaatattttaaaaatccattccctatatttcctatccctgttaccacagtgctggttctgaagacaggcatagtttagtggaaagaatatgcgttgaatctttacaagtgtccatcttttaactgtgcttctgctacttacaagctgttgaacaacatctgtcagacgcatgtaccgagcgatatgaagtgtgcattgtgctcggagagtgaagggcgttaaacgacagcgaggacgaggggcacgagcccggcctgcagcacggccacagcctcgcgcttactcctccatcgcctcctggagtccccgaattcatcccgcatcctgctgggaaacagcgtccatccgacacagcaccgcccacagcgggccctcggcgtggcccgcaggcccttcggaccgcctgggagcgcggccacacgtgccagcaagtgagggcagcgacctgggaccgccgcgtctacttacaccgcgacgactccgcgatccacggacaccgcccggcccccacggcggccctgcaggggagaactcgggccgccttcccgagtcccggccgccgctgttcggctcgcgcggctgcccgccggggacccgaacggaagaagggtggcgaggcgggaaaggaaaaggcctgagggtccaaggcaggaggggacacacggaacacgccgagggccaaccacgccgccgcgcgctccccggctaggacccacctgctgcaggtactggttaatggtaatgtgcgccatgggagcgccgccgaacggagagcgccaccccctacgcctcaagcgggccagctggcgtcacttccggccctcggtccgtctgggtcctggcgcccccggccccgccgcgggtgcgcaggttggttccggagggagaacctggggaccggctcggcgacgcgctcgggctgagggggcccggggtctttctgccggggccccgtcctctcagccgggacgccagcggctctgattgtgtgttcgggcccgcccgggctgaggggtttggggtccagtggcgaggacagccccacggctaaactgcctttcactgcgctgacccttcgtctgccccttgtgaaaaccaggccgcggaggaccctccgcgcctggctgggccagggcctcggggcgcgcgcgcccgaggagggggagggggagggacatggcgcgcgctcccgagctctcataaggtgcctccgccgcgcgctcccgagcctgcaggagttagggcacgtcccggcgcgcacccctgagccctcgaggtggtctcacgcccggggtgggggtgccgagccctcaggaggcgcgcgccccggggccctcaggagggtgtcccggctcccgatcccctcaggaggggtgcccgcggcacgcatccccgagccaggagggggtgcccggagccctgggggcagggtctcggtgcgccccccggagccgggggtgagggtcccgatccctcaggacgggagtcccggcgcgcgccctcgagccaggagaggggtgtccgaatctcttagggggagtccgatccctcaggagggattcccggcgcgcgttcctaagccctcaggagtagccgggcgcggcggcggttgggctcgggcacgcgggcggggcggggcggggcgcgcgaggaggacggggcggaggccgcgcggaccggggcgggcggagcggagctcggcgggcggcggcgctcggggcggggcgcggcggttccggcccagccatggnnnnnnnnnnnnnnnnnnnnagggccaggcgccccgggcggggaccccacgagaccccgcccgacttggggggaaggccccgagatccgtgcgggccccgggagcgggggcgccggggcgccggccgggtcgggggtggctacgcggggcgcttcgcggcgcgccctgagccgcccgctctccctccgccctgcagacagacctcggctgcccgacaactacacgcaggacacgtggcggaagctgcacgaggcggtgcgggccgtgcagagcagcacctccatcaggtacaacctcgaggagctctaccaggtgaggcggcggccggggctggggacgccgctcctgccccgcgtgacgcagacgcggccgggcggccgctccgggtgcctcgcaggctctcgccggggagcggaaaggcagggcgtttgcctccactgcagggccgggagccccagaggcaacaagtggttttgtttattgccgtggtggaatttttgttttcaggcttaagctgcttagaaccatatttaaagttatcccattacggaagagaaggaggtgtgtttctaggagccacgtgactcatattttgcaagtatacggcaaattattttctcgttatatgtaaaactcatgactgtgtcacttgccacagtaataagagggtcttttctctgttgtgttttgtgattaatggttgcctttaagatattcaaacagattttgaaaaaattcaaaattcagaaaaagtggttttgttctctgttgtgttttgtgattagtggttgcctttaaggtattcaaacagatttggtagcatttaattcaaagtgatggtgttccgtttctgaagtaacaaaaaagtacattttaccatacttggatattttatttataagcgactttttttctggtgtcttctttttgtaaagtaacattcattcagtagtctaatatctatattttaggtcacgatgtgtcatacaattatttctattaaaaggcttgaattaaaaaaactttttttctggatatgcaagtgactgcattgtaaaaattataaaaaatacaaaaaagaagacttcaatcacctatactcctaccacccaaagaaaactactgttgacagtttggtgtacatacatccattctttgtctgaagtgtaagtggatgatgttttcttaccagctttgagatagagtctacatataatgtgcacttcaggaagttttaacagatgcatgcagttacgtaaccggcaccacggtcaagatggaatctttcttggtagaatggtagaatattgctaccacccccgaaattgccatgaccacttttgcagtcagccctctcccctgactcctagcccttggcggtcccccatttgctttctgttactatattttgcgatttctagaaccttatctaaatgcagtcatgtatttcatagtcttttgtatctggctttcacttaggacagtgcttttgagattcatgcacaacgcagtgtgattgtaatttattacctagtagaatgggtataccacagttgttttatccattcaccagttaatggacatttgggtgtccatgtttggggttttttgtttgtttgttctttgagacggagtttcactcttgtggcccaggctggagtgccatggcacgatcttggctcactgcaacctccacctcgcaggttcaagcgattctcctgcctcagcctcccgagtcgctgggattacaggcacctgccaccacgcctggctaatttttgtatttttagtagagtcggggtttcgccatgttgggcaggctggtctcaaactcctgacctcaggtgatccacccacctcggtctctcaaagtgctgggtttaccagcataagccaccgcgcctggccttgggttgttttaaataaagctgctgtaaacatttgtgaataaccctttgtttggacatatattcttactcctctcaggtgagttctgcttacttctttatctagaagtaagttctcagggtcatatggaaaatgtatgtttaactttgtacggaatttcttgtttttgcaagtgactgccccttttgcgtctctcccagcagtgtatgggagctccggttccactccgccaccagcgtgtgcgtctctcccagcagtgtatgggagctccagttccactccgccaccagcgtgtggtgtcctcagtctgtaactttagctgtgcttgtgggtgtgtggtggagtgtcattgtagttttagtttgcatttccctctgatgctaagcatctttgtatttacttgccattctatgtatcttcgttgacgaagtgtctatttaaatattttgctcatttttattgggttggttattttcttattattgagtatttgagtttattatgtattctggatacaagtcctgtatcagatattcgccttgcaaatactttctgcctagtcttcaacttgtcttttgattctcttaactgtgccatttgaagagtaattgttttaagttttcaagtcacatgtatcagtttgttcttctatggattgtgcttttagtatccaagaaatcttgcttaatctgaggtcacaaagttttctcttatactttcttccagacattttagagttttaggttttacatctaggtctacgatctatgtagagtgaatttttgtatatattgtgaaatacaaatctagagtcagagtcgggtgcagtggctcatgcctgtaatcccagcactttgggaggccaaggtgggtagatcgcctgagcgtcaggattttgagaccagcctggccaacatggtgaaaccccatctctactaaaagtacaaaaaattagccgggcgtggtggcaggcacctgtaatcccagctacttgggaggctgaggccggagaatcgcttgaacccgggaggcggaggttgcagtgagccgaggttgtgccactgtactccagcctgagcaacagagtgagactccatttcaaaaaaatacaaagaaaagtctagagtcagtgttttccctgcaaatgtccagtttttcagtctcttttcccctactgaattgcctttgctcctttgtcaaaaaccacgtaggagtaggaggagtgagttgtgaaatcagggtgtgttggccccccagcttcatacatttgcacaggtttctggctattcttggtcccttgtgtttccatgtgaattttagaatcggccaatttgtataagaaagtgtgctaagattttgattgacggtatatagaatctacagatcaatgtaggagaattaaattcttaacagtattgagagtctgggctcagtggctcacacctgtaatcccagcactttggggggctgaggtggcctgatcgcttgagcccaggagttcgagaccagcctaggcaacatggtgaaaccccatctctacaaaaaatttaaaaattagcctagtggggtgttgcatgcctgtagtcccagctactcagggcccccacaccacaacctggaagctcttcacacaggaagctgagcagttggggcctgtttgtctcccatctttctgagattcactgtctttcatagcccagtactcagtgcttcgaaaactgttgcttcgtatattttgcctgattttgtggttatttcaggcagaaagttaatacagttcttgtactgtgtcttgactagaaacgagtcccacctgaactctcagaggtctttggtttaataaaatatgataccttacagctaaagcttcttactactcttttcctggagatttggctgtctgatatctgctgcctcattatttttacttaaaaaggcggaattactttgcaacaccttgtacacagtgatatgtcttataaaacaatcactagatattatgaacaatgtttgtaggtgccttaggtgtctgtcttgaaaccctgagaactaggagtgcttaccccaaaatgacagtcactggttcctccttggaatgagacatcgcaaattccaggggcatctctggaggtgctgccccaccaggggatatgtggaatcagttgattcacttacttgtgatcatctctccacgcacaggtgggcttctggcctctcacagagtctgaagcatgagctgcctcagatctattggaagcaaatgggatagaaatctaagaaaagcaaatgtgaaattactgatgtctgatcaagcaggcaatacatttgacttggtgtttcaaaataaagtctcagtttttgtataggtggggtggtgtatactttgccaaagaatcttatgtgaaaggaccaattctcacccaagtttgaaaggtttggtttcgtgtttggtttttggttttgctcactctccctctacgtctaaacaccttaggagtcctgtcacttacactttttgggcctcagctggcctgttgtttctgtttgttactttgtttttatcattttcctcctgtagtgtgtagaggagaatgttgtgaaggcatggatcttttccattgaacgacctgaatttcggtctgtaataactaactcctgaagaaagtgcatcttctgtgtcttgtgtctctatgttttagtcctgcttgttgctaaatgagacaacagaaaactgaagactgcatttctagaaaggtttcagagaaaggctgtgttttgatttagaactggtttttttgttttttgttgcacaaaaacaaacctctcaggccctttaaaaaaaaagagagagagaggtgtggcctccctatgttgtccaggctccttgggaactcctggactcaaacagtcctcctgccttggcctcccgaagtgctgggattccaggcgtgagccattgcacccggctgacatgcaagttctgaggaaagccaggctgtctttcttgagtcacggagtagttgtcttcatgacatgttgataccaggtgataatggtcagtgaaagagagaggttagtcctttgtattaggtggcatccttccctcacacccaagctgcaggcccagcgtaggaatgggacctccacagccacacaggtctcatcctgtgtggctgtgaaggtcgctatatgactctggaggtagctatgtgactatggaggtctcgtcccgtgtggctgtggaggtcgctgtgtgactgtggaggtcacgtcccatgtggctgtggacatcttgtctgtgtggctgtggaggttgctgtgtgactatggaggtctcgtcctttgtggctgtggacgtcttgtctatgtgactgtggaggttgctgtgtgactgtggaggtcgcgtcccgtgtggctgtggaggtcactgtgtgaccatggaagtcgcgttccgtgtggctgtggaggtcgctgtgtgactatggaggtctctctcgtccgtgtggctatggaggtctgtgtgggagtatggaggtcacatcccgtgtggctgtggaggtcgctgtgtgactgtggaggttgctgtgtgactatggaggtcgctatgtgactatggaggtcgctgtgtgactatggaggtctcatccatgtggctgtggaggtctctgtgaccatggaggtcacgtcccatgtggccgtggaggtcgctgtgtgactatggaggtcacgtcccatgtggctgtggaggtcgctgtgtgaccatggaggttactgtgtgcctatggaggtcgctatgtgactatggaggttgttgtgtgactatggaggtctcgtccatgtggctgtggaggtctctttgtgactatggaggtcacgtcccatgtggccgtggaggtctctgcgtgactgtggaggtcacgtcccgtgtggctgtggagatctctgtgtgactatggaggtttcatccatgtggctctgaaggtctctgtgtgactatggaggtcgcgtcccatgtggctgtggaggtcgctgtgtggctatggaggtcgcgtcccgtgtggctgtagaggtcgctgtgtgactatggaggtctcgtctgtgtggctgtggaggtcgctgtgtgactatggaggtcgcgtcccatgtggctgtggaggtcgctgtgtgactatggaggtctcgtccgtgtggctgtggaggtcgcgtgtgtgactatggaggtctcgtccatgtggctgtggcggtctctgtgtgactatggaggtctcgtctgtgtggctgtggaggtctttgggtgactatggtggtcacgtcccatggtcccatgtggctgtggaggtcgtgtgtgactatggaggtctcgtccacgtggctgtggaggtctttgtgtgactatggaggtcacgtcccatgtggctgtggaggtcgctgtgtgactatggaggtctcatctgtgtggctgtggaggtctttgtgtgactatggaggtcacgtcccatgtggctgtggaggtctctgtgtgactatggaggtcatgtcccacagctccatggccttccttgttctgtcttccacatctgagagcagggattgcccttatccgcagtgagcattttgtttaagtagcagtgagttcactccaggcaatgctttgacactataaatagacgtgtatttgacattcacacacgtgtctgttgagctaatacagacaatcatttgatgaacctgctagttaggaagtagctgtgatgtgagaagagacagtgctggctgtagatatacaccaaatttcctcacttggctgttgatacaaggaaagcatcttgatactaataggagtagaatgcaaatgatacttctctacctccgatcattggattacattccttttctctggggtgaatctttaaaatgctaatggcctgagtgcaccaacatgaagcacacagtaccatctgattagttgctttatgcatccagagagggtatttctaaatctcaaagtatgattgagtgtcaaaaatccatttgggggaggggcaactcctgtgttgtgctgcttctataacagcacaaaaaagtcttccagtatgttcctgccagcaaggagttggcagggcggggagaaacaaaggctgtcgcctttccagtgatgagtgcctgtaatatgaagccgggagtcctgactcagcacctacagcaaacctgggttacccagggcttgccacttgttttgagaggttcttaaattcttaattttaaaaacaaagtaaattgcagtatgactcatatgaatagtaaatgtgcaccaaataggacacataggaggcagagtgggttataaaatatttagtcatttgccacaaccaggaaaagatggttttaaggatattggttcttggtctaggaattaaaacatccagaaaatggtcctaagttactgttgatttttgctgaagaaaatacattttcttcatgtgttatataaaaaacttactttgtaataattatgtttgtgggattcactaatgtttaactactggagcaaaacctttgtcgtaaagttctcttggttgtttgaggagacaaaaggatggcagatctttgaccaaattatgaagatatggaattcaaagggatggaattgaagagtttgagaaaggagttaaagtaaatacagaatgtgggtaggaattccgtttctatagtaagacaaaatgtagggggaaagtttgtatttctttgttattatgctgataataagcttgctagaaaacaggattataattaaaaacaggattataattattccacatcctcttttgatctttgtaaatatgcatgtattttatatggtagtaatcactgtatgtatttaactttggttaatatgtagcagctctccgatatttagtattggaattattaatacttgtgtaagtattagtaaaatgaatagctttataactttaatttaccttttttcctaggggtatattgtatcctaattaaattcagattatttatctaaagtgtttttattctgtatatccccacatttttcgaaccccacattggttcaaaacttgttagaaaaaccatatttctgtttataatatttcatattggaattgaatgagtttaagtttttgtacctaagattggaaaggaaattttattagaactggtaagaatgtacaagcattgtttctttgaggtgagtaaaaatattgtgagaaaaaattttctgcttcaaaaaatggtgtcagctgggcacggtggctcatgcctgtaatcccagcactgtgggaggccgaggcggacaaatcacctgaggtcaggcgtttgagaccggcctggccaacatggcgaaacccctcctctactgaaaatacaaaaattaacctgtgcgtggtggcaggtgcctataatcccagctactcgggaggctgaggcaggagaatcgcttgaacccgggaggtggaggttgcagtgagccaagatcctgcctttgcactccagcctgggtgacagagcaagactccaactcaaaaaaaaaagatttcttcttgtattaggggtgttcacagaataaaaaagaaagtttattaattaaacaaactgaagtgaattacacatctagcctgcagaaaaataaataggaaacaatacagtctggcctgtgtcacccagaaaaagctcagtttggattgaatcactgccctggggagtgtgaggggaaggcccagcctgttgttctccttcctgatgggaaggtggtcactgagggaaaagattttcttggttctctagccctgatttcactttgtaatcatcaaggtgaacttaaacacaaacacactccagtgacccccatctcagactgaggaatcggagcacccggaaacaggcctgtgaggatcaaacctgttgagaagtcccaagtgactgggcaccatagatgctcaggagtggtgcaggccagctgcctgggacccgaggtccagcaggtgcaatgtgcccacattaactgttgttacctctacccccatgccaactatgactggactgcagtgttccaacgagaagtgccctaaacttagccataataagtaatttatttgtagattcctgaagtactggggtagggtgtggggtgcctttttcttatgattacagctatgttaacaatagggtttttttatgaaccaatctgttgttcatactgaagaattgatgtagcccttttgtttgcaggctgtggaaaatctctgttctcacaaagtctccccaatgctctacaagcaactgcgtcaggcctgtgaagaccacgtccaggcacagatccttccgtttagagaatatcctttttttggttcataaagtttctattcattatctaagtcttttaaaactgaacattattatgataaagagctaatgagtatccttaatattaaaacaacagcttttaaagttctcttttatttgataggtttgtaagcgaaatttaccatttaaattattttgctgatttgaattaaagggaaaccgtgttcatttattgggtatggttgaagtatttaggaaatgttctgaaaaatgtcttcaagtttgagtatcctttattctaataaacaccatctgcattggctttctgtgataggcaacaaagtcccatcgacttggcgacttatggagacacccacttatcagcgcacagttgtgtctgtcaggaggccaggcaggattcagtggattctatgctcagtctcacgggcagagtcaaggtgtcagccaggttggggcctcacctgaggtctttgctagcacgggcaggcagttggcggaagccagttcctgtggtagtgggactgagggccctgccttctgtcccgtgttgcttggtgtcactctcagctccacatgcacaggtccttgcctctcctctcacagcacgactcttttctgcttctagaccagcaggagaatctgcctgtctgacctgctgagatagggccttatatgatgtaacccgtaacccagtcaaggaatgatgaccttcgtattcacagcctcgttcacagttgcgtgtgaggcatcctccacgtggggacagggcaggagcatctcagaattctgctgccacaccagctgtgactcagacgtctacaggggagtctctgggctccttggcatcctatagaaaatcctttaatctggactcaatctcattccccagcctcctcccagtactgtagctgtccatgtgtctcattgggtaggaattagaaagtagagtttataattgcagaaaatctacttgtggctgtacttttctaggcctccgtttcttcatgtgtaaaattaggtggtttgtgtttgcttatttctaagtgttcttctagttcaaggaaacttctgctcccccatctccctgatcttgggaaactaaaccattctgagttcattggaagggtcctcagggaatctgcagcagttggtgctgctgaagttgaagcacgtgacagggaagctgaaatgcagggtgagaggtctctgtttagacaatctccacagcaccccgcacagatgtgagtgaagtcggttccagctctgttgtgctggcttctgtaaatacgcctctgcagtgttttccagcaaagccctttcctaaagatcatgaggtcgttcaagagatcagtgaccgcacaccaccttttggaacctggccaaagtgcaccttatctcaggaggcgcctgtgagggcgcacagaagcaggccccgccccagtgccacggctcagcaatgcgcttccaggaacctacgttccagatgtttccatccaaaaagcggcctgactcctaggcttgggggaagtctttagcagatgcccaagccttctcccaaagacttaggcgtttatgagagtcagtaggcggtgattgttcctactctagttgctgtcccaatttacttgaaaacgactatctgattacctgatcaaatgaatcttttgccagttactcctactctgtgggttgactaatgtgccatcagttcactcactgcacaagcacttgctttctacctactgcactggcaccgcaaaatggaaagtgacccccatgcctgatttctaccctccaagaagtcgcaggcttatgggagaggcaggggaattactgtatttccctggtgcagtggcaaaactgtgattacaaaaattatcatttggttcattaaaggcaaaagaaaaaaacactaccgtattaaatgcccttattagtcatgagacaagatcttgagttgagaactgcgcgtcaggccaggaatggtggcatgtgaagcatctggggcagagcctcccagaggagaccctcctgaagggatggggaggatgcgccctcctgtggctgtggcaccagaagcagagcgtggagggtgctctggaaaccccgagcagcgggcacaactagaactccagagacctggtggcccttaggctgtgatgctaagttgcagactgaatttgaatctttgtggatactaccaaggagtcagacttcagtctgtgagtatcccagagtcctcacaggttttttaagcaagaaaccagaattagattgttcatggaggtcactctggcagaatgatgggataagtttacatatagaccagcacaccacagccttccattgggtcggcacatgtttttaagtatctgtcatgtgctaggtatgatgccaggccctgggaaaataaatctgagcagaatgggattctgtccctttggagcttaaacccgaatggcggtggcaaaagcatcaggataagcatttatgcagtgctgtgataagggttttttttgttttgtttttttgtgttatttatttatttatttttgtgagatggagtcttgctctgtcacccaggctagagtgcagtggcacgatctcggctcactgcacctctccctcctgggttcaagccattctcctgcctcggcctttccagtagctgggattacaggcgcccaccaccatgctcggctaatttttgtatttttagtagagacggggtttcaccacattggccaggctggtctcgaactcctgacctcgtgatccacctgcctcagcctcccaaagtgctgggattacaggcgtgagccaccgcgtctggcctgtgataagggttttcaaaggttcagataagctcctgggacctaaagaaagagcagctagcccacctgtgtaggggagcattgcaggggcgaagcgatgtctgggccatgtcctaaaggatggatgaggaagtggcaggcgctgtgggatgccaaggtggcacaggccagggagcagcgtgggcagccctggcgctgaggaagcttactgggcagaagagccaggtatgctgctgggtgtgggagagttgaccactgacaggatccctaaaggggaaaatgagaggaaggtggatgctgaattgtggaggagcctttgttgaaccaagaggttgaggtttatctgaaggtggagattgagccaaggtgttcaggcacagcatggctgggttatgttggtaagaagttagtgtgcctgtgtgtgtgcactgtggtgtgaggggtcacaccacaatggtttgactgggcagcaaaaccacagggtggaatggcagcatcctgccagcaaacctcttatggttagagggaaaggatctgactgctgtggaaggatgaaccagacacggattgaggcggggagggtctgtcgtggtcacgttgatttggaaggaggagacacggattgaggcggggagggtctgtcgtggtcatgttgatttggaaggaggtgaggaggcactcaggtagagatgcctgttgtgcatttggggctggagacacagatccagtggctccagacatggatgagatgcccaggaaaaatgagcagagtggccagacacagtggctcacgcctctaaccttagcactgcattttgggaggccaagttgggagggccagttgagcccaagagttcaagagcagcctagacgacaattagccgggtgtgtggttcacacctgtggtcccagctactctggaggctgaggtgggaggattgcacgagcccaggaggccgaggctgcagtgagctgagattgcgccactgcactccagcctgagcagcagagcaagacccccatctctaaaaagaaaatgagcagagccatgagaggaggtggatgagggctgctgtcaggaagatgagaggagaacctggagagtcatcttgtgggaatcgaggggcgagtttaatatggcaggcggcttagtgaccagtaagtagagtctgaggggatgatgagaccaggaagtggctggttactgtgatgaaggcttttaggctacattcgtacgttaacctagtaaacatggggtgtttctgtccaactcagcactgtgcgttggggaccagggacaggcatgaatggcacgggtcctgctctcaaaaagcttgtttttgctggaagagagttctgacccagcccagtctcacatggggaaatgttaatgtgatggcagatgctgagatactgtgtggcagggagtattccaaggtctgcatattcagatttcttttgcctctgggatattccagtacttcaagtaactctactttctaagatttaagtaatttgttgttgttgttgttgttttgagacggagtttcgctcttaattgcccaggctagagtgcaatggcgcaatcttggctcaccgcaacaacctccactcctgggttcaagcgattctcttgtctcagcctcccgagtagctgggattacaggaatgcgccaccacgcctggctaattttgtatttttagtagaaacggggtttctccacattggtcaggctggtctcgaatttgcgatcttggattatctgcctgcttcgacctcccaaagtgttgggattacaggcgtgagccaccatgcccggccagatttaagtaatgttatgtaccgattatattttgattgtatgctgatattagattatagatgaaacccatcagatgtgcaggtagaaaaagggcttttgtggaattgagtcattcactaccatcttcttcgtttaccacatccgttttcttgtctcacatgtttgataaattctgcacttagctgtccgtttcaaaatagatagctgctcttggtgacgtcccttcctcaaaataaaggccatttgtacccttgcactcatacacatgctcagccacaggcagctgctgcagaacccacaccacatgctgcaggaccacgtgccacccagccaagctacgtgggcaacaggagctcttcaaaaatgtcaagcccgcagagtgcggtggcttacgcctgtaatcccagtactttgggaggccaaggtgggtggatcatgaggtcaggagatcgacaccatcctggctaacacggtgaaaccccgtctctactgaaaatacaaaaaaattagccgggcgtggtggcgggcacctgtagtcccagctactcgggaggctgaggcaggagaatggcatgaacccgggaggcagatcttgcagtgagccgagatcgcaccactgcactccagcctgggtgacagagcgagactccatctcaaaaaaaaaaaaatgtcaagccaactgtcctcagaatctaacctgtagataactatagatgaaactcacattttccttcccctggttcaccttgacagcattgcagctctggtcagccacagaatgccaggcagtggtggacaccatgatagccgtgtggtcagaagggaagggcacgggagtgagctgggaaccttggctgttggggaagttgcaaagctccagtttcctctaagtgtgcctttatgatccgcactggcgacagcaggctttgtctttccttagaaagactttgtgcctgttctcacttgaccagatatcgtgtacggagcacttgctggcagtaggccaagctctgcacattcatgaattgctttgtctcacaacaccctgagccgtaggtatctttattgaccatattttccagatgaagagacgaaagcccaagagaaccctgttaatgctcggccagatcagaggagacaaaacaagcacccctgccttcatgggttgtgtggatgaatgagggtcggcctagggctgtcccctcgcggtctgtccggtctgtcggtacaggcagcagatgggccacttgttcctggaattgcagaagcagataaccaagtgtagaaaatgtatgtatccctcttctaccccaacagaagcaccgtctttttgctttttctttttttttttagttacagatatgataggtaggtttttttctatggtgtaagcatttctgctgttggattttgtttgctgtttgaagacctgcctaactcgtctcagtaggctgtataaatcgtttaatgaagattggcccttttctgaagtgagaaaaaggatggttgctgaagaacctatctcgagaatacactattgacagactcacggtgtctgtgtgtctcacatcctggaattacttgcacaccattgtggctatgtgttatatcccagaatatggaattgattttgatgtttagaaggccaaagcttacttagtaaatgccacactgattttagcttaccattttgtagtttttttctgtgggaaataacaaaaaaattattgattgaggatctatattgattttacagagctattttagaggaagtatttctcatttaatgaacactttacattggactttccatcttaacaagacactgccccaggtggaactctgtcttcacaacacctgagctgcccagtggtgtcagattgactggtgtcagtttaaccccgttaagtttaaaggatctgtgcaccctcatctggaagcaaagctccgccttcggctgctgtggcccgcctgcccgcagagaggcttgctgggaggtccaggccgcagttcccgtccagctcctggagtcagagctgcaggatggctgttgggggtccttgaagcctgtccagatgcacttgggatgggtttttttgttttgtccagactgtttctgtagattcctaatataatgagccattataattttgaacaatttgtaaagagtacttccagaggaacctgttaaccattcaaccattaggtctttgctgtaagtgtctgtttttaattttctggcagtgcttctgagaattctgcaaagcctcaagaaaaaatagagtaagctgtcttagccaggcccctgtagctttggtcacagcacttcctggtgtgacaaggactcagaccccccgggagccccttggctatcctcagcactgtttattcctcctcaggctctgcctggcaccctaccctccctggcactctttctttgtcaggccactcgttgccaccctgagactccagctcatgtctgatttgtgcatcctacttaactgatgtgtttttcctcctctctgtgtgtgaggatgttgtcaccacctcacattggctcttgagtgtgaagtgtcttgctgcacggcagaaacagacctagagaagtcccttggtttggccagtattgtgttgctgacaggcggtggatcaagagttaaaatgtaggaagtccatgttctgtcccctttgacaagccattttcttaatctgtacaaagggaacaatgtctgcaccacgaggttggggagattttcagtgagagtggatgtgaagagtgtttcgtaaaccataaagcagtttattgtcattgatgattctcagctttgcatgaacctgagggacaccagaccacttgctctaggagcccatattctgggttctttgtcctaaactactttttgggccttttcctaaaaatacacattctaagagtcaaggtaagagtgttcctaatttggtgcatggatgagagttcatgttagttttcattgaggctggaagttaaacctgagccattttcctgtccagctgcactttgccacaggctgggcacactggctcatacctgtaatcctagcactttgggagactgaggaggattacttaagaccacgtgttcaagaccagcctaggagtatagtgaggtgccatctcttttaatttttaaaaaatagtcctagtgactcttaccaggccagtcaccatctccaggagcccccctgtgggagtatgttcagtgtctgccctttgtgaagtggggccttttgtcccgccacctacccccagggcacttaaggcctgggtgtgtttctgccggcagggacttgaaggtgtctggcagtgaaggaaggagaggatgaagggaggctggagagggagtggcgagcggccagaggcaggcggggccgtgggaagggaaagcagcacaggcaagctgagtgcacattggtgatgagatacagagatccatgattgaacttctagtgtatcttagcccactggggctgccatgacaaaacaccatagagtgtggctcatcaacagcaggagtctgttgctcacagctctggaggctggaggtccagggtcaaggcactggcagattgcatgtctggtggggccccgcttcctggtccatagccagcaccttctcactgcatccttatgtggtggaagaggcaggggagctctctggggtctcttttgtaaccccattcttgaggcttgtccactctcatgacctaatcacctcccagaggccctgcctcctaacaccattaccgtagagtgagagcttcagcctatgaattttggggggacatgaacattcaagactaatattctttcagtattccagttactgaatggtgtgtagtattcagtggagaaggtagctgaaattaaggggttaaaattgtaataatggccggttgcggtggctcacgcctgtaatcccggcactttgggaggctgaggccagtggatcacaaggtcaggagttcgagatcagcctgaccaacatggtgaaaccccgtctctactaaaaatacaaaaaattagctgggcgtggtggcacacgcctgtaatcccagctactcaagaggctgaggcaggagaatcgcttgaacctgggaggcagaggctgcactgctgagctaagatcgtgccactgcactccagcctgggcgacagagcgagactccatctcaaaaaaaaaaaaaaaggtaataattaaattggccagcatttttaaagttttccttagcagatctgtacagactcactagatagtgttttatttttaaagaagattaacacgtgctggcaggaccactgcagacaaatggtaagcttgttcactttttcatcaaaacacgacctcatccatcttccctcacccacatgattgagagctgagacatagaagttctgttgaggattctgtctgtgttcagtgctgtggttgaacagcacgatgagaaaagcagggaaggtgaactcctcagctcctgtgagagggcaccactgaccctcttggccttcaggtccacagtcacagtccgcagtggtgacagggttcttagatgcctgcatgggtctctaaatgtctctttaagcacagtttactcctcagaatctagcctgaatcccaggtctttcctgcagctgcacaaccagcgtcttaggctttgtagatgtcttggctttgacttgacgtcatgtatacatttttagtgtgacctggccgttaattacttaagtgagagaacagaccgtattaatagctttcctaagtaggttgaaatcttccgttttctaaatgatatcagtaggagacgatgggtgtatttcttttctgggccaggtagctggcagctgctagagctcgctgagggtctgttgggaagggtttggtgagatgcgttcacaagtctccccagccaggtagtgggctcgatggtaggagcacaggacaggaccagggatcatcctgcatccctcactctgctcgcaacgcagagtcagagacacacgtccaagagcctcatcatgtaacaggaactcaggttttaaaagctaagtgcatctccctaatctagtaagaagtagcacatcagtcaaaaaaatgaccaaatttaggccgggcgcggtggctcacgcctgtaatcccagctctttgggaggccgaggcgggcggatcacgaggtcaggagatcgagaccatcctggctaacacggtgaaaccacgtctctactgaaaatacaaaaaaaaaaaaaattaaccgggtggggtggtgggcgcctgtagtcccagctactcgggaggctgaggcaggagaatggtgtgaacccaggaggcggagcttgcacatcacgccaccgcactccagcctgggcgacagagcgagactccgtctcaagacaaaaaaaagaaaaatgaccaaatttaaaagatatcctttaggccttggctgaacacaggatctctttaaaaagaaaaaaaagataccattttaggctaagtgcgttaaaattcctacagtcagatttacaatattaaagagatggaaatcacataccaaggggacaaaattaactttagaaaaaaaaaataaaacatgagggctgtggtggacaggaaacagctgttggatttgagacagctagcatggagttaaaaggcctgatctttcatattttgctagtagaattcataagtaaatggttctcctttctgctggtcagatcatgatcagaagcatcttcctgttcttggaccgcacctatgtgctgcagaactccacgctgccctccatctggtgagtgtcctcacagcgcagagctgcgtcttccctgcagctgatgcttttcgtcccgtttgtgtcttccgcaggctaagatggtaaagtgtgtgtgattacttgtgccttcctttcttcagccaaaatcattaacgtgaacgtaggagtccaggtgggtcttagccttgaaacaccaggtgtctagccagcagcaaggagtggagcaggaagctcggacaggcggctgactttggtcatgagggtgaagacagagggtcttggtttctctctgacgactggaggttgagcctggagcggctctttccagcgctgcagttgaaactcggagaaagactgcctgctgcccgtggggtcgcagccctgaggctgtgcgtcccctgtggaatggcttgctcagcctcccggcctcctgagcacatagcactcatcgtccgtcatctttcggggactgtatacaccaggggttctggggcctttcctcagcagcgttcgcggccacggaccccacatgtcctctgctgacccctgtgtgtcctctgtggccaccccatggcgctgaatcctgccgcctcctgcaagccgactttggacaaaagctgtgtccggtctcaccgtctgatttgtcttgttctctgttaatgtagtgtttcattcttctcacattcatacataaaagtgatgtcgtgccttctcatgagctttaaacccaagttctttaaaatgtgcctgcttttcctaccccacccactgggcacgctgacccaaggcaatgtgatttctgctttcgccatgtagagattgctcttgtctgagatgtcggtgacctgccagttaccaaatccagcaagcatttttgtccttattttatacaacatctatacaattttggacaccctgtccttgttgaagctcccattaatgccatttgcccttctaacttcctcatggaactcccaaacatctcctagtaggcatccatgtggtctacgagaaggcaaacgctgcacagaaaagacagcctgtgttccaggaaagaatggagatgataaaagtgatcatagcagattatttagcatttgctctgtgcaagggactgtttcctactaatgtatttaatccctagagcagctctgtggcgtggccattgtcactcctattttatacaaactaaggcacataagttaaaataacttgccctacctcagttgtctggcccatagtctaaatgcttttcaaaaattattattattattattattatttttagagacagggtctcactctgttacccaggctggagtgcagtggcacaatcataactcactgcagcctcaaactcctgggctcaagtgatcttcctgcgttggcctcccctgtagctgggactataggcacgcaccaccacattcgactaacttctaaaaattttttgtagtgccaggatcttgctatgttgcccaggctggtctcgaacccctggcctcaagcgatcctcccacctcagcctcccaaagtgctggaattacaggtgtgaaccaccatgcccaacactaaactcttaatttataaacatagtttataccataactgtcatacaaactataaacattgtttataaaatagaataaatgataccacctccagtctaccacaagtggctaaaaacctgaacgtgagcatcattacaagaagaatcctggttgaggtgtgtgtgggcaatgcatggtgaggagatactttgtccatctctgggatggggaggagggctgagggtgaaccttggcctgtgctttgaagaatgagcaaaggtggtcaggcagctaagaaagaaagagtagaaggaagcagtaagttcaaagccgagtatctcctgctagtgatggctaggacggcagcatgaccagaagaagcctgtgtggggagtgggaggtggggagggatagagctgatgagggccctgaagggtttttcagctgaggttgatgttttaaagagaagatcccagtggcagggtagagagtcacacaagtggagacctaagccttcctaagcactggctacctgcctggcactgccccaagggcttcagaggcaggaactaataacatttgatccccattttaacagttcaggaaggaaaggcacagagacattaagcttctcacccagggtcacacagctagcaagtagtagggccaggattcaaacccaggcagctgcctcgagcccacaagtctggccactgcaccttcctgctccaactgtggtgaagtgcacagaagacctggtgtgcagcacacgcgggagcaacaggagaggcccatggtgatgtgggcagtcaagggaggtgcacgtctccaccattgaggtggctcccagggccctctgcacacctgtgtggcacccaccactgcggctgctgccaccactgccaccataatattattaataatactaccaccaccacccgcctaccactgttactactgccaccaccaccaccaccattactgctgccaccactacccgcccaccaccattactgtcaccactacccgcccaccaccattactgtcaccactacccgcccaccaccattactgtcaccactacccgcccaccaccattactgctgccaccactacccgcccaccaccattactgctgccaccactacccgcccaccaccattactgctgccaccactacccgcccaccaccattactgctgccaccactacccgcccaccactattactgctgccaccactacccgcccaccactattactgctgctgccaccaccagtattactgtcaccgccaccaccgctattactactgccaccaccacctgtccaccactatattactgctgccaccaccaccactattactattactgccaccaccagcaccactcctgccctgatgtgccaattccggatttctggctggagcccagcatctgtatttttggcccctccttaatggcgtacttggccactggggacagtaggagtgttgaagcaaagcacagagcccacaagatgggttttgtggacagccactggcagctgaaccatcttcctaacattcctcaggccatgagctgaggactgcgatgaactctgaaagctgtgcatcaccttctcttctcaggggaaagcagcaaacatttggtaggagagctcccagggcttggagaagggaagctgctgggacgtgctcagcagaggacactgggaagagagtgtaccctgagggctgttggagacggtggcgggaggggcaggtggggcaggcagggtcgtggtgcccaactgcctgagtgtctcccgtcgctcagcaggaaggtggcgaggaccccgggcttctgccagcagcttgtgtgataccagttttactgtcagtggcatgcatgacctagcagcgtctccaggaacgtggagcagctctgtttaaggaaggaaatacaaggcgcgctagactggctgagaaacagaagtttttaaaaggaattcttggcacctagatgtagagaattagcaacttcacatttttgggatgatattgaatagcatagctggagattcacccataacttctaaaaagcgaaactaaaatgtagtcctgtttcttactgtctatacagggatatgggattagaactgtttagaacccatattattagtgataaaatggttcagagtaaaaccattgatggaatcctactgctgatcgagcgcgagaggagcggcgaggccgtggaccggagcctgttgcggagcctcctgggcatgctgtctgacctgcaggtgagtgctgcctgtgcggaagatacctgggtacctgcccagctacttgcaccagaataaatggttgtaccaaagatgttaaacaatgaaatcataaaggcatttgttgaagataggagagtctttaaaatccctagaaggggaatagcgctcaagctaacaccacaccaggtgccacaaaagagaagatagatcaatatcactacataaaatgcacggatagatcaatatcactacataaaatgcacgtttttcatggaaaatataaacagagacaaagccagatgacacgctgggggaaaatattagcaacacacacaaaagacaaagggcgaagttctttagagcaataggaccccaaggcactataggaagagaacagaggagggcctgcccggccgttttgggaaggacagtgcagccggccggctgggtggccacaggcgcctccaagttcaggtcatggcagcctgccccgtcagaaactgggatgtgttagcacttgtgaagatagtttcctttactgaaattggtcagtaactctgcttgtttcttaggtgtataaagattcatttgaactgaaatttttggaagagactaattgcttatatgctgccgaaggccaaaggttaatgcaggaaagagaggtgagatgatgggatgtttccgaatcccctggcttcgtttctgcagatgagcacctaggaggactttcctcatgtttgccttttcacacacatgcaaatgtttcattgaaaatcttctgaaagctgcaatcttgccagaatccccagtaatgagcttcgttcttagtatactaagaatttagtttatgtgaacttagaaactattgcactccccccacaagtaaaaagctgtaagatcatttctgaaataattaaaataactcaaatttaagcaagatgataaaaacatacatgaaaacttaaaaatataaatgtaaatgataaaatttttcatttgtgtgaagcactgcaaaaaattttcccaaaaaaagctgtgcgaaaaaacatgtagtagtaataggaacccaaaaaacttaatcacctttccagataccagagcaaaatcataaaggaacctgccccatagactgtcacccaaatggtgcgtgctactgccagaatggaccttagccattggttccttcattctggctttgcagaggaagtttcatgtcagatactgagcccagctgcagctaccccagcagagcctcaggcctttcccgcactgtcttgggaaacatgggcgtactttgaggtctcctgcaaccgtgttgtttggtgtcccccaaatgaacaaccaccttgttgacttgcttttgctgacccagctgtgcggggcagggttgccatttagcacctcatcctcctaccaagtgaggctcagctccctgtgggccctggggatgggaggagggtgtgcacagaccccgaaacttggtggtgcacagggacgaaagagaagtgcagcctgggccctgttgtaggatggatgttaatatcagcgtcctttctccatgtcccccacacacatttccgtcctacctctccctccctgttaatctgtgttaatatttggcttgaatatgtattctgctttttaaaaaaattacatgtaaggaaaacaaaatctcaatttcttggatagtgtcgacattctttttgttactgatacatttaattgttttgtttgtaaggttccagaatatcttaaccatgtaagtaaacgcttagaggaagagggagacagagtaatcacttacttggaccacagcacacagtaagtaccgtttgctcgctgagcgttcgtatcttcaccatggctggaaggttctcctggctggttattgaaataaagggtgtctttgtcaattcattcagtactaagagtgtttttgcacctagcatattttactttgttatttgtcattatttggcattcacaaattacagtttttacccagtgccttgtcatgagttacgtctaaagagagtaaatcttgctgagatacttggcatctttgagttttgagacggtctatttatgttaatggagtatcactgaatattaggttattttgattgtgcattctctgttacacattttatatcgctttaattttatttatggtgctgtcacacaattttctcttttcatcttatgtttttttcctgcaaacctgaggttgatgagtagctagggaaacaaaaagggagagattatgtgagcgtgtgtgtcaggcacagtgtgtccatatgatgggaggcaaggacagaggcagaggggacagcaagggagagaaatgaaaatgatacagtgtgcagctgggcgcggtggctcaggcctgtaatcccagcactttgggaggctgaggtgggcagatcacaaagtcaggagatcgagaccatcctgaccaacatggtgaaaccccgtctctactaacaatacaaaaaaattagccgggcgtggtggcgggaacctatagtcccagctacttgggaggctgaggcaggagaatggcatgagcccgggaggcagagcttgcagtgagccgagatcacgccactgcactccagcctgggcgacagagcgagactccgtctcaaaaaaaaaaaaaaaagaaaatgatacagtgtgcagaactggacccagtagggaatgataaaatgtacagatgtgcagaacaggacttggtaggactcagcagagaaaacaggaggagagatgaaaatgatatggtgtgcagaactggactcagtaaggtgcggaaaggggaaggattctgacagaatccagcacaaaaacagagagggtgcagaaaaagagatttggtcacttagacgtgtggagttggaggagcctgtgggaaatccaggatctcgaggcaggccagggtggctcgggggccatgttgtgcttccttccaactgggagcagaagagcagcccccgggagactgggaagcagcagccagggaagtccgggggaaatagtggagagagcggcagccacagcgaagccccacaaccagggtgtgcaggtcacacacagcttccctgagccctttctgcctgtgtaggaagcagaaggcggaatgtcggctctgcccttctccgtaagatggtgcattaaaacgttccttataaactggaaatgaaggcttgggaagatggctaaaatcagcaatccttggaataacgcagaagcatccctgcttccctgggcccgcccgtgggcctgcttgtgctgttcagtaggtggtttttagaaagggcttccttcagcgtcattagcaacaggagtcgtcgtccgtttgcatgaggaaatgttcttaaccttccgtttctgattgcctctagactgcatctgtcatagacaaatgcccccatcttttgcagagaaccagtctcttctttaaactttacttctaacgcttattctttttaccttatataggaaaccactgattgcttgtgtggagaaacagctattaggagaacatttaacagcaattctgcagaaaggtagatttcctaactcttgtgcaaattaaactgaacaattatccttagttcattaggaaagtaaagggggcattacaaatagcagtgttaggacgtttgttattttcataagacagtcattaaaaatcttttctaatgaacatgttagccatccacgggagaaaaaaaaatcagtaagagaaataatggaaggcacctagtggaactacattcactgctaaaaccccagtggcaggaaggcccggcagaccttctgtaccacactcatgctgaaacatgggtgcagtgagcctgttgcagctctctgagcagactcatttcctgtgtccggccgttcttcatgcacactcggatgtaggggactcggggagctgttcgggctgttagattttcgtgaggcttccctcacctgcggacttcgtgcatcttagtgtcagatgaactaccgactaggtggtctgcttaagcagagtatacttttctcctggttttctggaagagaagagcatgtgttctagtgctgacggcgcggccttcacgtccgcttctccccaagtggtggcagtacctggccataggaaggtggcttctagcagcctgcacctttaaaattgatgctgatgtcttacctcgatctttgtttattgctgttttttctaggcttcaaagtgtgctgaattctatgaaaattacaatgagcagtctaacctttgtaacactttagtacttactggcacatttcactgttaccatttgaaacaatgttaccttctgaaagtcattttaaatgtatttggaaaatacgagacttttttcaagccattggaaaccttaaagtttaattttgagaaggccctaaatggtattcaaatatattctgctttgggttctacattgtcagataatagtattatggctaatgagatacttaagtgaaaccagaataaaaccaaaagggaggagaattaacatgattgagcatctcctgttacaaacaactccacttgatgtgaatatcttttcaagcaattctgtgaaatcattatccccattctacaaataagaaaaccagggcttaaaacagccagatgttggtgcctggaatcacattgcttgtgagctgagagtcacgggtccaatctggttatgatgtttctgcttattccacactgaaacctacacatcacctatccacctaaaaacaaatgcattcagaatttgtgtcaggtgtttttatgaaaggagtcactttataagaaaaaaggccaggcatagtggcccatacctgtgacatcagcactttgggaggccaaagtatcactttggatcacttgagcccaagaattcacgaccagcctgggcaacaaagagagaccctgtctctaccaaaaaaataaaaataaaatttttttttaaagccacaggtggtgcatgcctagggtaccagctactcaggagggtgaggtgggaggatcactttggcccagggggttaaggctacaaaactacaaaaacctgggtgacaaagcaagagacctgtctcaaaaaaaaaagagaaaaaagatttcaagtaaatagtagaaatttgcataaattgttccagtgcatactttgttaagcaaaattatttaaagaaaatggtaaattatatatgtaaaagcttaccctaaattttattagaaatattttaaaaattaaaaagatacttttgaattcttaagacatgggttttagtaaaataaagtataaaaagtttgtgtcagtagatcagaatgtaattgagagaaataaacatttggagctctaggtgaggattgtaattatagccccaccatgtgtttgcgcacagctttaaacctcctcgtttgtgtgaacatcgtgcccagtgtaggcagaatctgagactttgtgaattgtatgactgttcaccattttatgctttaacctggctgcctctcagtagttatcataaagcaagtatttagaaaatctatgagagtttttctcattgaggtatggtttcagaaaaccgttataaatattaaaaatctaaaacactgaaagcttttttaaatgctgtgttaaacacttcaaaatatccgatgatgtttttctcttatagtttactataggtgtgaataaatttaatccactataaattagatttgatagcttgtccttttacattgtctggccgatggactaaatcagaagtagattgagaacatgaacctcccaggttaaatagttggtgtaaactggattttctgacttgctaacttaagtgaaataagagggcttcaatgacataaagaagtaaataatacatcttccaacatactcagagaaaatgaggttcacctaataggatccatctcacatatttaaccagatcaacctgctcatgtagaggcagcgatgtggagacccgcccaatttctaagcggtgtattgacgttcttctggtgcacgctgtattctagttgagttgttgttaatgctgcccatgctgtactctgctgacgtgtactgcacatctcagggctcgaccacttactggatgagaacagagtgccggacctcgcacagatgtaccagctgttcagccgggtgaggggcgggcagcaggcgctgctgcagcactggagcgagtacatcaaggtactggcggggttttgaggccgcgggcgtgggcattccctgcagggagcagagcccctcctgagaacgcctagtgtgccctggcaaagggaactgggctgctggagggcccgtctgcattttcatcacagatgatagggtggacagtaggcttccatctgcttcccaatcaccagtgtgaatttgctttttaggataacaccagcagtgattagcaccatcaaggtagaaagtataacttaaagaacaactgttttgctcttcttcatcagcataaatattggtttaattctaaatcatgatttttcctaaagtaatcatttttgtaaatctgcttgtcagacatgatctcctcatgccctttcctcagggagaactattatatatttggcatatcagtttgctttataaactttatttcttaacggtccaaatttaggatttattacttaaactttcactttcatgtttcgaaagcatttctttggcatccctaacaagcccagtccaacccgtcgtagagtggcttcttgggcagtaccctgagttttcacatgtcctgtgcaggagaacggccctttggtgctgacataggacctccctgaagactaggggctctcggcccagggcaccaccccaccaaggggacatttgttgatgtctggagacatttgtggctgtctgaacagagagggtgcggcttgctttgctgggcagcaccaggggtgctgctgaatgcacaaggcagccctcaccacaaagaatcacctgcccagagggccagagttgcccagcccaagaaacctgctgaagaccctctaatgagaagccattctccagatgcccctcacagaaacaggagaactgaggcagacatcagggccccttcacagatagctcgtgttttcaggatgtgccagttgcctagcatgaattttccagcttaaatggtgaacatttagcaaaagtctgtgtttttgcttgctggtgactattcttaaatcccataatgaaaagataaacaaaatttccagagaattacactaagaggaaaaaaagaaaagccaatcacagatacttaacgtgttattgcataacattttggaaatgacaaaatttagaaatggaggatagatgaaaagttaccagggtgtagggatggggcagggtgtgtggttataaaaggccccaggaggtagccttctgcgggaacagtcggggtttcggccgaggtctagatgtgcacacccagatgagttacgagtaaactgggccatgtgaaaaagacgggtgcgctgccatgtcagtaccccagctgagacactgttgtgtagtttcgcaaaccgttgccattggaggaaactgtggaaataaagacactgggattgctttgctatttttactattatgcaaatctgtcattatctgaataaagatttccgttaaataaaaaagataaagcttacatgctgctttatggaataatcagacctgaagtcatgtatcagtccagctgtggaaagccagcactcacagcacccctccccacaaggtctcgtacaatgatagaattggaacttataactgagtcacactaaattggccataaagctactgaagatttaggttttttgccagtgagacagtcttcaggggatgggaatgtgtgctaaaaactaggaaaagttcacctttgcagtttccagtctgggtaataaaaatcagtgagtgaccatcacccctgagtgtcagcaataagtagttatactgtaacaaaatagtagtttatattcaactccacatgccgttatcaaaataaagctgggccttgtagtgtatgtgcattatttcaaaatgcagttagcaccaaagggtgtagagtaagaggtaagtccctcccacacctgctagccacacaccgcccctctctgggagagtctgtgccctttctgttggcatctttttttttttttttttttttgaggtggagtctcactctgtcatccaggctggagtgtagtggcgtgatctcagctcactgcaacctctgcctcctgggttcaagcagttccctgcctcagcctcctgagtagctgggattacaggctcccgccaccacacctggccaatttttgtatttttagtagagatggggtttcaccatattgtccaagctggtcttggaactccagaccttgtgatccacccgccttagcctcccaaagtgctgggattacaagcgtgagccactgcgcccagccttctcttggcatctttccaccagccagctacctcgcgtgtgtgtgtgatgtgtgagtgcacatgtgcattctattgagacgaattttttaaatccaatcattgtattcagttcctcttcggcatatatagtttatatcatcaaatgttaactgtttattagtgccctacacagacttttaggaatgtttaatataacagttttaaattaaaaatacaaactaggctaggcacagtggctcacgcttgtaatcccaccactttgggaggccaaggcaggcagatcatgaagtcaagagatcaagaccatcctggccaacatggtgaaaccccgtctctagctgggcgtggtggtgtgcacctgtagtcccagctacatgggaggcggaggttgcagtgagccgagatcacgccactgcactccagcctggtgacaaagcgagagtccatctcaaaacaaaaaaaaaaaagtacaaactaaaaaagtgagcttttcatggttagaagtgatggagaaggaaaactagccaagaagtcccaagaggtatattgaattaataggaattaacttgtcttggaggaacttacacataaacattctttaaaaagcaacggacattttccagtcgtttgtaagttctctcagaaacagaatcgtaagaccaatgcattaattgtgtatttaattgtatattcacaccaagcacaggggctcatgcctgtaaacccagcactttgggaaatcacagtgggaggattgcttgaggccaggagttcgagaccagcctgggcaacatgaccccgtctctacaaaactttaaaaagatgggccagatgtggtggcctgagcctgtagcaccagctactcaggaggctgaggtgggaggattgcttgagcttgggaggttgaggctgcagtgaaccgtgattgcaccaccgcactccagcctcggccgcagagtgagggcctgcctcaaaaaaaagtgtattcacttaatttttgaaatgtgaattcaatttgtgaaacttttaaagttattgagtatttactactaagagtaatttatgttaaactatcctgattatatgatagcaggagaagatactgtttgctattgtaaacatgttgctgagttggtattgatttgcttttgtagacttttggaacagcgatcgtaatcaatcctgagaaagacaaagacatggtccaagacctgttggacttcaaggacaaggtggaccacgtgatcgaggtctgcttccagaagaatgagcggttcgtcaacctgatgaaggagtcctttgagacgttcatcaacaagagacccaacaagcctgcagaactgatcggtagaaaaatatttgttttttttgtttgtttgtttttgagacagtctcacccatttctagacaattttttaatatgggaaaataaggcaaaatcaaccaaaatgttcaagctgctcaaggggtgtgtggaaagcgtttttatcaagtcttattaggacacaaatttaaaaaccgacacacctgcatgcatgggtggaggagggcatttccataagggaagatgaggtaagaatttagaaaagaaatgatgcttgacttcgccaaagaagggaggggtgatcaccatctttgtatcctctaatccatattaaaataggataaaaccagatgagatctcaaatgataatactatttttaagctgtacaattttttcacaataatatcaaaatatatttcagaattcataggctttctctagtcagtaaaattttttttttaattcgaaggagaaagggggcaaagagagctgaaatacgacgatactagattgactgttgattactgctgaagatgtaagatggaacatggagctcattgtgcaattgtctgcttttctgtgtgttcagaatattccattacaaaatgtttaaaagaaaaaaactaacaaaaacagcaacagaaggaattcaggaggcagtttactttggcttttgttcctctgtatcatttgtggtttctctaaagcaaagggatgttgagctcttgggagtttgggcttctggaagtcttgggttctcccatcacatggggactttggtcctccctcccaagccacctgacgatggcttgtgcagcctcagaaacaggaagcccgagtagaaatgctttcaccctgcgttgccaccttggatgctctgagaaagtctttctctttgagaatgtctcctctgcattcatgacaccagatcctagaaataggcactccagcgtccggggcagtcacgtcctgaaacctgagcatgtatttgctgaagtcattttattttgaaattcagagattgcatttaaagataagaaagatatttaaacctgctttaaacattcagtcctggcttcattaaaattttggcaagtatttactctcacttgacttgagaagtacttaccttagaaaatcagatatttgtttttttgtcatatagtcattttgggaaggttccagaatgttcctgtacaatgttgctaatagaaattgaagatgctctctttttctagtttagagtatttactatatgtttatgctcacagcaaagcatgtggattcaaagttaagagcaggcaacaaagaagccacagacgaggagctggagcggacgttggacaagatcatgatcctgttcaggtttatccacggtgagactcgggcactcagaaaatgctgcataatcaagaggtgtaaacaggccctgctttcccagaggaggtttagcatgagaatgtcagtatcagtagagccagtttgcattagaatgaacacttttcatccttgctaacatggtgaaaccccgtctctactaaaaatacaaaaaattagccaggcgtggtggcaggcgcctgtagtcccacctacttgggaggctgaggcagagaatggcgtgaacgcgggaggcggagcttgcagtgagccgagatcgcgccactgcactccagcctgggcaacagagcaagactctgtctcaaaaaaaaaaaaaaacacttttaagggttttcagcagttgaagtttgaagtttaacatttgcttatcaactctctgatgtcttgattattctcgtctggttataaataggtaaagatgtctttgaagcattttataaaaaagatttggcaaaaagactccttgttgggaaaagtgcctcagtcgatgctgaaaagtctatgttgtcaaagctcaagcatggtaagtatgtggggcctgggctcctcccctgtaactgagggttgctgccccgtgtgttaccccgatctcactccctcctttgctgtgtccagagtgcggtgcagccttcaccagcaagctggaaggcatgttcaaggacatggagctttcgaaggacatcatggttcatttcaagcaggtgagttgtgtttcttaggtaaagcggctttttaaaaagtatctgttagtgtggtggctcatgcctgtaatcccagcactttgggaggcagaggcaagagacgttcttgaggccagaagttcaaaactaccctgatcaacatagcaagacccagtctctacaaaagaaaaatttttttaatgaacaggtagtcctagctactggggtagggctgaagtgagaagatcacttgagcccaggagtttgaggctgcagtgagccgtgactgcaccactgcgctccagcctgggcaacagagtgagaccttgtcgtggatgggtggatagatagataatacatagacagagatagcagtaccttgtcatagatagataaatagataaggtaggtagattcaatagattagatagaatgaatctcactctatgtaagaagaaaattacactattaacgtttcacaagtaaattttaaaagaagaaaaagaagatctaaacgtgtggcaagaattttatttcagtgagtctggtggtgacacctgaagaagggaaaaaggcagtcctagtgaggcattgggtttcatggaatacattctggggactgagataaattctaacacagatgaaactttatattgaaaattacacggtttattttgttttaggttaattatgttttattactttctcaaaatgattgtcttggatttctctgttttagcatatgcagaatcagagtgactcaggccctatagacctcacagtgaacatactcacaatgggctactggccaacatacacgcccatggaagtgcacttaaccccagaagtaagtgtgcagaaagcatgctgtccgctcccgctgtcatgcccttaccaggcacagatatgttgccttcaagaattgttgaatggggagtttttaaaaatagcccactcagtccaaaatcaaagtgctcttatggtctttggaaatgtgcttgagaaagtgaccacttttgtcaccttctgtggctcctcccagtgcagcctgtgtccacctgctgacctgcagggggcccatgagcacaggcacttgttttggaagttatggcttattaagctgcggttcttgtctggttgttctttctttccattgtagacagtgctgaagtcttgggaatggcattatttagggccttctttgtcagccactactttagctacactaaacccttcagtggagggtttgcatgccggaggtagaattctgtgctcaatgaagttaacatcagcaggagatacaatacatgcaccattcatttaataccaggcgaagggaaagggctgagaccagcctgcaatcatggaagacttcctggaaaaggcgtcccttaagcctgatctcaagtaaagatgaatgatgatttcgtcagctgagaagggaagaaagacacacagctacagtggtaggacagtgtgattccttttcttatccatcatgagggtcatggccaatgctcctttaacaaaagacaaattaggaggagaaaaccttaacaaatttatttaatcaaagttttatttaacacatcaggcttcagaaacgaagaccaaagacccagggaagactgtccattgttatgcttaggtttgataaagaatgggcagccatgtagaaataggtgtgttagtctgttttgcattgctgtaaaggaatacctggggctgggtaatttgtaaagaaaagagttttcattggctcatggttctgcaggctatacaagcatggcacctgtgtctgtgcaacttctgatgaggtcccaggaagcttttactcaaggttgaaggcaaagggggagtaggcgagagagagggcgcaacaggtggtgggggaaggtcccagactccttaacaatcagatctcgtggtaactcattaccacagggagggcgccaggccattcatgagggatccacccccatgacccaaacacctcccaccaggccccacctccagcactgcagatcacagttcaccgtgagatttagaggggacagacccccaaactcttatcaatgtgactggacagaagggtaccatctaacagtagtagagtagcggggaaaccagtaaggcctgtctgttcagattcttcttggcctcactgggcaatgttctttcctcccaggtgtagggcaggacacctctggaacaagagtcttatgacttaactatcagcaaggtagttcagagaacttcttaatatccagatcctacacaaaagggcatgggaagcatcgagtagtatctccaggctttatggctggctttgggcaagaggggtttgagttttctctggcctgccttggggaagaagagttctcattccaggagaactttgggggagaaggtgagtgagagagcttgcttctgaggcgtcctagccagacttagagaacatgtgcgggatgctcaaagaaagccaggcagcctgctttccacgctggccacgtggtgctgtcccttcctgtctccacagatgtttgtgcttctgcaccattccctttccccttaatattctagtggctatttcccaagaacataagcacctgtcaaatgagggcattcactctgatgtaatactttcaccccatttctgttggttgtctcagatatgtcctttgtggtgtttttccggtacccagctgagcccaggacccaggcggccttcgatgctccctgtgagtaggttcaggttgggcaggtccagccagatgccccgtgtccccatcaggatcctggcgggaggtgcgcactatcacgtgccccagtgtcttggtgacattcgataggatcctcctgtgaaggtgctggctggtttctccaccgtatcgttagtgtttttccttttgtaatcactaagtaatctgtgaggagacatttcaagactacgtaaacctcttaatcctcatccagctgtcacctgtgtggcgattcctggctgaattgatttttacctggtgaatggggatttttttccagctctatcatttctctatatttagaagttggcattctaaggaagagcccttctttccaccccctttatttacttatttatttctctctctttatatcattatgaactcagggattcttaatttatgtacttattttgatgcttaaattgtcccatatgtggtctgtgagccacccttaacactggttcctttgctctttgatatgcctacatcatttttttagtacttttttgttttctagcaaaagttgtttgaagcttaccatactgtatttttttattgtggtaaaatatactttaacattcaagttacctttttaaagcgtgtggttcagtaacatccagtgcagttgttcctcagtatccacgggctgttggttccaggactcccacagatactaaaattcacactcaagtccgttattttatataagtgtgagatcttagataacctatgcatactctcccatatactgtaaataatctctagatgatttgtaatacctaacaaatgctgtgtaaatagttgttacactgtattgttaacagtacagtaacagacctgtctgttcagattcttcctggccttttaggggatcactgacaaaaaaacttagtgcatgttcagtacagacaaccatcctttttttgctttcgaatatttttgacctgagattggttgaatccatggctgtggaacccatggacacagaaggccagtggtacatttacagtgttacagagctgtcacccctgtcgattccagaatttttccatcattccattagcagctcctccccagcctgctctgctccggaccccggcagccactatctgcttcctgtctctgtggatttgtctacattagatagttcacagaaatggaatcacaatatgtgagcttttgtgtctggcttctttcacttagcgtgctgttttcaaagtccatccgtgctgcaccatacatgagcgctttattccatccatgctgtaccatacatgagcgctttattccatccatgctgtaccatacatgagcgctttattccatccatgctgtgccatacatcagcgctttattccatccgtgctgtgccatacatcagcgctttattccatccatgctgtaccatacatgagcgctttattccatccgtgctgcaccatacatcagtgctttattccttttctggctgaataacatcacattgtatcgataggtcacatctggtttctccattcaccaaacattgggcatttgggttatttccaccttttggccgctgtgaataatgctgctatgaacatgggtgtacaagttttagtttgaacacctgcggtcacttattttggggtatatacctgggagtggaactgctgggtcatgcagtaacttgaagtttaagttactgaggaattgccggactgtttcccacagtggctgcagcagcttttattccagttagcaatcacgagagcttcccaccttctcacctacacctgtgatctgcctctttcgttgtagccatccctgtccatatgagctggtctctcatcttgccgtgatttgcatttccctgatgactgttgatgttgagcatcttttcatgtcctgattgaccatttgcgtatcttctttggagaaatgtctgttcacgtgctttgcctagtttttaaccgggctgtttatcttttgttattaagctataagagctctttatattccaaatgctagacccttatcagatctgtgatttgcaagtattttctcccattctgtgggctatctttttactttcttgatagtgtgcttctacaaaagtttttaattatggtaaaatcacatttattttctcttttgtaacttttggtgtcatgtctgagaaaccattgccaaatcaagatcacaaaaaattgacgaggccaggtgcagtgcctcacacctgtaatctcagaactttgggaagccaaagatcacttgagcccaggagttaggaacagcctagacgacatggtaaagccccgtctctacaaaaaatagacagattagccgcatgtcgtggtgtctgcctacagacccagccactcaggaggttgaggtggcaggattgcctgagtctgggaggttaaggctgcagtgagctgtgatggagccgctgtactccatcctgggcaacagagtgagatccgagaccgtgtctcaaaaaaagaaaataaaatagcactatgtattctcccaaaagttttatagttttagctcatatgtttcagtctttgacccattttgggcctggactggtagctagcacatagtacccaaacgatagcattatgatgataattatcctcattaataccaatccagtcctaggaatgaatcccaaggagatggtttttaggaaagatatgcactaagaggtttatcacaaaccatggtacttctcaaggcaaaaagaaagaagaggcttatcacattattgacttttatttaggtatggtaatggcatagtagatacatttcctaaaagagttcctgtcctttagagatacagaaatacctacaaatgaaatgaaatcgatgatatcgcgcctgggatttggtgtcattgaagatggggagtaggtgcagcaggtgatttatacatgtggtttcatagaaaggtgactcttgggctgagttttgaagcatgaagaggagattgccaagcagatgtgaggtcagcaggaatttctgacagggcacagcttagacagaaacacagagaaactaaaagggcacgtcaagtctagagagcagcaggcatttatgcagcacctgctggtgccatgtacagtgctgcaatggggagtcagagagccagaggccctgccctgtgagcccctgtccggagtccacattcacactgtgctatagatgctggtagagctaagagggtgtcagagaagacctctctgaggaggcggttctggaaatgagtaggtttcatgagggagatgggatatgggatccagcagaagaaaccacgtgtgtgaaagtctgaggggatgagaatgtatgaaagacagtggaatgatcgactgaactgggcctggaggatgggaggggcacaggccaggtctgtgagatcagaggttagaatttcacgctttctttgtcccaagatctttagaagccatccagagacacagggaatggtgagctcgtgggagaggagggattggtttggatttgtgttcctgcccaaatctcatattgaattgtaatcaccactgctgggggagggcccgggtgggaagcgaccggatcatgggggcagatttcccccttgctgtgctcatggtagtgagtgagttctcatgagatctggttgtttaaaagtatgtagcacctcccccttctctctcttccctgctcccgtcatgtgaagacgtgcctgcttttttccccttaccttctgccatgattaaaagtttcctgaggcctccacagccaagctacttgtacagcctgcagaactgtgagccaattaaactttccttctttataaattacccagtgtcaggtatttctttatagcagtgaaagaatggacccatacaagacgtataggtggatgctgagtcccggagcattggcatttgtggagtggacgagagcagggggaggccacgccctgggctgtgcagagatggtctcctgaggcgaaactggtgagcccttgcgtgcgcagcacagacgtgtcggagatcccgggtgcagtggacaccagacaggatcaagctgaagagtggagggtatgacggaccaggaagggcatgcagaagtcagggaaagcaccgcgcatgggagagtcacacacagcctgcccctgagaggcatccggaaaacacgagcaggatccgggcgatgggaaaggctggtgcactgaacgctgggaacttgaaaatgcagcaaccacaattttaaggatcagtagaaagtttggaaaatgtaagaaattcactcaaggccaggcacagtctaattccagcgttttgggaggccgaggcaggaggagcgcttgggcccaggatttcaagaccagcctgggcagcatgagaagacccatctctacaacaacaacaacaacaaaaatcaacgggcttggtgtcatgtacctgtagtcccagctgctcaggacactgaggcaggtggatcacttgcacctgggagatccagcctgcagtaagctaggatcacaccacaacctggctgacagagcaagcctgtgttccaaaaaagaaaagaaattcacccagaaactaatcatagaaacaactaactcgtgctgcactttctgtgcaggcccagatggaggtgtttgccatcagcccctgcacagtgcaacgcaaggggttgtggtgtcacccttcacagatgaggaagcaggagccccgctcattgccgggaacaccagccgaggccagggctgggcatggccgggctgagacacaggatctggcctcagacacctttttcttgacgggctccagtcttcactctgtgccactggccccagcaagccctggtatgtacagagaccacggaatacagctggtctgtaccatgaaacaccagtgcaggcattatctcgttgacactgagaagccccaaagttcaaggattgaggacgtttttacaaataatggaatccagaaagtgtgagaatatagagctgaccttttaattcagccgtgagaaattgtaaaactctgtgcattgaatggggagctattgagatggatggtgtgtggcataattttgttgttctcctatgcttaacagatgattaaacttcaggaagtatttaaggcattttatcttggaaagcacagtggtcgaaaacttcagtggcaaactactttgggacatgctgttttaaaagcggagtttaaagaagtaagttgtctgtttcatttattttttattatttgtaaatatgttaatataatttttttattgttactggactttagtagcaaaaaaggagtgtttcactttaattcactagcttttataagtcaataaaatttataacagttaaagggttattattccaatcaataaaaattcttaagaaatcaatccatagaaaaccatttacctattgaaaaaaagagcagagaatgtgaagaggcaactcataaaagcaaaattgaaaaaaatatctgtgaagatgcattacacttctctgctaaacagagggcttcaaagtaaaatacagtaagatgccactttttgactaagagatttgatgaagcctaaaaaataaaaaaaaattaaaaaaaacagactcttgcccactactggaagaagcataaactgtagtgagcttttggaagggcagtttggcattgtgaactttggcaaccctgctgccgagttgttgccttagtttcaactctaggaactcatcttaataagacattttcacggattaatgaatgagaatagtggttgcagtgctgttattatgagcgattatttaagaggggagaatgcatacaatgcactgatcaatgaaaggcgcttatgaaacggcaattatatacactaagcaaaaacataaaattcctattttgtatagctgttatattaataataaacttatctgtacattatcaaataagttatacatacctactttattattgtagagagtcatatacatgaaaccatatattctcttccttaaggtattaggaaagttaatttctattatccccagttttttacctacttgctgactttagttgaacttgacctccacagggtctgtaccagcaccaccaactgcagctctctccaggtgtgcaggaagggcttgttatgggcttgtgatgagtctgggctgggtccgcagagggggccaccaactgtcacccaaactctcatgtgcctctcgtgggtctgacctggaggcatgtggcaagttgctgcagcactaactcctgaatagaaaaggagatcatcctgggatatataaggccaaattgcattcacccctacgttacagtcagtcccgtataaaagaaagctggactgtaatcccagtacctggggaggccgaggtgggtggatcacaaggtcaggagatcgagaccatcctggctaacacagtggaactccatctctactaaaaatacaaaaaattagccgggcttggtaggcaccagtagtcccagctactcgggaggctgaggcaggagaatggcgtgattccgggaggtggggcttgcagtgagctgagattgtgccactgcactccagcctgggtgacagagcgagactccttctcaaaaaaaaaaaagtttgagagcaaaaagaagcttcttttaatttttcaaagattgtacatgcacagcttcagaggtgtgatgaggccttctcttccaggggaagaaggaattccaggtgtccctcttccagacactggtgctcctcatgttcaacgagggagatggcttcagctttgaggagataaaaatggccacggggataggtacgaaaactgcagagtgcatagctccatgagttgttcttaaagcatgtatttgttttaagataagacatagacttggtagcatgattggtttactgttgttgagtctcattcgtttaacgccagcctttgcctgcatttgcttcccattcagaggatagtgaattgcgcagaacgctgcagtccctggcctgtggcaaagcacgtgtgctgattaaaagtcccaaaggaaaggaagtggaagatggagacaagttcatttttaatggagagttcaagcacaagttgtttagaataaagatcaatcaaattcagatgaaggaaactgtatgtataaactttctctttttacttatagggggtttagcagggaatcatttgtttttgtagtaatgtttttggctgttagaggcctgaagcacatttctacaataatccaatttcactatgtaatgtttataagagtactcattttcctgtcgctttcattaacttcacattctcagtaggaaagaaaatcagaaaaaaagccacttaatgttattcctattcacaaaaaagttgtgtgctaagccagaactccccatggtcatagggtttcgaaaattatccacactttctatggtaatagaatctgatatggttcactcttggtgttgtacattctgtgggtctgggtaaatgtataatgttatgtatccaccattataggatcatacaggacagtttcattgccctaaaaattctcttatgttctgtcgctgtatccctgtctccctccgagcccctggcaacccctgaccctgttactgtcaccatagttttgccctttcctgaatgccgtacagttggagtcatagtgtatatagccttttcagattggcttctttatttattagaacgtatttgaggttcaccgtgtcttttcatgactgggtaactctgctttttgcactgaaggattctccgttgtctggatgcatcacaacttatcccttcacctactgaaggacatctggttgtttccaagttttggtgatgatgactaaagctgctataaacatttctgtgcaggtttttatgtggacttaagtttttaactcctttgagggtgcaccttttatagtgggcaaaagtgagaaggtctatcagttctttctcccgaaggtaaccactactgccctttttgtttgtggtcacagcctttttctgtggtgtgagtgtatgtaaactttttttttagtgggatcactaagccaggcacagtgacatgcacccatagtctcagctactcgggagggtcgcttgatcccgggagtttgaggccagcctgagcaatgcagtgagaccccaaactctacaaaagaaaaaacacctgggatcactgtacatatggcacctgtcagggccttcctgtagccagttttcgttgctgatcgcagtcttctcctggccaggacttgttgcaggagcacagtgccggttgtgtagacccaccagggctggcagtgccctcggccacaggcactaacattcctccactgcccctcctgaaaataagattacgttcaacaccctggcacagacatttctgtgcacttgttagattgtttctttagtgtgattcttgctctggagctgctgggtaaaataatgtgtacttgtcttagtttgctcttttccaagttgaagtctggcagatttcaccagagcacagtgtctgcccccacctccacctgtcctttgctcaccctgttctgagcagcccaaagatagtttgttgcagttttcattttgatttctgattctttacagcatctttctaccactcagtagtttatacaaattatataatctttctaatgctcagtttctcatatttaaaatagacatactactacctcaagttgtgagaattaaatgaatcgtttagaaagctctttgccacacacctgtaagcacttcatacatgttgatgctgctctttttatgcttagccatttgtatttttctttttctaattgcttttcaagtcatatgcattcattataatgttttttctcttactgattagtaggttttctttatatattaaggatattaatgctttgtccctttttttttttcgtttttttttttttttttttttttgcatttcactctgtcgtccaggctggagtgcagtggtacaatctcgctcactgcaacctccgtcctccgggttcaagcgattctcctgtctcagcctctcgagtagctgggactacaggcatgtgccaccacactcaactaagttttctatttttagtagagacggggtttcaccatgttggccaggctggtctcaaactcctgacctcaggtgagtcacccatctcggcctcccaaaatgctgagattacaggcgtgagccaccatgcccagcctgctttgtcatttttgacagataattttgttgtttttattgggttttttttcacataacagtttttaagttctcaaatatagtctccttttcttttatggtttctgacttaatgtgtaatgctgtattaggccattcttgtattactataaggaaatacctgaaactgggtaatttataaagaagagaagtttaattggctcacggttctgcaggctgtacaggaagcatggtgccagcatcacctcagcttctgacgaggcctcaggaagtttccagtcatggtggaaggtgcaaggggagcaggtgtctcacgtggcaaaagcatgagcaagaacagggagggaggtgccccacatgtttaaacgaccagatctcatcaccaaggggagggcccaagccattcatgagggacctgcccccacccacccggtcccatctccaacactggagaccacatttcagcatgagattttgaggggacacatattcaaaaccatatcattggcctaagagagaaattcccttaaccagagttttaaaaaacatttatactatgttatttttctagaagtttttacatttaaatctttcttttcatgttgcagaaattattttagtatctgaaaacagtctaactgcccccatcctttccaaaaccaaatttaaaatatcatccttgaacaagttatttgaattatcaccttattatgtatcaaattcatataggtcagtttctcaattctcttctataaattctgtgtctatttcatagccagccattttttttgttttgttttgttttgttttttgagacagtgtcgcccaggctggagtgcagtggtgtgatcatagctcactgcagcctcaacctcttgggctcaagcgatcctcccacctcagccccaggcatatgccaccacgcccagctaaatttttgtattttttgtagagatgaggccttgccatgttacccaggctggtcttgaactcctgggctcaagcagtcttcctaccttgaccccccaaagtgctgggattacagccgtgagccaccgtgcccggcaccaggttcttttaattaatgtagctattcctataactttattcttccaatgaacttgacaataattgtatcacgcctttgctcccccaaataagaacattgacatttttaatccatattgcattaatttacagagcttttatctttatcatattaaatcttgtgattcatacatatgtgtatatatgtaaatacatacaaatctttttctcagagctttctagttttcttctgtaagtcttgcatatttcttgctagtcataaattttcattcattcaacaaatacttattgagcatctgtggtggcccaggtcctctgtgaagcactgagaattcatccattaacaataaagaataagtccttgtttctaggagtgttcagtcttttccagcagagaggtagcagaggatcacacacattgactaacttgtaagagtggaggaaaatgttaggatagagaagtgcaggagagtctaattaaatactgtcgtcagccaacgctttcctgaagaagtgactagctttgctcaggaactgaaagaaggcctctggctgcagcatcgttgccaaaaggggaagctgagccagacaggcctgatcagggagccacagctggaccctctgaagatggctcagatccatgaagcatttggaaaaccactagagttttaagcaagacaggctaatgaaatgctgatatcttataaaggggaccttttttctttacatttctgacggtttttatcagaatgtatgtattaatgctatttgtctttgtatatttattttatttccagccactttacaaaactctttagctttgaaagtttttctgttgattttcttggattttccagctcatctacaaataatgaccgttttgtctgcaccttttcaatatacctctttagtctgttcctgtattgcatagttagaacctctaaagtaatgtttttaaggaatagcagtgcagctgagcttcctaattttatctctagttcagaggatgttaactttttgggggtcatggatcctgttgaaaatgtgatgaaagcttggagtctctcccatcctgaagcatacttgcctcatatgtatgcacagaccttcccccagccctcatttcaactgcagatccccatcaggttcctgttggactaaggttaagttgtctctagtatttgctgtttgtttctgataaccatgttttatcatgttcagattcttttttattcatccttgtatgctaatgtttgttttaaatcaaaaaatcaattttatcatgccttttcagcatctatcaagatggtcatgtaatctaacctttcaactgctacagtgctctcacttatattcacagatttcctaatgttgatcaacacttaacatttctggaatatatcctgatggtcattatgttttgtttactgtgctgctagttttaatctacatcacacatagagttgttgcagctttcttataaggaaaataacttttaaaaatattttttaagttttggttttggagttttgctattctgggaaggtaccttttactacaacaagtaaacatgcataataaagtaggattcatccaatgtctgacctttctttgcatcaaaagaacatttccggccaggcacggtggctcacgcctgtaatcccagcactttgggaggccgagccaggtggatcacgaggtcaggagatcgagaccagcctggctaacatggtgaaaccctgtctctactaaaaatacaaaaatgagccgggcatggtgggggggcaccgtagtcccagctacttgagaggctgagacaggagaatggcgtgaacccggggggcggagcttgtagtgagccgagatcgcgccactgcactccagcctgggtgacagagtgagactccgtctcaaaaaaaaaaaaaaaaccatttcccatcaaattcggtaacatcaggtcattaatattgaaatataggccaggtgtggtagctcacacctgtaatcccagcactttgggaggccaaggtgggcggatcatctgaggtcaggagttcaaaaccagcctggccaacatagtgaaaccctgcctgtacaaaaatacaaaaagtagccgggcatgacagcaggtgcctgtgatcccagctactcgggaggctgaggcaagagaatcgcttgatcctgggaggcggaggttgcagtgagccgagatcacaccattgcactctagcccaggcaactgagtgagactccatcgcaaaaaataaaaagaaaatacagttttacacttaactttttttttcttttttatacaggttgaggaacaggttagcaccactgagagagtgtttcaggatagacaatatcagattgatgctgctatcgtcagaataatgaagatgagaaagactcttggtcataatcttctagtttctgaattatataatcagctgaaatttccagtaaaggtaaatgtaacattagcataattaaatttgtagtatttgctaaacaattgacaaagcatgtttaattctatgttcagtcatatcatttgacctgcattattcatggtgctttgtgtatacactgaatgtagaaaaactggcaaatgtgaagctctttattccaggtgttgctcatcgccactgcagaaatgatagagccctaaaactctccttcccagggatggtgcgcgcttgttcatattttcaggaagggaagaggtagatgggacatggaaagctgaacacttttctcatagtagtagcggtcaaggttacatcacaagattttaaggaaatgataacaataactaacttactcagcgtttacagcctacaccgcgttttccaccacggtaatagtctactgttgctgttgcttatgaaagtcagcccaggcctgtcaacccgcgttgttttcagaactgagatttactgtcctgccacgtgtgggatgcaggataagccgggaaagtattatgaaacgttttttacatgtatttatcaacccaggaaatactgaactctgatgacgcctggcctctcagggacaggaccggccacacgtgctttggagggaaagtccccagattccatgttgtgcagtttgagcctcccattccatcaagggaataaagttgagatgcactaaatagtcgaacacttaagagtctggtggaagtgccactgtccatcagcccgcatttgcccccttccctgcagaggtgaggtgccgtcctcagggccctgggaagctccaaaagcaccatcaggttcactgccccttcctcccaccagctggagcaagtctcctgttgccactgcaaacaatcaggcccagcgcgaagcagaggtgagcaagagtggagtgtggcagaccagggcacctgctctgctctcgggtagagagtggcagaccagggcgcccactctgctctcaggggtagagtgtggcagaccagggcgcccgctctgctctcaggggtagttgggttttttttttctttgagatggagtcttgctgtcccccaggatggagtgcagtggcacgatctcggctcactgtaacctctgcctctcgggttcaagcagttctcctgcctcagcctcctgagtagctgggcttacaggcacgcgccaccacacccagctaatttttgtatttttagtagagacagggttttaccgtgtggtcaggctggtctcaaactcctgacctcgtgatccgcctgcctcaacctcccaaagtgctgggattacaggcgtgagccaccgcgcccagcctcagccacatcttgtaaaatgtgtggcttatcactgaatagaaggtgaagtttgtttggaaaatagagggtctcccttgtatagggagagccttgcacgtaagtgctcacacagattttcttcctaatacagcagagctggagtggctgttccctctgggcagagacaggctgtggctgtggattcgtctcctcagtcacctactcttagtgcaggaacactggggattgtagtttcacttacgtggacatggcatgcaataactatgtaaatacacgagaataaaactacaggccaggcgcactgcctcacgccagcgatcccagcactttgggagctgaggcaggcggattgattgagcccaggaatttgagaccagcctgggcaacatagtgagaccccttctctacaaaaaataaaattagccaggcatggtggtgtgcagcctgtgatcccagctactggggaggctgaagcacgaagattgcttgagtccaggaggtggaggctgcagtgagctgagatcgcaccactgcactccagcctgggcgacaaaatgagaccccatctcaaaataaataaacaaaataaaatacagtacttaggcagaagcatcctttcaaaggataaaagttgccccagtaagacatgttgagattttcctttcaaataaaaatgtgtcacgtgatcgggtctgcctcacttatacgtgcccttgctgatggcagatgtcggatctgcctcgcttatacgtgcccttgctgatggcagatgtcggatctgcctcgcttatacgtgcccttgctgatggcagatgtcggatctgcctcgcttatacgtgcccttgctgatggcagatgtcggtctgcctcgcttatacgtgcccttgctgatggcagatgtcgggtctgcctcgcttatacgtgcccttgctgatggcagatgtcggatctgcctcgcttatacgtgcccttactgatggcagatgatgtatgtacatttcacaagtttcacgtttccctcaggaaaccacactctgaccataaactcacatggacgctttttttatcaagagataacgttaactttgtctttaaaatagaaagttttgttcatttcataaatatgtgtataattataaatgattttcatataaatatctatttgtatatatatttctataagtatagttacatacttcatgcatataccccttgtatgtaaatgtttgtaaatttaatgccattgtaattaggggggttttattcttcttttttagcctggagatttgaaaaagagaattgaatctctgatagacagagactatatggagagagacaaagacaatccgaatcagtaccactacgtggcctgacgcatctgcagacggttccccttcatgaaacactagaatgtaccctcagagcaggaagcacacctgtgccatttctgggactctgattgatccagctgtggacattggaaggcgaaggaagggaggtggctcctgggtcatctttcacaaggctcaagacttcaacctgcagatgtatctttttccctccagtttttcctctagttcttttaggcatttaaattgtttctgttactctgtgcaaaataactttgagattggacaagaagatgttactaaagagaagttcctttaaaaggtcttgttcttgtgtcaaaaagctgcaagtttggtttgttctcgtgtgtgatcatgagtgcacaatgaagaagaccctagatgctgcattttttagctctgaagattccttaggtatccctgaagacagctcgctcagatgatcagcatttagagtgaaaacaagggcccttcatgggtgaacattagaaagagccagggttcaaagctggcgaatggatgacgcaccctagccactggcccctctctgtttcatgtatttccaaaagttgtaaactttgatggctgatttttcgtaagtcaggtttctaagtgagctccctgaggtgccaaggccatggtgtccgccctgctgcgtctgttcgtcagctgagttccttgtgaatctctgttttagggtttggggctagtgtgtttgtgtttccattctaagattgagtctggcagtccctgtttttttgcattggggtaactgctctttgattttttttaattgcagtatttgtgtgattgcaataataaagtttggtttggtttttacagtcatgcgcagggacgatccttgttctctgctgtaaactgtaaaaagtttatggagacttaaagtcttgatgttgtgaagcagaggttattttgtggaaagattaaaaggattttgttggtacctggttttgtgttgtgtatatatacatgaggttgaacagtgaaaggaaagttcagtagtgatgttagaagggtaactatgacaaagatacttttgagataacatttaaaagtactttatattttacataatagcatgtttcattttgattaaaagctaccaaaggaattttgatcatggcataagtgtttaaagcaatattttctggaatataccaagtttatataatttgattttgtgctaaattattaagagtctctttttgaaacatgcgggtttgaaatatgacaccttgtgggtttccatattaaaatcctcactctttaattgtcatttctatctttgaaaattttcatttatgagttccatgatatgtggtctaagaaagaccaaacagatttctatttttttttcttataagttcgttgtgtctagagattgttaatattgtaatttaatgtagacttactttgaataaaattagtttaattggccttaaaattacattaataaaactttgtgatatgcaaatgacacattcttcataactctttagcagctttgactactagtgcactagacagaagtcagagcagggagcacctgtcccctctcaagtgattattctttcctggccacctctaccacaaaataccagtggggccaggtagtgacaagtgggtcttttttacttggacgattcgttgtgctgtgcctttgtttcatttgagcacagtggctcacgcctgtagtcccagctatgggagggcaaggtgggaggatcgtttgagcctgagttccagaccatcctgagcaccatagggagatcctgtttccattttagtttatttatttttaattgaggtggagtcttgctctgttgcccaagctggagtgcagtggtgcaatctcagctcactgcaccctccgcctcctgggttcaagcagttctcccacctcagtctcccaagtagctgggattacaggcacccgccatcatgcccagctaatatttgtatttttgtagagacggggtttcactatgttggccagactggtcttgaactcctaacctcaggtgatctgcccgccttggcctcccaaagtgctgggattacaggcgtgagccaccatgcccggcctgcctgtttctgttttataaaagaaaggaaaatctatttatatctattctcttatttagcaatatttaatgttttattgttaaaggtcagtgtggtaaaacaaatagtatagaagaaatcattgaaaaagaaacagcacttagacagaaatgctgtaaaagtggaaaggagaaggtgaaattacttgcaggttagatggttgcatacccaggtcatctaaggagcaaatgaaaatctgtgactgaagaaagaattcaccaagttaaccagacacaaaattaacaaaaacatcagtagctttcctataaatataggctataatggagggtcattttttatttttatttagagacagggtcttaactgtcacctggactggagtgcagtggcatgatcatgtttcacggcagcctctaccttctgggctcaagcgatcctctcttctcagccacctgagtagctgggcctacaggtgtacatcaccacgcccagataatttttattgtattttttatagaggcagtgtcttgctgtgttgccaaggctgttcttgtactcctggcctcaagcgaacctcctacctcagcctccccaaatgctgggattacaggcatgagacactgcacctgaccagaagtcattttttcaatagcaacccccaaaaaagataaaatacctagtaacaaatagggaaacacctatgtgaaaggtattataacattactaaggaacacaggccctgaataagtgaaagttctgttgattctcacattttgctatacagtatcttaagatgtaaaaccttcctttaaaacacaagcggattctaaagttaaaacagaaaagcaaatatgccagactagtcaaattgttttaaattctgctgtttttagaacattgtaattgaaacagcatgatgctggccctttaaaaagattcctggaacaagaaagtccacaaataagccaaatacacaggaactcggcgtggcacaaaggggccgtgtgtgatcaggaactggaactttgcaacaactacccatgctcagaagtttgggccaccttgaaaagagaaaagttggattagactcctttttatactaagggaagttccaagtggtcaagtatttacgtgtaaaaaaatacatatatatgaaaccataatcataagatactttttttgtaaattgactattattgtataaatttatagagtataaagtgatcttataaattatgcatacattgtggactagtcaagctagttacatccatcacctcaaatacttaacatttttgtagtgagaacatctgaaatttactcttagcaattttgaaatgtacaatactcaatttttgactgtattcaccatgctgtacaatagaactcagaaaaagaaa

SEQ ID NO: 15398 - DNA, 22404 bp, Human; identical to SEQ ID NO: 11765
  misc_feature (1)...(22404): n = A,T,C or G

SEQ ID NO: 15399 - DNA, 36389 bp, Human
ttcctatcacatctcaatgccattaggtgaataacaccggcatgcatcttcactactaaatgtcatacaaacaaatttcagttgtttcacatgcaacctgtgtggctgctgcagtttgtatcaactatgtaaccacagggtgggcaaaatagcattcaaaatgagctatagtgcaagataccatccatacgtagagttaagccctttcatgcttagcagtcacaatcaggatatctttggcccacagaaacctatcctgactggaattttcctctcctgtgtgtctcctggatatagtaagttcctaataaacatctcctctgattgctagccttgacaaatttccaggagaaccagggcaaggagaagacagtgaggcagtgcccgctgctcttcagatcaccaacagaatagagtcagaatatgatattattgaaaccttccaagtttgaattaagataaaaacaactttttcaaaataccaaaaaccttttatttaagaaagtgaaatcgctcgatgtgccctcccactctggttagatgctcaacagaccacagcagacaatgcacctcaaccagggctaagtgtgcaagaaaactgaagtacacaaaaagcaaattatagactcaggtactgtcaggcacaaaagaagaaccaaccctttctaggagtcttgtctttgcttcctttattctttcctcgattcttgtaattgaatgttacaaagtatatcaagaggaataaacgtatggggcccctctcttccaaacaagaaaaggttaagcttttaattacaggccctcaaactatcattttgtgcaattagcaattaactataatcgttgatgagcaaatgcaaagctgcgctagcaatttcccttctcctcatcccaggctgggttatttcagtcttgttctattacagaggaccagccacaaccgcgcgcactctctttcaaacatacacactctctcacttaaagacacatttagttttcggcaaaacggcatctcagcgtgcgattgagaccggcatcccaaaccccacttttgagcagcccaaacgtttggagcccctccgcttcatcactttctgagtggatagaggaggcccgaagaagatgctacctaccagcctctctcaggggcgcaggagagggtggtagagagatgcttgttgcccctggaaactgcaagtaccccccaggtgcacgccccgtcagtggggaggcggtggcaacagcaacgatagttgcatcagcgctaactgctgctgctgctgcgtgttctgccggaggctgccgggagggtacagtaatgactgtagggagcgcacagccgctgcggcggcaggttccctggatcaggaaattaggacaggcacccgggattggaggcgagggcggcgcgcgagccaaccagcggtcgccccgggcccccgtgagccccaggcgaacgcgcggagcagccgggcccctagagcggtccgggtggcggcggcggcagccacgaccacgaccgcggtcactcacgcacgctcacactcgcacgctccccgcgcgggcacccggctgcccggcgcgtgcaagaggagcgcgtcgagggaaaggagggccgaagccgccgcgctcccgcccgcccgccgcgcctcccgttgaccacgccccctccggccccctccccgctgctcaccccgctctccggccgccgccggtgcgggtgctccgctaccggctcctctccgttctgtgctctcttctgctctcggctccccaccccctctcccttccctcctctccccttgcctcccctcctctgcagcgcctgcattattttctgcccgcaggctcggcttgcactgctgctgcagcccggggaggtggctgggtgggtggggaggagactgtgcaagttgtaggggagggggtgccctcttcttccccgctcccttcccccgccaactccttcccctccttctccccctttcccctccccgcccccaccttcttcctcctttcggaaggactggtaacttgtcgtgcggagcgaacggcggcggcggcggcggcggcggcaccatccaggcgggcaccatgggcacgtccgcgctctgggcgctctggctgctgctcgcgctgtgctgggcgccccgggagagcggcgccaccggaaccggtgagtgaggacgcgcccctccgccggcgggcgggacccagccggggcaccgggagaccccgaggcgtaggtctccgtttgcccacccgcctcctaggaggcgcctctcggttctcctcgccttccctccctcccctccgtggtggcgcctctgagctgtcagcgccgaggctaaagggagccgggcttggggaacagcggggttcggggtgccccgacgcctcgcctgaactagtcttctgcccctcactccgcctcccccagagccgctgctttgcctcgtttctcgccctcttgacgggcgccgaggtgcgtgggcttctgagcattgaacaatggttctgcctcctctgccaggcgcagtgttgggaaggaggcagagggccaagacgtgtgcggcagcctcgggcgcaccctcgaaccccggggagtgcgggagcggacggggggagaaggtgagcgcctccggggacgcggagcgccaggggccggccgggcttcagagtcttccggcggccgcgagctggcgcacgttcggtgggcggcggccgggaggctccgcggagccgagggcacccggactgcgactcccccggcgcggggccgcctctccggcgtgcggggtaggggagcggcggggctttacgcaggactctgctctgggcgcttctcctctcccttttccccgcctcgggcggcgtttggaaaccgctcgggtctcccgtgtagctgaacgcggagggggagtggaggggagacttaatctggttagtttgctgaccctccttcccggtgacgtttcctcgagaggaattgagtcctaggctagtgactgtaattagccttcattctacacaatagctcaaaggagcagcgcgagagcgagcgtgtggccctgtcttgttgggaagggcggcggtgactactgtcgggtccccagactctgccgcgggggcctgggggccccgcctggtcgtcagccacgttcccacttggggcctcgtaactttcctggacaggcgacaggaagcctttctgagaggactcagtcggaatcctagcgcgtccccgaagtgatcttcagatgtgacgccgaggggcttgcttgccagctgcagggaattgggactgaaagccgcccaggcccttaacacccgttccagagtccctggctcccgtcgccgggtggcttcaggggccctgccggcctgcagtcacgtgctcctgaagtgagagcgaactttaaagcatgtggtcaaggagcctgtcgggcagcgcctggggtttttacgtctccgaatgcccctgccctttggttgccactgtccggagcgtgtgaactgggactggcctttccgccctctgcgattggttagcggtgcgatcacgtttaggttggtcacatggttccgcggactcttaagtgggcagcatgggcagtgttattttcaatggaaagtaggagactccacaggctcttacgggctgttctctcaaatgccttcccctgcctggactctttgaagaggacgaatgtgtagtgaacatggaatctgatgtgtaacaagcctgagagcctagaaaagctctgcttacaagagtttccaaacgctagcattaatcattaatagatgagtaatactaacttattaaacgatttctcagtatagtgccatgacttgcattatgccttttgtaacatttcaaaacgctaaggtataccagaaggagggacaattatccaggaaggtgagagaaaagtttcgtttttgctgcatgtcccttccactagaggttaactttaccttatagaatgctaggaatgcacctaaactactgacatgagttagtcaaagccagatgttcaccttgtattgggcaggtgaggatccttttcactttgtcacatgtgaaatatttgacatgccatgaacaatggaaaaacaaattcttcaaaggagaggaagcagattcttccagaactggaggaaatttgggctgaggcagttattgaccctaaaccaatcccaaccggcatctgtcttaagttcaaagtctcagggcatgtgggctgactttctaccctggagcttctacacataccccttctgtccactggcacatggtgctgttccacaatactcctggacaagacaggtgaacactgagactctggcaaggaacttaaggctaacaagaagttggtatacctgattgcacaattcctgggggttctgggacattttccttcagcctaagtagtcaagattaagatctgtggtatgatatattctttaaggccagagtctaaaagaaccaaggttttttgagagctattcatatatggctagcaactagcctaagaatagaaagaaaattccctcattgtgagaagtgggttggtggtactggtggtagtaatagacctggaggtaggaaactggttggcatggaaagtaaacttggctcatccagatagcaccaatgaaggtatgacgatgatagtaccccttatcaaagactgatcactcatgtgagcagggactgcgtaaaggaaggtcaccagccaagccctccttggcagtaacagcttcatgaaatctagtgtagctttgttccctggatcaccctcttgcccactttatgtggcatttacctatagtgcctgtcctgtgtcattttgattgtttgcttttatggcctgagtccccagatacttaaagcatgtataaaggtcaagtagagctgccaaatattaagactttagtacaatagactgctatttaacactaaacattgctagcaaaggtgacagtctccatgctcaaaagaagtgaagacctgatccaagtgtctctacctgtcataaaattgaataaccgtaaacttgacttgagtagtttcattacagttttggaagaggaaaaaagttgttacaagccccttctgctccaggagaggtatcaaattgataagacttaacaagaactcctagagtagaacatgaccataagatcaagggaacacatagtacccagccgtgtggcttcgggttttgatcccaaaccttgaagacttggcacacagcatagaaatacagctaattcattttaaatatctagcccattttctgtttctcacagaatgtaaatttgttcttttcagtgcagggaaaagtgtttaagacaaggcagttgcctacgtgacttaaagtaatgattgcattcactttggatactgactttcatttggaaaaccaccttcacatactagcctataagaaattaaatgtattaaagggcttgatgaggtctataatgatgttcgttgtaaatgtacctgccttagggagctccttgtggtggctaatacaactgccctctacatggttagttgataaattcaaaattgcttagtttggtccctactaatttaatctcaaaagaatacttggacaacagagtgatagactactttcaaggcaaacagtccaaaaatactgtctgctgaggttatgggcgagatatacttgttaagcggaagtaagtagtccagggacaattttttctgccacctaaagagttttgggctagaaaatctgaggactgatagtttttctgaagagttggggcagagtctaacctagctataggcgaatctggcttttaagtaaaaatcatctcaattttactgtctgcatttttcaaactaaatcagtgtctctttgctaagttcgtctattggcttgcaacaaaaactctaaacactgttaataccacttagttaagtacactaactgcactgcaggaaccaaatgagatggcaggtgataacacaggttaagtgtcctttatctgaaatacttgaaaccagaagggttccacagagtttagattttttcagattttgggacattcacacatacataataaggtatcttggggatgggacccaagtctaaacatgaaattcgtttatatttcacatacaccttatacacatagcctgaaggtaattttatagactatttttaatgattttatacaagaaacaaagttttgactgcaacttgtcacgtgatgtcaggtgtggaatttccacacttacggcatcatgtcagcactcaaagttttggattttggagcatctcagattgcggattagggatgctcaacctggaccataaatttagcatacttttccccttgagtgaagtctcctaggaaagcttgggcccaacagttattttgagtctctaagcaagagaatgcctgttaggtcctgtgagagtaagtgtggagattctgttagaaatgtttcaatgcttgcttagagatcctttgcctactttgtagtttagagatgctggaaactataagatgaagcctctggctagagcagctgattttgccaacttgggggccatctggggagcctttatgtatgtagacgaggtggtggggatggggggacttgcaatttgccaaccaagggacataacaaagcctcggcgatagacagcatttgtgagttacatcacatgttagaacttaatagttctcccacatgctgtgaataaacagggtttctattttatagactgcctctaatctttcattttcttaagaaagacttccccacatctgaggtattaactgatctgtatgttcactaagtaggttgcagattgatgttggtcatctttgtgcatcttctggaaaccacttaatgtacatctactgagtacctaccatatggcaccaggcatggggacagagtgaccatagcactggtggttccttcctttgtggcacttagtctagtaggggaatcaaagcaggaaacagccaaagaccgcttggaatagaagctctgaagaggagtgagcagatccagtgtttaagacttaatcataaaagaggcagatagcagctggagatttctggaatttccatatgctatctgggttctagcttatgaagtttccctaaaattaccaagaacttagactttaatttcaaaaagccagaaataattctatgtctgcagataatcctacaaaagtgatatgactaaagcaacaatggattactgccagtattaccaaagagcattaaaacatgtcagaagtaaaatctgcgtctgatatatcacactcaactttaccagttagccgctgctaaccttctcaggtgttggaacctctcttttcacatggaaatgaagccaacacacccaaagggacacactcattctgacagacaagtgtgtgaaaatgcactgtttttaaatgataaattgcaacaaagaggccgggcgcggtggctcaaacctataatcccagtgcttttggaggccgaggcaggcagatcacgaggtcaggagttcgagaccagcctggccaacatagtgaaagcccatctctactaaaaatacaaaaaaattagctgggtgtggtggtgcgagcctgtaatcccagctactcaggaggctgaggcaggagaatcgcttgaacccgggtggcagagatttcagtgagccgagataacgccactgcactccagcctgggctacagtgcgagaatccatctcaaaaaaaaaaaaaaaaaattgctacaaagatgaggtgaaggtaccctcataggcctagggaacagggacctttataacctagagtctttcaaagtattctagctagtaaaacaaccagtcacacttggtttcaagttctgaaaaagctgggggaaatgtttttgacaaaagtttttagttcagaccagctttattagtaaactaataaatcaactcatgcacccaagactaccaactagtgcctagagaatataggatgtcaggcaccaggtcctgagttacaaatgtgaactgcagcccatgccttaggggatctctgtgtctaaaggtgaaaaatggtagctgaactcatctccttgggtgatggctctgtgacagggactattatgagaaagcagccagaccatacctagtttttccaaaaaaggcattgaggcctcattcaagaatacaatctgagcccactcctggtgaatgggtggacaagggcaacatgaacaaactgagacaaagcagccatgaggaagggcaaagccatggggaagtgagtgggtcccctttgagctgttagctcagcccgtatagcagatggtgggtagtgaccaatagggaaaagtctgaggaaattagtagggaacttaatcctagagatagtggtaagccaagaaatgaccccattcttggctattctaggttgcttgaatcactaggttgcttgatatgggtagagaatgtggcagcctggaggcaaaggaacaagacatttaaattgacatcaggtgagaggagggcttgggcatagccagggattgatggccaaatgtcagggaagaatttgggctcatttctggagtactgatttagagtaagtaatggggccaatcaaagatagactacacagggagggaaggatggattttagaagaacctctgcctagtaagacacccaaataaattttttctgcaaaatagttttgagggctttactcacatgttactatcatgtgtattgtaaaagaggcatttatctcctgtgtccctcctgtgatgaacattaggccttatgagggtgttattggtatatgctacaaccctgaaaatgaaagagccacttacattatgggtagaagctgtagcttcttaaccttagtgcagtggttctcaaagtgtggaccgaaattggcaacattaattcaatgttaattgagttcatgtgtcaacattgactcattagaaatgcaaacttaggccctgttctagacctgctgaatcagaatccaggctggggcccagcattctgtgttttaacaagccttcctggggattctgatgcacacgggagcttgagaacgactgacttagtttaccactcacagaagctaacgattttcaaggtatatccgatggagggcctttcctctgacttgaaccctagacaagaaaaccaagagctataatccttttagaagacttgctgaggaattctagaaacatttttaaaaacttagaatgaggaaggaaagcaggcctccatctcaacaacaaggctaaatctaagttgatgcttagtaacacagtatctagagccagtgcctgggttcaactcctagctctgcccagggcaatctgggacaagtgactgtactttccttctctaccaggtttcctgatctgtaaaagaggaataatagggccaactgtgcaggattaagaattttaaaagctaagagatgtgaagtcttagagcagtgtttgaccaacaacaaaaacgattcgattatgtccatgattcttaagatcaatttgatgtaaatggaaattgaatgtaactgacaattgaactgtaaaattcacttatttccatgactcagaagaattagcctacatattcaccactttttagtggcccccaaactagtgtttttgttgctgtttgtttgtttgttttcgagatggagtttcactcttgttgcccaggctggagtgcaatggcactatctcggctcactgcaacttctacctcccaggttcaaacaattctcctgcatcagcctcccaaggagctgggattacaggtgtgtgtaatgcctggctaatttttgtatttttagcagacactgggtttcaccatgttgaccaggctggtcttgaacccctgacctcaggtgatctgcctgcctcagcctcccaaagtgctgggattacaggcatgagccaccgtgcctggcccaaactggttcttacaatgtttcagaggctgactttaaggccagagcacaatctttgtgcttgacagctcagaacatttcccttaacacctgttgtggtactttgcctcttacaaacccttctccccttaggaaaacttttttgctgactcagaaatttgcttgtcctgaaaggagttttagcttacaaatagaaacactgtcattaaagtggcaagcagtagaagtgaactagactaaaaataaatgcccttggtggccccagaagtgccaaaacaaatggacggaaggaattccagcaagtaacacccatatgctcaagcaatgagtaagggcatgagagatgtaaatgcttggccctggtggccccagcagtgtggcagcatgagcctctgtgcaggctgaagtacgctctgagcctggtacccagagacactttctctatattctgggcatgcatcttggagtgctcctgccagggtgctgctcggagccccatagggagatttgtagtccgtttggaaggcttggtatttactcgaaggcctatgcagttttttactgaagcttatgtattagtcctccatgtcaaccgctacagggaaaattagacaatggcggctgacttctatatgcattaaaaaccctgagtttccctctaggacattggtctagacaaggaatttatgaaaaagacctcaaaagcttaggccacaaaaacaaaatagacaaatgggacttaattaaactaaaaagcttctgcacagcaaaagaaataatcaacaaagtgaagaacaacctgccgaatgggagaaaatatttgcaaactattatctgacaggagactaatatccagaatatacaaactcaaacaatggggaaaaaataatcccattaaaaagtggagaaaggacatgaatagacatttctcaaaagaggacataaaaataaccaacagatacatgaaaaaatcgttaccattactaatcattagagaaatgcaaaccaaaaccaaaatgacatataatcttataccagtcagaatggctattaataaaaagacaaaatacaacagatgttgctgaggatatggagaaaagggaagtcttatacactgctggtgagaatgtaaactaatacagccaccaaggaaaacaatatgcagatttcccaaaaaactaaaactggaattaacatttgatccagcaatccctctactgggtatctacccaaaggaaaaatcagtatatccaagggatacctgcactggcatgtttattgcagcactattcacagtaacaaagatacagaatcaacctaaatgcccatcaataatgaaagggtaaagaaaatatggtacatatacacaatggaatactattcagccatgaaaatgaatgaaatcatgccatttgcagcagcatggggatggaattggaggtcattatgctaagggaaataagccaggcacagcaggacaaatatcttatgttctcaatcgtatgtggaagcttaaatatttcattccatggaggtagatggtagaaagatgacagagactcagaagtagggggaaagggagagcagatgaaaggaagtgggttaaagaatacaaacctacagtaaggtagaagaaataacgtcaatgactgtagttaacaaaaacgtgctcgcgtgatggacaccctaaatcctcggatttcatcagtatagattcattacatacatgtaacaaaattttacatgtacctcataaatttatacaaacaccaccaagaagaaccctgtttttcttggagccagtgaactgccaatgtgtctgtgtagcaaagttaactacttagagaagcaaggctcccaggaaaataggtccttgaagttagtgtgcatattctatagtctgattccatctatataagtgacagtaaaagtgagaattttttgacgctccaggaattcattcattacaaatttaaataggcacataagtgagtaggtacaagcgacttccaaccccctcacccaaaggagcagagatattctaaggattagagctggaagaaaacctagacaatttcttaatagaacccttttcaaattcttacaccaaaatccaatattcaaaagaaagtcttggtagaggcagaggtggaacacccagggcctctgctactgtggcctttccctccacttcaaccacccctctagcctgaggcattcttgtgaaacctcatggctttaaggaacccactaacaattgcattttgccccatcttctcacctgtctgagcagaaatgcctagcacttctacttccaaggtattttttgaggtgtcattggctttagtttagcctgaagaattaaaagaatctcgagtgtagatgatttcaagctcaacttgttccctttatgaaagtataatactgaatttgagacgtaactttcatggatggaaatagactgcaggtccacaatcctataatcccaaagctttggaaaccaaaagcctcttaactcatttggtgctttcagttctcctagagctctgcacagcagcagtcccagctgagcaccagaggtggataggtagaaccttttaaaaacttgaacagaaaacttaacagtgttccagtcaggtggctaagggctgggcattcgatttagtgtctgagctctccctctctgtgggaagcagagaattaaacagaactagggagcactttctgcccagtagcagtccctcaaaacaaagtgcttaggaaactaggaaacgaagaggcatagccataaagcttaaggtctttatttgcctgtctttaaagagtcctttataaagccagcttgtcttcccacccccaccccaatgtcattcttttaaacaggcagggacattttagtagcacactgtactcctaatgcctgttgctactccttattggagagagagagagagagagtgtgtgtgtgtgtgtgtgtgtgtgtgtgtgtgtgtgtggttgagagagagggagtaaaacacagctttatgatgatcaggcagaagcttgagtaaagtggaaatatctcggataagaaaagctagaaattaaactcctttttggcttcggatattttcttagtagaaaatgctgatgcctgtcctgagtctcctcaatatagactcttagagcagagctgctaggattttaatagaatttattactgttgatagcttgtatattacaactaaattcagagaccctctttaaggcaatagtagagtaaatatcagccttgggatactgtatgcccatacttaatcccaggccactctgagtgcctaggaaatctgtagcttcaaactcattcttaaggaggttgtcttccaggtaccttaaccctgaggtgggaaactatcaattgacattgacctttaagttgctattcaaatctgattacaaggtttccattttgattatgtagatatcaatgtcaatgttgttgtctcattttgacttaataacctttggtaactaaaaccttaaaaaaaaaatcagaggctttcagtctttactgtatcttaactccaacctgactattctttccaagtatatttatacctatgttctcagactacaaatcattcttttcctgattactcaaggtagagtcttaccactttcacagtccccaaaggtagtaaggtcatatagaactgcaagacacgtaccctcagcattgagaatattgcaaacatattaagaatccagtggcaatgaggggagaggggagaggcaccaggtacctcagatttggtttagcagtataaaacaacacaggtgatgcttcctgacaacaatctctaccctcctctagttccccttctaaatccctagtatattacaaccaataaaacgtgaagaatgaaaaagtattatgaaatgaaggtaggaaaccattctgctttgtagctgggtcctagcttaattagactcatgggagcagagtgatagatgcagttttaaaagcaacatatttaatatccaaggaagtaaccacacccatatggtcatcttgatttgggccaaattttaatctccctgggaagagccacaaagcacgaaatgctcccagacagcagggagtagctgacactagggagaccaactagggtattgtgcacgtaacacaagagttccagtctgtgcttgtctctgtaatatcagttcttatgccagcatgccacagctgcaaatgctgaaaggtggcaggaaatcggaaggccttctgctgggacaccctccctaagtaatctgcgtgaactatatgattccactgtttttctcaaatatttgcagtatatttgctttaagggccacatctgtgccttttatcgtgaagcaatcacatccgccagaaggacggaactgctaatgataggaagcacctgaacattagctggcctgtgccgggcaaaacaccaactgtcccacttagaagtcttagttcacaccattgtgtgaattaaatatccatacattaagcatagaaaaccagattcagagaaatcgaatctacatcttcagctccacctcactttcctttcctctcctctttaaatgacaaatgatcttcctttccctcttaactatactttcttgttgcttttatcttggagctgttttttaaagctgtgtttttccaattagacctcagtttctaagaggaggaatcatgtattaaatctctatttctaccctattcttgctgctccttctaaatcttcttcactgtgcttgtaatagaaacatcattaatggataatagtatggatgtggacaagaaatgccattaaaggattaggacttggctgattatagccacacacgtagtttcaacaaatgagagaaatgagtccacaggcagagatgatgccccttgtggtctctgggcaatctggattccttctattttcgtctggctccatttgcccgagatcactattccagccaccatgcccaattttcaggtaccaggaatgaagagatggaaagaaaatggatcctctatcctcttaaggacatttcccaaagttgtatataccattttagtttacattccattagtcagaatgtagccccttggctgcacctcactgagaaagaggcttgaaaatctagtatttagtcttagcatgcacccagctaagaacgcaattactgtcagtcactggctgaagagccatcctactctggcccttaggatgtcatagcctgccgagtctgcagtatccttctgagaaggtccccatccatgggtattaggtatcttgaatctataaccaatccttgctttaccgaatgttcccttcttattctagggagaaaagccaaatgtgaaccctcccaattccagtgcacaaatggtcgctgtattacgctgttgtggaaatgtgatggggatgaagactgtgttgacggcagtgatgaaaagaactgtggtaagtaaagagtttgatgacttatgcattttgttaaaatatgatgttatcttagtctgcaaatgtattgagattctgaaaataaaatccacttctaacaattgctttgaaagaatctatacttctctgtgtaaaggaataaaattgaatgtttgacgtggggttatcaacttgagaatggaatgataaggtgatgttccatttaaatgacaggacctagtttatcttagatcagacaaacgtggaataggaatctgggagaagggagaagaggaccagaaatagagacaaacagaagattgcttagaaggggcttttttccccttttaattttcaaatggctctgatcctagaaaagaaggcaagccatggacatgagaaaatcccataaagtttcagggggttaattaacccttgacatagaaactacaagccagcacagatcaaagatcagataaggattcttttttaattctctgcctacaatagttgctaattctaaagcattagcagggcggaagacattctctccccaagagaatggggatacagtgtcacagccatcaatcagcatctattaaaagatcactgtgagaaatgcctatgtatgcaatctatacaacctcatgtcaagccaaaatagctgagaactgcatggcaagattacatttacataccatgaatacatgctgaaatttgctctacgatccctttgttcagggttgtaaacattctgaaacaatattctatgtgaatattggtgctaacattgtcatttatcttttaaaagatgttatataaagatgttcactatacaaggtagaaatacagaagaaaagtagagtctaaatgtaggtttcatcaactgccatcttgttatgcctttacctacttcttcatgcatcattattaaaatgctgtaaagtatgcatcatggcagaccttgttctacacctgatctctcagagcagtatcacaggtgttttcatgccaatgtgtaaagcagatcagtagctcctttagaagcataagaaagtccattctaccatctcagggaagaaacttacatccagtctcaggaccaagaatagttctcctgtgcaacactttatcatcatttgcattttaacactaagattttaatctattccacaagacactgagtctcatgctatttctgggttacctaggtaatttagttctcttactaaatatctccttagagagtcctcactcttgtcaactattttcctgttgtaagttgcaattttttttcctctcttctaaacgatatatttggcaaaacccattgcttgttcttaaaaagtaattattctctttgtgttgcacaagtctttttttaccatgtgactcagtaggaactaacctgggtcaacttgggatttttctaaaatagtcttgtataagtactctctactagccacatggtaggagagtttggcaaagaaaaagaggtagatgtatatctaatcaagatcatttgaggcaggaaaaattatatccttagccaaaatttgtctctacttcctgtgtgtgacagtagagaaagaaagtagaaatattacaatcagggaaggtctgagtgcttactttgtttctctatggaagaggaaagctatagaattacttaaaacttccaaagctgcctcctatttttagtctaacctcttaatatggaacttggttacaatatttagcttagttctttatttccagtatgtcaatgggcatagtcaacttaaccttagattctattagccatgtgcttctgttggtcccattaactcattcttttataatgttaggctgagctaattaatcagcaacctaagtactctaaatatgtaactgctaattctcttcctctgtagcacatctaaattcctatttgtctctcaaggcccagttcacatatcctttctttaccctcccagtctatgctccaaatgaagagagagaaccatacggcaatttgtctgtctctgtttatcttttgctcaaacactgtggtatacagccaatctttcacatcctccttacgttttctaagacttaaaatcatggagggccgggtgcggtggctcacgcctataatcccagcactttgggcggcctaggcaggcgaatcacgaggtcaggagatcgagaccaccctggctaacacagtgaaaccccgtctccactaaaaatacaaaaaaatttagccggacatggtggcaggtgcctgtagtcccagctactcgggaggctgaggcaggagaatggcgtgaacccgggaggcggagcttgcagtgagccaagaccacgccactgcactccagcctgggtgacagagcgagactccatctcaaaaaaataaataaaaataaataaaaaatcaatcaatcaatcaatcatggggtctctttacagccattccgctactccctcttttgtagcttccaaagaatatcacaggttgaattatagcaactaaccctgcagaccctctgacttcttcctccatgctcaggagaacacagaccttgaatagcacttaattcattaacattagtgtttgagtttttcagtgattttagaaacaggcatgaatctaaagctagcatggccagtcttgtttccttggctgtgtaattcaaggagataatcctttatagatcatcataatttgtcaacccatcttgagttctagaaattaactgtaatcactgtctctctcctttacaatatcttactctcaaccagagtggtccaagggcacactctaagctctgagagttctacctgctttaaaccagtgatttgagaaacagtccctttcaaatgttcatcaaattgtgaatttttcacttatttaccttcacagaatatatgttatagaggaatgttttaaaatagaaattgggtagaaggtataagcatataggcaagaaagaatataatctaagaaagataagcttagggtatcctgtgtggctactttatatcaagattcatcctgctccgtgattccttcatgggtaggataatcaagctgcccgatttgcttaggacagtcctggtttatgcttatcttccagatataattaaaagtgtcccctttctgctgagactgtcccagtttggacaaaaaattgcatggtaaccctaagtataggggaaagacctgccccaggaagaattagcaacagaatcaattcctctccttaggctattttaacattagcaggcagttatggatattagcactgacagcttcaatgacttttagctggttgatgttagcctaccccttggctagaaaggctaaaatcttctctcccttgaattctaagtacaacatctcttgttacactgattgagttttctcccctttctacctgatgagtttctttgcccctgtagaccagtatgggtgacaatattcagtactggggtttggccttcattctccacactaaacacatgtgttgttaggggatgccccttgaacagtatattagtcagctcagactgctgtcacaaaaataccataagtgggtggctgaaacaacagaaatttatttctcatagttgtggaggctgagaagagacctgccagtagatctgatatcaggtgagggctgtctttctggtttgcagatgaccatcttctcactgtgtccttacatagtagataacaaagagagagagagtaagcgctctggtttctttttatgagggtgctaatcccattcatgggggctccaccctcatgacttaattacctcccagaggccctacctcctaataacatcatgttaggggttaggatttccacacgtgaattctgggtggagacaaacattcagtccccagcaagcagttctactatgatccagtcagaagatggaatgtttagctgttaaatgaagtacttgaatgacttggaagaaatgcatgtagaaaatgaaagtgttacttaatctcaacattataaaacaggcaggaagttaaatgtaaggtatctccgagttgtaagataatgggcaacctctgtctgaccttgacttcagtttcctccaagtctctcaaatgagcatcttcctcctctgaaaaaaaataataatttttctgaagtttcccctggatattggcagttgagtgcccattgactcagcttttttttagagcaaaacatgccaaaatgcagtatgagccctcatgtgaagctagggctgtgggtaaatgacttcaactttaacccttcaaataaacgtttgtagtaaagaagacgtgtgctgaatctgacttcgtgtgcaacaatggccagtgtgttcccagccgatggaagtgtgatggagatcctgactgcgaagatggttcagatgaaagcccagaacagtgccgtgagtgtaacttgctttggccttgaactttgccaagttgttcggtgtctaacatttctaagtattgcttaatctcctacttggtattcatttttctttgcctgccttaaagtttaggtcaattgactccaagggcagtcaaatcattaccagtttatcagcctcctttaaagaatgttctccctggtccaacaagactgacattctcttgggtagcttcactattgaatacttaaaactgaagtcagcagattcaatcaagaactccttgactaggtgcatagatttcaaatgtctgtttataataactgagcagatggtactctggtcctggaagctaagtcaagaagtgagggttccctatgggccaagcaaaagcttttagaagcacagcttatcatactattaaaaagctattactgaagaggtaaggtagctagtaattgggtgatatagtgactcctgacacacatgtaacctcaagttactaaaatggagatcttacagcatattcttaaataagagaaacttcataggtatgcaagtatatacctgtgtccttaggaaaaagtctatgagaccataaagaatgatggtttgggatcatataaattgagatcacacgaatgtcaaggcaaagaaagtcttagagtttgagtcagtagaggcctgcactggtagaaacactaaaaaaggactaacatgaacacagtttaggtctaaagtgtgattatgaaagaaaatcaaatagaaaggaagataaggctgttactttcaattttctagataagaagtgaggggagtaatattggtcaaggcaagtgagttcaaggcctgtgagctaaagacaggttgtgtaaagattcagcctcaacttttagtggagaatgacctggtcaagtcaagcattagggcatgcttctactttgcaagatgtcaatctaaaggacattgtgaaggaggcccataaaggaatctaggcaatagaagattttgtaggtgtttgaccatctgacttttcatgtatttgagattagatgacaatatctaggtgtgcccacttgacatccaacagataaatagtggtctaggagcaggccagccaataaacttcaccacgccaagtaaaacaaaagccagaactgagcacgccatgggaccttgaaggagtgacgtggtcaaagctgtcacgtacactgccaggtagcataggttggcacagcttctaaggagtggagctgatgaaagagctccccgggcttcagccagttagtagaatttcaccagtgtgccaggctactgagtcacaggtattagcgcttccaggcagcacaggagcagcagctttgcattgatcagttctgaggctcttttgagactgtatatcatcaacagatatgagaacatgccgcatacatgaaatcagctgtggcgcccattctactcagtgtatcccagtgtcctggagatgtgatggtgaaaatgattgtgacagtggagaagatgaagaaaactgtggtaagaagatcagtgttgagtgacgtaacccaaagacccttttcctaaaggaagggtgggcaggggaaactaatctaagcctgaagacgcactgacattgactcacttttcagtgacttcactatctgctcaattacttgtccttcataactgccctaaaaccctaaaagacattcatgtggcaattgaccatcgcttggtgtttcttttaggcaaatagaaataagaaggtaagtcattcaaggcacttatatatagaagtagctcagggaagcagcaattgtgtgggcttttgttttgacagtaattcatgtgtcttttgcactttggcacaataaaattagaaggtgagtagggttggcaaacacattcataggtctaaatttgattgggttattggaataaattatttgagtattatacaagcatttctttgcccatgaactagattctggcataactttcccagaaaaaaaaaaaaaaaagacacagaagcatgaattaacatcttgcctcagatacccaaagaaaagtctacccaactggtgatacctttgtctcctgttgcagttcctgtctctgaaagctaactctgcttcctattctttcatgtttctggtcttggaaaatctttaataaaatgctgcatgttgaaggtgagggcctgggaaaatcactaggttgaacaaacagtgctttgaatgttctttcaagctactgccctttttatagggcctctaaaacctacagctcccaagtctgacaagcatgggcctcctgatatggtagtagtcaagggagctcagggcacttacagttgaaacaccagtcttgtgtgtagaagtcgcctcctgaggtcaataccactgcacctagtccaatgagttttagtgttcaatcctagaattgggttttctgtattggtaagccctggtgctgccaagtgtttcccttataaatctagactttgcttcccaagagagtcgtggtctctattctaattgccaccaaattgtgaccttgaaacatttggcaggaatttaagtcaaagtaccaattggctagtaggactagcttatcattgtcagcatacctgattgttaaatggtgattatagccctggcagtgactttttcaaaatggaaagtgtttaagacttgttattcctgatccttatttaaaggaccaaaaagaggaaccatatatggtggtatgtggttcacctcttttggtgacaaagtcttaatgcttgttgtgagtattacgttgcatgatattctcaactagtgataagatctgacaagcagtatgttgattcaaggacaactcaatctctgccttccaaattgaaatcccttgttacagtttgttatttatgatggccacttttagaatcaattgtggttctcatctcaaattaatttccagtcttcaactattttcttggttctttatttctgttcttcttatttattgtgtgccttcattttttgtacaatgagactgtacaaaagttcttgatttaactccattgtagcctttaagttgggctagtaagttaggattaatgaataaagatcaatgtattagattttgggacaagaatcttgaacggaccaatcttgatgcattttcagtggggcatcctctctcttaataggcaatataacatgtagtcccgacgagttcacctgctccagtggccgctgcatctccaggaactttgtatgcaatggccaggatgactgcagcgatggcagtgatgagctggactgtgccccgccaacctgtggcgcccatgagttccagtgcagcacctcctcctgcatccccatcagctgggtatgcgacgatgatgcagactgctccgaccaatctgatgagtccctggagcagtgtggccgtcagccagtcatacacaccaagtgtccagccagcgaaatccagtgcggctctggcgagtgcatccataagaagtggcgatgtgatggggaccctgactgcaaggatggcagtgatgaggtcaactgtcgtaagtagctttctagcatggcatgttcagttctcttccctgtatcaactgggacaatttgctggcttcattccatggtgtttcctccctttgtagcctctcgaacttgccgacctgaccaatttgaatgtgaggatggcagctgcatccatggcagcaggcagtgtaatggtatccgagactgtgtcgatggttccgatgaagtcaactgcaaaaatggtaagggtttcttcttgttggttaagcaatggattgctctgaccagacccactcatggaatctctcttctttgtttctctttgtagtcaatcagtgcttgggccctggaaaattcaagtgcagaagtggagaatgcatagatatcagcaaagtatgtaaccaggagcaggactgcagggactggagtgatgagcccctgaaagagtgtcgtaagtgtacttgttgttcaagtacagatcctggaagtttgacacaatccagtatagctaacactgtgtggaccccccgtgatggctagttaaacttttgaatgtactgaagttcaattgtagacttcagagtgaaactttatgacttaaaagcccaggtaggacaaactagtttatagtttttgtttttgttgttttttttttttttttttttttgagatggagttccactcttgttgcccaggctggagtgcaatgatgcaatctcggctcactgcaacctctgcctcccgggttcaagcagttcttctgcctcagcctcctgagtagctgggactataggcgcccaccaccacgcccggctaatttttttttttttttttgtatttttagtagagacagggtttcaccatgttggccaggctggtctcgaactcctgacctcgtgatccacccgcctcggccttccaaagtgctgggattacaggcatgagccaccgcgcccggcccaaactagtttatagtttaacctccttaaagataactgatcatcaatagagaaacttgactaaatgcttgaccagctggtaacttgccgaggagttagataatccaccctgaaatatatacctataaaataaatgattaggtcttagacaaatcgtgggtttgaccaggccaactagataagttatcacaaatagcctgggttttaaatgtgaaagatattaattgaaaataagttgtcaagtgactactacatttttattccagatataaacgaatgcttggtaaataatggtggatgttctcatatctgcaaagacctagttataggctacgagtgtgactgtgcagctgggtttgaactgatagataggaaaacctgtggaggtgagtctaagaagaaaacctggaccctgcaggtgatgggaaaggatagtatgtacctagtaaggtataggagcagcaagactaattctgatttccctcccagatattgatgaatgccaaaatccaggaatctgcagtcaaatttgtatcaacttaaaaggcggttacaagtgtgaatgtagtcgtggctatcaaatggatcttgctactggcgtgtgcaaggcagtaggtaaatgaacttggactggtatggctgttgtacctttatgagtaagtgcctctaaaaggtacagccagtgactacaatagtcaaactaaacatgaaattgtacttgagaacaatgctgctaacctcataatacagcagtataggtcaaatagcagatctctcccctagatatgtaccttgatcattccttttgcatatgataccatgaatacctaccaggtttgcatgctctgtttccaaaacttgagtccaactcaaacaagtgacttattcatcactcaccctgttcttgaaggctgtaaccccacgactgccttcctaaactgtaggaagcacttgcaggtcccaggggcaggaactccagaacagatactactgaggtattccacaatacctttattttctaagtgctcctctgctgggaggaggtggtttagaaagaccttgccttcttaaagcaaaactaagtaacccagacttccatcttgcaggcaaagagccaagtctgatcttcactaatcgaagagacatcaggaagattggcttagagaggaaagaatatatccaactagttgaacagctaagaaacactgtggctctcgatgctgacattgctgcccagaaactattctgggccgatctaagccaaaaggctatcttcaggtaactttcagttccttttgtggtgtcttgacataagtcattgtcacttgggaagtgatctgtgggatagtttggaggagtttcttttgtgtctagccccatctagcatcgaattacctggggacattaaatctaatgctaattctttattaaactgttatcacttcctaattagaaactaacaattgtctatgaagtaaaagatgacatctttcatattttttatattttctcccttttctctacagttaattgagaactgttcattgttgctacaaatagaaatggtagtacagccttttcttaatgggaactatagaaactcagatgatggatactgaaacaaatagcttcacttagaaatttgttgttcttgtatatagaatacataccagcaactagataatctacagcattattaatttaggatcagtaagcagcatggttaaataatttgagtggtgagctgtggtgttaactggatttctttctgaacaaagtcattgaccattttgtaagcaaaaagtccattctccaagctctaattgtgtcaaactcttaaatttcttgtgacctattctgtttcagtgcctcaattgatgacaaggttggtagacatgttaaaatgatcgacaatgtctataatcctgcagccattgctgttgattgggtgtacaagaccatctactggactgatgcggcttctaagactatttcagtagctaccctagatggaaccaagaggaagttcctgtttaactctgacttgcgagagcctgcctccatagctgtggacccactgtctgggtttgtagtctgttttccatcacagactttggaatggtatctgtgtaggtcaggagctttctcatacctgaattagtactcaaatctcaaggtttatgagccttctgcaacaaagaattagaattctaatttaagatatcagttttgccccaggtgagtgaccctgggatgtccttatctatatgacaggtcctcctgtctgactctcgtatgactgattgctggctgacattaatgaattaacattcctgatttgatgtgtgtaccaaaagctgtatctgaacccttttgtccacccagtttctacgcaagtgattttttaatttttgactgaaagctttgctgggctagctctggatgatcaaacctaaacgacagcctgaattgtgaggatttgggtaaccacattgcatctaagtgtgcaagttgtctgaaagtccagcagaaataaacagacctttctagaaacatttcactaagggggttctgtaaattgccactaagtaacatagaagagcagctcaggaagttgactaaggctgtagttgtcatcacaactggcccccgtgcagcctcattagaactcagtcagccagccaacccctgctatgaaatttgaaggatgttcgtcttgcactcctctgtaagaactgaccttttaaaaaggaaacataaccttgtgactttgggccgaaatttaaatgtcagacaaacatagattattatagttaataatgagcttgtagattcttaatattcaattttatttacctagaacataatttagacccttaagtgttactatttgtcactagagaatgccttgagttttctgctcaaattttaaatttttgtttccagctactacaactttattccttctaaaccactgaggcttatttctcatttaatttttcacagctttgtttactggtcagactggggtgaaccagctaaaatagaaaaagcaggaatgaatggattcgatagacgtccactggtgacagcggatatccagtggcctaacggaattacacttggtatgtatgttcttccttctcgaccacccactcaactatcttcatagtgtttccatttatctccatggtgaattctggactagcagatgactctactgcttccgcctaaattctagcaggaattttcaatgggagtaactgaacaacacaagtaaaatggtggattaacaaattacacattccataattactggcctgttgtccagctgggcctaatatgtgacacaaattcagtgaacgttgggtcttgggtgcactcatactaaatattctgggcatgagtgccttagcatttcctgaattgcaggcttttaacagttttcttctggctttttggaggagaacaacaaaatggtagcctcttttaatattttctgtaatgtgagtaatatttcttaagtcatttgctttgagaatctcaggtaccctgttagtccccaaaaatgaacgtggatacaggctctgcatgctgcttcgcaaggtttatggtgaccccgttaagaaaccctgctggggaaagaaccgtgaaagtagattattaattcattagatatttttaatggaagccagagtagtagtggcttgtcatgtaatgacaattcttttcctacctagaccttataaaaagtcgcctctattggcttgattctaagttgcacatgttatccagcgtggacttgaatggccaagatcgtaggatagtactaaagtctctggagttcctagctcatcctcttgcactaacaatatttgaggtaagatgtgtctcacatcaaagtgtgtacctttgagctactatatcactttgagaagaaataacagacatagcgggaggagggaagagcagctgaacatggcttgagaaactgctttcacttaaaacctggtacaaatcagacactaagtcccagaagcactccacacctaaacttgattcttttacagttttatatccagtgtcccagttcagcattcagtaaacttagtccattaaatgagaagtaaatgatgatgaccttagaaatggacttgtgttaatcctggatgtacatgctaattgtgggcttctgttttaggatcgtgtctactggatagatggggaaaatgaagcagtctatggtgccaataaattcactggatcagagctagccactctagtcaacaacctgaatgatgcccaagacatcattgtctatcatgaacttgtacagccatcaggtaccgtggagaagcacagtccttaataactactttaagggaagcagcatgacacagaacctgctggatgtcagtagctcttggcaactcagttttctttaaaagggaacttttgccctcctgtaccctaccttaaacatttcacatgttatttttttatttctgctgcctcagagaaatggcttctcaacttcagctcctggctttcctcccaagcctcagtgtcagagcttttatttctgtttcattcatgtccccttggccttcagcccctcttgccaagactattgcagtagcctccaaagtagcttttgtgctacaagctttctctactgttagtttgctaggatttttgcaatgaagtaccacagactatcttaaacaacagaaatttattgtctcaaaactctggaggccagaagtttgaaatcaaggtgccaggagggttggtgcctcttgagggctgtgagggaagggtctgttccaggcctcttcttggtctgttgatggtgctcttccccctttgtctcttcacatcatcgtccctctgtatatgctcgtgtccagctttcttgctttctttctttttctgttttttggagactgactcttgctctgtcacccaggctggagtgcagtggcacaatctcggctcactgcaacctccgcctcctgtgttcaagcaattctcctgcctcagcctcccgagtagctgggactacaggagtgagccaccacgtccagctaaactttgtatctttagtagagatggggtttcaccatgttggccagactggtctcgaactcctgacccaaagtaatctgcctgcctcggcctcctaaagtgccggaattacaggcgtgagctgtaataacagtcatattggattagagcccaccttaatgacctcattttaacttgattacctctgtaaatatcctatcctcaatatctccaaataagatcacattctgaggtactaggacttcattatatgaattttagggaggaacaccattcaactcataacacctactttccccctgtgacacacctgatataggattgtgtagattctcaaacacatcgggttatattatctcctgctgaaaacacttggctggttctatctaaataaagccttcaaaccttcctaaggctgagtttccttccactttgttggagcaagtcaagagaaaaccaggagaacatgcctagtctcctttctctgagccttcacgctaaacctcgggcaaatagtgagagccagtcctggtccctcacctcccttccccacctcctcttttggcatctgtctcttaaaggcataacttttacagtctatctcgaagaggtcccttatctggtgtccttagagcatgctgcctgtacctgtatacttattcttccttgatactgttctcacttgaaggattagcagagtagacaagtttaagctcttgggggcaaggactcaggtcttcaacatgtagaacaaggctttatatatactaggcaccggaatacccattttaatggtattttttttcctgactaggtaaaaattggtgtgaagaagacatggagaatggaggatgtgaatacctatgcctgccagcaccacagattaatgatcactctccaaaatatacctgttcctgtcccagtgggtacaatgtagaggaaaatggccgagactgtcaaagtaaggcattttgtgtttcaaccacaagtagaacctacaacaagcaatataataagacacaagcttggatttttaagaattctgtcttagctaattctttgaatagatttgagaagatatctgctattgtatgccgggttatcatgtcatttctttagaactgactttaacccatttcaacattaaatgagtttataggagactaaagtgtcaacataccttacactaatttgtacctagtcccttaacagcactgagctagccaacttgcaggtaattaaatgaggccttaacatttttcctcaaaaggaggaggacagaaattatgcttaaggaaggccatggttacagaaacctcattgcctcagtgggtgacgctaccctaaaataacacttaggctgaatttgcatttagtcttctgttcttaacttttgattaagtggcaaattaaagtcatttgtgtgatcaaggagcttgtatggtgaggctgatgaggtttttattagcgtaattcatggtcaggcagggattagctcagtttaccaagaaattagttgcaagacagtctggtatgcctggtataccagagcatcttgagaacatttctcgtagtttccaggaacatgggatgttgtttagagggataaaatgtggttgtccatcattttgaattgtcaaattccaaacaccgactgtccttcccaaagtttcatgtatctcttttttgcatgaagattgctatttcaatgttgacacatcagctgtacaacttagttcagcagtggtttgtctattttacctggttttaaaataaccttttacatggcttgtctggacaaaacagctagccatgctggaaccctggcattaaccaggttcttggtttttataattcaggtactgcaactactgtgacttacagtgagacaaaagatacgaacacaacagaaatttcagcaactagtggactagttcctggaggtattgagttcagtactgcaaactgttaatctcaactaacagccacactctttgtatctacagcttaaataattaatgcagcctttaactactatttctgccccaattggtaacctatatttaaacaccaaagacttaaaacttgcatatcttttcctgactgatcttaaaggtttctagtagagaactgtcagtgaaatggctactacagcatgtgactcaaatacttctaagccagagttgttcctggtgttcaattgttgtagatactgaacatcaatattggatgcaaaggttttggctccttacctgatgggtaaatttctaagtctgaatacagatccttctaaactgattccttttattcctctgtagggatcaatgtgaccacagcagtatcagaggtcagtgttcccccaaaagggacttctgccgcatgggccattcttcctctctgtaagtagatttcctacaagtctgggttcaagaacttcttagataccagatgaagattttttgttcatctggagctacccctttcatgggcctttatgctgtctagcatttatgacactgaattacgttcgctttctcccccacataatacactaaattaaggcccatatctttctcttcagttgtacctttggcacagtaactggcaatgataagtgttcaacggttaatgctttctacttccgcactgttaacctggcttatccccttttataataagtctctttaactagtgtactgttctgttccccctttgaaatgtgtgtaatgcttcatacagaggagatgcacaaatgcttaaatgctaagagttacaggacttgttgaggataaattaaaagcagttaagaattttcaaacctatggaaaaggacctctaaacgagacacgcaaattctaaggactttgctataaaaacctttgtcctaaatgaagagacccaagcttagctaacacgccaggaccacctgaatagctctccagaaccttctgcaattttaatttggtgagcctaaggtgggaccgaggaccctgcccttgcctggatggatgtggctagtccagctccagtgcacagagctacctctgggctgaacttgtttcaagctcctggcccatgtgtattccaacttctagttatcctagctccataaaacatggcatttttactaatgtcaattattatggattcctgaacgttattacctttcttgtatgttccaatactagacttagctcacttagctaccctctgatttttttcagtgctcttagtgatggcagcagtaggtggctacttgatgtggcggaattggcaacacaagaacatgaaaagcatgaactttgacaatcctgtgtacttgaaaaccactgaagaggacctctccatagacattggtagacacagtgcttctgttggacacacgtacccagcagtaagtcagctttgtgtctttatacaccatggcttgaagtgagacttttcagaaaggagacctgggtgagagagagagagccattaggatgatggagttaccaaacacttcatctgctacctggctattagacagacagtatagcctgttagaacataagtcactcagttgatcagcatctaaccctcaccaactgacaagtgggtcaacttaaagtcaccactatattaagatatttttggttatagaaatgacatgtaaatactagcatgaaccaagtagctcattactgaactattaaatccattgcctactggatatttgaaagtaaattagcatatcatatataggggagttggcttaaagtcagtgtattgagtaagattcacttagccaaaattattatatgctttgctttaaaaaggtatcccaccgcccttagtatagctagcttttcttccagcaatagtcactcacttgttcttcagatgaaacccaagtggagtatttggccttcacgtaggaaacaggctgaacaaaacaagtattgatcactcccctctcaaactccggtgaaacatggaacagtggtcaattcttgacacacacatggcttttcacatttttccccaagacttatgatcattaagtagaaaagacagaattagtcacactatcttatctcactaccaagcaggtatagttgaattcaagttaaatgcatgaatgatacaactcagtattcttttgtatctgactgacttttcttctaagcactctgagtgtttgaatgaccaactcaaaagcaaggtccattttaaagactagagttgccatcagtgagtgatcaccaagctcattctatacttcttcttttccacagatatcagttgtaagcacagatgatgatctagcttgacttctgtgacaaatgttgacctttgaggtctaaacaaataatacccccgtcggaatggtaaccgagccagcagctgaagtctctttttcttcctctcggctggaagaacatcaagatacctttgcgtggatcaagcttgtgtacttgaccgtttttatattacttttgtaaatattcttgtccacattctacttcagctttggatgtggttaccgagtatctgtaacccttgaatttctagacagtattgccacctctggccaaatatgcactttccctagaaagccatattccagcagtgaaacttgtgctatagtgtataccacctgtacatacattgtataggccatctgtaaatatcccagagaacaatcactattcttaagcactttgaaaatatttctatgtaaattattgtaaactttttcaatggttgggacaatggcaataggacaaaacgggttactaagatgaaattgccaaaaaaatttataaactaattttgtacgtatgaatgatatctttgacctcaatggaggtttgcaaagactgagtgttcaaactactgtacattttttttcaagtgctaaaaaattaaaccaagcagcttaaccatggtttgtgcctgttcctctaggatgaactcctatcctgagtagtaccaagtgttctaactaaatgtgtgagctgtagttcttgatgttgtataactaagcctgtaattgggctggtttctcttacaccctagcacagttaaaaaatgaagtactgtttaacatttgctcccgaaatatttcttactgtgtaaaagaagctagcttagtctgtacctagaattcctcttggttagaggagtgagtttcttttttttccattaacttgtttcctgatcgagaaacacgtgctaagatttctatgaattctgcttctttatagttaagtctctgttttccatgttctgtcatttatataggtcaaggacaagtgccttctaaggcatggataagggctttcttcttatgaaagtctagactgtcttactgtgaagatggccagggaggatagcaagcaatggcattcttgaacagtctaaggcaggtttctcagtgtggtcctgagaacagaagcatctgcatcacctgggaatgtattagaaatgcaagttcccagccccatcccagacctactgaatcagaaactctgggggcgagggctgaaacctgctttcataagcccttcaggcgatactgatgtaaactaaagcttaaaaaccaccgttttactgtgacttcatgaagaatataattgcaatatcacctaaatttttatcctggctgggatggggcagattcttactatggacaatttctggaacttacagtatgaagagcagatgaggagtttgagacaaagaaaaaattgtacagggagtttagtgaattttccatcaggttggccattactttctttctctaaagtctcaggatgtctggaagcaaggaaagacaaaagacttgaagcaccgggtgcatgctgtgtgtcacaagtgaggtggagagttggctgtggaaggtacagcaattcctctggaattaaatgaccgaccaacacagtaccaagaggatgaagagaagatgttttgcgttgctacgtgaatcagtggatgactcatatttcacttgcatatgaaatataaggcagttaacatcttgtttgtggcttaagcaaggacattaatcctactagatgaaggggaagttggttctgttgtcttaagggatgcccccttgtgattttggtcaactgaatgaaaaagaaaagatagccttggacttttttttcatgggaggtttggaggtcaagcatgtagaaggaaaaggctgtagtcatgaatatagaactgtctgctctccaccttttcctcactctacatttagtcatcacactgaacaggatgtggcctgctgacagtgagtagctgaagtgcctgtttggtaagtaggttagcattcatcatgaactctgaaagccatttcagagtttggctgctgctctgaccctgctgtggtacaaaaaacatggatttttttttttttaactggagtaataccaaattccctttagaagcttgaagtttgatactattgctttccccattataaggattatacagtattaattaattataaggcccaaagtttgttttggcaaataaagtattattctctatcatcatcttttgaattcctgtccctagtatgttctttcatgttctgggtaaaatttccaaccctcaaagagtctaaaacgtctcatttttttttaccacgtcctccccagtaagaagccaaggtacaactcattgtacctacgaggtacaaactcatttgtagaaacaaagtaactagatattcctattgaaataagaatagatatattggtgggccaggcatggtggctcacgcctataatcccagcactttggaaggccaaggcaggaggatcacttgaggccaggagttcgagaccagcctgagcaacatggtgagaccctgtctctacaaaaaaaaaatttataaaaatgaaaaaaatagttatatgactaaactactagtca

SEQ ID NO: 15400 - DNA, 5434 bp, Human
cttcggtccaaagaacagctgtcatttggtgatctggaggtctgagctctgcctcaaaggaagtcatgaccctccttctttctaaaactccctgccccattttggctttcaaggccacacataatctgtcccctgcctacaatgtcagcctcattctcaccgctcattctctattctcttggtattctgctgctagttttgttgtttcattattaccaacagaggtctacacccatgtggtcctttcttcctgggagatcctctaaacatcctacaccttctttcctataacttcatctccgtaactcctacttttccatgacccttgtgaatctgggccatgttgtccaatctcagaagtatatttgtgttcagaggagcatagtccagaaccaaaatgtattttcaaaattactcaatcttttcaccgacacatgaaaccctgattctactgtcttcttccaatagaattattacaagggccaatcaactgatcaatccatgtgccagctgccattttttattccatacttcctgctgtcacaggaacaatgtttctaaaccgtcagtttcctctgtccatctccatttcgaatcttttcactcaactactctagacaaattacgaccccaaaacatgccgtctcattttgcgttggtcattttcttgatctggattgcccatctacccttttagcctgtccaaaccctaataatctttcataacttagttcaaatgcccactctttgataagcatttcaacagccgaccctgtcactttttcctctgttgtttctgctgtcctctcttatagggcttgcagtataatttacattactgttacttgtttatagatctgtttcttccactagagggagaattccttgaagtcgagggtttcttcttacttccttttgggtccatagcaaaatgatttgtacagtaggtactaattatctacttactgaatttaagttcatatgtcattttaatatttatatcgcattttcacatacatttacttattagtcatcccaatggatctatgagacatataatattatcgcaattttaagaggaaaaagtgaagctcacaaagttaaatgatgagtctaaagtggtacagcgtggaggtggccgatctagacttcaagccaggtctccaactccccttgtagttgtgaacgtctatgattccgtaattctgtttcaaattttatgccagaaaggagaggaaaatgattatttcattataatattgcagagaaaaaagactggcaaatgctcttccgttatatgcaagcttgtattatgccccattggaaatgaacattataaacattagcttcaacaatgtaacataacagcagcttcttttattagcattgtttaaacatttgggtaataagcaggaacacctcatcaaacatatgttctcagtcaaatatatatcctctatgcaaattgtatggagttatctttattaggtgttatttattcaaaaggcggaaggtgccaacgtgcagaaaataatgaacagactggactgtggaaaaatggcttaattatgtaggtcaagagtccttaaccagacaaccacaaaaaaatcactttacagaaagcattgggggagggggaactggcacagggatatgcatatattatctcctggcatattaaaataagacttgactaatgtaaaaccaccttatacaaagtccccaaaagaacagaaatcttttcctgtgggttgagagtgccaaaactggcacaatgaaggacatgttcaaggaggaagaacacggttttgctaatctgaaggtctttatttgaatctctctcatgtccgtcacttcctatctgggtgatccgggacaagttacttccttctgagcctcctcgttctctttgtggaatggggatgataataatattgaacttaccaaattgtttattattaagagtaactgataaaaatctacgtgacgctttttcctgggggcagcagccgggctgagaggagagtggctgtctactctctccgccatggcgtgtgtccgcccactgatgtcgctgtactccgaaaagggggagtcatctggcaaaaatgtcacttagcccgctgtattcaaggctcctattcgaccagacatcgtgaactttgttcacaccaacttgcgcaaaaacaacagacagccctacgctgccagtgaattagcaggtcatcggaccagcactgagtcttggggtactggcagagctgtggctcgaattcccagagttcgaggtggtgggactcaccgctccggccagggtgcttttggaaacatgtgtcgtggaggccgaaggtttgcaccaaccaaaacctggcgccgttggcatcgtagagtgaacacaacccaaaaacggtatgccatctgttctgccctggctgcctcagccctaccagcactggtcatgtctaaaggtcatcgtattgaggaagttcctgaacttcctttggtagtcgaagataaagttgaaggctacaggaagaccaaggaagctgttttgctccttaagaaacttaaagccaggaacgatatcaaaaaggtctatgcctctcagcgaatgagagctggcaaaggcaaaatgagaaaccgtcgccgtatccagcgcagggggcctgtgcatcatctataatgaggataatggtatcatcaaggccttcagaaacatccctggaattactctgcttaatgtaagcaagctgaacattttgaagcttgctcctggtgggcatgtgggacgtttctgcatttggactgaaagtgctttccggaagttagatgaattgtatggcacttggcgtaaagccgcttccctcaagagtaactacaatcttcccatgcacaagatgattaatacagatcttagcagaatcttgaaaagcccagagatccaaagagcctttcgggcaccaagcaagaagattcatcgcagagtcctaaagaagaacccactgaaaaacttgagaatcatgttgaagctaaacccatatgcaaagaccatgcgccggaacaccattcttcgccaggccaggaatcacaagctccggatggataaggcagctgctgctgcagcagcactagaagccaaaccagatgagaaggcggcggttgcaggcaagaagcctgtggtaggtaagaaaggaaagaaggctgctgttggtgtgaagaagcagaagaagcctctggtgggaaaaaaggcagcagctaccaagaaatcagcccctgaaaagaagcctgcagaaaagaaacctactgtagaggaaaagaagcctgctgcattaactcttaaatttgattattccataaaggtcaaatcattgtggacagcttcttttgaataaagacctgattatacaggcagtgagaaacaaacaaacaaacaaaaatctatgtgacaagaaaacttggaacatagtacgtactcaattactgaatattatcattacacttcctccactgacacatacgtctcttctaaacatgaatttttttgagaagctgtgacttatagaaaatttgggaggacgtattcaccctctatttctattccagattttacaattccctttctcaaacacctgtttaatttcattttcctggtgccttaagaacaaacatcctaatatctctagccacttcttttagattaggaacaatgacattcaaggtaatcagaaaggaggagacgggagaggtaaattccaaaggacataaaggaaatctatgtatcaacagacggcctttcgttctttccctcttcgcaattctttctgctcagcctaatttggatctaactggagcagtgtttctcaaatggaggtggtgatgttcccccagcgggtatttggcaatgactggagatatttttggttgtcccactggtaggtataactcgcatctagtagatggaggtcaggaatgctgctaaacatcctacagtggacaggaaagtgcccccatcaaaaaaaagttttctgatccaaaatgtcaatagtgtcaaggttaagagtcctaaactgaacaaattatgatcaaactagatatgcataaaagtaaaaggccctaatccaattcaaggattatttagtgagttttgctcttggtgttaagccccttactagctcctagagacaatgatccaagagatttagaagtaggagagaaatttggccattaggtctcaatactatgtggaaacctctttctccattcaagactgatctctctggagttaggttcacaagaattcttttgcaacaagatacagtagcagtttatgtcagacatagcttgtaaaaactgcaggttttagagagtaattaaaagaagtctttatatgcaaattaccagcttctcttagctagaagctatctctggatagagctgcctagaggaggaatttttaactttgttttaaacattaattgggaagttagctacttctgactaagaaataagtccaagaagtttagtttgagattgttgtgttgtttttgtggaggaaattgagaaatgcatattgccatattctaatcctcaatgctataatgtgatactttttcttttctttagcttcagttacttttttttggagaccgagtctcactgtctcacccaggctggagtgcagtggcttgatcccggttcactgcaacctctgcctcccaggttcaagtgattctcctgcctcagcctcctgagtagctgagattacaggcgtgtgccaccacgcccagttacatttttttaaaaaagttagtgaggggtgggaagtagaggagagctagagagctggtgggaagtctctattcccacaggcagctctttgggaagagaaagaggctaggaaagacttaatagtgagatgaacagcccaagctgtctgtcttaggttcctcggtctctcccggctttagaacacagcacccatgtgacaggtttggccagcaccactaaaaactagatcttggctggtggaaaatcttggagttaaagagtagggcctcacagccaacactaaaagttcaagttttttgaatgcccatgtttgttcatatagaatggacatcaaacagattgggcatagctggtcataaagtacattccagatttgtgttaggagagtattgggtatggagccttcaaagacctacagcatctacaaaagacacaaagaggcaaacaacaggtccttctcaaccaagcatggcactttaatgaggagctcaggggacccagttacaggggcctcaaagctgtggcaaatggactagacactatgtgctcatgtagatagctgaaaagccttgaaatcaaaatggtacataggtaagaggtgaactaaatccaggattaggatagatatgcatctacctagtattag

SEQ ID NO: 15401 - DNA, 26433 bp, Human
atgggatcgctgggtcaaatggtatttctggttctagatccctgaggaatcgccacactgtcttcaacaatggttgaactaatttacactcccaccaacagtgtaaaagcattctatttctccacatcctctccaacatctattatttctttttttttgaaacggagtctcactctgttgcccaggctgtggagtgcagtggcgcgatctcggcttattgcaagctctgcctcccgggttaacaccattctcctgcctcagtctcctgagtagctaggactataggcacctgccactacgcccagctaattttttttatttttagtagagacagggtttcaccgtgttagccaggatggtctcgatctcctgacctcatggtccgcccgccttggcctcccaaagtgctgggattacaggcgtgagccaccgcgcccggcctccaacatctattatttcctgacttttttttttttttttttttttttgagacagagtcttgcaccttcgccctggctggagtacagtggcgtgatcttggctcactgcaacctctgcctcccaggttcacgtgattctcctgcctcagcctcccgagtagctgggattacaggcacacaccaccacacctggctaattttttgtatttttagcagtgacagggtttcagtatgttggtgagactggtctggaactcctgaccttgtgatccgcccacctcggcctcccaaagtgctgggagtacaggtgtgagccaccatgcccagccctgtttcctgactttttaatgattgccattctaactggtgtgagatggtatctcattgcggttttgatttgcatttctcttttttttttttttttttttttgagatggagtctcactctgtcgcccaggctggagtgcagtggtgcaatccgggctcactgcaagctctgtctcccgggttcacgccattctcctgcctcagcctctcgagtagctgggattacaggcgcccactaccacgcctagctatttttttgtatttttagtagagatggggtttcaacatgttagccagaatggtcttgatctcctgacctcgtggtccacccgcctcagcctcccaaagtgctgggattacaggcgtgagccactgcgcccggcctgatttgcatttctctaatgaccagtgatgatgagctttttttcataggtttgttggccgaataaatgtcttcttttgagaattgtctgttcatatcctttacccactttttgatggggttgtttttttcttgtaaatttgtttaagttccttatagattctggatattagccctttgtcagatggatggattgcaaaagttttctctcattgtgtaggttgcccgttcactctgatgatagtttcttttgctgtgcagaagctctttagtttaattagatcccattgtcaattttggcttttgttgccactgcttttggtgttttagtcatgaagtctttgcccctgcctatgtcctaaatggtattgcctaggttttcttctagggtttttatggttttagatcttatgtttaagtctttaatccaccttgagttaatttttgtataaggtgtaaggaaggggtccagtttcagttttctgcatatggctagccagttttcccagcaccgtttattaaatagggaatcctttccccattgcctgtttcagtctatccaatttctagatttatttctcattgtctttgttgtaagatttgcacatttatcagagatttgggaattagtgtgctcctctctctgacttttgaaactggtaatagtttacttctgtagaaggggagcaggctagagactttgttttcctttagtacgccttcatactgtgactttttaaaaaattatatacttgtatgatttcacaaaagaaacctcaaaataatacactccaggaaaagtattttaaatagaaaaagtaacctctaacatctcggcttgtgttttctcccagtcgtttccacttgttccatgtgacacagaccagcctcaagacaagcccccagactggttcacaagctacctggagacggtgagtgttctgtctcgcttgggttttaactgcggtgttggcacaggtggaatgtggaagaaatagaaaactgaacccaggtggctgctgcctctagtaccggtgaagagtggtagcttataatttccaaacttagaacagttccagtcgagaaagctctaacctttgcagtgaagtgtcagaaaaagagggagtctaattctaagcatgtaagggagagggacaactctctgcttgagaaaaagttagaaatttacttatcaaaaggatgttttgatattttcttcgaaccagtttagctgtggaaggaatagaccttttgctatgtttctgtctattcagtagcagttgtttattgtgtttttgtattataccagagacagttaggtttcagatctattgatatcttcacatttttttctgatattggaactgagttttttccctaccttctgctccatattctagttcagagaacaagtggttaacgaaacggttgagaagcttgaacagaaattacatgaaaagcttgtcctccagaacccatccttgggttcttgtccctcagaagtctcaatgcctacttcagaagaaacattgtttttgccagaaaaccagttcagctggcatattgcttgcaacaactgccaaagaaggattgttggtgtccgctaccagtgtaggtaagcagttgcttgggagtagctagctagtgatagaccttacagcttttacctccctggctttctgtgtaggtaaagggaaattaattgtaccctgtttctgagcattagatgttgtagctgtgagttggaagcacaagctactcttcacccacatgctttgtatgttgtaactattcagattgttgtgttcaaatgtgcatttggattagcaaagccaggcaaaattatgttcccctgaacggacaaaattagatcactaagggtagttcctcggttgttccaaatgcctttttttttttttttttggtgacagggtctctgtcacccaggctggagtgcagggtgcaatcatggttcactgcagcctcaccctcccaggctcagacaatcctcccacttcagcctgccaagtagctgggatcacagactgccttttaattatttttttggagatggggtctccctatattgcccaggctagtctcaaactactggactcaaatgatcctcttctccatggcctcccaaagtgctgggattacagacatgagccactgtgcctggccccatgtactttcacatcttaccttcctcccatagattttcatttaaaatggatatgggttaagtgttattatcctcattttattaatgaggaaaattgaggcatggcatagtcagatggcatgctcaggttacctgctagttggtactggagcaaacatagaagtatggtcttatatctccctaccccaggtacttcctattctgccattgtgtattgtgccattctttccccacagcctatgcccatcctacaatatctgtgaagattgtgaagcagggccatatggccatgacactaaccacgtcctgctgaagttgcggagacctgttgtgggctcctctgaaccgttctgtcactcaaagtactctactcctcgtcttcctgctgctctggaacaagtcaggtaaaaccctctacatggagatgcttattctctgattgacttcttggttctggtgacagggtatgaatcacaaaactacagatagtctccttagttctgctcattttcaattgatgtgcaataatgaagacagttatccaaagttagtgaaatagaaataatagctataaaaagaaattaagaaactaaagtaggctgggcacaatggcccataactgttatctcagcaacttgaggggctaaggtgggaggagtgcttgaagccaaatatttgagaccagcctgggcaacatagcaagatcccgcctctacaaaaaaaatttaaaaattagccaggcgtggtggtgcgtacctatagtttcagctacttgggagtctgaggtgagcagattgcttgagcccaggaatatgaggtggaagggagccatgattagaccactgtactccagcctacatgacagagtgagaccctaattctaaaacaaaaaaagaaattaaactggaagctgacactgatggaaattgcaattggctccacatagcttcagaatttatttgtgactttcttttaagacttgcttttattatctcacaggctccagaaacaggttgataagaactttcttaaagcagaaaagcaaaggttgcgagctgagaagaaacaacgtaaagcagaggtcaaggaacttaaaaagcagcttaaactccataggaaaattcacctgtggaattcaatccatggactccagagccccaagtctcctttaggccgacctgagagcttgctccagtctaataccctgatgtaagcccaggactggggtgggagccaaaactttaggcccagctctctgaaactggaacttcaaccaatttccgtcttatttattggtagcccttaacacctaaatctttaaaactttccattatctggtcttagtattttttgtttgtttgttttttgagacagagtcttgctctgtcacccaggcggtagtgcagtggtgcgatctcggctcactgccagctctgctttcgggttcacgccattctcctgcctcagcctcctgagtagctgggactacaagcacccgccaccacgcctggctaattttttgtatttttagtagagatggggtttcaccgtgttagccaggatggtctcgatctcttgacctcgtgatccgcccgccttggactcccaaagtgttgggattacaggcatgagccacacagcacccggcttttttttttttttttttgagatggagtctcgctctgtcgcccaggctggagtgcagtggcatgatctaggctcactgcaacctctgcctcccgggttcaagtgattctcctgcctcagcctcctgagtagctaggattacaggtgcatgccaccatgcccggctaatttttgtattttttcagtagagatggggtttcatcctgttggtcaggctggtctcgaactcctgacctcatgaatccgcccgccttggcctcccaaaatggtgagataacaggtgtgagccactgcgcctgcctggcgtggtcttagtattattaaagggtggtttggtagttttttgtttgttttgtttttgagacggagtcttggagtctcgcctgttgcccaggctggagtgcagtggcgcgatctcggctcactgcaagctccacctcctgggttcacgccattctcctgcctcagcctcccgagtaactgggactacaggtgcccgccaccacacccagctaattttttgtattttttagtagaaacagggtttcaccgtgttagccaggatggtctcgatctcctgacctcgtgatctatctgccttggcctcccaaagtgctgggatgacaggcgtgagccaccgcgcctggccaagtttcgtagttatttttgacacttgttttgtttccttcttcagaaagatagaaaccactaaagttcaaaatggcggggtccctctcttcattggaggcaatctggaattgaagcaaaaggaacaaatgtgttaaaagcctgactctctaggtgttgtatttataggcccttttaattactcttaccatgacttttttagctcaggagtgagacctatcctctgttttgttttattgttttaagtttgtcagaaaatttattgtttctaatatgtggtcctatactagtaatatcagtattatttttaaggcaaatgggttagcacattttcaagagtcacagtcagactctcaagctagtgtgaggtattcagaagccttcacacccaacagcaagtgactaagcatctgaatttctgttcaggctccctttgcagccctgtacctccgttatgccaatgctcagtgcagcatttgtggatgagaatttgcctgatgggactcaccttcagccaggaaccaagtttatcaaacactggaggatgaaaaatacaggaaatgtaaagtggagtgcagacacaaaggtaatttttcccacaaaatgcaaagatgaggtgatttgaagtggcagagtgctcagctgacaagcttgctttctcttcttactgttcttttcagctcaagttcatgtggggaaacctgactttggcttccacagaaaagaaggatgttttggttccctgcctcaaggccggccatgtgggagttgtatctgtggagttcattgccccagccttggagggaacgtatacttcccattggcgtctttctcacaaaggccagcaatttgggcctcgggtctggtgcagtatcatagtagatcctttcccctccgaagagagccctgataacattgaaaagggcatgatcagctcaagcaaaactgatgatctcacctgccagcaagaggtgagcattgactgacaggctttggcctagtatccaaatcttagttagagaggagatggctaaaactaaaagaacccactcatagctggttgttttccagaaaccttgaaaggttagcatctccccccgccccaacacatctctatgctgatatttggcctcttccttagggtgtttgttttagcgtctttagggtcttgctgcatactgaatacttttgtacctctttgtgatgttgcatggtcagcctgttggctgcacaagggaaaaagggactcctggcctgggctggcctgtggaactgctgaactgatagctttactccttaacatccatctctcctgaaataccctgtgtatgttccctaaatactaatgaagtcttgccctggttgctacttagtgaacagttttttaatgcaatttctctgtattagtggggcagagtgtttactgcttaaagttatccaatgttaattttctggttttgactattatagttaatataagttatcgtcattaggggaagctggggaatgtgaattctctctgctgtttttacaactttttctataactgtaaaaatatatcaaaaacattgttttttaaaatatggaggtacagcagcgtttttatttttgggggcattgtcagcctgcctcttcagttctgttgaaggcctaaaatttgtctcaatggtttgtctctataggaaacttttcttctggctaaagaagaaagacagcttggtgaagtgactgagcagacagaagggacagcagcctgcatcccacagaaggcaaaaaatgttgccagtgagagggagctctacatcccatctgtggatcttctgactgcccaggtggaagattcagcactttgaagggcaagggacagagggagagagcacaggagagaaggtggtagagccataggcagtaatcaggaaatcagagatatgcccactttgatctagtcaggtatatttaatgggaaggagatcacccatggaagcaagtttgtaaactagatgtttcctctttgaattgggaactcaatcctgtacttccccacaaactccctttagttgcctcttcaccttggcctagctaattctccttcatacctgctgcattttctctttcctgctattgggttatttcaacatctaattcccatttaactcttcttgttttcacttgtctggggacaggcatgaatttgaacagagttgaatacgaaatgatgtggaaatggtctacaggtcccatcaagacatggctccagcatgcactccaaacagcctaacattgtctttttttataggacctgctgtcctttgagctgttggatataaacattgttcaagagttggagagagtgccccacaacacccctgtgggtaagaatgtcactcatttcatcttgttcgtcttactaataggcacaaaagtaccacagcctagacactggtagtgttttattctgaggaaatggcaaggatttctcccacagtaggatagtaaagcagcaatcatggatccgtttttcttctttcctgtcctttgtcaaaagtaacaacatgctgggcatggtggctcgtgtctataatcccagctctttgggaggccaaggcaggaggatcacttgaggccagggtttgagaccagcctgggcaacatggtgaaacccccatctctacaaaaattacttttaaaaattagctgggtgtggccaggcacggtggctcacgcctgtaatcccagcactttgggaggctgagacgggcagatcacctgaggtcgggagtttgagaccagcctgaccaacatggagaaaccccttctctactaaaaatacaaaattagctgggcatggtggcacatgcctgtaatccgaactactcgggaggctgaggcgggagaattgcttgaacccagaaggcggaggttgtggtgagctgagattgcaccattgcactccagccaggacaacaagagcaaaactccgtctcaaaaaaaaaaaaaaaaaaaattagcttggcatggtggcctgcacctgtggtcccagctaccagggagactgaagtgggagaatctcctgatcccaggaggcagaggctgcagtgagccaggattgtgccattgctctccagcctggatgacagagtgaaacccaatctcaaaaaacaaacaaaaaaaagaggctgggcacggtagctcacgcctgtaatcccagcactttgggaggccaaggctggtggatcacaaggtcagaagttcaagaccagcctggccaagatggtgaaaccccatctctactaaaaatacaaaaattagccaggcatggtggcaggtgcctgtaatcccagctactcgggaggctgaggcagagagttgcttgaacctgggaggcggaggttgcagtgagccgagattgtgccactgcattctagcctgggtgacagagcaagactgcatctcaaaaaaaaaaaaaaaagcaataaaacaagttcgtgcaaggcttttccactataaaggaatcctcttctcttttttccctctagatacttgtgtccttttgttcctttatgttcatggttttgtgtcttggccacagctttccaggctaaataactgtgattcttcctgcattgattgatctgagatattttgcttacttattggtctggagaaattttttgtaacagacctcaaagcatatcttggtttattttagccctgcgggaggcaagaagcctacaaactgctacttctggacactgactgttgatgatatgatgctttctcttgattgatggttctcctgtcttcattctccagatgtgactccctgcatgtctcctctgccacatgacagtcctttaatagagaagccaggcttggggcagatagaggaagagaatgaaggggcaggatttaaagcacttcctggtaagggattaaacatttgtaaagtatttgcatcctccctttccatatcataccctattttacagctatcccctactgaccctaccttagcatgtaaatgggcttgctttctgtagcatctcatgttttgaagtctcctcaccttcacatggcacagatagcagctattccttggtttagttttagcatgggtaatgactggtgaatgttcttcagcactttaaacaccaagtgcagacaaagtttagatagcagctattccttggtttagttttagcatgggtaatgactggtgaatgttcctcagcactttaaacacccagtgcagataaggttcgtgtgtctttcagattctatggtgtcagtaaagaggaaggctgagaacattgcttctgtggaggaagcagaagaagacctgagtgggacccagtttgtgtgtgagacagtaatccgatcccttaccttggatgctgccccagaccacaaccctccttgcagacagaagtccttgcagagtgagtgtccttgcatttcccctacctagcagggtggcacctgaattgtgactgccagacttgactagttagatgtgctcttcttcactgagactgaagggagagtgatcttagttagaagttctgatcttggcggggcgtggtggctcaagcctgtaatcccagcactttgggaggccaaggcaggcggatcacaaggtcaggagatcaagtccatcctggctaacatggtgaaatcccatctctactaaaaatacaaaaaattagcctggcgacgtggcgggtgcctgtagtcccagctactcgggaggctgaggcaggagaatggcatgaacccgggaggcggagcttgcagtgagccaagattgcgccactgcactctagcctgggcgacaaagcgagactccatctcaaaaaaaaaaaaagaaattctgatcttgtttgtgtctttagactctacgtatgctacctgactgttctaattagagcatcaggagtaaagaagccatcatactcatttctccatcttctcaggggcagaattacagctgcattccacagtggaatagcagccagttgtgctgcctggattctgcagtaaggaatcttcctgtaatttgacagagctccttagcagagacccctatgggtagctgagttgtctgctttctccaagggcagcagtcccagaaacagtggatagaagcaggagtaccaacaaagtttctcaaggttaaattctgctgtaataaatacctttataggccgggcacagtggctcacccttgtaatcctagcactttatgaggctgaggcgggtggatcacctgaggttgggagttcgagaccagcctgaccgacatggagaaaccccatctctactaaaaatactaaaaattagccaggtgtggtggctacatgccaaggattacatgcctgtaatcccaggtacttgggaggctgaggcaggagaatcactttaacccgggaggcgaaggctgtggttagccgagatggcgccattgcactccagcctggcaacaagagtgaaactccgtctcaaaaaaaaaaaaaggaataaatacctttataacagaaacttctaggtatcagatagatagaaccaatagcatatattttaagaagtatccaaaaattcaaatatactatgtcaaaataatattggagaatctctttattataatcaaatttgacctatatctttaaatattatttatcttacttttgtttaaagtatacatgtaaggccaggcgcagtggctcacgcctgtaatcccagcactttgtgaggccgaggcggacagatcacaagctcaggagtttgagaccagcctgaccaacatggagaaaccccatttctactaaaaatacaaaaattagctgggcgtggtagcgtgtgcctgtgatccagctactcaagacgctgaggcaggagaactgcttgaacccgggaagccaaggttgcagtgagctgagatcgcaccactgcactccagcctgggtgacagagcgagactccgtctaaaaaaaaaaaataataaagtgtacatgtggccaggtgcggtggctcatacctgtaatcccagcacgttgggaggccgaggtgggcggatcatgaggtcaggagatgaagactatcctggctaacacggtgaaaccccatctctactaaaaatacaaaaaataagctgggtgtggtggcgggcgcacctgtaatcccagctactcgggaggctgaggcaggagaatggcgtgaacctgggaggtgcagcttgcagtgagctgagatcatgctactgcacttcagcctgggcaacagagtgagactccatctcaaatcaatcagtcatgtatatctttatatttttttccacatgtgtgtacaaatacataacaaaaaggtctggaaagacagtaccaaaatgttcacagctgttattctgataggatttatgggtaattttttttttttttttgagataaggtctcactcgcccaggctaaagtgcgagtagcaagtttatggctcattgcagccacaacatcctggggtccccctacctctgtttcccaagcaactgggaccacagccacatgctaccacaatgagctaaatttttttttttttgtagagatgggatttcgccacgttgcccaggctggtcccaaacttctgagctcaagcagtctgcctgccttggcctcccaacgtgctgggattttaggcgtaagccaccacacctggcctgggtagctttttttttttttgggacacagtctctgtcacccaggctggagtgcagcagcgcggtctcggctgactgcaacctccgccttcccaggttcacaccattctcctgcctcagcctcccgagtagctggcactacaggcgcccgccaccatgcccgggtaatttttttgtatttttagtagagatggggtttcaccgtgttagccaggatggccttgatatcctgacctcatgatctgcccacgttggcctcccaaagtgctgggattacaagcgtgagccaccgtgcctggccctgggtagcttttttctatccttttttaccctctcaaacatgattggccagttttctcccatgactgcatcatctttgtaaagaagaggaggagatagacatataatcctgcaatactcatctcctaactttttctctttttatagcactgttagtgtatcagttttggtttaaactctactcagtatattaaccatcacataaaaaggaaaaaagggatggagctgcctccttttatgattcatagagcttcttggaaacctgagtgtttctgcctaccttgtttctgtgagctttgattctattttgttttgcatagtcttcaaacttagaatatggtcatagttccagaaccagcccttccctttagttcttccctctcctctggctttcataattctagcttatgatccacaaggctttaccaagtaaggatagtacttaggcctgcttttagcttccaccttaaaattggttgctttcatcctttagtgacatttgccttgcctgaaggaccacttggaaatgagaaggaggagattatccatatcgctgaggaagaagctgtcatggaggaggaggaggatgaggaggatgaggaggaggaggatgagctcaaagatgaagttcaaagtcagtcctctgcttcctcagaggattacatcatcatcctgcctgagtgctttgataccagccgccccctgggggattctatgtacagctctgcgctctcacagccaggcctggagcgaggtgctgaaggcaagcctggggttgaggctgggcaggaaccagctgaggctggggaaagactccctggaggggagaaccagccacaggagcacagcataagtgacatcctcacgacctcacagactctggaaacagtgcccctaatcccagaggtagtggagcttccaccgtcactgcccaggtaccactcacagccccctcagctggggtgttcttcagaggtgaaataaagagaggaatcgacctgatctcaaaacctgttttttcctcagtatggaaagagactattttccatagcaaagtctgaatttagatgaataaaagttgtatttcccagtatttgtggattctggatttaaagaaatatttgttttagttggccttaaattatctgagtatagtctgtctgcttatattttgattattgagagctggttgtgtttttttttttttttttttgagacagggtctcagtctgttgcccaggctggagtgcagtggcacaatcttggctcactgccacctctgcctctgaggctcaagcaatcttcccacctcagccccctgagtagctgggactataggcatgggccaccacacctagctaatttttgtatttattgtagaagcggggttttgccacgttgtccaggctggtcttgaactcctggccttaagcgatccaactgcctgggtctcccaaaatgctggaattacaggtgtgagccactatgcctggctgagagccagtttttaaacacaaacatccctggaccttccctccttgttttattgactcttcagtaaaggcagcaaaaactcaacccaaacagtcataattaggaagttaaatccattatgggaaaaaacactataaaaccaaactaattatttttaattctctggtgaatctatctgaatcattcttgtctcctaatagtagggaaaatgctggagccttgactataatgtaaaccattctccccaaaagctagacatttccgtttattgacaccacttgatgtaggtggggacatgaccagactgaagccaacatttctagcttgcctgtggctaaagaggaaaatggggtagaatgtagcccttatgatggaaccctaaatccagacatgtgatctggatcagaaatgtgaagcctctgtagagaatttggcactgctgtgctgtgtttactatttctccactgttgccataagtgccttttcaatttactttccatattgtgtctttctgaaaggagctctccttgtgtacatcatcatggttccccaggagtggatttaccagttaccataccagaagtttcttcagtccctgatcagatcagaggaggtaatgatcagcctaagctttttctctttttctctgctcctgtctaatggaaaccaggtataaatagcctctctctcttcgtgattcttggtggttttttgaaacttgcccttcacaggccaggcgtggtggctcacacctgtaatcccaacactttgggaggccaaggcaggcggatcatagggtcaggagttcgagaccagcctggccaacatagtgaaaccctgtctctactaaaaaatagcaaaaattaaccaggcatggtggcgggcacctgtaatcccagctacttgggaggctgaggcaggagaatcacatgaacctgggaggcggaggttggagtgagccgagatcgcaccattgctctccagcccgggcaacagtgcgagactccgtctgaaaaaaaaaaaaaaaaaacttgcccttcactctctccatgctcctcctgcatactctaatttctattctctggctgaatatattgttagacctcatagaggtagtggaaagaacacaggctttggagccaaacaatctaggttccagctccatctccccctttcctgactagcagttcagcaggtttctaatggctgtgagtctgttttcttactacaaaatatatcagtgtgttaggattatagagttgatttttctgattcaataaacaatcatcttgcattgcatttctggacagtttctccttatcacttaaactacccttaaaacttcccaaatactttaaaaaaaaaaaaaaaagacttcaaacactgtgatcagattgccacctgcctcaataatagccttgctgtgagttaggaaacagtaggtgcttatggatgctgcatctaaccaacagctcttttgcttttagagcccagaggctcatcaggacttgtaaacagcagacagaagagctatgaccactcaaggtaacaaccttgtgcagtctcttttttcagaagcaggtggatattcttgtattccttctgcttaaaagagcctctcacagtatgtacccatcttcagagagcagagaaggggagcctttgttccgtcttattcttgtttcttctaaaggctttgagcaacactgaacaaacggctaaagctgatgtttaagagtgttctgtttgggaggccgaggcgggtggatcatgaggtcaggagttcaagatcagcctggccaacatagcgaaaccccatgtctactaaaaatacaaaaattagccaggcatggtggcgggcacctgtaatcccagctactcaggaggctgaggtgggagaattgcttgaacccaggaggcggaggttgcagtgagctgagattgcaccattgcactccagcctggctgacaagtgaaacaacatcaaaaaaaaaaaagagtgttttatgtttcagacaaggaaatagtgtccacaaattacctcactcttagcactggggaaaaggtagaaaggttaagcccagtatacatttaaataattttttcttggacatacctggttctctgcttccactcatattaggccagtgtccagaaaatcacatttcctttgcaaggtgttttctctgagagaataattgagcagacaaactgttgatatccttgtgtgtcctcgatcacattaattttcagctaggagtgagagccatcatggttaccagagtggtgtgtttcctgcagtgcccctatcttgcttgcaccagtagagctgggccctccatcaaaccatgatctgtagctataaagctgataatgaaagcaattgtgttctctttttccatctaattttttctcttaaggaaatcttattccaaggattagagcccagattatcttgtaaaaaggtaatgatttgtgtttgtttggggagataatttggttttcctctgcaggcaccatcatgggagcagcattgctggaggactggtgaagggggctttgtctgttgctgcctctgcatacaaggccctgtttgctgggccaccagtcactgcacaggtcagtgtgtgtgttttattttcctgaatctcaactccatgtcaccagtgaaagtgatggcatctgtctgggttgaagagtaacatggcattgtggaaagggcataggctttagatttagtctttagttaacacacaacacaactctgccacttttttttttttttttgagacgaagtctcgctctgttgcccaggctggggtgcagtggcgcgatctcggctcactgcaagctccacctcctgggttcacaccattctcctgactcagcctcccgagtagctgggactacaggcgcctgccactacacccggctaattttttgtattttttagtagagacgatgtttcaccgtgttagccaggatggtctcaatctcgtgacttcatgatcttcccgcttcagcctcccaaagtgctgggattacaggtgtgagccaccgcacctggccaactctgccactttctaactatatgactttagccaagttacttaagggaagaaaagagaagaatgtattattgatgatctattaatattttctatagagagaagctattccaggtgttggcactatggcatgaataaaacaccagttcttggccgggtatggtggctcttacctgtaatcctagtactttgggaggccaaggtgggaggattgcttgagcccaggagtttgagaccagcctgggcaacatagtgagacccccatctctacaaaaaaatttaaaaattagataagtatggccggtacagtggctcacacctgtaatcccagcactttgggaggccgaggcaggccggatcacaaggtcaggagatcgagaccatcctggccaacatggtgaaaccctgtctctactaaaaatacaaaaattagctgggcgtggtggcaggcacctgtagtcccagctactcgggaggctgaggcaggagaattgcttgatccagggagtcagagcttgcagtgagccgagatggcaccacagcactccagcctggcgacagaacaagactccatcttaaaaaaaaaaaaaaaaaagtatgatggcatgcacctacagtcccagttacttgggaaactaaggtgggaggatcacttgagcaccggaggttgaggctgccgtagtgagccacaatggagccactgcactccagcttgggtgactgagcgagaccctgtctcaaaaaacaacaacaaaaaagacactgagtcttgcccagaaactatgggaaacaagtgaggtgcatggatacttaaagtacatagtaagatactatgctggccgggtgtggtggctcatgcctgtaatcccagcactttggaaggctgaggcgggcggatcgtgaggtcaggagttcgagaccatcctggccaacatgatgaaaccccgtctctactaaaaatacaaaaattagccaggcatggtgatgtgtgcctgtaatcccagctacttgggaggctgaggcaggagaatcacttgaacctgggaggtggaggttgcagtgagctgagattgtgctactgcactccagcctgggcaacagagtgagactccatctcaaaaaaaagaaagatactatgccagtgctatcagacagatgaaacacttcagcctggtgtgcccaagtaaggctttctggtagatgatgcctgaactgagtcctaaaggacggagtaaatgttcatcaggaaagagggagggaaagggtattgtagacagtgtagccagtaaaaaagacttggaaatgtgagcatggagtgtgaatccggtctaagaagaggagtaagacgaaaaaagactggctgggcttggtggctcacacctgtaatcccaacaggttgggaggccaaggctggtcgattatttgcgtccaggagttcaagaccagtttgggcaacagggcaaaaccctgtctctactaaaaacataaaaaattagctgggcatggtggtatacgcctgtggtcccagatactcaagaggccgaggtgggaagatcacttcagcccgggaggcagaggttgcagtgagctgagatcacaccactgaactccaatgtgggtgacagagtgagaccatgtctcaaaaaaaaaaaaaaaaaaaaggctgggtgtggtggctcacgcctgtaatctcaacactttgggaggctgaggcgggtggatcatgaggtcaggagttcgagaccagcctgacccacatggtgaaaccccatctctactaaaaatacaaaaattagctaggcgtggtgacgtgcctgtaatcccagctactcaggaggccgaggcaggagaatcgctttaacctgggaggcggatgttgcagtgagccgagattgcgccactgcacttcagcctgggtgacagagcgagactctgtctcaaaaaaaaaaaaaaagaaaaagaaaaacagaccaaatatgtaggcaggatgctgtgttatgaggtttggattttattttaaggctaattaataggaggagcaattgaagggttttaaggaagtgattgacatgatgagatctgtttttagtaagattaccggctacattgtagaggctggtagagccagtaaagaaatccagttgggcgtggtggctcatgcctgtaatcccagcactttgggaggccgaggcgggcagatcacgaggtcaggagttcaagaccagcctggccaatatggtgaaaccacatctctactaaaaatacaaaaattgccgggcgtggtggcacgtgcctgtagtcctagctactcgggagtctgaggcagaagaattgcttgaacctgggaagcagaggttgcagtgagctgaaatcatgccactgcactccagcctgggtgacagagcgagactccgtctcaaaaaaaaaaaaaggaaatccctaagagaatccatgtattggtggaaaggaagggtagaaaagataattaagagatggaaatggcataactttgagatgatgattaagtggctaaaaagaaggataggctgggcacggtggctcacatctgtaatttcagcactttgggaggccaaggtgggcagatcacttgagttcaggagtttgagaccagcctgggcaacatagtgaaaccttatctctacaaaaaatacaaagaaattagccggacttggtggcgcacacctgtagtcccagctacttggggggcttaggtgggagaatagcttgagccccagaggcagaggctgcagtgagctgaggtcatgccactgcactccagcctgggcaacaaagccagacactatcttggggtggaggggaaaaagtcaaggataaatcccaagtttctggcttagtaccattcattaagagcagaagaagagaactaggtcagttttgctggacagtgttgagtttgtggcatatccaggtaaaggtaaagatatccagagtgcagctggatatatagttgtccctcagtatctatgacggttggctccaggaccccctgtgggatactgaaatccatagatgcttaagtcccttatataaaatagtgtagtatttatatataacctaggcacatcttcttgcttgcttgtttagttttagttttttagatacagggtcttgctctgtcatccaggctggagtgcaataactagattgtagctcactgcagcctagaactcttggattcaagcaatcctctcacctcagcctcttgagtagcagggactacaggtgggcaccaccatgcctagctagttttttaaaaatctttttgaagagatggggtttcactgtgttgcctagggcaactaactcctggcctcaaaacaatcctcccacttcagcctcccaaattgctgggatgagaaacttgagccgctgcacccagcccatctcatatacttcatctctacattacttacaatacccaatacaatgtaaatgctatctgaatagttgttatacggtattcgggaataatgacaaaaaagtttgtacgtgttcctttttttctccccaaatattttcagtcctttggtgactgatccatagatgaggaacccacagataatggcaagccaacggtatccatccagatcacaggggagggatttggcctggtgatacatgcttgagagtcacttgcctacagattatagcagaagccatctgatggaatgagatgatccaggaataatggggaaagcaagaagcaacctttaaggatcagggaaaggaatactctgaaagaaagctgggaactaggaggaaaatgaagagagagagttctatgctggaacttaaggaagggtgttttaataagggggacatggtcaacggtgttagatgctacagagagatatgaactggtggtgaggaatttgagagtagaagtatgccacactttcaaatagacaggctacaacaggcagaagctaggatacataagacaagaggaagcatttttaaagttgggtgagactttagagatgggcaagccagcagtgaaagaggttaatgataaagatgagaagacagattggagatggagaaagatttctgaagtggtgagaggtaataagatacaatgcaaggtacattccattaacctgcaaaggaggatggataatctattctgaaataagaaggtagaatggaacagtggaatcaggtttggagggaaatgcttaacatgtttgcatactgttctcatctttacatactttttcaacaaccctgcaaagtaggaggtatgatatatcttcagttcataaaggaattgatagcacagttggtaagtaaatggaagattagggtttgagtctaagcctatctgcctcccaagttaataatctttctgctgcacagtttcagtatccccagtctgtgaaattgggataataacagaaccagaggccaggcgaggtggctcacatctataatcccagcattttgggagaccaaagttcaaggatcacttgggcccagaagttcaagaccagcctgggcaacatagggaaacctcatctctagtaaaaaatttaaaaatttgccgggcgtggtagcgcagaccagtggtcccagctatttggaaggctgaggcaggaggatcacttgagcccaggaggttgaggctgcaatgagctgtgttcacaccactgcacaccagcctggggaacagagtgacaccctgtctcaaaaaacaaacaaaacaacaacaacaacaaaacaagcgtttaaggatttaggaaggtaatgcttccaccacagggcttgaatgaatgaatgttaacttcctcttacctattcttgtttttttttttttgagatggagtctcgctctgtcacccaggctggagtgcaatggcgcgatctcggctcactgcaagctccacctcctgggttcacgccgttgtcctgcctcagcctcccgagtagctgggactacaggcgcctgccaccacgcctggctaattttttgtatttttagtagagatggggtttcactgtgttagccaggatggtctcaatctcctgacctcatgatccgcccgcctcagcctcccaaagtgctgggattacaggtgtgagccaccgcacccagcccctcttacctattcttttggaggagaaaaaatcaagaagccttcccaggttgtaatttcccaagctgttttttttgtccagctcctctgcatatctgacaaaatttcccatagcatctttcagtaacacttttatcttgctcatacttcccccatcatcacaattacacttatgttcacagggtctctggggcttgctgtcattccttcatctggccaaaaaatgcttcttcctgaaagccccgagtgaagcattctcctggttctaagtacagttcattagctccccggtttcccttttctcctccttcaagtacacagataactaatctaaaatagggccttcccagtccgaaccgttggtatcaagtacacaggagtgccatagccttgaatctaattacctagtactttgaataaatctggaaagactagtatgcttgcaagatgatacaaatgtataaaataaacatttaaattatacagaatttttttttttttttttgctttgcttgtctctacacagccaataatttctgaagatcagacagcagccctgatggcccatctctttgaaatgggattctgtgacaggcagctgaacctacggctgctgaagaaacacaattacaatatcctgcaggttgtgacagaacttcttcagttaaacaacaacgactggtacagccaacgctattgaggagtgaccttgtattaaataactgcctgctgctcagagatgatctttattctgtcattggggtatgggatagaagcccttgcttatttttaatctgatgaatctgtatagagcccatcgttgagttaccaagacaatacctgctacagtattttggggagcaaactaaagaccagaacttaaattttcactttagacattggatgaatagtatgaagacagtttttcagttgatttggataaaactattttagtgcattgacaagtgtaacttcaacttcatatagaaccatttttctttctgcttttattgaaactgagtatttttctttggctaatgtggattttttatggggatatctgttaattttcaggttttgaaagacattaacctcggaagttgtttttaagaattattctcataattcttattctcataatttctgtaatccacctcaagcttcatagttatttggcattgaaataacacccagagcatgatagaaatgttgttactcttcctctctcaaggagaaagtaattttcctgcaatacttaataattggcaccgttgctttctaaagactccatggtgcattcaagagtatccaacttcaagggaatctccgcatttcaatgaaaggaggaagagtgtgctgataaacctaccagcacctattgagcaatgtctattatagtaattttgcatacatttttatttaagggaaaaaatataggtattgtgaaatattttgctaatcttatagaaaaggaaaaaatcccgttatttaaagggaaaagtaaatttaacagttgccttttttcttaatgtcagggcagatcttattttacagtacagtgggggaaatagaaacatgtgaaaggcaaaaggcaggctcctaaattaatgtcagtgaagttcagggtgggcaaatgagtgtgtgtgaggtataggaaatgctgatgacttctttaatgcttgaagtccgttcacaggtatctagccctagaatgcctagaacaggaagaggcagctggtgttctgcaaaacttggacaggggcaaagttgctgaaaaagttttggtttaacccgaagataagtggaaaagagcttgtccatgaacccaggttctcactctgtttacagaagtgtgttgagtacagttggtgaaggaagaggtaacaaaaaatgctaaatattttatccatgaaaatgacttccagaaaaggaagaatatgaaccccagaccgaaggggaaaagatagttaatagtattatctaacctggttggtatttgtaatgaatggtgattttaattagtcattagccataatgatgtttatttacagtataactcctgaatgctacttaaataaaccaggattcaaactgcaagccagccaggccgttcattatttaaaacgttttaatcggggcttccgggtagaaggtggagcggcagggtgtaattgggttgatgggtgggacctgtcttgaccatcggagttttataatcgagggccaggagggcccgggttgctctcctggttatgtatgtacttgtacataaccacctaaagaatggtgaaataaatgttcttggaaattcctacccggactggctagtccttgcggaagcagcgtccgggccctcgggtaacgtttgaagagctggcagcgtctcaggctgctgcgtggcgaaggggcggaccgggggacgggggggtgggcccttaggggctggggcgggacttccctgggcactgagtcaaagcttgaggggagtgttcgctcccgcattttcgattccactctcttccgtttctgtcgctgcagtcgtccgcgggtaaggccctccctagaccctttatacctactttacctttcggaggtcaagacacctcctgttgccgcctcctcgcccaacacacaggcgccccccgcacgggtaccaagcttgactaacggcctctaggggtgtgtggtgggacttgaaatcctcccttaatgaagtcacaccttctccgtccgcttccacccggtcggcccatggcagagcccccatgtagcccaggaatcggcttggcccttcggggaggtcagcgtccttactatccccactctccagtgcggcacattcgttcccctaggactccggccggttgccggccccaggcggtgcttctccccaccaccgcccagctcagctcagcccagcccagcccactctgcccttagaggcccttctccccaaagacgcactccagaagtctcgccctcgtgcggctgaggagcctgggatcccagacctgaacaaggtgagcatccctatattttagcccagaaagatctgtgtggctcacttgccggcctcgttctgtcacacagagtccagatttagccttgagttttcctagtgaaagacagaccctggtatcactatgaccctcctcaggctttcttaccccgcctcagaaagcagtgaggtgtctgctttctcccagggcttctttagataggggtcttaaccacacctgtgaccagtctggcctcctctctccttgattcaaagaatctcttttctgccctatccaacttccttcccttaaactgaatgacagctcagcaacttttccagagaaaaattaaatgctctgacaatcacttatggaagttccttaaagtgaagtaacttctgcttttcttttgttttcccttttgtaggcagattggtctcttttaaaataatgaaaggagtcgaaatgcattgagacttctgagagtcccatgtgaccacccagtttttcacatcctatcttccttaggcttgagcttgcttaaactgtggtgaagctccttgccagtcttgagaacttcaaaccaaaattacatctggcgtcagtgctaacaagcttagcactgaactttggtcttttctcattagtgaaacccccgcccctgaagaatgggtaagacgttttcccagctgggctcttggcgggaggatgagaacaagtcaatcctgtcctccaaaccagccattggcagcaaggctgtcaactactccagcaccggtagcagcaagtctttttgttcctgtgtgccttgtgaaggaactgctgatgccagcttcgtgacttgtcccacctgccagggcagtggcaagattccccaaggtgagtggcccaaggctctggaaatagcctggaatccagggaaagttcttagcctgttggcctggggcagcccctctgagtctccttggatggggttagatctgctcccagctcttgacctcccagtctcaggctggccagggagatacttaactatccttgggttccctgcaaaaacctgccctccttccctggttgtattctccagccccttgtggga

SEQ ID NO: 15402 - DNA, 152070 bp, Human
tctcttaatctctctgggttttaggttcctcgtttacaaaataagaagaatagatgcattgtcttcagaggtccgtttctgaaattgaatatgattgaaggttttgggggaaaattagaagaagtcatgctgtgacaacagatgccaagaggggttaattttctccttgaaaaactgaatactctttcaaaaatttcttagttaaaaattaatgttcactatatttcatatagatttaaactatgatgcagtgcttttcttatgctaccaattaaacactgtttctcttgctccattcctccaggaaagaaaactagaaatctggtctttgctcaatagcaaggaaattcatatttcttttattgaatgcataagtagtaaaaggggatgtcaaggccaggaagccggagaaagcatacctgttagagtaaacaatggcaggtcaggcaaaactgagaaacgtggcatgtttaattgtgaatgagagaaagtacatgtctttgtttacaaatctcatttacatgatagtagtctccctcatctttcaactgtattaaatgttatggatttggggctatctttgtataagactataatcgaattttgattttagtaccatattataccatacacaaaattagttaacttgattctttggctaagtttagggcatatcagttggcttttggatatacgttaattgttttagatcaccaaatagtaagttttaaagttggaaaggaccttagaaatgatttactctatttatgcagccaaaagacacatgaaaaaatgctcatcatcactggcgatcagagaaatgcaaatcaaaaccacaatgagataccatctcacaccagttagaatggcaatcattaaaaagtcaggaaacagcaggtgctggagaggatgtggagaaataggaacacttttacactgttgatgggaccataaactagttcaaccattgtggaagtcagtgtggcgattcctcagggatctagaactagaaataccatttgacccagccatcccgttactgggtatatacccaaaggattataagtcatgctgctataaagacacacgaacacatatgtttactgcggcactattcacaacagcaaagactcggaaccaagccaaatgtccaacaatgatagactggattaagaaaatgtggcacatatacaccatggaatactatgcagccataaaaaatgatgagttaatgtcctttgtagggacacggatgaagctggaaaccatcattctcagcaaactattgcaaggacaaaaaaccaaacaccgcatgttctcactcataggtgggaattgaacaatgagaacacatggacacaggaaggagaacatcacacatcggggcctgttgtggggtggaggggaggggggaggcatagcattaggagatatacctaatgttaaatgacgagttaatgggtatagcacaccaacatggcacacgtatacatatgtaactaacctgcacattgtgcacatgtaccctaaaacaaagtataaaaaaaaaaaagaaatgatttactctaaattatattctggtgacatcctgacagcctataaaagtgtcaagaaagtagaattcatgacacttacatccaggtagggtttgtgttctgagaattaagaacattttgatataattttggatgatagtttataaagggatttaaacaatttataacaaatgagatagaaggtagctttcaatgaaatttaacctggatagtctcaggataagaggtgctaatgggaatttttttaaagaatgtggattagtaattatttataaagtggtcagaatgaccatacacatgcacggactgtcatggtagtatgttgggataagaggtatgagagttgaaagttagtttcagtataggattttaagaacaattgtaaggaagctagtcatgcaggagtgacattttaaactttaatttcattttaatctatttcagagaccatcatgcagacatcagagactgggtcggacacaggctcgacagtgaccttacaaacatctgtggctagtcaagcagcagtgcctacgcaggtggtacagcaagtaccagtacaacaacaggtaaggagctgctgctcttagaaaagatgctgttactttcattatgttggctgtccaacatacctgtatccaaaaattatttgaactttactgtcttgctatgataggcatacttcagtttttaggttcattcagcaaatgtttcttgagcatttcttggatgtgccaggttctttctgtgctaggctatagggatacaaaaatgaatactcaagttataatctgtattctcaaacagcctgtcttgactcctaaagcaagttattttttctgatatgaccactcaaagttttctccttctcttctctcctcattgtttatcacaactttctatttctttcatattgaaatgtcagcaatattatactttatttagttggctcacagtagtacttaataggatgcatgcaccttccaggcagggattttgcctttgtggtattttagaaagtgcctttgcattaggtggttgataaatactgttgaatgaaaatagaataatcttcaaggtctggagatctgactcaagctatttaaaaagttgggagtgaattcatcatcagatatttactacaggtcttattcatacgcagggcagttggcttgtttggaaagatactgacaaagtaatgctgttcatgtatgtggattgtgaacacactggcctgtgatttcttctaaagagtggtgagaacataagtgagaaagatcatatgtcatataacattatcttgagattcaagatttgcctataatttcttagtattaaagagactctttagcaaacgttgctcttacaattataaataagtggttagggagaaggatatagatgggttatagatgatgaaggacatttttataattgatagatgcaaggttatattctttacaggatatagaattgggttgggcagggggtgtgctgcaatcgtacagaagtcattggcttttaggataagtaaagacatctgagataatcgtcttgtgtttgttttgttttgttttttgagacgggagtctcgctgtctcccaggctgcagtgcagtggcatcatctcggctcaccgcaagctctgcctcccgggttcacaccattctcctgcctcagcctccagaatagctgggactacaggtgcctgccaccacgcctggctaattttttgtatttttagtagagacggggtttcaccatgttagccaggatggtctcgatctcctgacctcgtgatccgcccacctcgacctcccaaagtgctgggattacaggcatgagctactgtgcccggccattttgtgtttattttttaaacatttttaaaaaaatcttagcatactctgccatatacacatatacaactttcccatccctcaagctaccagtttattagattgaactatatatagttttgatctacaaaaagtgttacatgtttcaatctattgcttatgttccttttatttcttttaagcatattctctcttttttagaattgtagatccagagcatacatatgcaggtttgctttatggctaaattacataatggtggggtttgggcttctagggtacccattacccaaatagtgaacattgtacccaataggtaatttttcaacacttatccccttcccaccctctctccttttagagtccccagtatctcttattgtcatctttatgttcatgtgtaccaattgtttagcgcccactttattggttatgtttttatctttttatatatattttttaaccattaaaaatgaatcttcacaatggtgatttaaaaggctctgttattattaatgccatcaccaattttaagactctgaaccttattgagaaagggatagcttttgtcatgtcatctgaagagcaagtaaagaacaattcagacattgttataactaactttaaaaagataacagttatctttttaaaggcaatgttgaacatttaactcactctggttttcatctctgtagaagaatggttttgagagagtgcctatcactaacaagagtgtgatggaaatagtgttcctatctctggaaggtgccttctgtaaacatgaaaaaaaagttttctttttattgaatttacatattatcaaatatttacaccaggtcttaatagggtatataatagtataaagactcaaaaaacttagcaaggtctgttattttaaaaaaatggcctttaacctcccccattctcccacaaaccactcctcataggcaactacattgacctctttaaacctgttattctgatatttacctccatttatttaaatatagtatacttattttactgcaccttgattttttagttttaagcattttaaacattaccttagcatgcccttcttttggtccctaacacaacacacacacaccctggcccacccacccgcccacccacccttcctgtcccttatgttcttgacagattgaaccatatgtgtttttttaggtacaaaaacaataatttcatgtctcaacctataagttatattttaatttcagtaaattcagtaaattcagtgcttatattaccatgatatataaatgcttttcaaatccagccttgtagtaaacagtgattaccttcctttcctgtaaaactcatttatttttcttagatttaatgactgtgtttcttctagtttgcaggattgccatggacaagccaaacaccaatctgatttctgatcttttttatgtggtttatgtgatttttttttctctgaaactttgtagaatatttgaaattccagttttatgaactttatgatgatgtgcattgatgcaggcctattttcaaatactgtactagaaacttcatgggccatttcagtctggacattcatgctttttcatttctgggaaactttattcagttttttcatttatgattacctccccctctgttttcttgtttttttcactttccggactttttttgttctattttcaatttcattgttcaggccttatattatttttaatttctatcactttttttttaattttcaggaatttttaaaaaattcctatgtgttccttttcgtaatatcatgttttaattcatggttttcttttacctttctgaagatattaatttttttttaacttgttgaaattttttttctctttacatagtctgtttcttttaaggtactctgttctgttttgttttgttttttactatgtctctgtctttcatgttaaaagcttttctctgatgtctgacaatctgtgggtgtttatccatattttaaaatgtggatataagacgctgatttgaatgcatgagtgagtcttgttgacttcaaaatggggtcatctgactgacaaggctttttaattaagaaccctctgatgttcagtatctttgtttgccctctttggctggtcaatttttttaagaagacttgtccaacttcctgcctagtgggggaatgcttggctgcctgggagctgagttggggaaagagttgggtatttattgcacgaatttaattaatctttctcttttttcatgtggtattacccatgcttggtattcctcaatgaagagattaagccaaagaacaaacctccaaacattttactaaagttagggaaagccagttaccttactgcgtaggggttggtagagggaacctgattgcttcttaagtagaatcacattttatattaaatacatatattaaaaacaaaaattggattgctgtcagaagtggaaaatcagtgtcactagccataaatagaagattatacatacacaccctcaccacccccaacacttcattcttgacctcataaaaaataatcttgtgtacacctggaccacactttggaaaaaacattgtactgtgccatatggctcactcccaacaggcatatttttcatttcctcaagttagctttttcttctgggacattcaaggcaggtgataccttatattcctttacaccgagcaaagaaggtgagaacactcattttctttttgtcaacaaagtgttttatttcacgcagttttttgttgtgatatttgcctggagacccttgttatgttgtcctcccagacttatttagaagcatgtttttcttctttgtcgttatttttctttttttttcttaagtagaatagtgtcatgtttgaagctccccagtatattccagtggtgtccccgtggatataaattgtctataactgataagattcatgctataattcctattcctctgacatgcctataatgtttgaattgttaatgtgctgctattatcttgggtttgcaaactatagtaaaatgcctttaaaagtttccagcttttgttactgacccataatggatatagaaatcatgatattgatgtcaaaggtagttacttctgttgattcaacttttcattgtaactttgctttgttgattttgacataaagagaaagtttatagctaatttttaaaattttgaggcattcaatattatatataggttggtgcaaaagtaattgcggtttttgccattaatttaatttttgcaccaacctaatatactagaatgatgagtgtattagtccattttcatgctagtaataaagacatacatgagactgggtaatttatacaggaaaaagcatttaagggacttacagttcatgtggctggggaggcctcacaatcatggcagaaggcaagggggaacaagtcatgtcttacacggatggcagcaggtaaagagagagagcttgtgcagggaaactcccatttttaaaaccatcagatctcataagaattactgactatcacgagaccagcacagaaaagacctgccctcatgagtcagttgcctcccaccgggttcctcccacaacaatgtgggaattgtgggaattacaattcaagatgaggcttgggtggggacatagcaattccccacaagtttgctccagttcccaacaagtttctcatctccatctgagaccacttcagcctggatttcatagtccgtatcattatcaccattttggtcaaagccattcaacaagtctctagggagttccaaactttctcacaattttctgacttcttctgagttctccgaactgttccaacctctgcctgttatccagttcacttctacatttttgggtatcttttacactttgacattttggggtatcttttcaacagtgccccactttactggtaccaatttactgtaccaccccaacatgattcaatcacctaccacagggttgctcccaagacatgtgggaattgtgggagttataattcaagatgaaatttgggtgaggacacaggcaaaccatatcaatgagaaaccagaaaatttcaggattgcagtattatacacttcttctgtttcttcaaagccataaggcttctaatttcaccgtgtagtaagtaccgaataaaacaattctaaaattgtttttatgattttttgtttattttatatgacctcaagtatccatttgtcacactttcttagacaatatggttcagggatagagaattctgaacaaagaatagcaagatcttactatgtacagggcgaatattacttacctgaaatgcctgggaacagaagtacttttgctttggaacttttttcagtttgtggtatatttgcatatacataatgagagatcttgggggtgggacccagcattaaacatgaaatatatgtttttttatatataccttatacacatagcctgaaggtgagtttatacaatattttaagtaattttgtgcaggctattacttgaggtcgggtgtggaattttcttcttgtggtgtcatactggcactcaaaaagtttagaattttggagcatttcagcatttggattttcagattagggatactcaatctgaaatgctatatgaaatttcctgtcttttcatgatctcacaaaacatcatagagtcttatttccaaatatagacattgttgcccaattcaataaaattgataaaaatatctaagtatcttgattagaaactcaaattttgatattacccatcctatcatctttataaagactttttggaccaatgggtctctatagaatatgactagaaatggattgctccttctcctcatccttcatccttgaatgatttggtaaagagtttcttgtagattattctttgtttttcattttatgcctcaacctaggaggtcgtctaacccctgcttgtcctagaactgagttaaacatccaggagaaagacaaaggaaaatgtcttcctactattccatggccagccagattagttttcttttcaaggtagaactttgacagaagtcagaactttcattctttattataatcttgggctccaggtattccacaaatactgctaacattgaggataatttctaagccatcttgaccatggctctaagatttttttcctcccttttaagtttttcagttttaactgcctttgcaactgtagtcctcctctctactatctctgtctgtcttacctctttcttggagaagagcacaaatctttttctctcaaaatgagtaaatgtattgtctctatattgtttcttctaaatgtaacacatgaggtatagtggagccctggggttcagggacttctattgagttcaaagcaagattttctttttttcaaagaagctttcaattttgctgaaatttttttatgattagaaattgtagtctttaccttttcctgctaagggactcagagagtttgtttctggtagatttttggtttgtaattgggatatttgaaacccctttgtatgccataaaagctcctttcaagactatattcaggaaagaacatttgtttttttctataaattgcctagatagactagagaaggacactttgttcataatctgagtcattaaaaggaatagaatagctagttggctatattggtttctttttggttagtatcagcctatcacacatttagcctttccacataaaatatggtatatcctgcaaactgagcatattatccttgtggtcaaaaagataaaagacattttctttggggaacaaatctaaccagagttgtaaattaggttgcaggagaagggcaatcttcaagtaaggtaagatttaaatgaatagtctccattagatctctttattttgggtatctacaaaatgatctgttaatctttaggaaatagattttagtaatttaagtgtaatatgaatacttcttagatcctcacatttcttagaccgtagtttcaatactgggtcatttccatcttcacttctgtttgccatattctgagtagtatgtcgttacaaccagtaagaaaccctgataattagaattataccgatgataaagtttattgtcattaaagcaatcagtagtgatttttaaaaattgcctatagtttgttaaattcataatagagtattctgttggatcaaattttgatcaaaagtatcttaaatgaatttgttagtttggggagctatgcccaagatagtgcactccatcattcttgtctttatctttcttttctgttcagggtcaagaggtttgctttctgtgaatcctagcattgatggacatgaatagaattcttttcatttgagaccattatttcatataatcagctgaaacaaaggcatttttctccggtttgctcttacttgggacttgattcccattggcttggttccctgaggggggacagtgttctcataattaagactgtggcagacatcctgaaagattgagttatattttaaaatgaattccaaatgaatgtctttttgaaaaaaaaaaagacaatgattttagctcttggagagatttatttttagaaccagaactgcaaaatattggtatccagtataaagaagtaaggtgttttggaggaccatgctgatttacaatggaaataagtcttgctgtgccaatccaatattaaggcccttttgttgaccatctctactgaatagttaaaaaatgagagctctactatttaagtagttgagtaatagtatgctttgattctctattaagtaattaaaaaaatttttttttatccagagttagatcattgtgatcagttctagataccatgttctaagaggaatgtgccaggcactatgttaaatgctggggtttctaagaaaatttgacatggtatttgatgggtaggaagccagcttttgaagaaaatacaagtttgatggaatttgatacaaagtgcttaggagcaaagatggaagattgtctttgggagtgagggtcaataatgtgacaccaaagatgtgacccttgagctgcatgctgaaggaaaagttggaattcacaagaaaaacaaactggaagagggtatctctggtaaaggaaagcatgaaagatttcaagtgaaataaggcaatctgtgaaggtgactggggagaggaacctgggaagtgagggatatggaacagtgttgcacaagagcctctttgcagaaggttgaatcagatgactcatttgtgataccttcatatgtgtcccctccctagcattttcattttcttcctactcagttgacttatttcattaggtattccccgactgccaattttcctgataagagacatatgtacttgtctactacatttcctttttgtatgttcagttcttaatcctatgaaatttggattctccccatccaacttgaaactgtgcacttctggacaagctaaatccaacattattttctaggatctttctggatttttctttgacacttgatactattgactattatctcttttttcttccgtggcttctgggcttcctcttgtatttctttgaggactacttcataaagggaagcagattttgtggaaattgagtgggctttattgttggaaggcataaattcaaatcctggctctagtcctttctacttatatgactgggcaacttattggctttttctgaaactcagttttctcttctataaaataattgtaacaatgtcttgctcatttatagctaaaaatattaaataatacttctgctaaaatatttaggttagtacctgattataataagcctttaatatgtttattattttttactattattattttcattgttattattaatagtagtaatagtagtagaattcatgatcttctaaaaaaaaatttggagtttttaaactccttttcttgtaacattggcttttggccactttctctttgttctcactttcaagtaacttatcctctgtagctattttagaaaccagtgctgctttcattttctttactagtcaagaacttttgttcctccttccttgtattggactggattatgagtcagggaggctcagactctagatcagaaccaacaccaacttcctctgatctgcagaggtggtggtggtgtctttcactttgaataggcacccagtgtagtcatcagtcgtttgaaaaaatgccagacaatttctcaataaagatacctccatcattttatctacctcataaaatataatagttttggatcaagtgtggcattgtgataggatataagactttaggaaattagggtggaaataatatattattatcttagatgaccttattggaatttgagtttctagttagaaaaggcttaaactattcctttagtgcaactattcccaaggacgtcccagagttgaattgcaaggagttttcttttcttttcttttcttttctttttttttttttttttaagacaggctggagtgcaatggtgcaatcttggctcactgcaacctctgcctcctgggttcaagtgattctcctgcctcagcctcttgagtagctgggattacaggcgcacactgccatgccaagctaaattttgtacttttagtagagacggggtttcaccatgttggccaggctagtcttgaactcaccttaggtgatctacccgtctcagcctccgaaagttctcagattataggtgtgagccactgcacccggccaagagttttcttcttcaacagatcacttactgtataagactatgtatagacttactttagttgattccatagttttgttcttagagacatacaatttctttcctattaatatctaatttgcctatcaaactatcaattttagcattagttctttttttgctgggaaaattcaatgtgtcctataaaatgttttacatgagtagaaaatagaaaactttaggataactggcacctgtacttacatataatttgaacagtttgcaacataatttaaacagagcacctacccttttgccatagcaaattagaagaattatttatgtgtgctaaaaatacaccctcattctaatagatctcaatgtatagctgagtctgtttgtcatcagtgtgtcaaagaaaggtaaactttaaggtccaaatcaaaattgtcatttatagtatgagctggtcaaggaagtttccccagagggactgacttttaagctaagatttgaggaatagaggtaacagtgagggaataaaaggaagtgtttattcagggaagtgagtgtatgaagacctggcacgagagaggagctggtgggtttgtggagttgaaacagagtctatatggctgggggagagcgtgggaagggtgtggtaagagttgaagtagggtgttaggtggcacctggacaggtgtcttggtatcttgagcttatgaataatatttcagtctgcactataagctatttaagttttcaataatagctatcattttgaatttacctaccattttacttctgtcagaagtccagttcaaacaatggatcatagtaatagaagctacaatctactgagcatcttattatgtgtccctatgcttaatgcatggctcattatttctcaagcttaaaacaaccctgcaaggtagttggtattatctgccttttatgggcgaggaaactgggcctaaaggaatttaaataacttgtttttgataatagccacttggtcttgacagcctgtgcttgtatttgagaagtatacgccaggacagtaattataaaatgaatgtatgtgagcttgatgttacattgctttcaggagtggggcacatattatctgtttagcaaatgattctttttttcaaaggctctttcatgaaaccagtaaatactggccagtagtaaatgctcaatatgtattggaggaatacactaaataatgcaaacactgaggtattctgtagtgtcattgtgtatgtggagaggaaaggacttgggccttgctcacttagtttcctgctgcccctgatagcagctctttacatgcctttgtggaacctctagggatttatggaacacagtttgagaatcatcttttctcctggatacttctgtagccaaatgaatcggtcatcaaaaaatttcaagctctgtatcaaactgaaccactatatcagagggttaatttaatggaacacttacttttctgtccctgaaaaataattattgtacctttttttaaatccagggctgattttagaaatagatacacaagttatgcctttttattttctttgaaaatgtgtgttgaaagttttacatatcttctagaatttatcaggttttccgcttaccagaaacccccatccccatgcagaacactctgtccctgcctgaaacaaaataaaacaaaacaaaacttgtgttgacatcagtcaaaccatttctgaaaagactctgatggttcattttccttacagcccttgtgaactgataggctttctatttaaagcaaactggagccactctctttgtcctggctgcgtagtaactcagtgctaagtcttaagtctaatattttaactaatataccttgctttagccattttttttttttggccaagagtcattctcaagtcatctgacttcatgagctcttaagctctacttccagagataaagcagtcagatgaattaaacaagataaactgtgaagtgctataagccctctgacagctgtactaaacatggcaaccccatggtaaagaacataatttactttatgtcaagaaggattaattttagctctaccaatcactatgcattatcaagaaatgtcacaagcaaaagtagtaaagcaaagaagagcacccaggatataaaggactatttgagcaaaataactagcaaatttaaaaaagtgatccttgaacctcctatgccctacctaaactcagactctaagtatgaacatcaataaatatagaaccttaaaaaaagagggaaaaatgataaaatccatgtagtaaaatattagcatctgggtaatctgcggaaaggaatattttgtataattcttgcaatttttctaggaatctgaagttgtattaaaagaagaacattttaaaataaataactttgccaatctgaaataagttcaaaaagtgataatatgagctactaataaattatagtcaatagccataggtatttatttagtgttttatctttaaacaaataagaactgaaactttgccatatatattctaagcaataagagctcttcaaaaaaatatccagtttaaaccactttatagtcacctagaaaaatatatagcgaaaaataaattttgaggttttgcctaattttctctacatttcctatcaactcttgtcttgaaaattactatcaagaaaataaatttgtttgaaaaacacataaaacagatgataattaagaattacaggtactctaaaggactatttttaaaacaggtgtgtataaggaattggtggtacaattggactactttacaaacctcattgctagaaaatacaaactaaatgattctcaagaaaaagacaaaagcattaaaaattagaaatcaggtactaaactaaaaaattatagttagccagtttctggctttgctttttgttttaattagtaggatatatatcctagtagactgaaggccctcagtttccaccccaatctctaagaaaagctagaataattaaatcaattgatcagtatttttttaaaaaagttaaactcacccaaattcatattatagttgacatattaattattgaatgtgggacagaatacagatttttaaattaaatacaaaggtacaacttttcatctttttataatttaaactcttaaatgttgctttaaaagattatattttatttctgtaaagtacagttttaacaagtgacttttaaaagtaagcctcaggccaagtgtggtggcatgtgcctgtagtcccaactacttgggaggcttagcaggaagatcactgaagcccaggagtttaaaactgctgtgagctgtgatcaccactacatctctagcctgagtgacagatctaagggggacaaaggagatagagtggagtctgtttttcacctaacatataataaatttatatattaacctcaaggtgtcaaatggagaaaagtggaacgagctccagttgaaacaacaagcaaacaaacaaacaaacaaaaaagtaaggctcaaaactgaaagtagtaatatatataactttttatttctggtttacagattggccaagctgtttcttgtaaatccgcttagctaaccaagggcatgatttttcatgattcttttttctctgtctccctttattatttggtgtttctgggttattaagtattgatagctttggatcctgttagatctgtgctttttattagtagtaatttcagctatttataaatagtatgattaaagaagagaaatcaaggaaaagatatatataagaaaatatgatgaatggaattatattcttaaataaaaatgcttatgaatataattaggtttaaagaagcattgtcccatttgtgaatctcaagttaactttctatctcatcattagcagaattaaaccataatacagatttacatgtttctttttgtttgtaaacaaatctaaaaaatctgtatgttgaaatgattgttgaaatgatagagcaaaattatttctgaagttttttggaaagtgatactaaataaattaattttactttgaacaaacctaagcttcagatcccagtaataatctttttattgatttttttcttatgggactgataagatcatcgattacagtcctgtttacgaccattaataacataattattctacaaaaagcctttttaccaataattttgggaattttttttggtctttgttttgggcttattttcaaggtttttccttgaatttgaggttcccttgactttgagggtttgttgcctatgggttcattgatttggtaggcagttataatatttaaaactcatgattatgcttaattttcccaagcacttttagaaatacattttgaaaaatggagtgtttctttaattattttaattaggtattaaaaatatctaattttaaagatatctagattagatataaaaataacaaagcaacagcgcatcagagaagttgagaaactttatcatgggaaaaaagtgatctagagaagctagtgtaataaaacaaattcatactctttaaagctcagtataaaaatgttcagtataaaaatagcactactaagaatgctaattaattagatggttcttaactaattgtgttaaatctaagtagacaatttatttcacgtggaaaatattgttaatgtttgagcttaaattatatttctatcttcattttggttggtaatacttcaagttagcattcatttaatgtggtttttgtcctgtttcttatgaagcagtaataatattgctgtaaaatattagagatatgaactaaagggatagtgacttgaatttgatctaatgagatgtaggtgaatcaaaatgccaggtctgccacttacaagctatatggtgttaagcaaatcacttcagccttactgagcttcactttttataatactgattgagcatctgttatgagccatgaaccctgtttggtgctgtgatatgaagaatgttgatgttaggtcaaagagactggtaggtaaacagaagatgacataaagaatggtaatgtctgaggtatacataggggatgtgggagcaaagaggtgagtcagttggtgggaggaggaagctgtgggaaactttctagagagggtggtacttcttcagggtaccaccagtcttagttttcttatctttgaaatataatttgcccataatgaggctgggtgcagtggctcatgcctgtaatcccagcactttgggaggctgaggctggtggatcacctgaggtcaggagctcaagaccagcctgaccaacatggtgaaaccctcatctctactaaatacaaaaacttcaccaggcatggtggtgcatgcctgtaatcccagctacttgggacgcggaggcaggagaatcgcttgaacctgggaggcagaggttgcagtgagctgagatcacaccattgtactccagcctggcaacaagagcaaaactctgtctcaaaaataaaaaaaattaaagtaaataaataaataaataaataaataaataaataaataaattgcccataagttataaaggtcaaatgaaaaaataattgatgtagtggtgctctgcaaactgcaaagcgttttacagatataagtacaaattattgatctgtatgtcacatactctgctgagaactggagacatgcaaatggttgcaaagagtagtgtttctcaaagtgtggtatatggatgtattctcagttatctctgtgtgtgtgtgcaggtgtatgtgcttatttagataaaatttttaatgaaactacaaattgaatctattaatagatgagctgaataaccacattataactgagatttccactcaatttcagtgtgtttcatatttgcctatgatctttttcattctaggttaaactactttaattgtcttgcactaatgaggagaaagagaaccagtcttaatatgaaaatgttaaagctaagtgatatcacaggcaaattgaataaaaaaaaaacccaacttcattgtactagttggtcccacactgtcattgtttataccttgctttatgtttgcttatgttttaataatattttgtggaggtcagcagtcatgaccccagggaagccttcttgattgtcctatctagattaactttcctttatgcactctcctagcccatgtacctttccttcacagactttttcattagtatggtcttaattgattcaggtaattagtgtctctccccaaaactgtaatgtacattgatgatccagggaccatgtctccctttgctcccactgtagtccaaccttgcatgcactatgtctggcacataatgggtcctcagtaaatgtttgttgaaataatgagtgaactaggttatgactgagttgccttctaaattgacagtaatttatttacatgtttagtgttgaatatgtacaggcacacactccaatttttaaactataatttctgaatagcgtaagcagtcactatctgatgtatccaaaatggagcatctctattctaggttagtgcaacaagacttactagaatatgagaaagaaggccgggcatggtagttcacgcctgtaatcccagcactttgggaggctgaggaagacggaccacctgaggtcaggagtttgaaaccagcctggccaacatgatgaaaccccatctctactcaaaacacaaaattagatgggcatggtggagcatgcctgtaaccctagctacttgggaaggtgaagcaggagaatcgcttgaacccgggaggcagaggttgcagtgagccaagattgcaccattgcactctaacctgggtgacaagagtgaaactccatctcaaaaaaaaaaaaaaaaaagaaagaaaaaaaatatgagaaagaagtgttagaatttttatttctatttatttttacttaaaaataggagatatagccaagatatagaaacttatacatatcatatatatgaatgaggcatcctgaggggcgaaaaatgcaacttgtttgttacactttccattttcagcaaggtggattaatggattatgtagtctgattttaaactaacttcataatattgacaagtggcttaaaaatttttccacatatagcttacagattgaagattgcattaatattgcaggcagaaacaagaaaagggcagaatgagtacctgtccaattcttcgacagtcatgtaacaatttgaagatattacctaaataagaagttggctctaaaattccaaatactaagatttttgacacatggatttatgtctattgtatgtattattttcagtgatgaattcttatccaagtgtatattgtgctgtaaaattaactaatgaagttgcctcaatgaacaggatacttaaatatttgatctttagtttttattttgtaattcctatttttgtatgttttgtaaagtgtatacttatatttatacactagaacatgtatataatttataagtaaatatttttaactaagaagcaaacataataaaaaaattcagaaactaccgaactgaaaatttctaagtataatttacacgcaataaaatccacctatttaagtgtactgtttgatgagttttggcaaacatatatacctgtataaacatcaccaaagtcaaaatacagaacattttcattaccccaaatacttccctcttctttgttattagtacctttcctctcccatccaaattctaggaaaatactggtctgctttctgttatttagatcgctttatattttccacgacttttatttgaatttccaataaatgatgtcatacaacatatattcttttttttattattatactttaagttctagggtacatgtgcacggcgtgcagttttgttacatatgtatacatgtcccatgttggtgtgctgcacccattaacttgtcatttatgttaggtatatatcctaatgttatcccttcccctcaccccatgacaggccccggtgtgtgatgttccccttcctgtgtccaagtgttctcattgttcaattcccacctatgagtgagaacatgcggtgtttggttttttgtccctgcgatagtttgctgagaatgatggtttccagcttcatccatgtccctacaaaggacatgaactcatccttttttatggctgcatggtattccatggtgtatatgtgccacattttcttaatccagtctatcactgatggacatttgggttggttccaactctttgctattgtgaatagtgctgcaataaacatacgtgtgcatgtgtctttatagcagcatgatttataatcctttgggtatgtacccagtaatgggatggctgggtcaaatggtatttctagttctagatccctgaggaatcgccacactgtctttcacaatggttgaactagcttacagtcccaccaacagtgtaaaagtgttcctatttctccacatcctctccagcacctgttgtttcctgactttttaatgatcgccattctaactggtgtgagatggtatctcatagtggttttgatttgcatttctctgatggccagtgatgatgagcattttttcatgtgtctgttggctgcataaatgtcttcttttgagaagtgtctgttcatgtcctttgcccactttttgatggggttgtttgtttttttcttgtaaatttgtttgagttcattgtagattctggatattagccctttgtcagatgagtagattgcaaaaattttctcccattctgtaggttgcgtgttcactctgatggtagtttcttttgctgtgcagaagctctttagttcagttagatcccatttgtcaattttggcttttgtacaacatatgttcttttgtgcaagctggcttcttgcactcatcataatgttttgggagttcatccatgttattgtgtgtatgagaggtttttttattgatgagtaatgtttcattataccaatatttattatagttggtttatccattcacctattgttgaacatttaggttgtttctggtctcaaacattcgtatattctcagggcataggtttttatttctcatgggtaaatacctaggagtggacctgttgagtcccatggttaattgtttgttgaaccgtataagaaactgccaaaatatttttcaaactggttatactattttatattcccaccagcagtatatgagagttctacttgcttgacatctttgtcaaacttggtattgccaatatttttaattttagccatgcaaatgagttatatagtggtatctcattgtggttttaatccgtatttctctgatgactaataatactatcttcttatgtgcttattgaccaactgtatatcttaatatctttgcctactgagagcttactattcttccctttctacttttatttaaagtagtaagtacctaatttgtgtataattttttttttttggagatggagtctcgctctgtcacccaggctggagtgcagtggcgctatctcagctcactgcaacctctgcttcatgggttcaagcgattcacctgcctcagcctcctgagtaactgggactacaggcgtgtgccaccatgcctagctaattttttatatttttagtagaggcggggtttcaccgtgttagccaggatggtctcgatctcctgaccttgtgatccacccgccttggcctcccaaggtgctgggattacaggtgtgagccaccatgcctggctaatttgtgtctaattaaatggatttctataatacactcacataggtgtaagtaaccttttaaaattgtaacttaaaaccaaggaaagcaagaataaaataactttaataatgaaaaagtaacataagtgaggtcatgtttttggtaagaaataaatggaatactaaaaatgatgtgaaatttgtttaattttagaaatcttatcagcttgtattgagaaacctggtaatatatggttagatggtatgctagtttgaataaatttaaatgtggccgcagcatgccatggacagagttagataagacaaataagctacatcatggtgtggtcttgctcactgggatcagaatcaaagtaaaatggcagacatgtgcacagctcatcctgatagctgtctgaccagagtgtattatcaggcgcactcctataattctgactgggagttaatggtcttcatagtggagatgacagctttggaaagagatcagtagtaatcttcaatctgaagaattttgtatttgaccataagattttcaacatttaggtaatactttagtgaatctctgtagagagcttgagtaaatattagtcactgaggctcatttgttggatcatagagattaatgtttataatgtacatactgcaaatagtatggataatatttatgggataaataattttttgttctaattttgttcatgaaccttgtatcatgacaatgataaattacgtaattgttgttaatgctaatttgaagactgtggagctggaagaagtcttaaatgttatctactccagttttttttttttaacctgtatttttaaaaattatggtaaaatacaaaatttaccatcttaaccatttttaagtgtacagttcagtgtgttaattacattcacattgttgtgcaaccagtctccaggattcttttcatcttgcaaagctgaaactctctacccattacaatttcccatttccccctggtaactgctgttgtaattttgtttctatgaatttggcttccctagttgccatataagtagaatcatactgtatttgtctttttgtgatctgtttatttcagttagcgaaatgtcctcaaagttcatccgtgttgtagcatgtatcagaatttcctttttaatgctgaataatattccattatatggatatataccacattttgtttattcattcatcttcccttggatacttgggttgcttccaccttttggccctgcccttgtgaattatgatgctatgaacaagctgtactattgggaattatgatgctatgaatgggctgtacaaatatctcttttaggctctgctttcaattattttgagtatatactgagaagcggaattgctggatcatatgataattctatttttaaaattttgaggagctgctatactgttttccataacagctataccatttcacatccccaccaacagagcgcaagggttccaatttctccacaccctcaccaacacttattttctcttttcttgacagtaaccatcctaatggatgtaaagtggtagttgtggggtttgtgtgtgtgtgtgtgtgtgtgtgcgcgcgtgtgtgtgtgagacagagtctcactctgtcgcccaggctggagtgtagtggtgccatctcgactcactgcaacctctgcctctcgggttcaagcgattcttctgcttcagcctcccgagtagctgggactacaggcgcatgccaccactcctggctaagtttttgtatttttattagagacgggatttcaccgtgtgagccaagatggtcttgatctcctgacttcgtgatctgcctgcctctgcctcccaaagtgctgggattacaggcgtgagccactgtgcttggctggtacttgtatttttaaaagtctgtttttctttttctttctctcttcctaatctttcgccttctcctcctcctatactttttgtcctcctgcttttggcaaacaggtctgtatataaaattgatcttcccagaacttcacagaactgggaaacctagagcttcacctttccttataccttttattcctgaaggggccaggaggagaacagaagagaaaacacagatctctttgactttcttattttaaggctgaggaaactgaggcccagggaaatgaagtgcagccacacaggcaattaggactaaaatttttaattctctatttaacagttttcttaaactacataggtgtcaaagaaatctttaaagatctctaataattttttctgggtgggagtgtgaattagctttctcaggttacctagaaagatattgtctgaagtgtggaatgtttattcttttgggatgtgatgtgattttaagtggtcttagctgccaaaagatggacttccgttgattttggaaaagagctttaagaaaatgttgaattgcagagtgaggagtttattccctcatccattctctctcactgtctcggagtagtcagtgaggtcagtttggtgcagagtatctataaagcctcatgaatatttgctagtcttcccccatacctactgacacacctaaaaatagggagtagtattcaagcttagagatacaaacatagagatatggcaacgaatagttggctagtactaaatacctgttttgatattatttttagttttgtattataacaatgaaagatggaagatagtagtttaccattttttcttgtgtttgcaaccttttttccaagagatttaagtagaaaatggaagaactgttaagtacataagatacgaggtgaggccaggcacagtggctcatgcatgtaatcccagcactttgggatgccaagttgggcggatcacttgaggtcaggagttcaagaccagcctggccaacatggtaaaaccctatctctactaaaaacacaaaaattagctaggtgtggtggcgggcacctgtactcccagctgctcgggaggctgaggcaggagaatcactcgaaccctggaggcagaggttgaggcaggagaatctctcgaacctggggggcagaggttgcagtgagccaagatcacaccaccgcactccagcctgtgtgacagagcgagactccatctcaaaaaaaaaaaaaaagaaagaaagaaagaaagaaaaaaaagatggcaggtgctacatggagatggcatatatactgcgttagtttgggtactaaagaagcagactctggtacaaagatttaagtacaagtagtttatttgggaggtgatccctggaaatagtggtaggatattgggaaaatcagacagaaaggggctttatccaatacagtttttcttattatataagatacagctgtggataattatcacaatggagaaatctggggagccagtattatcccacatctcagagttatcccacttgagggatgaggaagcctctggtgtttatacacgtatttctgttggtcataggcagagagatacaggggtggttaatttcctggtattgctagctaatgtgatggtaggcaaagaaggtattagggtaccaagaaatctctcaggcaaagaaatacagttgctgtagtgagaagcttggccggtgtacactgaagaggtaagggtgaatgtatacagatttggggcatgtaatatttaccacttaggtattagaataatgactaccttaggtaatctctattgtggctaaacattttcaaagatatgaatttatagccacctctgttattaggctgtaaagtgttgaaactgtaaagggaatttttcttggtacctaaacatagtccttccagttgctacttgagtttgttttcagatccttttctcaatgggcaaagtactgaaagtgtctgttcccatagtattccttcctctatttgaataaagactattattactagccttctgttctctactaacccaaattattttaggttttctttgttatgccatttctcaatcatttagtaatttatgttactctttcttggacttcctgtagcgtcttttcatcttacttaagttgatgagtctattttctatagctgctttttcaggataatacaattaatgaaaagaagtcttatataatttaaatttctggccacatgtaaaacttcataatttattaattatcatcatttgaatagtaatttaaatgattttagttatacagatcactgaaattatccccaaagtcatagcatatctatatcaattatttgatagttattgtaatatattttagagctgcgtaagcggaaacacttatttaatcctaagtactttgctctaatataaagtattaaaattaaagagtaagaattaattgtgctgctaaagaaatggaattggttacatgattttaaagtatctaaattcattttgctttatcttaactccactggcaaataaaaaagggctattgctagcactatgaacagagacatctgaatttttgaaaatggaagccgctgtaaatgataaacaggcaaccctggtgtttagagaacttacccttgatagcaactaataatattcccttgcagttatacacatacaatagtgaataaattgaatgactttactcctaattagtctttcctgcaaatattaaataatttaataatattttgctttttttaaaaaaggattcatcttatgttacaacagtaatttcaagagtctttgcttttaattacattcttggtcattactcccacagatattttgtcattctattgtggccatatgtcattatgagaaacttaatacattactgttcagttttctgagaggaaacaccccacatcatagacacatgcaccaatttgaattacttatctggacattgtaaagtaaaatacttaatctcaatttgcagttgtataagcatgtattttatatagtggagaaaggagaaatattttgtatacttttttgcttttaatctttagtgagctataatttatttacagtaaagtgcacagatatcaatttatgcagtttattatgttttgagaagtgattgtgtaacccacacttaaattaaggcatttttatcactctagaaaactttcctctggctcgtcccaatctctaccctccccatccctcgatcccagaaacaaacactgttctgattcacagattatatatatatataattaatagtttttaaaaaataatttttaaaaatcatgtacttcatagaagatttgaaaggatagagttgtaaatttattgaagactgttttgaaccacagagtaggcaagggactgaatattgatactatggttggaaaaaggaatcataaaaatatattataatttccaaaactacttacttttgaataagtattttgttcagttttctgaggataaataattaatattgaattgaaccctatatattacctatgtgtactcattggataacttgctctagggatcatttaattttttttttttttttaataatttgaaacatcctaaccagcagtcttaaaaaaactgctctgggctgggcgtggtggctcaagcctgtaatcccagcactctgggaggccgaggcgggcggatcacgaggtcaggagatcgagaccatcctggctaacacggggaaaccccgtctctactaaaaatacaaaaaaaaaaaaaaaaaaattagccgggcgtagtggcgggcgcctgtagtcccagctactcgggaggctgaggcaggagaatggcgggaacccgagggcggagcttgcagtgagccgagatggcgccaccgcactccagcctgggcgacagatcaagactccgtgtcaaacaaacaaacaaacaaaacaaaaacaaaaaaacaactgctctgtaaatctaattcgtcattaattgagccccaaattagtcatcagcaatttgtgatccatttctttagtcatttgttcttggcttcaaaatatcatttgctttcgctagtgtaaaagtattctttaagtaattatctgatttgttgtcagtgcttacaaagctttcttacatcttcagaagcagtccttttatggtagaattttaatttctaccatttcaattacttttattcttgtaaaatagcatatgggtggaggtatgaagtaagaaagtcatgaaataaggaaaaatagaactcctttatttggaaatttctatggtctgaatgtttgtgtttgtggacaaaatttatatactgaaatccttacccccaaagtgatggtattagaaggtggggattttaggaaatgattaggttatgaggatggagtccttatgaataggattagtgtacttacaaaagacaacctagagagacccctgtctccatccacgtgaggacataggaagaaggtcagtctatgagccagaaagcaggctgtcatcaaacgttgaatctgccttgatcttgaaattcccagcatccagactgtgagaaataaatttctgttgttcgtaagttacccagtttttgctgtagcagactgaacggactaaaacgaatagttccagcactcttcactgtcttcctatctttttctcctggtgtgctatttgcctttgtgattttttccttggaagctcaaagctacttgtcatatttcagtttgtatctgcctcctttccttcaccaaatccttattaaggattccctctgtactattaatagcaattgtgataagtagtaaagaagaaatagacattgttcctgactttatggagcttacttacaaaataaaattatctttctctcgtctacatcagaattaccactgtttttgcaaggaagctagttatactaagatgtaagtggatgacagaacattgaaattaactctgtcatccagttcacattataaactacagtacttaggagtcattctttgttgaagggttccaggcaggtgggtgatagattttaggtggctaggcattcccagtgactgtcagttgactgaaacttgttacagcaatgtgcagggacactttggtaattaggtcaataatatcttttgtttactaagccaaaaaccacggagatgtcaaagaaaatcagttaaggaaatgatatccctgtctatcttattggtaagaccattttcttatctttaaattatttcaatgcccttttacttttctctatattttttaagattctaaaacttaactatgttgttctcagtcctcttgaaattgaaaccattatctttaatattcactaattttttattgctttaccttatttattcttttgttttaaaaatgtcatacaagtgccaaagggaacacattttactaaaaaggattcagatagaatagaaacacacaaacaaagtgaagcttattttattttgtcttgtcatcctggtatcattaaaattttctttcaatatatctttttttaaattatataaatcagctatatatcagtttggatttctctaaactgctttcagagtaatatttcttagagtatgataagttttagaaaggtaatatattatgcaataaattgcattttcacttagaggcagaagatcaacagtggaacaatttatgctagtggaactgagattgtggattaattcctattttaccaaaatattgaattctcttgtaaacattgtagtcactgcatgtatgtagctaaaatactgaaatagctctggttatcttatatatcctaacctcttgtgaaatagattttcaattctagggattgatgatagcattctcctaaattttcatgtgatactttactcattgactttgagatttcgtcttgtcctttgatatttttagttttcaatttgcttgtaacttaactattcgaactttttgaggaagaattatccttgtatttcaccaaagccttaacatttagcaggaaattaaggatttaggttgttatgtgtgttactcttaattagggaatgtcaatgaaagtaaaagcaaagaaaggggaagtggttccgagtgtatttccttttccctggggaattctgaaaacccatggaggtgtaaaatgttggtaacaattcctttggactctgtctggattagtttcttcttgctgtgtatcaaattacaaggatgtagtagctcaaaacaacacccacttattatctcacaatttttggaggtcataagtctgggggtgcttgattgagttctctgttccatgtctcacaagactgaaagtaatgtgtctgtcacatggggcttttgtttagagatcctggggaaggatccattccaagctcattgagttactggcagaatagcagaactaaggcctctgtgttatcttgttggctgtctgatgggatctgttccccactcctagaggctgcctgcttgacttctcttgtagcccctccattttcaaagcaacaatacggccttatgtattgactctgactgctgccaccagccagagaagcactccgcttttaaggactcatgggctagagcaggcctactcaattttaacgtcagctgtaccatataacgtaagataatcatgggaggtatttttcattgtattcacaagttataggaattagagtttctaatcttggttgagggggaggcatttttagaattctccttaccctaccactttgaaatctattatcaatcttcataatactttactcatagccagtgaggtagagtgaagcatataactcacatatgaaagggcattaagaaggcctaaattttaaaatgagagttttgctacaaaggatatggggaaactactacttttttgagtgggaatgctccttattataaataattcatttatctcccaaatgcatgcatgatttcaatgcaatccaactgaaacacccagatgacttttgaatgtacataagaatagccaaaaagaaagaaagaaagaaagaaagaaagaaagaaagaaagaaagaaagaaagaaagaaagaaagaaagaaagaaagaagaaagaaagagaaagagaaagaaaaggaaaggaaagaaagaaaaaaaaaagaaaagaaaatttgccaaaaacagactagtggtagagaaagaacttgttttatttaatctcagaagatactatacagttatggtaatcaaaactgagtgatatcagaccaggaataaataagcacatcactgtataaatgaaaacttagttcattatgttctttaatagtaaaatagttaaataagttaagcttcgtctatactatggagtactctaaaaccaaagtagttggtgcgtgtatgtatgtgcagacacacacgtatacacgcacttggaaacagctccaaagatgtattgttaagtgcaaaaaaacaaacaagaagtaggaaaacacacatatctcacctaggttcctatactatatgtactctcctataaaaagacactgcatccggggcataaaatgctcacctatggtgtttcccttgtatttgtgttgggtcctgtagcatattctcaatagtgagctatgagcaacagtaccatgtattatttgtgagccaagacatttaggagctagtatgcttctacaatctctcagctgctgcgagcctacatcacagtgacacaactaaaaggtggtggaacctctgttaaccagggtccccaagtgagcgtgtggagcagggcccgctgcaccactgactgccacacagacagcctcccagtggtaactcctaagttagagagttaacttagaaacattttctaagttagagaggtaactttggagttaccactgggaggctgtgtgtgtggcagttagtgttaactctcctagttagtgtagacacagttaaacacatgaggatgaaattattggtagggggttggaggattgtataccattatctctgtgaagtggaatagcaggaagtgtgagcataaaggatgcagttgcattttacttggattatttctttgttgtctgaatactttatgaaactgtgtttatatataagttttgttatcagaatactgggatcagtaaaatgcagttctcctaaaaagtaggtaatatattagcagtttgcttcaaaattaactttacccttgctagaggagtattatggttgctactctttttcttttcttcagggatttagatgaatagtaagttgatacaatgaaacagctatttttgttttaattcatgcatgaaatgtaaatctctaaagtaaaagtcttttgttggtgtctttatgaagagtataatttatagtgtatgatgtgcagtgcattattttctaatattctgtcttttgcaaactacctcatgattttttgctttatccaagatgcccactatattgttactttttttttttttttttttgagatgagtctctctgtcaccaggctggagtgcaatggtgtgatctcggctcactgcaacctccacttcctgggttcaagcgattcccctgcctcagcctcctgagtagctgggactacaggcgtgcaacaccatgcccggttaattttttgtatttcagtagagacggggtttcaccatgttggccaggatggtctcgatctcctgaccttgtgatccacctgtcccggcctcccgaagtgctgggattacaggcgtgagccaccacgcccggcctgttactttttttacttaactgttttctataaaattacttaaaagaattaatttaaaacaaaaactttggacctaaaatgaaaagccagcatctcttgacataaatataagatttatcttatattcataaaactgaatatagtaaaaattaaataatacttatgagatatggctagctgcatttgcttaaaaagacccagtcctaagacctgccttctcttaaaaagtgaaattattcttcaatagaacgttggttaagcttaagaaggcttcagttaacatactgaggattgtagaaccatatatttcatggggatatccaaacctgaagtcagcaaatgaacaaatctacaagcgtggttatggccaaatcaataagatgcaaattgccttgacagataacattttgattggtcaatctcttggttgagcatcatctgcctggatggcatcaaccaagatatgccacatcttggcatcaaccaaatatggcatcatctgcctggaggatttaattcatgagatctatacagttggaaagcacttcaaagaagcaaataacttcctgtggcccttcaaattaacttcttcaggagttggaatgaagaaaaagaccgcccattttgtaaaaggtagagatgctggcaatagggaagaccagacaaacagtcttgttaaatggatgagctaaggtgtatcccatgattatttttgtaacctagtcaattactaaaatgactgctttcaaattgaaaaaaaaaagtgaaattagtaattgttatagatggtaaatgctgagaccttgtccttgaaaaaacagaatgattttaaagagaattgaaaatgggctgggtgcagtggttcatgcctgtaatcccagcactttgggaggccgaggcccgcagatcatgaggtcaggagatgaagaccatcctgcccaacatggtgaaaccccgtctctactaaaagtacaaaaattaattgggcatggcagcacacacctgtggtcccagctactcagaaggctgagacaggggaattgcttgaatccgggaggcggaggctgcagtgagctgagatcgtgccactacactccagcctgggtgacaaagtgagactccgtctcaaaaagaaaatggagttaagtttttagtatatgatttattgttacttaatgtcttgcctttgtactaccaatatcattattcccatatttggggaaacactggtattgtgggaggaattctaggattagagtcagaagatctggaatcactgccagctgacaccatgtctttgagttgtcattgtatctttgtacttatgtcactatttataaaatggagataaaaatgcctaccatttttacttcaccttaggatttttgcaaagatcaaatgaaatattattgcatatcactattaataatagtgttagcactggtttaataatcatgtataagtaagaagttctgctatttagactatagtgctttggctgcaaacaaataattcattcttgtaatttccagttctataccctgaaagaaccgacatctttatttaactctcctgtaaatatgcataatatcaatagacaccgggagtaagtatgaatctgtatctatgtattcacagcagaaaatacatttaaagtacatattcttatggtctctctagagttgccaaacttaattttctgtagttagatattttgatgtgctgcatacatttattgatattttatgtttctgtagtttcatttattattagaaagactagaggagcctcctgttacaaagaactctcctaatactgcagtaagcttgacatctttagctcatttgctctttctggtcaccacagtattatttagtaaatgcttttcccaataaattattacttagtttagtagaatcttagcattggtaggctctgctaggacccaagggaaataatgcttaatacagtgttataatcctgataaaatgctactcactttgtaagaagtaatggttgctatgttcctttggattcacaaaaataggtttatgtattttatgtaatatctatcctgttttgtcgctgagaaattattctaaactaaatctttcctgagtaacattcctgctcccagacacactccccctctcgcctttgaaacctgctttacttcttccaagtagcttctgctctttgatgccagtctattttgggagaaataaatggtaggcatctagggatgatttattgaactaattcacttccatttaattcctcctttctcagatggtcacaaggtcaagagagccaggaccctactgctatgttagccttcatattattcttctcaagaagttcaggcataacactattacacttatgctgtcctcacaagttagagttgcctatagcaatcatgtagttttagtaaataattcctataaagcataagtttcatgtttaactgcaaccctgtataagaagcaggcttttgatgtttattggatttgaacctgctggaagcatctgttaaagtctaatgaaagaaaattatatccaaagagctaagactttctgaaaaacagaagaagctacacagtttataagtgatagggtcatctaccacaggggcaatgagtgaatttataatgtaaataaacaaattctgttttctacataaaatgaattctgtcatttaaattaacaatacaatattttctaatctttgacattcatcacattctttgacatggaagggctaccattcctagaagattcacagcaactttgtaattaacattgaatatgcaaggaagtcctttgtaaattaatgttaaagatccagggaatctcctggctcttgctcaataaacacagtgagagagaatttaagtaatattttttccaacccccttaaccatgctttttgttctctgtgatcctgtgctcatgaagtataaacatccttacctacaaattataccaaacattcataatacttgtagaacttgtttttggcaagatttattaaatagcctgtgacttattttattttattttactttatttttgagacagggtcttgctctgttgaccaggctggagtgcagtggcacaatcatggctcactgcagtctcaacctcccgggctaaagcaatcctcctgccttggtctcctgagtagctaggactacaggtgggtgtcaccatgtccagctaattttttattttttgtagaggcagggtctccctatgttgtctaggctggtcttaaactgctgggctccagtaatccacccatcttggcctccgaaagttcttgcaatttattttactttttttttttttttttttttcctaaagaaacaaggtctcactatgtttctcaggctggtcttgacctcctgggctcaaacagtcctcccgcctcagcctcccaaagtgttggaatgaataccgtagcctcccaaagtgttagaatgagccattgtgcctggtgcctacttttaaccaagactgaaaaagctgttttcaggtttatgatttctattttcataacccttgcttacagagaaaatcagtttttcccgtatgctttttcttttcttgtgtcttcccttctagcatatccgtactgtgcttttgacttttttacttctctttcctcaattgcttcatttccctgtggttttactgggccagaaataccgactgagttctattccttctcttttctcacaaggttacttttgtaattaacctccctgctgctactctggatgtcttccttctccactgtccttttattaatagctgttataatgtgggtcctttttccttctgtttcacatttagtcagtcacatagcagcctctaccgtaactgttctaatatcccatgtttttaatctgctaagagctctcctatttcttgtaggtctattaaaatgatcttaatacagtttttgacatttctgaaaactaaggtttgaaatgtttggtgccaaccaaatgtgtaagaaatgctcttctgtgtgaaaggcaatgaaggccttgacataataaagaaatttttacaaagagactagtattgttcttagctgactaataagcttaacaattataaatgaactcatttactattgaaaaggatttctgttttgaggtgtgattcattttatttttcttgaagcacatccgaaataacatattgtataaatttgtcctcaaaatatactaattgattctgttgagctagcacgttttcctgtggtatataatttgttttggtattcacttttttaaaaaataatacaaattacaaaaaaagtacacaaaattagcaaatgtatttgtaatagaatatttgaatagtaatatgaggtgcttccatatatttaaatatgcatcagtaagagagtgttaagttttttaattcatctagtgtttatgaatgtaaatacatcatgcatatatttatatttgggggataattttttttcccttcagttgacagaataaattctggtacagaatgttattacagtcagacttcattgctgccaacatactgatgtgtactaggtaaccatttaaaaattaactcaaggtcattttaaacctgatatggtcaggtcattttaattcattgaacacttaattagtgaaattgcagattattcctgctaattccacctttgttcttctcttttcagttcacattttgcccatttcactgtttttttttaattttaaagtagtgaaaaatatttgtttattctctttggaaatatttctgggaatttattttgggaaaggcaatgaaattgagatgattaatttcatagagagtttatttaattatctcttctctaagtgcttagatagtacaaatagtaaatgtgtcagtttaaagacttcacaaagatgggtagaaaataaaattattggggatggtaatgaaatgactacaagatgctggtttccccatctcttttagaaatgctaacctgaatagttcctgcactaagataatggcaactaaaatagaaaataagcttgtaatagataacttagtaaatatttgaacaaaaattaatgtttaacatagtagcaactaatatttgaacaatttgaatcacatttgatcattttagaacgagaaaatagcatgcaactttactttaaaatttcacctttggtttttaatgatacactaatggtattaaaagtgatcatatcagttcactttgaaaaaataaacatttttttcattatttaaaaaaatacacatccccatttagaagattctaccaattttataatattctctgggcattgtttgttattgaataattattaaatatagtgtgttttccccgtgctgaactctgggaacataccaacaaatataaaaaatgttgctgctctatatgtgcacttgggccagggctagggatgggctggaattctcttattctcatttcccatcctgtgtctgggtgtatacatcctgatagactggctctgtggtcacagttctcttcctggacctgactgactttactttgggtagaagagagcatagctatggctttccaatccacctttactattataacaaaggcagagcctcactgcctaaacagcaacaataacaacaacaaaacaaataacaaactctaaactaaaaactagggtaaagaaaaggttcttgagggtcttaacttcttaacttctcactggtagaatgaggtatgtatacataagatactttcgcttttttggttcctcttttcattgtctgcccttttttaatccctctttgcttcctccattatcttttacctttgaaaaaaatcccttctcaaattgcaagcggtatgcccaattccatttcttactttcaccaaatcgtttcaagggtctcgtaggcccagattaaaggatggcagaaaaaccatgcataccagatgatatgggtgggctctgtgtccctactcaaatctcaccttgaattgtaataatccccatgtgtcaagggtgggaccgggtggagataattgaatcatgggagcagtttcccccatgctgttcccatgttagtgagtgagttctcatgagatctgatggttttataaggggctttccccttcgcttggcattctttcttcttcctgccatcatgtgaagaaggacttgtgtttgcttccccttctgccatgattggaagtttcctgaggcctcccaagccctgtggaactgtgatttaattaaacctctttcctttataaattacccagtctcaggtattttttcatagcagtgtgagaatgaactgatacactggataataataaaaatggtgttaccgccaaaatatgctgtaattcagtattttcactatttaatttggtcttccattcactttgtcaattcgttaacttggtaggtagtgtaaagaattatgccctatttttacgttgtactgtaaagtctccatgtgatcaagagacgtatttatatattgctatcctagacaagttagccagcatctatccagatttcttttccaagattcttgacattttcccagtttcatttctactttaattatagaatctcatgattttaagggacccttgatgaacatttattgtgcatatttatggctgaaaccaaatgggatctaaagatgaaattttcacagacataaagacaagactcttgtttatgaagtatttcataattttaccagttattcaagatgtattataattgtcatacagacctaaaccatgatttgtatctaaacttaattgctttggatcctcacagtaacccttttgatagattagatatcatttttattttatacacaaggaaatcattgcttaaagaaataactgacgaccctaatatccagtatcagcacaagaacctcttaatttcaaattaaccaatttttccacctcacagtattgaccaccatgaagaaaaccagttgagaatctgaattagtactaagctatgtgctaccacctgtgtattcataaatcctgagagcaaaatgaaagaaatagtctcttgtgggataaaataagttacagaagaccttttagagaaactcatttttaaaatatatattatagttgttcatatttcggggatacatgtgttattttgatacacatatgcaatatgtactgaaccagtcagtgtagttgggatatccatcacctcaaacatgtatcttttcttggtattgggaacattacgattcttctagctattttgaaatatataataaattattgttaactacaatttccctactatactaccaaatactagaacttactacttttatctaactgtatttttgtatccattaaccaacttctcttcatcctcccttcctcatttcccttcccagcctccggtgaaatttggttgtaatataagctattaaataaaaattctctttaaatactgctttcctgcgtgccacaaattttatgttgtgtttttattatctttaaattcaaaatatgttctaatttctcttgtaattgtaactgcaaaaataaaaatattattttgtttaaaaatttagaaaagtagagactctaaatttttaattaggcctcaaaggaaatagtggatttctattggttgatgagataatttatgtagagaaaacaatataagcgatgagaaggtagcaagaatgtacaagattttaatggatgattataaaggagcggagaggctatgtttgaaaatatccatcaaggtttacatattattaatgaaatgattttgtgtcctggttattttgtttttatctaaaatatgattgggatgcacttaataatttaagcggaggcattatattatgaaaaaagtgagtatttttgaaagtgccaaagatctgtctcctactattaaatataatatttgtatttttttctatagatgctttgtcaggttaagtaaatttctatccttagcttactgagtgtgtgtgtgtgtgtgtgtgtgtgcgtgtgtgtgcatgtgtgtatgtgtgtgtgtgtttaatcatgaatggacgttgagttttgtcaaatgcttttctggcatttattgaggtgatcatatgtttttttcttttatattgtaaatatggtggattgtatttgtgggtttttaaatattaaactggcattgcattcttgggttaaatcctacctgattatgatttattgtcctgtaaatatattattagattagatctacttatattttgttaaagatttttgcatttaggtttatgagagacattagtttgtagtattcttttcttgtaatgtcttttctagtttgggtctcacttttaggctagcctcataaaaacagttgggagaggttctgttgttctctgttttttaaaacatttgtgttagattggcaatttttttcttcttgacatgtttcctacaatttaccagtgaaaccatcagggcctggagtttcctctgcgggaataaattcaagtttacatatatgatttgggattgggtgttttggggccagttttggtcatttaggccttttataaactttttccatttcatcttagttgttgaatttattgacactacgttgtctttattattacctttttaaagatgtatagtgacgtttcccctttcatccttgcaatttgtaatttgtgtcttctttttctctttgataagtctaccttgctgtttcttgtttcaattatttttttctgttttcatatttttatttcttttattaacttctttccttctttccttccttccttccttccttccttccttccttccttccttccacttattctagatttgatatattcttcaatttttaacacaaagtggaaacttaggttattgccttagatttttttccccctaatatatatatttaaagttataaatttccctctatgcgaggctctggctgcactctgaaaattatgatatattttcagtaacattcaattcaatacattgtctaatttcccttgtgatttcttcatgatataaaccatagattatattaataagtatattgttcgttttacaaatatgttggactttttaagatatctttttgtcctcgatttcgaatttaatgtttttggtcagagagcatgctctgtattgttttaatacttttaaatttgttgggacttgttttattcctcatttattcctgaactttcatgatgcatgttcatgtgcatcagagcatgcctgttctgctgttgttacatagattatgacgtgaaagtcattttggttaagttgattgataatttctgtattctcaatgattttctgtcttttttgcgtatcaactatggaaaaaagaatgctgaagtctccaattgtaactggatttttaaattttcttctttccgttatatcagtttttgcttcatgtcttctgaaactctgtctttaggagcaaagacatgtaggatttattatttcttgatatttttcttaatgaaatatttctctttttctctggtaatattctttgtcctgaagtctactttgactgatattaatatagccagtccattttttcttataattggcatttgcaagatttatctctttatatccttttatttttaacctgtttctgtatatttaaagtgtgttttggtggatagcatatagttggatctcacccatttttacccactctgacaattaggatatgaatcttgtagattccaggtaattattgatatggttgcatttaattctagtgtcttgttatttgttttttatttgtcccatctgttcttttatttcctttatttttgctttctattagatttattcagtgttttctagtatgacactctatcttcattatttttttctttagtattcaaagatttaaaaaatatgtatttatcagtctgtgttcaaccaataatttaccactaaatatatatgaatattataaaagagtattttcaattccctcttctgtcctttgtgctatttttgtcattcctgcatttcacttctacatatgttgtaagccccactaggcattgttattatttttgctctacatagtcagaaaagtaaaagataagaaaacaaaaaatccctataactttttacagaaaagtaaaagataagaaaacaaaaaatccctataacttacctaaaaatttattatttctgatgtttctcatttctttatgtagatctcagtttccatctagtattctttttctttagtctgaagaacttcttttgtcattatcttcattggctgtctgctggagaagtatttttgtttgtcagaaaaaggatcctctcttcatttttgaaggctatttcactggttatggaaatttagtttgaaatatttttctgtcactactttaaagctgttttttttgtcttagacttgcattatttttcactgagaagttttcagtcattctaatatttgctgcctggtatctatctttttttgtctgcttaatttttttctctttattactgggtctagcatattaattataatgcactttggtttaatgttctttattcattttttaaaatgttttttggtagagatggggtcttgctgtgttgccctggctaggcttaaatttctggcctcagtggatcctgcaactttggcttctttgtctgtacattgatgatgttcttctgttcgtgtttatcatttcaatcaaatttggaaaaagaaatctaccactctttattcagtatgttttctgttacttctctgtctgagactactaaatactgtcccctagttcattgatactttatttctcatcatttcttttttgcctctgttcttcatggtaggtagattttattgctaagctttcattttaagtggtatacattttcattgtattgtctgcttttaatcctaaccagtgaaattttaattttacatattgtattttcctactctacaaatagtacttggttcttctttgtagcttctttctttttttctcagcacggtcatgttttcgcttaaatcataagtctattcataatagctgttttaaagtttctgcctgctagttcatttctatcatttcaaggtctgtttctattgattgatttttctcctgattacaggtcacacttccctgcttctttatatgtctaattttgttatttattatatgctaggcattatgattcttatggtattgtaagtctggattttgctgtcttcctttaaacatattacattttgttttgggtagtcagttacactgcttgtaattcagatattgtcaaggcttgttttttagcttcattaggatgagcctaaagttgtctttactctagagctagtacagccctactactaaggctttactccttctggtatatctacagaatgccctaggtgttcactacagtcttaccactatgggtaatcacatcttaaaccatctctgcaccttacacttgtgcagttcagaaaatgatgagagattctcttgggtctgttgctgtcgttttctctaatgccttctttaatactctgctcccacatttcagctgccattaagcctccccatttctttattttattttattttagtattattatactttaagttttagggtacatgtgcacaatgtgcaggttagttacatatgtatacatgtgccatgctggtgtgctgcacccattaactcgtcatttagcattaggtatatctcctaatgctatccctcccccctccccctaccccacaacagtccccagagtgtgatgttccccttcctgtgtccatgtgttctcattgttcaattcccacctatgagtgagaacatgccgtgtttggttttttgtccttgcgatagtttgctgagaatgatgatttccagtttcatccatgtccctacaaaggacgtgaactcatcattttttatggctgcatagtattccatggtgtatatgtgccacattttcttaatccagtctatcattgttggacatttgggttggttccaagtctttgctattgtgaatagtgccgcaataaacatacgtgtgcacgtgtctttatatttctaatctttgtttccttatctcagtgagaccatcattctgtcctagtttctctgttcctgttctgcaatgtggaaaatggttctaggtcagaacccaggatcatggcaggattcaccttgtttgtgtccattctcttaaggatcaccatcttatgatgccttttgtcacatgactgaaaacatcattttacatattttgtcaagttttctatttgtttcatgtggcagggcatttcccgtagtatttactccagcatggcctgaagtggaagtcttataatctttcaatacgttttaatatgatgtgtaaggtgcataatgtgtaaggtgcagagaagtttaagatgtgatcagccatagtggtaagaccttaagtatgattttatgtttaatatgattttaatatgtatgtaatatattaatttattttcacttaaaaaaatctaagagcaatataaatatgcagaataaaagatgatagttttttcaccccctcacctcttttcatgtcactcagcagagttaccatttttagaagtttggtgtatatccttctattcttgtttatatgaatttgtatacacatacgaacatatatgctgatatgtatatatatatgcacacacacatacacacattttgtttatgtttatatattcataaatttatttttgtatacacaaagctaatcatactgtaagaataagtattgttccacaacatactttttaaacttagtaatatgtattggcaatcttgcctaaaatacatatatatcttactttattcttttatatcagccatgtattctatggaatggttgaactaagattcacttcataatgtcagatttcatcatcattaaagttttcctttttcttataaattacgtattttttgaaatttttttgtacagcaactcttcagatattgagttttcttgttgaataaattcacaaaaatgtcaaatgatatgcctgcttataaattacctttaaattgcctaaagaacctatttatattactactaactatatgtaagcatgctcgttttcttaaaatattgtctttaattaatataatccctttggtaatttttatagttctagagagtaaaaagtagttttcttttcatttgaagttatctgattatgtttaatgttgagcttttaacatttacatttatcgttcatctataattttaattttgtgacccacccacctatgttctaacatgttttagttctttttttattgattcatagggagtatttatatatgtgggatactataccttattaagtacgttgcaaactatttattcaattatatgtctagattttgaactttgtttatgttgttagttgtcctaaactgtctttgttgttgttgttgttgttgttagttcaaatctgacttgctcttatggcatctggctcttgaatgtttctagggaggtttcatcatttctagtctataaatattggcatgattttattttatcctattcatttttatattatttaattaaactagtatatgtttgtatatttacatatatatgtgcatacacactttaaaaaaaagattttagtttcttgagaacacttcatttttctaaagcacctttagtattactgcaaaattaagaggaaggtacagagatttccataaaacccctcgcttcacacatgaatagcctcttccattataaacattccccaccagagaggtacatttgttataactgatgaacctacattgacacatcattatcacccaaagtctaaaatttatattagagttcattctcggtgttgtgcattctatggttttgaacaaatgtataatgacatgtatccaccattacagtatcatgcagagtagtttcactgttctacaaatcctatgggccctgcctgttcatctctcctttcccccagtggctggcagccactgatctttttactgtctcggtcatttgaccttttccagaatgtcagatagttgaaatcctacagtatgtaaccttttcagattaccttctttcacttggtcatacgcattcaagttctctcatgtcatttcatggcttggtagttcatttcttttcactgcagaataatattccattattggaattaatgaaaacaatatttcattgttttgatgtgtagtgcagtttattcttccgtccaccttctgaaggacatcttggttgttaccaagttctagcaattatgaataaagttgttataaacgtgtttgcctgtttttgtgtatacgtaagtttacaactccttgggtaaacaccagggaacatgattactggatcatatgactagattatgtttagtgttgttagaaactaccaacgtgccttcccaagtgtctaccattttccatccctcccaacaatgaatgagagtttctatatttctcacatccctgctagcatttagtattatcagtgttctggattttggccattctaattcagcattttagattttggtatcttatgatgggagaatatttgcatatccttatttgtcatctgtattaaggtctttggcccttttaaaatcagcttgtttattttcttattgttgagttttaagagctctttgtaaattttggataacaatccttaatcagatcagtattgcaaatattcttccccagtttgtggcttgtcttttcattttcttcacagtgtctttcaaagtagaaattttccatttaatgaaatccagcttgtgaattatttgttccatgaattacacctttggtgttatgtctaaaaaggcatcaccaaacccaaggttatctagattttctacacatttttttaataggattatcaatctttctcaaaattttggatgctcatttgtcttcggttttgcttattatatttttatccttgcaaacaggtttacaattttatttaaaagtatttttatcacttctgaatgttgtagtgaggaaaatttttcataattccaagtcaaaaggaatatattccttttttattttatgtcataatatttcatacttgaatgatcttcaaatttattctatattgttaagtttaagaagcaaggttcagaacagtgtgtataaaatgctttgttttttcttagaatgaggtgtgtatgtattcacacgtgggcacttctatacacattcatatacatttgcacgtttgtctaaaaagatatagagaaaaagaaaggcaatgaaaggataaacctaaacatagtgaaaatggttacctgttgggggtgtgggggcagtaagtaagatagaagcagcaggggtgaaaggagggtcatctgtccaaatatattgcctgttttatagttttggctttggaaccacatagatatttcatgtaatcataaaacaaaattaaatcaaaattaaatacagcaaatcctaaaattaaaaagaaaattaaatacatgaatttaactgcgtatcaagctgatgacttattttaagtgactttatagtaatacaaattacacatctctaggggcatatatcttaagggcagaaaattgaaggaaacaatatttgataatcaaatattagtaatatgatatttttattttgaaaccataaaatttcatgataaagcaaataagtaatcatgttaaaatctccagtaaccaaaatttgtaccataagagcaaagatggacaaatatatccaagatatatttaatttgtatatatttaaaattcaatgaaaaaattactatgaatttatgatatgtatttttatccttcaaaaaatatgtgtatttctagcttggttcaatgaaaagacctagaaatatgaatagcatcctagcagcaagcattaatgggtcccaattgtagtctttgaattccattttccactaagaagagccagggcttttttgaagaaatgtctgattccagatcttgagtaggaaatatgacataagcctgaagcatcttgttataacagaaagtagcagagttaagaaagatggtggggttatgtcataggaactagttagaagaggctaccattggccaacaatgggacaattttagcaagaaaaaaagattgctaggattgaaaatcattaaatatgttcaaaagctgagaatcgtaaggatacaaacaaaaacaaaataaaaaaccacaccgatcacctctggagggtactgggggataaagtcattttcagtactgtaatataaaaagaatcatgtacttatcctatttttcccataaaaactttatttcaaagtaactaaataattaatgagaggaatttattctttatagaaggattttgctaataaatgaagaaagaataatagaattagactaccgcaagtttacaacctttattatttaacataatatctgtaggaaatgatcatcaatggctactaatatcctcaggcgaaacgtggatagggagcaggatactattaatagatagacccaggtggcaacatatgactccactagtgaaacttaacattgcagagggacagccagttgttatatgtcaactgatatggtacaatactaagtacacaacttttaaaaaattgaacttgttcaagccccaacatataccagtttatacagcatacatgaaatagaggaacttattaaatgacatttcaggatgctgtttatcagtctagatgccagaaattctccaagataaatgacccagtttcttgaataagtaataggcgggaaataaaaaggataagggaacttggagattcaaagagaaagaaaatatcaacccaaatgcattattatgtagaccatgtttggatcttactttgaaaaaaccaatactatagtgattggactcatcagggaaattttaacaatgactgagttttagatgatgttaaggaatagttaatgtttcataaatgatattattgtgttccagctaaaaacaattcctatctcttagaaatacaaatgaaaatatttaccagtgaaatgatataatctctggaattcctttgtttttttgagacagagttttgatcttgttgcccaggctggagtgcaatggcacagtctcggctcgctgcaacctctgcctcctggattcaagtgattctcctgtctcagcctcccaagcagctagaattacaggcatgcaccaccatgcctggctaattttatatttttagtagagacggggtttcatcatgttggtcaggagactggtcttgaactcctgacctcaggtgatccagctgccttcacttcccaaagtgctgggattacaggggtgagccaccgcacccggccttctggaattacttttaaataatcctgtgaagggaataaacagaaaagataatttatcttggatgacaagtacatagggttattacaggattttttacatatttgagtgtttgaaattttctattatgaattgttcttaatttaaaaaaatcagctttttaaaattaaattggaatagaatttcataagtcaccaaaataagaactttcttttttttttttgagacagaatctcactctgtcacccaggctggagcgcagtggcacaatcttggctcactgcaacctctgcctcccaggttcaagcaattctcctgcctcagcctcccaagtaactgggactacaggcgcatgccgccacacccagcttactttttgtattttagtaaagacggggtttcaccgtgttgcccaggctggtcttgaactcctgagctcaggcaatctgcccactttggcctcctagagtgctaggattacaggagtaagccaccgtgcctggccaagaactttcataattttaaacctgaacagttgaaatgtgtctatacatttatacctgcagggaagttacagaatttattcagcataaatgttgcagttgctctggaatcaacacatgcttatcttgaaactatgacatgaatctaatagtttttcttatcagtctttctcaaatttatcaataataccggataaacctttgagatagatctaatgctctgtattcttcctatcatacctacctcttaccaaggtcctaatacttgtttttcaggtacagcaggtacagactgtgcagcaggtacaacatgtctatcccgctcaggtgcagtatgtggaaggaagcgatactgtctataccaatggagcaatgtaagtttatatgtggaagtctttttaattcccccactcagagaaaaataatgtacttttgaacacctcccactattcccagattgtttccttgttttcaaagtaattttctactagaacagttattgaaattaagctgatgtttagagcttttgtctatatttattaagaatatgcactcattttcctttcacttaaccccataggatattttaaattatttaaagtcttatgccctttaatagttcttcctatgtagagaaaaaatgtatataccccttgttagtgatatctgtattttaatgatagcttctaaactctatgctttttgttttattatacgaggtcaatttttatgtgatgtatttgcatgtaaatgaatataaaactagtatattaggagtttgggatttttgaacattttcagaatgagatattccacataaaaatgtctgataataaatgttactttcctatctaaacctgccccctgcccgaaaccagcttatctcttttgcatcaacaataatataaatttgtaaatttattttatttgggcttcttggctactttgcaataagatgcagaatgttgttataaataaaggaactaagaattattgtaagtcgcaaggattgtttccaaattgggttttttgtttgcaacctgttggcttcctcggttaacttaaaatgaattcaggttctctcactgactcttctgcccacctcccatcagtgttggtatactccaggatgataacctctgctgtctttattcttactacatctactctttccttgagtgatttcatttatttccgtgatgtcaacctataagttccatggaggcaggactttttttgtttttattcactactgtaataactcaacaccagaagtgtgcatgacatgtgagttcagttgttgttatctattattattataactaaaaacagaattctggttaattttgtattcgttttataattgtgaccaatgtacttaaatattctgagctttttgttattgttaccatggaaggggaaggagaataatttcactcttattgggtttttgcaaggatacaaggaaatatatttaaagtacctaatacagagcctggtacaataatagatgatacaaaactggaagcttttcattgactctggcttctttcttttcttactatatttggtcactgaatctacccacatcactactgcctaacactacctccattacctataaaataaaatctaactttccacactggcattctccgcattcctacctccgccttattttctaccttctaggcataaccaattttgtgcatttttccccaaatattcccctttcatacttctatgtttttggacatgccgttttctctgctgaaatagcattctctgtcttctctcctttcctcccagtctccctaaacccagtctagtgtgatctttatagacagacatgtcactcccttctttgtgacatggaccctgactctccttctctgcagttagcttatccttcccttataaagggcaacattatcccctgacttttacttacagcattgtactgtgaatgcttgtttatgtttcccatagtaggaagaactctccctgaatgcgaacttggcattttgttttatttacatttgcttaggtgattggcacataataaagtcagtaaatttctgttaccgtattaaatctatacctctttacatattttagacacactgtgaatgtttttcactctacttatttgttgtataggtccagggccccctggagcatgattttggaatcttcaccataaacttaaactactgttggcatttataccaaatgaaaaagacgcctgccacttcgacctttatgctctcagggaaaataaatggctttgtagacactgctagaggtcacccagttgtcagttgtcatttcatctttgtctgtgacaagtagtaatgggcacctgcaggggaatgtgagaatgggagtttgtagctttcgtgtctgttgtggtagaatgtgacaagggaaaagggcagttgaaatgggtattgagagagttaattgtatagtacctatcacagttatttctcattttgtactggtcccagctaaggtggagagattagtctgttatgtatgaaatgaagtaccagttgagccgaaaatctgaaatccgaaatactcccaaatctgaaactttttgagcaccaacataatgctcaagggaagtactcatcatgcatttcagattttagattttcagcttaaggatgcccaactggttaagtatataatgcaaatatttcaaaatgtgaaaaaataaaaaattcgaaacactgcttgttccaagcattttggatataggatactcaaactgtaacctcagtttatcaaaagtgctttatgtatcatctaaagagtaggacacactcaatgaacattagttattgctgtaaaattatgcactcattatttgtttacagtttttgctactacttaatgattctaaattctgcatattgtcttgtgcatttttaaactgctttactgctgatattagggtcttccacataataggtaaacatgagttgaatgaattcattcattcataaaaccttagaaaaacagcatttgtaaggtaggttctttaaaactataggacccatttaagtgcagaaatgattcaaagcaaatatttagtgctaacatgtattttctatggcccactagctcagctggttagatcatgactaatgaggtctaggtcatgaggtcatttgtcacaaagtccaattagctttgatctggtctgtgtggactcaaattgtatcctcaactctagccaataatgtcacaaatgtgcacttttggtcaagagggagaagatgcatcttcaaaaacctttcattactatcaaggataatttttgactaaaggttctgtagcatcatttttatacttaataaggaaatgtcattgtgttgccatgaagtatactcaaaattttagcaactagcgaccataagtattttttctcaaataggactagaaaatttttttcagcataagctattttggtctttctgtaattttgtagtgctgacatttgactattataatttttgtctctaatgttcattttagggtctttctatgacttctttttatttggcacacttccatgtacgttaggaaagaatattccatattattctgttctaccacactgaattaacagcaagttagtgtttgatccctgacttggatcacagtcggagtcccacttctgtgtgataataaatgctttttgctaatgatacttccagaagatagggactctgatctttatcatgaacttttgagcacccagtacatggccctacaacctgtgcatgcttagtaagctcgctaatgctcttgtcaccagcgtccccatgtcatgtagccataatgcatggggtctcactcaagaagtgatgacagctctcacagatatgtgtcgtcacttatgaatatgtgtaatcattataatttgatgatactaaaatgtttacccgattctccctgtgaatatggacaattactgccagcataacaggcttaacagtgtgggttagtgagtgagtgtacatttcaattaaacaactgagactgctttacagcactgtgtgttggaatagagtacctttttgctcaagggagaaggtaatttaattacttttgcccctgtttattttatccttgcttctgtaggaacccatgctacatcatttgtgtatttccttgcagtagtttttccaagatttcccaaaggcttgatcatcatctttatttctataaattcttactacttatgatatttaatcaattagaatactatgattaaacctgcttggaaacattgcataccatgtagagagagttcatttcaatggaaatttcttggtgtagctaagaagtttttttttaaaataaaatgatttttttcttcccccactcttttttgactcatacttcccccactcgctcctacatcatgctagtcgaagtggaaacagagacatcatgctgtattatggtcaaattaagaaatctttattttaaaggattttcttatataaaccactctttgaaacttgcccactctttagagataatcagtgttttaaaatgcaaaagtatgcattgtatggatatctgttctagtagtcttcctgtttagattatagatttctcaactccagtacataacttctcataccatgatccattgtacattagtcccttaagagttctgtggttacacaagcagtgaaacactgtgtgattcagtttctcttgagaaccctcaattcctgttacccttttaaaagctctgaaaagtcctatagaaatgcatagaaccagagaatacttgtacctgagtaatatctaataaaatcacatgttatgctttgggaaatggtacactaatatatattgacattgaataatttaaaatccatttttaaagtactatacctatagtcatctcttgaaaatcatgtattaatgcatttttgaagtcatctaattattttcccatacactttaaaagattaataaggaaccttaaaaggaatatttcttcaatctctcaatctcttttcttcctctataagtggaatgtgaaatttcgatatttgcaggtgaaattatgctttcttcttattattcaaatgctgtctccttaagagaaatggttacatggaattctgtaattgagatgcagaggtgctttcttcatttatgcttctacgtatgtacacattctgactggtataggagttgatttgtgaatccacttgccatttagatttcagtaattgtatatgtctggttacatagaaatttcttttggagagaggactgcccttatgtggaaaagaccatggaagggcaccctgttctctctctaatacctaaaacaatggcccatgatcggtgctcaatctatatttgctgaatgaattaaataaaattggcatttaatgatgggtgaaacaggagccgactacttggtggctttaagtaccagggataaaatgaatgaaactgaattgagatactgctgaccacatgcttttcagccccttccaagcttacttgcttctccacattacaatacaattgcccttatcaaggtcattgatgaccttcagttgttaaatctttttttttttaattttattattattatactttaagttttagggtacatgtgcacaatgtgcaggtttgttacatatgtatacatgtgccatgctggtgtgctgcacccattaactcgtcatttagcattaggtatatctcctaatgctatccctcccccatcccccaaccccacaacagtccccagagtgtgatgttccccttcctgtgtccatgtgttctcattgttcaattcccgcctgtgagtgagaacatgcagtgtttggttttttgtccctgcgatagtttgctgagaatgatgatttccagtttcatccatgtccctacaaaggacatgaactcatcattttttatggctgcatagtattctatggtgtgtatgtgccacattttcttaatccagtctattgttgttggacaattgggttggttccaagtgtttgctattgtgaatagtgccgcaataaacatatgtgtgcatgtgtctttatagcagcatgatttataatcctttgggtatgtacccagtaatgggatggctgggtcaaatggtatttctagttctagatccctgaggaatcgccacactgacttccacaatggttgaactagtttacagtctcaccaacagagtaaaagtgtttctatttctccacatcctctccagcacctgttgtttcctgagtttttaaggattgccattctaactggtgtgagatggtatctcattgtggttttgatttgcatttctctgatggccagtgatgatgagcattttttcatgtgtcttttggctacataaatgtcttctttcgagaagtgtctgttcatatccttcgcccactttttgatggggttgtttgtttttttcttgtaaatttgtttgagttcattgcggattctggatattagccctctgtcagatgagtagattgcaaagattttctcccattctgtaggttgtctgttcactctgatggtagtttcttttgctgtgcagaagctctttggttttattagatcccatttgtcaattttggcttttgttgccattgcttttggtgttttagacatgaagtccttgcccatgcttatgtcctgaatggtattgcccaggttttcttctagggtttttatggttttaggtctaacatttaagtctttaatccatcttgaattaatttttgcataaggtgtaaggaagggatccagtttcagctttctacatatggctagccggttttcccagcaccatttattaaatagggaatcctttccccattgcttgtttttgccaggtttgtcaaagatcagatggttgtagatatgcggcattatttctgagggctctgttctgttccgttggtctatatctttgttttggtgccagtaccatgctgttttggttactgtagccttgtagtatagtttgaagtcaggtagtgtgatgcctccagctttgttcttttggcttaggattgacttgccaatgtgggctcttttttggttccatatgaactttaaagtagttttttccaattctgtgaagaaagtcatcggtagcttgatggtgatggcattgaatctataaattaccttgggcagtatggccattttcacgatattgattcttcctacccatgagcatggaatgttcttccatttgtttgtatcctcttttatttcatttttatttcattcttaactgatcacttgtctctcccccactagaatgtaagcttcatgtgggcggggacctggtttgtttgcatcctgttctctgtctaatacctggaacagtggcccatgataggtgctcaatctatatttgttgaatgaattaaagattagcattgaatgatcagtgagacaggagctgactacttggtggctttaagtacacagggaaaaaatgaatgaaactgaattgagatgctgatgtggcattcacacagctttcttatttgttttgttgtgttttttcctctggtgaaaaactttcgagacttaacgtacatgtgtgtggttactcggtttttcttgtttataaatttttatcggtgacttcaaatcaaatcttttataatgccatttctgctaaaattgatttcagtccatatttatttccctgacctctgttgtcagggcaagtgactcatatatgtactgactatgtatatctttttggtatgcttcaaaaaccattatagcactggaaattttggtaatgttatcatgagcaacggccacagaatataaaattcctttttataacagtagactttggggttttttttttaaactcaagtaggctaaaagaattattttattttatttttgagttggagtcttgctctgtcgcccaggctggagtgcagtggtgcgatctcggctcactgcaacctctgccttccaggttcaagcaattctcctgcctcagcctcctgagtagctgggactgcagccacacgccaccacgcccggctaatttttgtattttttagtagagacagggtttcttcatattggccacggtggtctcgaactcctgaccttgtgatctgcctgtcttggcctcccaaagtgttgagattacaggcgtgagccaccgtgcctggcctagaataaattttaaaacactttttccctttcgttcctgtgaaaatcaggtttcataattgtagtatcaactagtacaatggttcccaaagtgtattccccaggctagcagcattcacatcaactgagaacttgttagaaatgccagcttttggtgcccactccagttctacagaattaagaactttaggggtgggacctagctctctgtgttgcaacaggcactccgggtgattctgatgcacattaaaaatgtgagaaccactgttctaccatacagaaataaagaatttaaatgctaagtaaagatgtgccgatccttacaaaataatcataggatggtataaatgattccagtatgctgtacattgtcaacatacatagtaatgaaaatactacacatgaaggagaaaactcagtaagttattacaagaagtattactgacttttaacatttattcttgcatttcctccccagtagctgtagcaatggctgaataaatgctttttgttttttactttttgttatagcagatgaagttagaagaaataagtatgtcttttgaatataagtgaaagcaaatgttttattagtgatattctttagtgtttattactttatatttaacctattcttttttattcttatgtagtaaggggaggtttaatatcaggtcacttgaattcctttctgaagtactgttttccttttggtgtcttccacaaaatagacatgtcatctttctggtgtatcctctgccttcagtctgatgaatattcggatattcagtcttgagaatatctgttttgaaactcatataagtaaataagtagtgcatgcggtccaggcacagattttacatatatatatgcactttgttgaagattccaaataatgtagctacttctttgcagggtattggtggcccatgtaaaaactccataatttgaaactgtttaaggcagaggttcttggtttcaagcaacagaaaccaactctggcctatttaagacaaagaatttattgaaagatgtttgtgactcacagaatttccaggaagtctggagaatcaagctggaaacaggcaggcacaagtgatgtcaggcagcagccagaccatgcacaaaaccgtagcacagagatagtgcagtacagacaccacaccactgcagccatcccaaagactgtctgccattgctacccctgggtactgatcttgtgtcctggccctactgccactgtaaacatgacatgtctcttacagtgtgtcaccatttccattgctttgtgcccctagctccttgtttagagcaagtccacctggttatttgagtcctaagttgatttcctttagcttgtttgtaagggaggttggaaaagccagtacctggcttaaaaatatttgtccctggtttccaaatgcacctcttgtgctctcaaacttttctaagatattaaaaagttgctcattctggctgcctttagttatttcctcagtctagttcaatcagacatataatgccctcactacactgagcaagcttccaataagatcacctcttattattgtatctatttcacaggttccagaatcatcttacatggcccatctcagtcatgggccctgattgcaactccgttttctcatggtgtatttttacctctctggcctcaggactttgtaggttgtctctctggctagaacattgccctacctcctcctacccataaggcctttaccactatcccagcccaaatcaaaatccaaacttcttacaatagtctgtaacagtggcttttaagcttttaaaactatcatccaccgtgagaaaattaggcgtacatttcatactctggtaagtacacacatacatacccaggcattcacacacaaatcatttatgtgtatattctcttacgataaaaacaaaatttctaaaaatgattcttattctcattaagtgtaataagcactgatgttttctagtctagtctagtctcttttttaaatgctgttgtgacctattaaaactaatttcatggcccactactggatcatggcctgcagttaagaaaattgtttacactgcatgcatgtttagtttttaccttccttaacctcatttctttctaacagctttctcatttgttatatctaaaatacttcagacttctaatttccttctaaatatcaggatctttcctgtgttgtgtgctatgttatgagtttttgtactgtcttcctaaaattttattcttcttgttttccatagggctgactccttttcatcttttagtttcaatctaaataaaaaatctggctttcagggataacattccttaactatcctatttggtatgctctctcttatttattctacttttatattgtattttttttttgctttcataggaatgaggaaaacttctaattatcttattttctttctaatttttgcccactttctccttgtgttacgtagccctaataatagtagaggtcatgtctgtgttgttccttttattctaggtgctagaatagatgcttattaaatatttgttaaaagaatgtatgcagagtagcctaaaagcaataaaatgttgtacccatgtgagataatggtcaccatatctatattctatccttataatacaatttatggtatgagatttacatgctattttatttccttaatgtatcactttcatgccattggttgattttatagtgacaagcttattggttggaggacattcaacatcttggtaaaatacaaaataaagaatttagagatactgagtatctggaattgtggataagacacctgaagataaagaaaacagaaaaaaactggttatagctaagataaattgccataatcatcctagtgaataagtaagtagggaatattcagggtcacccttagccaaggtgtatgctaaggcatgatgggaaacaaatggcactaaattactgaattcaatgaatcagagtcctgacatttacatagaaccttataatagagtcagctatgaagaagcttctgtcggcaagtatacacatatcgatgtgttcatattcattactggatacatatgcagaacaatggaaagatttctcttctgctatagaaataatatgacattattttcatgacttagtctatggtaatcaatacagaacaaacaaaatgaacacagcagtatcatttaaatgtgcacagaattgcttggggatttatctatttcaggaatgtacagtccagaaatagttagctgctttcaatctgatatgccaaaaattgagtcgttttcttgaacatatgtttaggaaatttctggagaaaatagtgtgcaagcagtaactcatatgaagaatatattcagtatacaatataaaagatgagctgatctgagatatcagaattagagagtctatttctagtacctaaaaaagaactgtttatttttgccgttggtgcttcttttttaaaataaatttttaagtatttattcaggagcttaaagtatttagacatggaaaaaacctttaggagttacctgttacttgtgcatgactctggctttggctccagggactcgaacaagtgggttcatgcttgccttcttacctttaagggacaatggctaagaatattattattattattttattattattattttttgagatggagtttcgctctgttgcccaggctggagtgcagtggtgtgacctcggctcactgcaacctccacctcccaggttcaagcgattctcctgcctcagcttcagtagctgggattacaggtgcgtgccaccatgcctggctaattttttgtatttttttagtaaagacaaatttcaccgtgtttgccaggctggtctcgaactcctgacctcaggtgatccacccatctcagcctcccaaagtgctgggattatgggcatgaaccaccgcgcctggcccagctaaggatattataatcagcctgtattactcaacccagtgtttgaaagtctcccccatttccaactgcaagtgtatttttgtcaaagccaaattcagacaatttatcacacttcattccttaatataattctgtgctttttctccctaaaaattgctactctttaccccagtgtgtgtttatagagtagccaaggcttctccacagtcgcacgatggagtgatggggatagtttatggattaggcacactctttagtgactttatcccttctcctcttctttggtcattttttagcttatgaactgactttgagggctatatagatatttcatatatctgtgatgcatttttttgcattactgttctttactgagtataatgatacaaagagggcaggcccaaaagctgcagtgatcccttgggatgtttttcttatgatgaggtagcaacttccacgatcatagaacatctaaaattccaatccgaagtggtaagtatcttctgaaatggccctgccttttccatggcttctttacaattgcaagtacatcatctacaggcctcattctgggtaataatggagaatagtgtagtgctagaaaacagtaaagtaagctgtaaggaaatctcaaatagcaacaggaagttcatatggtccctattccacttgttaagctgttccttagtagttgttaacatatatcattgacagatataaaaagttatgttctttttttttgacataatggttgagaatatacattaagtgtagattccagatccatgattcatcagctctgtgctttagactaagtaattcaaccaatccaaacttcagttattcaccttgtatgcgaaataggaattattaatataacagcacctacctcatggagtttatgaaaatttaatgagctaatgcctaaaaagcacatagaatagtgtctgctgcatagtaaatggtcagtaaatattagctatatttagctattattatgttttatttgagaaatctacttactagtagggggcatcctgaatcatcctgcttggatgatgaaaaggaaagggggcaccatgtcccgcatctctcaaagtatttattgttctatatctatttgtacagcttatttgactatacttaaatatcaacattagattgtgctattttaagcacagttaagtggggccactgtcatattcggtagacaaaaattaaaatgacctcatttctcattttatctaaatttgaaaccaacatggctgttttattttattaaataaacatataaataaagaaacaaatgagatttccagttgggaaatatagcagtgatgagaagaatggtacgtgtattttaagtgacatttttctatctggaaaaaaaaaaaaaaaaacattttctatgaatttgtttctatcatcaccccagactaaactttttacctggatttgctgtggctctttctggaaagggctctttacccagtgtggaatactttcagaacactcttattactttactaaaatatatattgtaaattacaagtataatttataatggattaaaagtatttgttttaaattaatcaaaaatcttggagtagtttagcataatttctcatgttttaacaaaataaaagatttgtgatacagaaatttatgaaactggctattacgtctaccatacttttaaatatttttatttgctgactgattagtgtgccagctatgtaccagcaactgtgttaagtgttgagagtactgatgggagtaggaagacttgaggaaattaacaacacattgagagctatgtttcaggaattcaaaggatgttgggaaagtacagaacataaaacataacagtcctgtgaggagtggccatagagggcaaaggatgcagaaaataattttgagataaggtgcttccgttgagagcttaagaatgattaggacaaaggcagggaggtggaataaaatgaaagggcctttcaggcagaggaatccttatgtagtgaagcagaaaggcaagagaaaatggcactttgtcaggaccagaaaaatggtcaatatgatgtgagtgaagagagcatttgataacatggctaataccaagtctcgagattatgtaggcacgaccccctgatgatttttgtaaagtggacaagagttttgaactttttctgaaggcaagagagaatcatggaaaggtttttaagcggttttatttttatatctgcgttacagaaaattctcctggcagcaaagttggagatagattgcaagagcaactgattagagaagggaaaatccattagaaggcaattacaggttgatcatccctaatgcaaaatccaaaatctgaaatgctccaaaatttgaaagtttttgagcagcaacataagatagtgacatctttgctttctcatggttcaatatatactaacttggtgtcatgcacaaaattatttaaaatattttataaaattaccttcacgctatgtgtataaggtgtatatgaaacataattgaatttcatatttagatatgggtcctatccccaagatctctcattttatatatgaaaatattccaaaatctgaaaaaatccaaaatccaaaacacttgtggtcccaagcattgttgataaggtattctcagcctgtataatagagaacattatgaattaaggtagtgtgtatgataatggaaaagagaattggaaaattatttagaagataacattgacaggactcagcaactcatgtcagtcagagggaagagtaagcaataatttccaaagctgaggatggtggtgctgccctctactgagaagcggaagtgtggaagaaagaacaagagaggaatggaatctcatcatacgttaaattttacacagcctcccatatttcatgggagttctgagtagtgatgaccacttggctgttagaaacccagatttaatattcttaaagtataactaggaagtaaagagggcagtgataccaacttatgtaagattgtttactaagagcatgtatatggtaatacagtactttatgtggtaaaggtctttgatctaaataaaaataagagctcaaaatggaaaactcagaaaaatattaatatttgatgtgctagaaaaattggagattccaaaaggctcttgagaggttatggtaaaaagcaaaaagtggaaaaggagagccatagaaactaagggacaaaaaaggttaagacatccaggctttaagatatatataagacagatctgaaaacatatacaccaaactctcaggaatggctagctttaggaggtggcgttgaagataatagcaaaagaactgggaatttcaattttgtatttgaatgtttaaaacctgttctatatatattataacttcttgagaacttagtattttaaaataaaaagttaaaaagatcctcttaaaattgaagttatagtcaattgaaaataaaaatagatgaatcaaataagcttaatcagaacagaaaagggagggaagggtaacatggagtggccaacagtgtcatactatagataggtcacaagagataaggactgacaggagtcttttagcttggtatttagctgtggtcacaagtgaccttattaaaagcagttctaatgaaaggctaagggcagaagcttgactgtagttgttggaaagtggaaagtgaggacatgaagagttagaatagtcatcttataaaggaggagcttaagtgtgaagggaaagagagatatggggagggacttagggtccagggtgagtaaactatttgcttaagatccttatggaggtaagaaagagatccatgatagctcctttagtcatggaggtttattggatgtcacccaggaatgttaagtagtctgagtattagctaagtaggagctaagtcaactactcacactactcctacttattccaggttccagcttttctaaaactgggatttgtagtacattttataagcaattgaagttgttcagcaagatttcttggagggaagagacctgagcttatttatatgctggagataggcaccaggagagggcaaaatctctgtagtacagaaactagttgaggtacttatttaaatgagtggccccttaatttgaaaagtaaatcgaactgtttctgggaatgaagttttgtacaaaatgcgaaacttgccatgttgcaaaggctaagccaaccaatatatttcaattacattcatattagaaaaaaattaataagatgacataaataagctagtaaatttcttttttcttcttcttctaaagccgaacaacaacgtatccttacacagagacacagatgtacagccaaaatactggagggaattactttgatactcaagggagttccgcccaggtgactaccgtggtctcatcccacagtatggtgggcactggtgggattcagatgggcgtcacaggaggacaactcatcagcagctctggaggaacctatctgatcggcaactcaatggagaattctggtcactcagtgacacacacaactcgggcctccccagcgacagtaagtatttgaatttttagtagtttagtttagcttttaatagtctctaatgaacatttcctttgatagagggaaaagaacaacacagatgggactggggcaagaatgtgttggatagttttagtattgagagtttgcagaatgtagtatatgtagtattatgcagaatgttactgatacatatgccctctaatcaggtgaattagagtttttaattttactggcaattagaaaggtgagttttactcattaaactgctggctttaataagctgtcttccatcagtaaaatatcttaaatttatatagaaagaactcactttcatattatgcttactttatgagataaaagccaggcagtaatacagagaataaaatataatttagcttggaattttcacatctttcaacaataatatttatgctagctcatgcccagagaagttatattatgtaagccagcatcccaaaccttagacatgtaagttttgccattttctcatgccacctgtattattattaacttaatatgttttccaagttgactcacttttaaaatagaaaatcgtgtgtaattttttcctaatacatattgaaatcaatatttaaatagtaaagttaaaaatgtttacccatgtgccatatgtaaattcgtgttgcattccaccagagagatactttagaaagcattactataggtgattcagatgaaaaatatttgtgttggctctgatcatagatatgagcaaacagtatcttaggagcatacatatttaagttaaatttaatagattattttaacacagtgggttattgtttggtggttttttgtttttttttttttttttttttgagatgaagtcttactctgtggcccaggctggagtgcaatagtgcaatctcagctcactgcaacctctgccttctgggttcaagtgattctcctgcctcagcctcccaggtagctgggactacagccacatgccaccatgcctggctaatttttgtattttttagtagagatggagtttcaccatgttggccaggctggtctcgaactcctgaccttcggtaacccaccctcctcagcctcccaaagtgctgggattacaggcatgtgagccactgagcccggccaacacaatgtattttagcgtactgaaatgatgtaatagaaatagtcatagaaaattttgcagaatttgatatcatcaaactttgtagcctgaacttctgcttttcacctctactaagcatatgagaatggtcatttagaaccacatagctaaagcagcaatgaaatagattttctaggtattacatataaaagggtgctggggatttgaattaaggagatgtatcccattttatcatttcatcatatagtttgttcttgcaatgaaatagagatagaaataaattggggagaaaatagtaatatgagaagctttatatttctcattttatggattttctccaggatattatatgtgcttggtaagtactttgtatatactttgtgtatttgtagtaatttcatgtgttcctactttcatcattcagtgccttttccctaatttatttttaaaaaactctttattttaattcgctatttgttactaacatcagaacagatgactagctgttctgagcggagagttcctttttgtaatttttttctttgtaattttgaagcatttcttatgtgtatttgttgtctcttccttttaataatattaaatacagtattttaaaccttttagtcacatcagtatatttatgtagattacaaggggattgctactaataaaccatagcttttctggatctcagttcccctatcaataaaataaggggttagttagactaaatgatttcctagtttcctcctagctttagcaccattagatttacaaaggaattataaaatattctaaatgtaaaagtaactatagcttcaacataaaaagaaaagagatagaaaatggtggcagtagtatatagcactcctcctataggccacctagaaaattattttcagtgaaaggaaaataccacttatcaaggccttaggaaaactgaaaaacggggcaaaatttacctttcccactttcatttcatccaccctgtcttatcctaacctaccatccttcgaaaccccattcctttcctacctcacctcttctaggtattcctacttgccttcatgctgattctgatacctgtttaacatcctcatcaactgggtgtgggtttactaaatttacttgctctctcactaaattaaccaaattgtttaatccagctcatgtaaatacagttgcattgctaacctttatagtttgaggattcttcttctattttttttttgataaggtatacactttctatgtaggtatgtatgtatgaaaggtggcattattccttaagttatccattatacaaatttgatgtgtgatttttattatactaactggtaaattaaacagataactgaattataaaaactgggaatagttgaaaactgttacaaaacaccaatttataatatcagttgtacatattaattttatactaaaaatattcatatttgaggttgttttgttaaggataaaaattctaaggtgatttttttttgttttgcgtttttttaaataagaaaattttcctttttaacaaaaggagtataaaaattaaaaaaaaagtaacttttgtatggaaaaatcacaaagtgatctcaccaagcccatattgattgatagtgcggtacttgtctaaatatacttctgctagtgtttattgtattaccttgaattgattattgaaaagtatatttaatttaaatccccgtctcaattgtactgaagatctgcttgactcacagtgaggttgtgattctcagtttacagtttcacatctgttactgtagtaaaattaacaaagttgaagtgccgtgaaacctatttaagatttcatatcatgtgcctcttgccaaatgtgagaaatgctaaccatagatttttgattgttttcactcctaaaaatcaagatttttttttttaggagatgccatgccattaaatgggatttaattgagtttatgtatatttttcttttactgtagaatcagagaaaagattgtatatgaacacaatctttaaagatttgttggtcaagactcaagccatttctttccaaacattgagcctatctgtaccatataagttcagtttttctcactgttctttagtgttcgacatataacctatagaatgactgatgcagcctactgtgcaatagtagcatatactgtggccgaaattcttgactgagaaatagtccgttgggtcactccttagggggctatcagtaagtgtaatgcatagtcaattaattcagttgatgtaaaactagctatgtttgggtacttggaaacagcacaaagcaaacactgttacccagttcctatggcaaagttttctgctccagtccttagaatagttgccttgatgtgataattgccagtgatagactggataaagaaaatatggtacatatacaccatggaatactatgcacccgtaacaaagaacgagatcatgtcctttgcaggaacatggatggtgctggaggccattttccttagcaaactaatgcaggaacagaaaaccaaatactgcatgttctcacttgtaagtggaagctaaatgatgagaatacatggacacatagaggggaacagcacacactgggctttagaggagggtagagggtggcaggagggagaggatcaggaaaaataatgaataataggcttaatacctaggtgatgaaataattggtacaataaatccccatgccacacatttacttatgtaacaaacctgcccatcctgcacaaatacccctgaacttaaaataaaagtttataaagtcagcatttgttaatttggtaacaaattaaattttatatgatgaatatattatatcaactactaatactcaaatttagtcaaaatactatttctcctttgatttactgtttccttttatatggtccatgtgtgtataattatatatatgtatatagatatatacatctatgcttttacttatataaatacatacacatacatttaaaaggcatttcctgcggataatattaaatagcaattttcagaaagatgttataacatttttattgaatcatcactggatatgggttcagctaagttgcgacctgaatatgttagggatctgtttattgttaatatttcagtagcacatggacattaaggtagaagaattggctacagtcataattctgaactcattatacatctgtcttctaactatatcaacataatatttccctctgcttttattcatttgaaattctaagtattttcatgattatttttctatataatcacatcatttatagaattttagagttttggaacctgaacatacttttcacttgaagattaaaaatttgtgaatgtagttagtgattttttttggtgctcatcacaacataatttatcttataccagagtatgcaataattaccaacttgctttaaaaagccttatttactcactcttacataaaataatatttttattcttataattagatggttatgtatgagttttttaaattcttcttaatacttaagattacattaatcatttttgagaccgtgatatgaaagttaatttttacacctttatgtatatacatttaaatgggctgttgctaacattagatcccagccaagaggcacaagaaaaatatcttgaaattaatattgttcatattcccacctcttttgattaatgtaaaatattataatttatttaattatttggaggaaaatttgaaagtccatctgctgctatataagtaaaagtttggcctagtttatataattaatagaaagttaagaattcatttaagaattatgagtgcttttatttatttattcttggtttggcatgtttatgaatttggtgtaagggaatgctttttctaagagtataaatatgtttagctcttcaaaataattttaccttcttattcttttgctgctacgttaccaatggccatgtgtttgatttcaaaattttaatttatttatacgaattagttatacattcttaagttgcacattcaaaagatataagaaagtacatgagtctctctcacccgtttcccaattctcatccttagaggcaaccagtattaccaagttctctcttatttttttatttattgatttttgattttttttgagatggagtctcactctgccacccaggctggagtgcagtggcgtgatctcggctcactgcaacctccacctcccgtgttcaagcgattctcccacctcagccttccttgtagctgggattacaggtgtccgccaccatgcttggctaattttttgtatttttagtagagacggtgtttcaccatgtttgccacactggtctcaaactcctgacctcaggtgatctgcccgcctcagcctcccaaagtgctgggattacaggcatgagccaccactccctgccaccaagttttttaagtattattctaacaatattctagcagaatattcaagcagaatatatattttttcactccctctctcttttttttttttttacacaaatggtaagaaaaatgccgcatcttgctttttttcacctaacaatatgtcttggagactttttgtttcatattagcacacgaagaactcccttatatttaagggaaatgattatattagaaggagctgaattgcccatctatcttaccagaggaaaaaatgttgaaataatattggattattggttatgactacatcgagacagaaaagcaatatagttacatgagatgaacgcttctgtttaattatcatatatgaagatatgcttagaagaaattttaagttagaagtatgcataaattatgcataaatcacagttcttattttatgtgacaaaacagtaatttctatttaaaataatttactaagttttacagttagcctcaatattttttaaaaaaagactctgtccacttattttggcaggaacatgtatcaccattatgatcttagctttttctgttttcctgtgtccctttttccctaggccaactcagtccctgaaatgaaactcctcagacagattaccatgaaccgtctgtttcctacactaaatcataaattgactgaaggttctgggcctcattttcaaagcatttaataaaatgggactttgaatgacttgtagtctccatcacttcatctgtattccattcagctgtcagtcagttccacactgctccagcctcgaagctgataagatctagaggcagtaattttaccattagggctgtaagacattccactcctagaaatcttgataaactagcaggttaagacaaagagaatcacagcatccttcattctctcctgagcatagccagtgaattcctctgaattttaaagcaaaatataatgaattattttattttttagctacttcatatttgaaacagcatttcagaacacaggtgtatgggtaacatgccagaaaaagctagattctatgtcatacaagatctagataagcaaagtttaatgatgctcataaattctacttataaatattaaagtaacctgtacctcaggcaacctcttatatatcttttgcttgatccttccttagatttacaagtcaagtttcacgttaagttacttgtttgaaactaacataatttttaaagaaaaaaactccaccaacttaatgcttcacttataaaaattagataatccagataaaatatgaaatgcattgctacagattaaaatattaatacattgtagtctaagagtgacatatgagtcaatattagactcagaaagtttcaatactgcctcttctactggcccatgtgtttaatttaaaggggaaaaatacgacacagtgcctatgaccaattgtcagttctctgagaaagaatttctccatgttcctgtgcatattagttcatcccccaaagcatgtgatttgattaccactttctcagtacatgtaactccagttgttgtctttatttgccacagaattatctggtttcctttaaactctaattatggcatttgattgtaactattggtggcagtaaatttcatgacataggagttttgtaatctacggacttagaaataattttacacatacacttaaaatttactaagtgtaagtttgagtgactttttcatctgtcttataggaaaggaagatgtgatgtttaattgtgctttcaaaattacaggaaagatgcagttaggcaaaagaaaggaaatacaaattcaaagggaggtaaagaggtcagaacttgtagatgatgtgattgtgtacttgataaaaatcatagagaatgaaattaaaaactataacaactaataagacattttagtaaggtggcagtacaatttttttttctttcgagatggagtctcactctgtcacccaggctggagtgcagtggcacaatctcagctcactgtaacctccacctcctgggttcaagcgattctcctatctcagcctccctagtaactgggattacaggtacctgccaccaaacccagctaatcttttgtatttttagtggagacagggtttcatcatgttggctgggttggtcttgaactcctgacctcaagtgatccacctgcctcggcctcccaaagtgctgggattacaggcctgagccaccgcacccagccacaaaattaatacacaaataaatcaatagcttttctagatagttagaaaatataatggaaacaaagatctcatttataataaaaacaaaaaatgcctggcaacaaactaataataagtgtgcaagatccaattgctgaataaaaaacacctaaagttcgccagggatacaaaaggaaacttgaataactggaaaggcataccatattcttggataagaaatttcaatattaaacatttaacctccctaagttaacataaaatgtttcaacataatctcaatcataataccaatagtttttttgacaagaaaggctgttcatgtaaataaacttgcaagaatttatagaaaattttgtaaaaagaaaaataatgagggatggggtggagggaaacaacctatcagatattaaaatgtatataaaattataataattaaaacaattatctaagcacatgaatagactagtaaatgaaagactagagaccaagtaggccaaatgcatgcaggaatattgtatatattaaaggaggcattgcctgtgagttgagaagtcatggattatcagtaaatgatatttggaacaactgaatatttatatatttataaaagaaaattagattggttcatatattagtctttatatcaaaattaatttcacttggatagaaaagtgtgttttatcattagagtgggaagcataatataaaatccagaagctataagaaaaatattgataaactcagttatgtaaaggtgaaaacatcctgctgagaaaaccacaataaacaaaggcaatggtgaaacaacaaactggcataaagttttgaggtattatactcaaaggactaattttttaaatttatagaccactcttacaaattcatcagaaaaaataacaaaaacagagcaagtacaagaacaggcagtccaatgaaaaggaagtgaaaaataaactacaaagaaataccacctttcatcccatacaagcaatgcggaagaggttggtaagccttgccaagtgtgcaaggaaataggtactctcaatcatgattgatgggaatctaaattggcacagaattggagagcaatgtggaaattttttatcaaaattaaaaatacacatatcctctgactcagtcagtgtgcttccgggaatttaccatactgataatactgttatgtatatgaaatgctacataaaaactatatttgttgtagacttatttgtaatagaaaaagattggggtcgggggcggtggctcacgtgtgtaatcccagcagtttgggagcctgaggcgggtggatcacctgaggtcaggagttcgagaccagcctgaccaacatggtgaaaaccccatctccactaaaaatagaaaaattagctgggtttggtggcacatgcctgtaatctcagctacttgggaggctgaggcaggagaatcgctttgaacctaggaggtggagtttgcagtgggccaagatcacgccattgtactccagcctaggcaacagagactctgtctcaaaaaagaaaaagactggaaactgccttatccatcagcagggaaatatgcaaataaacgttagtacttttatctcttaagtggaattacatgtagcccctagataatgaggctatatatatatatatatatatatatatatatatatatatatatgctatgtagcatgcattatatgtatatataggcacatatgtgtgtgtatgtatgtatatatatgcacacacacatatgtacacatttatatgaaaaaagtctccatgttgagcgaaaaagcagagtagtgtgtgtgtgtgtaaatagaaacacatattactatgtgcttatataagatatcctaaagtttttttttttgtttttttttatggagggggtgggacagtcttgctgtgtcacctaggctggaacgcggtggtttgatctcggctcactgcaacctctgactcccaggttcaagtgattctcctgcctcatcctcccaagtagctgagtacaggcatgcgccaccacacccggctagcttttgtaatttttggtagacatggggtttccctgttttggccaggctggtctcaaactcctggcctcaagtgatccgcctgcctcagcttcccaaagtgctgggactacaggcgtgagccaccacgcccagccaatcctaaagatgtctttaggaaggatacatgaagaataaaaggtgggaggcatgtgaatatattatctattaaaaaaaagaagtcacttgttatttttaaaaattttggacaagctcttaatgattatacattatatctatttggtcatattccccaaatgcatgtagataaagcaaatcctttatgtgcccagtattaatattgtctgtgaggtgtcacagttcacattaaaccctgatcctaggtttcagataaagtcctcatttattagactgttgaaagtttagacagtgaaaactggcatttaattcatttgaaatttttagagccattcttactgttcaacattttggaatgaaagttgatgtttgtatttgtatttatgtattgagaatctgagtttttttttttttttcggtcactgactttctcaaacatttattgaggtattactgttgaccaggcactgtgcttctgtgaatttgaagacttaacagtatgggctaatggagctagttcctgcactgaaaggtacctaatcctgtaaggcaaaaatacaaattcacaaatagcctccagacttctttttagggttagtttcaactactttcttgccacattattttttaaatcacaaatgttcatatgttatcaattgattaattttagatttatcaaaattgtgcttaccttctgataatattgcttatacaagttcaaaattgcctaaagattgggcaggattggatagcaagagagtgaaagagaatcatgaatgcaaataatacttaagattgcagaatcaccctttaattagagttaactggcaccattgtgggaatgtccgttacctacctatttatattcccttaagtagtcattgcagtctgactctggcaatgaaaaaaaaaaagatcatgttttagtgaaactgttttcaaacttgagtgtgcatcctctggagcattgattaaaacacatctctggatctcaccccaatgactttcgattcagtcagtgtgggcaagggccccttgcatttccaacaagtgcccaggggatactgaaaatgctggtccaagaccacactttaaaagcctgttttagtgattacggagactaactacaaagtgaaaatgttcttatactcagaataaactgcaaaatgcagagaccatttgaaaatgtaagatggagtttaaatcctattatttaattctaacccagcaaatttctgaggggtaattccaactcccaagtgcttttgtacttgatgtctcagaaactagttttatcgtcacagactcataggcttctagtgagggtgggggaatctgggctccacagaataatcaaagaagtccaaaaagacaatcttgatttcaacccagcatcccaaaataagccaaatgttctcagaacacattcaatttataaggtttcttaggcaaccgtttttctccccgctatgaaaatgttaagaataacttcaggttacaactttggtacaaaattgccaaaatttcaggttgaaagcataataacttaatttttttctctagacgtcataaaattatcagtgaatagaaaggaaaagatttcatgtatttgaacatttataaaaccttagaaaagattttgtctttagctactttctggttaaagaggacatgaaaagccaagctggctagatttgctttctgggcttttttttttttttaattttaattttaattttttaattattattttactttaatttctagggtacatgtgcacaacgtacatgtttcttacatatgtatacatgtgccatgttggtgtgctgcacccgttaactcgtcatttacattaggtatatctcctaatgctatccctccccgctccctccaccccacagcagtgcccggagtgtgatgttccccttcctgtgtccatgtgttctcattgttcagttcccacctatgagtgagaacatgtggtgtttggatttctgtccttgcactagtttgctcagaatgatggtttctagcttcatccatgtctctacaaaggacatgaactcatccttttttatggttgcatagtattccatggtgtatatgtgccacattttcttaatccagtctatcactgatggacatttgggttggttccaagactttgctattgtgaatagtgctgcagtaaacatacgtgtgcatgtgtctttatagcagcatgatttatactcctttgggtacgtacccagtaatgggatggctgggtcaaatggtatttctagttctagatccctgaggaatcgccacactgtctttcacaatggttaaactagcttacagtcccaccaacagtgtaaaagtgttcctatttctccacatcctctccagcacctgttgtttcctgactttttaatgatcgccattctaactggtgtgagatggttatctcattgtggttatgatttgcatttctctgatggccagtgatgatgagcattttttcatgtgtctattggctgcataaatgtcttcttttgagaagtgtctgttcatatcctttgcccactttttgatggggttgtttgattttgtcttgtaaatttgttttaagttctttgtagattctggatattagccctttgtcagatgggtagattgtaaaaattttctcccattctgtaggttgtctgttcactctgatggtagtttcttttgctgtgcagaagctctttagttttattagaacccatttgtcaattttggcttttgttgccattgcttttggtgttttagtcatgaagtccttgcccatgcctatgtcctgaatggtattgcctaggttttcttctagggcttttacagttttaggtctaacatttaagtctttaatccatcttgaattaatttttgcataaggtgtaaggaagagatccagtttcagctttctacatgtggctagccagttttcccagcaccatttattaaatagggaatcctttccccatttcttgcttttgtcaaatttgtcaaagatcagatggttatagatgtgtggtattatttctgagggctctattctgttccattggtctatatctctgttttggttccagtaccatgctgttttggttactgtagccttgtagtatagtttgaagtcaggtagcatgatgcctccagctttgttcttttggcttaggattgtctgggcaatgcgggctcttttttggttccatatgaactttaaagtagttttttccaattctgtgaagaaagtcagtagtagtttgatggggatggcattgaatctataaattaccttgggcagtatggccattttcacgatattgattcttcctatccatggttatggaatattcttccatttatttgtgtcttcttttatttcgttgagcagtagtttgtagttctccttgaagaggtccttcacatcccttataagttggattcctaggtattttattctctttgatgcaattgtgaatgggagttcattcatgatttggctctctgtcattggtgtataggaatgcttgtgatttttgcacattgattttgtagcctgagactttgctgaagttgcttatcagcttaaggagattttgggctgagacaatggggttttctaaatatacaatcatgtcatctgcaaacagggacaatttgacttcctcttttcctaattgaatactctttatttctttctcttgcctgattgccatggccagaacttccaacactatgttgaataggagcggtgagagagggtatccctgtcttgtgccagttttcaaagggaatgattccagtttttgcccattcagtatgatattcgttgtgggtttgtcataaatagctcttattattttgagatacgtcccatcaatacctagtttattgagattttttagcatgaagggccattgaattttgtcaaaggcgttttctgcatctattgagataatcatatggtttttgtctttggttctttttatatgctggattacgtttattgatttgcatatgttgaaccagccttgcatcccagggatgaagccaacttgatagtggtagatagggttttagatgtactgctggattcagtttgccaatattttattgaggatttttgcatcgatgttcatcagcgatattgatctaaaattctttttttttattgtgtccctgccagcctttggtatcaggatgatgttggcctcataaaatgaattagggaggattccctctttttctattgattggaatagtttcagaaggaatggtaccagctcctctttgtacctctagtagaattcggctgtgactctgtctggtcctggactttttttggttggtaggctattagttattgcctcaatttcggaacctgttattggtctattcagggatttaacttcttcctgatttagtcttgggagggtgtatgtgtccaggaatttatccatttcttctagattttctagtttatttgcatagtggtgtttatagtattttctgatggtagtttgtatttctatgagatcggtggtgatatcccctttatcattttttattgcatctatctgattcttgtctcttttcttctttattagtcttgctagcagtctatcaattttgttgatcttttcaaaaagccagctcctggattcattgattttttgaagggtttttttgtgtgtctatctccttcagttctgctctgatcttagttatttcttgccttctgctagcttttgaatgtgtttgttcttgcttctctagttcttttaattgtgatgttagggtgtcaattttagatctttcctgctttctcttgtgggcatttagtgctataaatttctctctacacactgctttaaatgtgtcctagaggttctggtatgttgtgtctttgttctcattggtttcaaagaatacctttatttctgccttcatttcgtatgtacccagtagtcattcaggagcaggttgttcagtttccatgtagttgagcagttttgagtgagtttcttaatcctgagttctagtttgattgcactgtggtctgagagacagtttgttataatttctgttcttttacatttgctgaggagtgctttacttccaactatgtggtcaattttggaataagtgtgatgtgatgctgagaagaatgtatattctgttgatttggggtggagagttctgtagatgtctattaggtctgcttggtgcagagctgagttcaattcctggatatccttgttaactttctgtctcgttgatctgtctaatgttgacagtggggtgctaaagtctcccattattattgtgtggatgtctaagtctctttgtaggtctctaaggacttgctttatgaatctgggtgctcctattttgggtgcatatatatttaggatagttagcccttcttgttgaattgatctctttaccattatgtaatggccctgtttgtctcttttggtctttgtggtttaaagtctgttttatcagagactagaattgcaacccctgcttttttttttgttttccatttgcttggtagatcttccttcatccctttattttgagcctatgtgtgtctctgtacatgagatggttctcctgaatacagcacgctgatgggtcttgagtctttatccaatttgccagtctgtgtcttttaactggggcatttggcccatttacatttaaggttaatatagttatgtgtgaatttgatcctgtcattatgatgttagctggttattttgctcgttagttgatgcagtttcttcctagcatcgatggtctttacaatctggcatgtttttgcagtggctggtaccagttatttgtttccatgttcagtgcttccttcagcagctcttgtaaggcaggcctggtggtgacaaagtctctcagcatttgcttgtctgtaatggattttttttctctttcacttatgaagcttagtttggctggatatgaaattctggtttgaaaattcttttctttaagaatgttaaatattggcccccactgtcttctggcttgtagagtttctgccaagagatccgctgttagtctgatgggcttccctttgtgggtaacccgacctttctctctggctgcccttaatattttttcctttgtttcaactttggtgaatctgacaattatgtgtcttggagttgttcttctcgaggagtatctttgtggcgttctctgtatttcctgaatttgaatgttggcctgcctcgttcaattggggaagttctcctggataatatccgaagagtgctttccaacttggttccattctccccatcactttcaggtacaccaatcagacgtagatttgctcttttcacatagtcccatatttcttggaggctttgttcgtttctttttactctgttttttctaaacttctcttctcgcttcacttcattcatttgatcttcagtcactgataccctttcttccacttaatcaaatcggctactgaagcttgtgcatccttcacgtagttctcatgccatggttttcagctccatcaggtcatttaaggatttctctagactgtttattctagttagccattcgtctaatcttttttcaaggtttttagcttctttgtgatgggttcgaacatcctcctttagctcagagaagtttgttattgccgatcgtctgaagtcttcttctctcaactcgtcaaaattattctccatccagctttgttccgttgctggcggggagctgcgttcctttggaggagaagaagcactttgatttttagaattttcagcttttctgctctggtttctccccatctttgtggttttatctacctttggtctttgttgatggtgacttacagatggagttttggtgtggacgtcctttctgtttgttagttttccttctaacagtcaggaccctcagctgcaggtctgttggagtttgctggaggtccattccagaccctgtttgtttgggtatcaccagtggagtctgcagaacagcaaatattgcagaacggcagatgttgctgcctgattgttcctctggaagcttcgtctcagaggagcacctggctgtatgaggtgtcagtcggcccctactgggaagtgtctctcagttacgctacttggtggtcagggacccacttgaggaggcaatctgtccgttcttagatcttaaattctgtgctgggagaaccactactctcttcaaagctgtcagacagggacatttaagtctgcagaagtttctgctgccttttgttcagctatgccctgcccacagaagtggagtctacagaggcaggcaggcctccttgatctgcggtgggctccaccaagttggagcttccaggccgctttgtttacctactcaaacctaagcaatggcggacgcccctctcccagcctcactgccaccttgcagttcaatctcagactggtgtgctagcagtgagcgaggctccatgggcgtgggaccccctgagccaggcatgagatataatctcctggtgtgctgtttgctcagttggaaatgcagaaatcacccgtcttctgcgttgctcacaatgggagctgcagactggagctgttcctattcggccatcttggaacctcaatccccctgctttttttttttttttaattgaggattaaaagaacagtttatcccgaatctctcagttaagctacttcttgacattgctgtggaagtaatgtatttgcatattgtttgaatatacagcttttaacagtacatagctggaaccttagcttgattgatggtgtttctgtatatatctgctgggtctgcagagctcaaggaacactctggagatccttcgaagaaggtttccattgactagatgggaactgatactgtttcagctgcttattacagggtatttgaagttttaaagccacaaactacaatgagaaatacctttacattgtggcccaatactcactcatatgtacatacatatattcatgagtgcacatctacatacaaacatgtgactatgtatatacatgtacatgtatacatatgactgaaactaaagtttcatgaagcaatacttatccatactgtgtgcagttaactctggttattttctactctattcagttaggtttttagaaatgctggtcagtacctacattattaattctgtaacccattagttgcaccttacattctgaaaaacactgctttgggcaaatgaaacaggaggttagagcatttacaatacatgtatgaaaggcctggggacagagtctccattgtagaggtttgttttgtttggcatttcttttttgggggagtaggggggtgggcagagtcttgctctgttgcccaggctggcttgcagtggtgcaatcttggctcactggaacctctgcctcccagattcaagcgattgtcctgcctcagcctcccgagtagctgggataacaggcgcccacccacacccagctaattttttatatttttagtagagatgaggttttgccatgttggccaggctggtcttgaactcctaacctcaggtgatccacctgtcttggcctcccaaagtgctgggattacaggtgagagccaccacgcccggtcttgtttagcatttctaacaggtacccaaatgattttgatactgctggttcaggaccacattttgaacaaccgcaattttagtgattatagagactaaatgcaaaagggaagtgttctttcttttgttgttcctggttgaatggcttcctataggatgtaccctcctcttcacacacaccaggaggctgtcatttcacacaggtgtgagtggtggctacatgctgatgccagccatcacaattcccttttctaaacataagtctccaagtagaaatgttctgtcttacctgatctcaagatgcaaaccaggtagaaatgtttttgtcttacctgatttcaaatacaaacaaaatttaaagtcctgaagatcagaagagaaattacccagaaagaaattcctggttttaagtgtatcctcttcattaagtttctctaaaaaatttacagttttcacaggaaaacagaaatgctatgtctctgagaaagtactcactgatgatgttaacagagtaacttgtattaacaagaaaatgcaattgttatacattaggtaactgtttttataattaaaatttaactatctagttaaaactttttattgcctagtaacttcatcattttacatcatttttgagtaacgtttatcgatcatatttaaatttttccagttagaaagtaaattgttaacagtaaatcatttagcaaattttgattttataagccactcactcctcagaagataacttcattacaacaatttgaaatatttccactttgtttatattcattttatatttgtatatgatggcaatgatgttgaatttaagcatgataaatcttggatttcaatttcatagttaatacccaagaaagttctacacatctcaagaaaatccatcaatcccacatagtctcaggtttctaatctgttaaaaaggagataatattccttacctttactattttacaaagttgttgtgaagataaagtgagaattaatatagaaaccctttataattcataaagcattgtactattccattttcaaatcactgtaacagttctagaaaagaaagtttctaccatgaaaccaattttaattacagtgatagttgaatatatcaatattgacctttactcttttaacaaaagattaaaaagccatttcagagtcgagagaacatgccttgacctataaagacaataaataagatgatataattgttctttttcttcctgccttattagcatataagggaatgacaggttaatatttacattaagagagagttctaattgtccgtatatatgatattctgtttgggacattgcatagatgtgtatgtaaccaacatgtccaggggagcctcttttggttccatgtaaatcatacaaaagactcaacacctcttcccattttgctgcatttcaaactgaggtttaccttcttggcattatcaactgcccctaaatgatccctgtgctccagccagtctcgattacttgtactagaagcatctgcaagtggcataggttttactgaagattttgcaggggaaagcactgttcaggatcacaccctctaaaagacggtcacacaaagcctcttttgtaccaccttgttctccccactctgtccttttattctgccagtgatcctccaccttcagtctttccaggtctgggatcattccgtctcctctaaatctcagaatctctcaatgctccagtgaacacttaaacctgagagcaactctgcaaaacaaagggccatcctatgagaaggactctcctttagaaggcaatggggacttaaaatagggaaaatgcattcccttataataggaaaaatatgttcccttataatagggaaaatgtgttttttcttttctattacatttttcttttcacaatatgtattgcctttgaaaaaatgtaatattgatcccttctttgaacatgggaagagaacacaagcacaacgtttattggacatcatttgaccctctcctccccacccccattctcttttccccctggcttaggttaagacttttctccaaaatctcttttttgatgctgatttttggacagatgtggcacaagcctcagggtggctcttgaatgcttggagactgtctgcctgtccttcattccaacaaggcagcattagcatcttggtgattggggaagttttcagcctgagttttaggccacggatttattgcactgtctctgtctcccaggagataataggtgccctgtaccctacaggttcttcctagaagggttgctatatctttgttggagctccactaatctttgtgttttttctccctggtgtgaaatacgacatctcccttgccctttctgaattcctaatcctaattcctgagaaatcatggaagttcccttcactgctgtagtctgtcacaaaatatgcatgcttggcatactcaaaagaaatgacgttctctgtcgtacagaatctatgcatttttcttgaatctacctgacaagaacaaaggccaggtgattgtttgtatggtcatatttttatcacatttgtgaccgtactactttgtacaacggaagcaaattaattggtatagtctctagctctccaggcttagtgtggagatcgtcttgcccaaatgaaggcaactcctgggattgtgtctttcaaggattcaaagtttggttagtggagctgactcacatatgtatttgctgtaattctccagttcctctctggtgctccaaatattttctcatagcaacccatacaccttcccctctttcttcactcaattgaactcactcacagcaacagtcatggcatgggggtgggtcatctctactctctgatgaaatctaatttactctgaataggtttcattgtaaaccactctctcagcaagttgctccaaccaggtttgatttttctatttatgttccatagcactttgtcgtatgacatcttgcaaagagatcttttcatgttcctgctaatatgtggtcagaaatctggcatgtaaattggcatgtaatgtggaagtttattatgtgaactttgactcttgaacctttgccaggctttgagaccacatataattcctaaggctgggcaacttttcatcgtcttttatcacttttctgccccagagaccagccactctgacatttcagcagtctgtctaaaggcagtgctgaatccccctcttcatcttctgaaaatatttctggcttccagtagcactgaatggagggttcccatctttggctgagaaccaacaatggctcaccccaccatttgatcttacaggagttgccatagagtcttatctgattgtgaggcagtagtccaggaccttcatgaaccagtcttaattcccaagcactatgtatcctaacgttagataatcatagggaggaggtgtacactattagtgactcagtcccagggtgatcatttaatagattacatataggcagtgtatcttagttcagagaattgattttttaaataataaacaaggatattttcatagcctaaagctttgtaagtttaaagaaaaaaatggagaatgtttactatccccatttttaatggaaaaaatgaactttttaatcttaaaagaaaattggttctgtaccattaagtaaaaaaaggcagaagaagattttaaaaaattgaaagaatctaagagaaaggaaaaagagaggaaggagcaacgctcaagaagagagatatcactgaggctttgcattagtctaacttaggttgtcacaaggcctcttgttaatgtgattacagtactttgcactacagttgaaatttcaataacaaaatgatctgtattcttagaataaagactatgcggcagagaaatgagcaggaaaaacattttagaatctattcatgtcaatgtgtttgatatgtgtatttgaaatgttctaatcacatagtgatgaaataaaggccattgtgttcatttcaagtaaaaatacagcactaccaagccttctcccttagactcccacctttagagctgtgatttgaaaatatgtttgtattcatccctttcattctcactgcagtgttatcaccagtttctcacctcaatcctggactattatgatagcttccaagttggttttcctgtctagattctctcctatcctacattatatcccaaattattaataatatatgaagtgatgtcagattaattccctttctcaagactttttaacagtggcccacatcctatataattgaacactcctagccacaaagttgcagtctgtatatatttacctatccctaaaggaaccttatcatttggccaattgtattagttcattttcatgctgctgaaaaagacatacacgagactgggcaatttacaaaggaaagcggtttaatgtatagctcacagttcatcgtggctggggaagcctcacagtcatggcagaaggcaagaaggagcaagtcacatcttatgtggatggtggcaggcaaaaagagagcttgggcagagaaactcccgtttttaaaaccatgaaatctcatgagatcgattcattatcaggaaaacagcacaggaaagacccgcccccattatgcagtcatctcccaccaggtccctcccacaacacatgggaattatgggaactacaagattagatttgtgtggggacacagacccaaaccatattaccaatcttacccttccttgaacctacattgtgcaatcttatcttgtttgctttgcctaaaatgttcactaacctgcccttatcagaatgccaggtattatttgtcaattttcttttttttttaattattattatactttaagttttagggtacatgtgcacaacctgcaggtttgttacatatgtatacatgtgccatgttggtgtgctgcacccattaattcgtcatttagcattaggtatgtctcctaatggtatccctcccccctccccccaccccacaacagtccccggtgtgtgatgttccccttcctgtgtcatatttgtcaattttctactaaagaactgccttacccatgctctgtcaaactgtaacagcaagaagtaatttcccttccttccagtaatattcaattatttaattcattcagtttgcctttaatcacttacatatttatgaaactctgctagtttaacgaatttcccactatcagcagcacacaccatagttgcactgggagaggaatagtgttgattttattcttatacttaaaaaaaatcttgaatttgaatcagttttaaattctagctgactcgtaacctaatcatttttgttgcatgaagctatggggatataatatctttgttgaggttaggagcatttcctcagatgatatatgagaatatcacattgaacacttgggccagtaatcttttggatcaatgagcctacttttaagcaaattttccatcggtgttaactgatcatcatttcctaccttaaatatgacagtcatgagtattgtggtaaaacatcatttagtgttacgtatatttctacctagcagaatttataaatttttcctaatgaatgaacttaactttttaagtgatccacaataaactggaagcatgtgatcttaccagttcactttgggattagtgttttaggtgtcaaatgctgatgtgtgccatttttttcttgagattggtaaactctcagaaggttgaacaaatatttacttaaatatctaacctacaataatggaaaatttaacaaatcaatttaatctttgatgagactggtagaaacttatcctaattcactaacattttatctagctaatttgcacactattcctctgtccctctacccaacctctccccatatgcataaaactacccccttgaaactatgataaacccaaatcatgggctaattcgtaggagtgacattagtaatccatttggaatcatgcaactagttaatccttcatatctttgtaatttcaaaggctcattattactcttcttccccatttctgcattattcctcttgcctcttcctcaccctcactttcccaccgttgtcatgatatattcctatgaatgatagtgtcttcctttactgttgtcccagagcttctattcaatccacaagcatttattgggcacactttgctttcacctattttaaccttactactagcatggccccattatacctagcaaaacccttctcctggctttatctgaaaattagcatttttcatacatccctacactttcctcaaaaccttaatgacattgctttttccctgattcccgcatacattatctacttccaacctattttttcagcctcactcataccactcccatatatacatgaaatgtatatttatagctcatgccctacaaactaggtttcttgccatttcccaaatatggacacagcctgtgctttcttgcctcctggctctattaagtcgattcttcctagatttcccttttaccccctgaacacttccatcttttaatacatgggttttgaattcagagagtctgtaaactaagaaaataaatgtgaattttgtaggtgttcttatatatattttttccaagtagagagttcacagttttcattacatcctcaaaagggttaaagactcctcaaaagttaaagactactactcttattttcttccacctttctgaactatgcttgtatttttgttacaagtagtcttgtttggcatattagtccgttctcatgctgctgataaagacatatctgagactgggtaatttataaagaaaaagaggtttaatggactcacagttccatgtgtctggggagacctcacaatcatggcagaaggcaaaagactcatcttacatggcagcaggcaagagagaatgagagccaagcaaaaggggaaaccctttataaagccatcagatctcgtgagacttactcactaccacaagaacagtattggggaaaccacccccatgattcagttacctcccactggctccctcccacaacatgttagaattgtgggagctacaattcaagatgagatttgggtggggacagagacatataatttggtaattatgcatttattcatatatatgaccatgtgtataccctgtctctcttactggattgtaatgtctattggattatgaaaaatttttgtaatcatgatcttttgcacacaaccttatatatgacagtcacacagttactatgtacttaaaaaagaaaagaaactgttttttaaaaaatgtaatcagggctatgatcctttcatgagattggaattcccttcaataaatttttaaaatgaatataataaatacatgttaattttttgtatgcttctcggaagttcttatcagtgaggtggtaactaaatggcctggttatcccattggactaattaataagccttaaagatttcatgagtatttagtatttggaagcccgtgggtttccaagtaggttccaacatgcatgctgaggctggtgtcttccttgtagaagaactcagtctttatttcttgcttgtcctatcattccatatttcttcctttccattccccgggctacacaaattcggcacaggcctaagtcagttaggcagaagattcctaaagccaaaagaaataccccttttgttatctgtgttacaaagtgacacaaagaagaaccgaaattctgaaggtccaaggcattctagaatgtcagtgtatctgttcctggggaatccattttcacccacatatttccttgcacctttccaaagctcttaaaaaactgtccagaaatgagaaggccatttcctaaaagcctggccttctagggaatcatctggaaatctaggaccactataaaataacagcttcaataacagaagcagatctctgacttttttttttttcccagaaaaagaagtgctggtttatccaactgaaaagtgcttattaacaaactgagagcatggacttctcctttagtgttgctcagcaattatgtatctggtaatttacctttcattaaaaattataatatcaaaagttacagatcattttatttatatttactagactgaaatcttacctcaaattctctgcactcaaactttaaagaaaatataggtataatggcaaattagggttttgagcaaattcttcctataagtgaattgtagtcatatgaatcctttgacttgttttctgctctgttttctctttgaaaaaaaagcacttattgatcatgttttaagagatgttataccaaagtcctttatagtttcacagtttaacattttggtaaaatgtttgttcattcattacatttacattactctttctgtaatatatctcttttcatttgtgcagtatcactattttcaagtatagtggtaaactgcattaacatccattctggcagagagaatgttgtagaagcctatgtttctagaagcctgtgtttcttagaagagaatgattaagaagtttacttaattttgttgtctaaaaaaagttaacagtaggataaattgtattacatcttcctatgaattaatttaatatctattttaagaatttttttatgatttcttaacctaacatactcttttcagtattatgttttattaactccagggaagaattagcaacgtgggaaaataatgtaaaataaaattaaagctattaacttctaagttgtttagaagaaaattagatttaatgttggtataattgatactgagtattttgtgtataaagtgttttaccataaagaaattggaaacttgggagaaaattaagactttgctatagatattactgcattatttttctttgggagggggcagtatgttaaaatttgaaggcattatcaatttccatagtcaaagtataagaaagttaaatatgttttaaagctctaaatatttttataactgcttatactgaattgttgatgtaatcagactgttaagaataatgaaatcaattttctctcttaaattgcatggtgtgatttttttcttttgaatttagctaatattgttaatatagctcagtatccaaatacatggtgttcagtacctgtttttaatgcaacatgcaatactaccaggagttgaaagatagataactttaaatatgaggttattaagagtgtatcacatttatcactaacacctggtacttaattaataatcgtacatggtatgctgagatttcacagattagagctgtttctgtgattgtcccttctctttgttgtctctgaattattttctcttcttcattccatttctgctgtcatttctaatatttctgccttaacaccacatcgtaaaatataatgtagggaccatcattttacttcttcatatttgttcatactgatgaccccctacttccatattttaatacaggattaatggagggatgtatggatttagtaacttttggacattaatgaaagaatctttgttcatttgcattaaaatattaatgcatattaaactcaaaatctgcggtatgattttcctttcgtgagagaatagcactaatattaaatactctttaggtgggagacgatttagaaagagaatagttactatcccatatcctgaactatgaaagtcaagaatgtttattcataagaagaaaaatccaccagggtccctgctcttcaggtctccattctgattataattatggaatgttcaaaaaaggtttactttgtgaatgggcttattattagtgtgcatatttttattttgttctctggagggtggggaagaaggggagaaaacacattaagtggcaactgttcattaacgaccgttgaggaagaagttggactttaaagaatctatcagaaattctctggtcagccttttattactatcttgtcttgagccctttttttaatgacatctattatcagattgaaatggcgattgagacgctgcaaaagtctgacggtctgtccactcacagaagctctcttctcaacagccatgtaagttgcctcttcttcatgtacactaatctcttgcttgttctgcatgtgttgcttgcctctaaatgcttgttttatttatttacttatttattttgcttcttaaccttcccttctcagccccttatgatctctgtgtcatttaatggctattttgtacagtgaaatatccaaaaaatagagtctccagtataatttattaggtttctgtactctttgggtacagatataatattttcgagttagtaacaagttgccatgtatttgtacaaagtaataatagtgattttcaatatttaaaatgttccagtttgatatttatttactatgaagcaaatacttgtaatctgcatctctgtcaaacagccatgtctacttgcgtgaccagtaatgttctttaagtagaaaaaggatgattaatgtgaaatccaatgataaactgtttgaaaatgatttgtttaccagtaagactatgtaaggtgggcagtaaacaaccccatagttgaattcaggtcctaagacctaaagagaagtaaaagtgaaccaaaagaaaaagtgagactgtctacaagccataaattgctaataattgagataaaactaccattactatgccctgaagctgtttcctgttatcagatgcagatatcactatgacactggtaagtgtaagaagggtgatgatagttttgtgaaattataaacatttttatcagctgttctcatgtgggaaaccaatgaaaatgctgaataaaaatttgttttgttaagatgatttctgaatatatggaaaaaagtaaatagacccatggtgtaaattcattttagatatatcttctgctaacttaacattagtgacattttagtttagaattttctcccacaactgacaatttgttcttaaatttagggataaagtattatgacttcttatttctttttcatattttataactgaaaagctcgatattggatcacccaaataagaccatttttttcaataaacctaaaacttttactcatagaaaatgttttaactgtgttttttttaagtatttgatctttgaaaaattttaattttatatcttaaaatagcactaattacctccttatgttcttacactttgtttttagatggggtattttgtcttgtttcttttttcaaaggaaagtatcatggaaaacaaaaccaggttagccaacttggagaatgcctataaatttggtgacaaattatacatacaaacttaaacatgatagtatatattctggcccttccttttgaaagagtttaagaaatataagttttttcatttctgaaaattggtatttagtatgtcactcttttatgtttcgtaagtatattcctgctatgttggcatgtatctgtgattgcattaaaggctgatttcctgtatactactaggctgtgtgtgtccggggggtgatgattaacttatatttatgctttgaaaatgggaagtgaaattgttcttccttttagtcacaaatgtgcaaggacataagaaaaaaaaaaacctgaagtttccagttacctgtttcagctttcagacttccaagttgtgctttcatattcaactcagggttcatttttacttgacatgaataacttagtaaaatatgttatatgtttaattttaaatttaacttcagttattcatcttagtatttttatgaacaataatggaagtataagaacatgtttcttatatattttaaaaatgtatttgttgatttgtttgaagcttttcaactgttagagatttttaacaattatttttctttatagaattcatgaaagaatgtttaagattaataaatgtttgaattaagctgcataaacaatgacaaatatttattacttcatggcttcattttttttattacataatatgtctgatcttccatactgctaacaactcccagagacacttcagtatgtggaaagagtgggcgcaaatgttgattgtgcagtggtaatctttctccaactatcctgattcatttttattacaccttgaggcacagtgaagttcattcaaaaatatatttatagtcaaatatttagaaacaaaaatgattctacggatggtttataaacagtggagaaaggatcagtgcttctactgactgatcagtgaggttagtttcttcctaaacacagaaaaagatcctgttgtctttttcctccctggaaagttgatgatgcttttaatgtttctgagatttatcaaaaacaactggaatttgctagtgcatgcattctggttgataactatttgctaaaagtattttacattctgtgaatttaactggtgtttttatgttgtgtagaattttttcagtggagagatggagttttttaaaaaaattgttgttaatattttaaatgttagtaaactatgttacctttatttctcactatatggggcataatatagaattatttgaggtttgtgggattctttaaggtgaacatgaattccgctttatgatgattagttccctgatttatcactgtctccaaaggatcaattttattatgtaaaaacattgggagaaattattgataataatttgcatcccgtattttacctgtttctaaggagaggtgttaatcatgacttttgggtgaaaagtctattctcattctattttggaatatggataagcaaagacttcctattttctgtttctgtatttgcttattcacagtaattttaaaaactcttattaggactaaataagataaataatcccctcagcagaatccaacttgattgctttgctttacacctttccacactttagaagatggggtgaggtattgaattttctaccccattttcaacatattcttaagagaattaacatggtgggagttattttagtaccagcatctctaataggcatttagtaagtatttattgcaagtggtagttccaagaaagtaaggatttttgtatgttttgttcaccagtgcatccctagtgcctagaacagtgcctggtacatagtagatactcactaaatatttgctgaatgaataaaaagaaacaatagaagggatcaggccttatgttaccttcattatttaggaattctaggatgcctttgccaatcatgtgtacatttattgtattgtttcttttcaagtttgcttcaagtagatatatatgtgaacatcgttggtaaagggtggtcttcttctggtataccatctgagtaaagaatgtatggtcactcaattatttctctatatgcagccttcagtttaagagtaaataactctttttttcctctaaacaatctcatcttttaaaaagatcttgccaagagtgactttgtttttctcctggtattttagaatggtactttagatttggttttacagaattctattagtctaataattttttatttaaatatttttgtttctaatttttttatatatgaagatgctacagtatgagatgtatagtctgcctaaatgaaattaaaatatttaattcttttcattgcagacaagattattttatactttttcttggtgttaattaatatgaattagtatttaatggttgtggtgtgttcacttatttacaaactacttattttacattgtaaatttgaattcagaaatgttgttaattgttcccaataatcgcatgaaatttaaggttgtacatttctttaaaattccatttaaagtttatgaaaagctctagccgtctattttatgtacttctcacaatctagcaaataattatttcctgttgtttgctggttttagctaccaaaatacatttagctcaaagcaaaaccttgttttttactcacttttccttgactttgctgtattgtaaatataagttattacagaaataaggcctgtcaaaatgcatatcgttagtaaactgaacttaaaatgaatcctgatgggtaataatccatctgggaaaaaatgacaaatgttacatttagatgttaattgggcaatgcaatatttatttctttttatttgtcaatcaggatttccctttgggaaaaacaggaaccattcatctttagtctatcttgattaatacagattaaatgcaaaggttgaaagatgcaattatcttcgtttccaccattaaatgagtgtatattagttcataagtagagtaatcaagttttaaagataaaggttaaaagttcctatgttattttatgggcttttgaaatcattcctatggtattttatgggcttttgaagtcagcatacattttacaagacattttataaaagagcaaaagatataataattgtttcgttctaaattattgaatgttaagattggggaatactaatgtccaaatacattgtattaaagacaaaacccaagaaaacgatatttaacaggcattaacttcccttgggtagctcatggagcctgtgcctttaggttgcacttaaacttacacaaaaacttaactgccaagtttctcttacagtcaaagtaatgcttcctaatactatgttttagacacaaatgtctgatttataattccatcactgtgtcaaaacgtaaaagttaaatactggcgtataggatggagattataatccccagccacatctcaaagtcttgtctggtggatccttttaaatcaatttctgttaatacagtgaatttctaggcgatctagcccgaggtgggttagtttttggcagtcttcctagctgggacctgcagggctacagcaaagccatctccatcctttcagggcttttacctccacttgacttccttattctctctcaacctgctctccaggcatctggcaaggaatacagttcctccttctgcatacaacgggtagggaacaaaacgtagctttgctagtgtcaaagtgatagtcatcaaaatacctgttcttgtaccatttttcaaactaactagtgatttatataaatatatatgtatatgcatatatacatataaacaaactgattttttgaactagtttagaaatgaagaatttaaacagaatttcttcagtttaagaatataaactatataagaagaacaatcagtttataaaacggtgcagattttttgacttacctagccatttcagtggcctgcatagccaatcgagtaaaagcttcacttcttgtaaattattcaattgggatataagtaatatcatttaggcttctaagtagtttgtgccaacgtttgctgtaattatctcactatttctatgaaaagttttctttatgaagagtggtctgattaacccatatatatatataaaaatgtaaatataccattggactcaaaatattttatattaaactttaatatttgtactagcttttacttttataaaaggtaatttacagtatccttcaaatattctattattggattttctttttcaaattttgtagtaaaaattttaatctacaagataattcctatgatcatgaaaaataagtaagctctcatttttacatgtttgtcttatttttaagtaatttaatgttgcaagaagactagtacacaagtagggcagttttttaaatgttttatttgtttctggttaattaaaatttttttaatttgcttttatcagactaaaattacatcagatctgtttttattatttgtatacttttggttgtaaagttcatattataagattgactaattccatttctttaaaaaaatgccctttaaatgaagatttttctatatgatatgtcttctgttcattagcaaaggaagcaatattgagttctttactcagaacaaatcatgctattatacctttgacaatatgcattattttatgaggatatgtagatgtacttacaaacatatctttggcatttttaacttacacatattgtgtgttccatgcttgtggatgtggaaacttcattagtttagttgaaaaatactactctgtttcaaaaagtatttacattttttatgtctgcctttccagaatttttttctttcgtgtcttctttatagtccttgatatcaagaacctatatgcccttctttaatatattaagactgccactagaaggtggtcaacccttgctctgtctagtatatgtacacaaaacaagaaccagcactgttgtacaatacagctcactagggctgccataacatcactcaagtgcttcccaatctcaatcattttaccaaagcatgtggataaaatatatgaatcaggattttattgctgcattttatgtgtagtctccctcagctatacttaaaactaataaagtcttaaaaaaaaaacactaaagagacatgctgtccccctgttgtaggcaaaatactaatttgaacctcagtaacttaatttcccaatcagactgccttatctcttttatactaaatgaatatgtgtagcaaacctattctgtgtgtcacttagaatactcagaaatcatgtttaagcgcccctggaaaacttgtttactgacaatcaagttatagatgattcataacaaaagaattattttggcctgtaatacttttatgtcattgtaaaaacaaatgtttattttgtgtaatctttttaaacttctataggtcagccttgtatatgttaagaggtattatgcatgtttaaatgtgcatattcattcgtatatgtgtcctgtgaaggacttcaagtctttctgatcaaaatctgaattttatttttaaaagtactctggtttgtcttgtagatttggtggctatgttttcaaagccaactatcaatatgggtttaatgacataagtttaattacataaacatcatgtaggaatatttgacattaaaatggtttttggaaattcagttgtcatgactaaagtcagtaattctgaaaatatttttaatgaatttttaaattaaaagtctgaaaattcaggttctaagtttgattgcaaatcttaaaatatgtaagtaaaatggagaaattttttatttatttaaatgtccatattatttttagcatttcattggaaattcctagaggacaaggatgagatcacattcatttttgcatcactagatgcctggcacattacttggctcatggttggtgctcaataaatgaattctttggcttctataatttataataacttgaattgcaagttaaatgtcagctctttattacacctgtcttacatatggcatgaaaatttttgttgacacaagtaatgtgaaatatttactgcttttgtgaaacattggtctggagtaatcaggaaatgtgaattggaaaccagactcaggcatggagacaatatgtgactttgagaaagttatttaagtctatttcagttctgcttttataaataaataaatgaacaaaagatttaattttgttaatgttaaaattcaataatatagacttggattcaattttctaaaattttcttgtacattcagtgctttaaagatttttttgtaatgtacacaggataacataaaactttagaatgtgaacatagactgaaaaagtattgtgttaccaactatcattgcagtgtgccttccagaataatgaataaacacagttttgaggtagaaaaattaaaatggttgtaataaatgattccttttcattacatgtaaactctttgccaatgtcttgtcagtttattttcatttggggaagaaacgactgaattttgtcttttctgctttcagaatctgtcgcagtagacaatattgttattatctagtggtaatttgagataaattaaaattctataaaaaggaatgtaactttaatataaacactcataccaggcagcctgctgttcatatgttataataagccaacactaaagacatactgtttaccatgctaccaggcttggtaacatattttgttctgtggcaatcatatttctgatatttatgaccagttaacgggattatttgaactccttgaagtggtgtctattttcaaaattggaatcaatacagggaaaattagtatgtctctacgtgtgcttgaatatttgaagaaatggatattgtctgagatccttagtgatgttcagctatttacagtgtttctgagcgttttcaaaggcagattaccaccttctgaattatagcagtttactctatcataagacttgatgaagaacttctaagtatttctgtatgttgcatttgcagtgtcttgtagaaattttggcaaattatgtgatttgtctgtgtttattgtgtcttatttccctagctccagtggctgttggacaattatgagacagcagaaggagtgagccttcccagaagcactctgtacaaccactaccttcgacactgtcaggaacacaaactggacccagtcaatgctgcctcttttggaaaattaataagatcaatttttatggggctacgaaccaggagattgggcactaggttagtattgaaaaataagatcataaactaatctctctttttcaaactagggcaattcaatatattgtttaaacaaaagtacttgattacagacaatatataaggaaatacatagaatgagctcagtttataacatccccaggaaaaggaaaggacattattcagtgacttctttccaagccacaattatatgttgtctaaaacatgaactgagcaaagctttgagaagagctgattctcaaactacatagaaattagcagaccaacctgttaatgcaagatttgcatatggtgctttaaaacacacacaaacacatacacacacacacgcacataaaaatgtattctcttattgaaagaaatcatactaatgatgatgagttaagtgacatagtaaatggaaaactatgtatcacttgactcttgaaaaattacatttgtctttataaataactgttgggatagagtaagaaactaaagcagttttttcatttcatttctggaggccagttaaaaatcatttggtaaacttgcaaaatattgtttaaattcctcagtgatgagatagctctattttacctcttattagcccctacttttttttctgctcttaatatgaaaccatgtgtatgtggaaggaaaaacatagtatagttcaattgaattgaaacaatgtgaagaagttgtttctggtttttcttcctttggaaataaatatgagtgttttcactaaccaaaatatcatgaaaagaatacttagaactctggggcttcatttttgtctttccatatttctataaattatcataagataaatattttaagtagctggacagaaggatatggatgtttttaatttcctaaatcttatagaaatcacataaaaagttaaaatagagatactgtactatacaacattaggtgatatacccttaattagctataaagcacaacttcagagtattttcgtaaagagtttttttttttttttttttttttttttttttttttttgagatggagtctcactctgtttctgttgccaggctggagtgcagtggcacgatctcagctcactgcaacctctgcctcgcaggttcaaatgattctcctgccttagcctcccaagtagctgagactacaggtgtgtgccaccacgtccagctaattattgtatttttagtagagatggggtttcaccatgttagtccagatggtctccatctcttttgtgatccacctgcctcggcctcccaaagtgaagagtttttaatcttaataaaataaacacagccttccttagtaattgacttcattaaaaatgtataccaaaaagaggagtgagtgttgtaggaagaaaagattgatctttttctcaccaccacaagactcatggctaggacccctataacgaaagattaacaacagaaaaggatacaaatttgtttaatataagttttacatgactgggagctttcaaaaatgatggcccaaagaaacagagagaactgtatgtattttatgcagtctgatgaagtggatagttctggagaaacatgattggacagaaaggggtatgatctaatggttctaggggtatgatctaatggttctaatctgggggaaactcagcaaggtctgttttgttttgttttgttttgttttgttttgttttgttttgtttttgtttttgttttgttttttgagaaggattctcgctctgttgcccaggctggagtgcagtgccccaatctcagctcactgcaacctctgccccccgggttcaagtgattcttcctgcctcagcctcccgagtaacccggattacaggcaccaccccactccaccacgcccagataatttttgtgtttttagtagagatggggtttcgccatgttggccaggctggtctcaaactcctgaccttaggtgatctgcccgcctcagcctcccagagtgctggtgttataggcgtgagccaccgcacccagcccagcaaggcctgtttgttcagatttttctgcatccctgtgtcttcaaaaataagaacgttcttttctgcaaggtataggaggacccctctggaatgagggtctcatgacctattttcaggagaaagtaagctaggttttatggcctgcttcagaggagaaggagtgaggggaattttttctggtttctgtggcccgcttctgttgtttcttcaaatgccaaggtgccatagtttgggatagcatgtcctaaaccccttcactgtgtcagttttatgagatttacaaggcctgtatgtattagcatgaattattgcttttctgtagcattttaagtgattatacagcttttggattgctgaaggtttagctctctcataaatatgtttccttctttctgtacttcaaaagatagtatattttaaactgaagaatgtgattgtctattcacactaaaggaatagttttcattcccttgagaaaactttttgtttctatagtactttttttcaaaaccacaaaaatcattatttggggacctaacctactatctcctcgctggtggctctgtagttatgcataccgtgccaatattttgaaactctgggctttattcaacattctaatagctgtattgttgtccttcttttgttactgaaaggaatttcaatgggtcctattttgaggctccattcaaacgttgaaacaagtctttaaaatagaaagggacaaaattggggttgtttggttttgtgaatgagtagaatccatactctgtaagtacgtattgcaatattgccgcttttactttctgatgttctgggttcctcccacccccaactaggtaacaattatgaattatgtctcctgtttttttttttttaattgtatgtagtgtttacagttatgtttgtgaagcaaaccctagaaaaataaggagaaaataagtactatggagggagtttaaagaaatgaagtgctatgaagacagaattctaatgtaaaaaaactgacaattgtaggagtgaggtactagacattctttctaccatagaaactgtttagcatttactttctactcctaatccaaggaacagatggaaaattaatataaatcatgaggcaaattaaatacttttttttaaaatgaactatatgtagaactattattaatattatctatcaataaaataatctggtgaaaccactcaaaccagaaccagatcttttctaaagtttttggacctaagtaaacaaaaagtaaatcaaatcactgttttaaacaaaggcaaataaaaaggtaccttttattagatcccatctccaagttaaatttgagtaaagaagaccatggatatgcttctctcccccaaccattcccaatgaaataaaaagaacctctccctcccaacccaattaaaatgttaatttgtaggaaaccaaaaagaaactcagcactccatctatttgaggtctcacaagagagacatcattttcctctgtagttttgtcctgtaagtaatgtctcctgcttcctaccgtacctctactccctactgtcctccagcttgtacaggagaacgccacaaattgggtatgtggaattttttggttttgcttattgcaccattctgcagtggatttttgagacaagatctaatctctgcaagtagaagacctttctttacgggcgttaagtttctctatctgctttattgtgctgaaagcatgtaggtatttggatgccctgcattttttaaaaactggcaatataatttatatagtataattttaatgtcttcaaatatatataaggttcatttaatatatgtttttaaatcttggaagtgcaattctgctctatttttataaaaaatatttaatccacactcttcttgcatttctttttgtaaatggaagaaaaaattggaaaaagtgctgatgtattgctatatatggacttgtgaaaaactactattttctctttgcaataatttacatatttaaaatgatattttgcaagaatttgcaaattccattcagagcaaaactttgtcatttctaatagcaaacatggtctttctcatgaacatggggaaattgtgacatttttattccaggtggaaatttgccattttcatagagaaatttccccatctcttctgtgacaaatcctgtttagcctgcaaaactaacacaaatccataaaaacagaaactaataaaatgtgtttcaaaatcaacagattaaaggcttactttctttttaggtttcaaaatattaagtaagtctttaccacaacattttgtaacagacaattaagttatcttacttcatcatcactgaagtaaagagaaaaatgtcaaacttatccaggaaagtagaattaagattttttctttgttctatatacatgctttacaataaatacgtattccattgactaatttttattggcctgttaactaatttttactggccaaaaacttttttcctatcattacccttcttaactaaatttaaaatagaaatttgaaaatggaatgtaatttgtatggaacaaatggactgtttgactaatatttaagtggaagtttataaacaaatatttttagcagggcctttagctgattgatttggaatcttattttgattcttcaaattttatcaccataaaaacataaaagtattcagaacaggttaatcataaatatgtaacattaacttactgtttttaccaaatttttccaagtgtgaagtttaatggacatcccatgtgattaatattagtttgactgacttttgtttctaatgtttcttgttcattaatgaagaggaaactccaaataccactactatgggattcgtgtcaagccagattcccctcttaatcgtctgcaagaagacatgcagtatatggctatgagacaacaacccatgcaacagaaacaaaggtagactctgaagttatcattgatgtgtccaagctatgtatttcttagttgttcgggtctccttttttctgaacaaatacctaagtataaaagaacgttcttattgttggcatgctttcactacagatagttcttaaatatgatttagaatttcagtgatctcgcctgttttccaaatttttaaaaagtacttatcagtcagccgtttggccccttttaagtgtgacatcccaaactgttcagacagggaaatgaaacacaaaacataaggagcatacccaagcaaataccaactggagaaatttgtttcagtattcatgagcttctgacttgctattctgcacatctctcaagtcattctttttgacacagtatgaattcttgcagaatgtttgggatgccttacatttgctttgaatccaactttcatagatacagaattgctgatattagagttgtaagagatctcaagcattcatgaatggatggatgaatgatggatggatggacgtatggacggatggatggacggatgaatagaatcatagatcttagatttgaaaaatatgtcagtctagtctggctttaaaaccttatgacaatcaaagcattaatagtttctgttttttcagatgagtcccagagaggttaaatgatttgcacaagcacaaaataaagttgcatagctaagggccttctagtcccatgtgacttatgtcacaatttagagtaaacaaaatgaaaaaatcctttcctctttaccagcatagctcaaccaagacagaagttatgatttttcttttcaagtgagcatgcagaattaggtaggagaaaggaggcctctgcataggtcccagtgtaatgatctgtagtgattagttgccttggccacatctccctatccatgctagtttagtcagaagcattaactctaagataatgtctgagaaaagaatatatcacacagtaattttatactatttagtcagccaatactgatgttaagccctgcatgcagagataagacacagttcttatgtttgaagagttaaaaaattagaaggggaggcacatggagaatggaaaaaaaatggaatacagtctgggaagtgctaaaataaaactttgatcaaggaactatcacaatacagaggagttttcggcaatatctgggagaaagggagattgggaagtttctagagaaagtgctctttgagtaggaacttagaggagtcataaaaagagaaatattgaagcagaaggaaaattcacctagcggtgaagtccatgatgtctgtggtaaatggtccatgacatatttattgaggctggtattacagaaggagaatcaaggaggtggttgagtagtttagtgggagatgagatcttaaaagtagtttggatcatatattaagggatttgcttgtatgtaaagctaataagtttgttctttgtgcagaacatagctttgaagctatgtaaggctttgaagcaaaacaatgaaactttgattttttctagagagatgactttttgattttgggcaagacatatttaatggaaagagactggaggtaaggatccttgttcagtggctttttacacagtcataatttccagtgtaagtgcaccagactgaagactcagttcaaggttggctattatataaaagatatcttaaaggttttagattttttattacagattctcaatcttatttttttattgctgattcttattttttgatgtgtagccagtgaaaaataagaagggctctgaaaaaaataataaaataaattatagaatagtacctcatagagttggatagtacctcatagagtttgtgtgagttgcaataaattgttactattttgggttatgattgctttttgcatctgttaatggcagcacttgtagcctttactttttggtgtgatttctgcactcatgcatagcaccactacacagtggagatgatggtgaaatcaagaaaaagaaagtttgcttcagaaataacatatactcaaacttaagtatgaataaaaacttaataaattatacctaagacagttgaagcccattatttgactgcaaggaatttcctgtgatttaactgccaggaattctagcaagctttcatagaaatagaagccttcaagggacattctttataaaaaaaacctgagttacataagtaaggcccagtactttctgtggtctcctcatgaaacagattctataaagattagcaagccataaaaacctctgcattctcaggatagtggtacttgagtttggaaacagataaaatatggagacatttcagaaatgatataagaatctcagtagtattaataaattgaatttgattcttatttcttacgaaacaggaatgtgaaagaaccaaagaagtactgaaacttcctttaatttgttgtgtttttttaatgatacaagtttaggattatagacagttgctcttaaaatgatgtcttgctaactgattgcagtgttactgttgccaattgcatgggcctctcttatagggcagcaggagtcttctgtggtctctctgaaggaatctgtccactgacaacattgataagccttaactgaaaccagttaccctgttgtgcagaaatatttagacaggaaagaaggagtttcttttcatgggtgtggacataaactaatttaagaatatttgttgaaaacagtgggaaaagaacttcttaaaaatatattttatggcttaaaaaaattttcaatttcaaaattcaaatgattctactgaatacagtaaaaattatataaagagactgccagtctcttgtaaaaatacaaatgacatgtgaaaggtttaaagtataaaatagaagatatttcaaaatattcacgttgtttgaatacttgaaggtttattaaatgcatccatgtgtgcttatctttcataatgtaaatttgttttatatgttcttatagtgaagaaatgcaagtctatgcagtgattattttgttaattaaatataacttttggagctcaattgtacatttttctcatgaatttggaattatagtcattgtagggataagaatgattattgtttttatatagctcacaatttcttgagctcctttatacaaggtgtcacttgaaggtttgatggggtggtagaggaaatctccatttatctataaatccaattcccagcaataccactgtatggaacatagccatgagtcggaaaataaatgtaaacagcttctgattggaaagcagatgtcatagagcctgcagtttcagttagttgaaaagataaagccattctcaagccattttacctaaaataaaggagattagagcccacttgattcacaggcagtcatgaactatgacagctgccaagaagaaatacaagtagacagggtcttctgtttaaaattattcagtacaacagtttgtggacactccgtggaggggcaaatggacctaggcactccagtaaatatttcaaatatcactctaatgactaaaatctagcctaacacaatataacaactgctttgcatattgatggcattatgggtaatcaaggggaggtaaaataccatggttaaggaggcaggagactgtgtaacagtttttttaaaaaaaacttctattgaaaatacttcatatgaaaataatttttttgcactaaaatgaagtaatcttcagtttttgacgaaatgcactcatagactaatttgtttaccctaatttagataataagtaagttagattattatagagcaaaaaggacatcagtaatttccacctcttcaaactaagtaacagtatttgctgcagtttatttttgataatgaaaagaagtacacagagagtattggcatgtatattttagatatttttccaaattccagtagtaaaagccaaatgcttttgttaatatgcttggctgtgtttgatcccagtagccattctcaaaatattaaatgtcatttatcatttcttcaacaaatacttatcagttgttatttgcatacacaatctgtcaatcacatctaaaagacataacacagaatcatagaatgttagagaaggaaggaagaaatcacctagtccaacttatcctgttgatgagaaaaccgaagtccataaaggttaaataacttatccacagtcatatagcaaccaggttaagaactcttgtctttattctcatgagaattccaccctcaaagaggtaagataacccaaacagaaatacacgtaataaaatttttgcatatgaaataaagggagaaatcacattttaatgagtatgtttcaagtaactgaggaaatgtgccacctcctgcctctttgcatggtctcttcacagcaattggattctgtgaaagaataaacctttctttcacaggatgtgaagtaagaatgtcacttaagaagagagaagaagaggtcatttggaaagatggtacagcaagcctacttttgttttggctgtagatagatgtaaaagcatgcacgttcttttagaagtgagagaggaaatttaagaacttttatcattagatggcctttcttaatatagggttcatagactagttaaacgaaccctatatttagaattggaaaatggggaattgagtacaggctacataggcacttctgcagagtgtatgacttaacttcactgagcctcagtttcttcatctgcaaaatagaaattcataatagactatctcacagattgttttgaagttcaagtggaataacgtatctgaaaatttttttaataactggaagtgttaaagtgttagataattattattaggatcattattatatgatgagcactacagaaaaatatctttcttatgggatatttagtgttttggaggagaatgaagcctggcaattggtcagattgggcttccatttctctatacctctaggctagtggtttctaactttgattgatgttaatagtttatcattcctttcctagacattaattccctggtgatgtaatgataatcttttctattgaagagaggagaaacataaataatcacaactcaataactaccaaactatagtaatttatgtagtttgttaataataacagtcaccacttatgctcctgagtagtatttgtggaacatttaaaatatttttcagtaaacacattacatgcaagatctcattggcaattatattgttacttactgataaggaaactgaggaccacttaattttgctgtattcaagaagctcactaatttatttcttcctagatagaacctcagttgccttttttgttgttgttattgtttatctcttggcatcagatggagccagattgtcattcttcaaataaagaaggtgggaaagggtaagagataaaagaagtgtcatgcatacttgtagcaagaatatatcagttctatacagctaaccataaaccacctatgcttagaggactcaatgaagaaattcatgagatcagagaatcatgtctgcctctttcagcactgcatcctcagcacctgggagagctctaagcacattgtcggtgctctctaaatatttgttaaatgaatgaatgacccacaactctgattttcgccagcagcttcaacctcctcctttacctgctgcagttaacatatagcccatttcaatttaattttttccacctcttcttgcccgattatagatgtaaagctaatgaagagacaaatactcagagagccaccaacaagaatggaagagatggaatacctatcattaaccagcatggttgatgttagaagtcatttgcatatattatcagtatattcagtgtaacatcaaaattagctactattctaaaagagtggaactcttcatatttactattttcttctgatccattagcgtttatatcacttggttcatttcagacatgaagtcatctaaagactttctgggacagttttttccaaagagattacaagattccagtagaaaattctagcctcctgcccttgttctgagctcagtatttcaatttattcatgcaaataaaatgattgtgtaatttctggaattacaaaacataatgatgtctccttttgcctatacagtttatattttgtgtttgcatgtgcatttttcagccactttgaaaggattttccaaatgtttcatttaatctgtagaaaatccttccacctggtgctgttagttgaatgtaatggtaaatatataccattctttgccttccattggactgttttagtacccatgtgtgtgggattgacagaatattacttttacagtagagttacaactgtccaagtcctaaatagcagctgtgactaaccccatggaggaagattcctaattattttctaagttttctgtgttagtgacaggttttatgcatacagtcagctattaaagcatgagagtttcttttatttcttaatcattaacaactttagcactgattacccattgagttgcaagctgttaaaattatcatttgcctcttactaattttgaaaccaagtgctgtttcattatttgataaagcacaggtctttctcagagcacactcaatgaaagagtactaagagtttactctgggaaaaccaaatctaaaaataattaattcataaagtaaatggaagtaaagggaggaaaatactcttaaatattaaaaagttcagtatttttaaaggattcaacaggaaggtttttgtttgactttttttttttcaatggaaatcttacctgttttttaaaatttattattctcctgatatggtagatttgataaagtttatggtgattattttatgaagagtatagagaatcagaaaatctacaagtcatgtttcaatgctataatgtcagttgaaattcaaccaaggttaacataatgtagaattactatgtaagccaatagaatataaaagacatcttggaaaaattatatttatacccagcattttaaaaaccatgtgcctatagtggcctacccataatacagtatgtgctcaataaatatttgttaaattgatttgatatatatacaaaatcagttgatgatatgataaaatcaagcatgttaccttaaacatttattcattcaaatatatttattgtacattccaaatatagtttattgagaaaagttaaaaattaatgacttattttgtttaaaatgatgtttttctaatattaattgatgtatttctacaacattgggctgaaggaatctatttgggaccaacaggctcctgtggattaggctgtactacctacttaagaaatacctcagaaacttgttagaataaccagttcctaagctccattctcaaatattttgggagtggatctagggtgagcctaggcacctgaattttttgaaaaactacctagatattgatatgcacttagatttcaaaagcagtgatatataatctacaaccactgtttccaagaagaatcagttgctactggtatttgtttagcctgtttttaatgtgattgttcttgacttcctgttaaactccctccttctttgggaagacacaaacttcagaggtgagggtaggggtaggatattttccttagttagggtaccttgaaaatgaggatctaggctttctcagtccagtatttctgatttctggggattttttctaagttccaatccattgccagacaatacattgtcgatataccatgacatgattcattacttaaagcaagaaaagcaaaagttatcactacctggaagctctctcatacttacaggcccacattagccctcttgtacatgagctgtattccatattaccatcttgatgtcattctttatggcacaaacccatcctaaactttgtccctagaccttttcccaggaggcataacatatgcttctggcttgcagaggtcctgtagccaagcaaccaagaatgaatgcacatagtgtgtctttgctcaatctctgtccatctttcaatccactattcaccgtgctacccttactcttgtggttagaatgaaaaaacactcatttccaagttctgatatattttctgtgtttttctttatttctactgtgtattataaaatcttttcctaagtactgacctgcatagtttctccagaatttaccaacttacctccttctttgccctaaaagttgatcttgatgcatttttcatctcccacataatatagtttatctctaattagtgtttcccactcagtatcattaagtataatcatatgttaattataatgcatcatgattttgattccttattaaaaatataatctctcctttcattaggaactttcatttgcaatactaacagctgtctccatcttcctaaggaagcagacaattttgcttgtaggctatagtattcctaagcattgtgcgcagttagattgtgatgtaacatctgtcttttgaaaacttacagtctaagtggaatataagtcattttcttttatggttaaattccatttgcccttgatatttgtgcctattaagcacctgtagtatgttaaatgctttgtaggacaaagaaatgtggcagagcataactgggcaaagtcttgtaataattttgcaatcctgtattaaaaattaatgtaattgaagtctattggaattattttcattttttcctcctccagggtaaatattaataactcaaattcctttaaccacttttattcaagctctgtgaatcccaaactccattaacttaaatgaagaaacatggttaaacaattttaggctattttattaatgagacacaattccatagctgaaaaggggaagctaaaatcagttgaaacttggaatgaatcaataaggaaaagaaactttcctgaacaaaataaggttaaaatcattcaagtctgctacaacagaatggctagcaactgctctgccgcacatgtacacaaagtgcttttttgcctcatgaagtttctttgcttctcaaagatgattctttaaggaggaaaaaaaaatcagaaaaacattaaatttttaataaacaaggcatctagcacatcacaacactaactcttctgttatatttggatatggccccagttgaaaagtacctcccagaaggtttttccattaagtaaaagattagatctgagttcttttctctcattagaaaacagcaatcaatttttttgtaatgaggagtcatcactaaaattatattcatgaggatgaagagtgctgtactgatttccaatctcttccccctctgactttattttttgtttttcatagttgtttgtaagatactgtcacataagaaataaatgtaaatgtcattatgagagatttggcaattatttggaaaatttcatttatctgagttgcaattgataacatccaagattgattcatttcctaaggcaagctgagcattagtttgtatgatgttctaccaggttcggtgacttcatatttgttgtcagcatgcaggcatctttgagtatgtcctgttcacatattagggtcattgttattcatagtaacttcatattaatgatgcagttgaattttagtatcaatgtaggggtcaagtgtctggatggtgagaatactagtttgtttgtaaatataattagaaatagggaaaaaaaagaatgggaggccagacagcatagtgtgaatgttatctctagatagtatgtttattgtagattttaattttttcttacgcttttctgttgtttccaaatttataaaatgaagaaaaataagtggaatcagagaaaaagaagaaattacagttgctgcttacttattttgttttgcttatcctaggatacttggccaggcttttttatgttttgtttttttatatgatatttctttttcaagacatcttccttcttccccatgccactgaagcacatttttttctatcttagctgtatggaaaatacataagtttgtatgactaggacctgaagatacataactttaactgactttgattctttattttaatttgataaactctgtttgtagattgattcttgcatatattttgctacaaaatgatgcttatggcctttgtatttgaggatgttgataattgtcatggagataaatgtgttgagatgcacgaaaggttctaggagatatgaaaaacaatatgataggatttgtaggctgatcatgttttagagatattaactaattgaaagccattcatcaacatttctcaggcctgagctcctagatcattgttcagattaaagttccaatatatccattgaccattaaaagttactttcaagctgtgtattaaaacttaatcatggacatctttgctcctgctgtccaaagaaataccttataattctttcattcttaggtaaatttctggatttccaaaaatgggtccccttcatgcatcccttctccccttttttcttttcacaattgaaaaaaatattgccttctaactttatgagactatcaaggaaaaaaatcctacaactatcatgagacgttaaagaagatagaataaaactgaatgctttgggagtttcgggtagtacaaaaaagcaaggaataatttggtttatttgtttttttccatctaatatttttaggtacaagcctatgcagaaagtggatggggttgcagatggtttcacaggaagtggtcaacagacaggcacatctgttgagcaaactgtaattgcccaaagccaacatcatcaacagtttttaggtatgttaaggtgtaatgcatattagttgctactaggattttgaaaagttagtcttttctccaagtgcaatgtctattatagatgtcaatgacatagaaagattttttttggtgccaaaattatgcacatcatatgtataacagtcctagttcatgtctgcctttcgtgtttattagagcttatttttaaaaatctcgagctatataggacttttatgcgtatgaattaaagactcattgctatgaaattgttttccagaatttgtattattcggcttttgtgatcaaaattatgctgtttactttcagtagtaacttcaagtgccaaaaagaattctcatttcctatgtataaagttatatatgcacaggctcagattagaaaaaaaatttttataaacttttttaaagtaatttattcatttaaattaatcacagtactttctatttttgtaatttatagatggaatacatgtttcttgttattgaaagagttaggaagaaaaacttgcatatttttcatatttttgccatagccaaaggggcaaaaaagtggcactttaatttgattgacaactcttctagagatgaacatgcatattttccatataacaggtcaagataagtagaaggtatcagagagtgactgtgtgtatgtgtctgtgtgtgtgtatatgtgtctatgtgcactttctgacaaagacaactaaaatagactctcaggttggaatcattactgaagttgaaaacatggcagcgtttctcagactgaagtcctagggttatattcttgtggacctttggtcattcaacaagaattttattttgtgatttcacttcgattatcatcttaaaaactaagcatattctggattacctagaaaactagaactaaatactgttctgcaattttagtttccatatttgtacctggatttatggtaagacaggcaccaaaatgtcttacattaattgtccagagctaataagaaaagaacacagagagacttactatgtaaattacgcctccctcacaagggaagcctagatcatgtccctgtattctgtgtgaaggaaagtttcacagtcatttgtacatagaagagtaataggagaagcagccaccacaaagcacatgttggtatagatctgtcagacccaaaagatcctgtgctgcggcagtcaatactgatccttgttgcaagagataacttagttacaggacaagagcatcatccatcacatcaaattaatgttgttaaattgtatgttatttttgtagttttctttgtatctgctttgtagctctttaggtttatgactctataacagttaagaacataatgagtttaaaattcgtttttttatgtaattaaacaacataataaaaatatctaaaataggtactagcaagctcgagatatttttcttttaataggggccttgtgttgagagacactgtgatatgcagtatactatttgcagtataattgtattgcaaattttgtttctagaaaattcttaagaatgttccctttagttttatattttgtgctgatgatgttgcttagttttacttgtaaaatattaatataaaatgtccttgctctctggacccctgacctttaaaatttgtttttctttttggtcttcttaaattttccctcattaatctgtaattggcaccatccacaatagcttttttctgttctgttgtcacggtaacagatgcatctcgagcacttccagagtttggagaagttgaaatctcttctctgccagatggtactacctttgaggatatcaagtcactgcagagtctttatagagagcactgtgaggtaagtcttttcaaatgtagtatgaacacatgctaggttttgccagataacttgctaatataaaataatcaagcttattcctaaaggacaggtgaacttagcactaattcttttgagcgtatcttttagcactaacaaattcatttttcttctttctggtctcagagtggagagatgaggaatgcagaaaagtgagaataagttttattctctatttcttaagcctatcctaatatgaatcctttggcgtagcaattccacctctaggtatttgtcctacaaaaatatttatatctgggtgacaagagaagtgtacaagggcatttgttgcattattatttttaatgcaaaagattggttataatttctttatctagtagggagctgcataaataaaatatggtattaatacaatctttagagtagaatactatacagccatcaaaagaataggcaactctatacacataccaaaatggatcacttcgagatttaaagttaaaagaaaaagcaaatgcaaaaaattatgtatacatattttcacttgagtgaaaaataacatgtgtgtttatgtatgtgtatatatgtatgtttcttccttttccttcatatatatatccatatgtatggatatacatatctatatatggatatatatatatccagaaggagaaagaacaagaaaatgttaacagtggttgcctttgtgaaggaaactgggtgactgggagttagaggggagagactcaacttttcaacagacctgttttatcttttgaattttatatcataagtgtatatttctattaaaataatttctggaaatgtttaataaagcaccttaggtgttctttccagggatcactgaggttccagttttgtttgtttcacttttgtggttaattagggttccttttggtgttttctagccctactcctactctcgttctgagtatcccacatcagaatttgcttcattgtctgggaggtgagctctctgcatgccagcacattaatgtaccacagctcacctggcaaaaaggggataatggattatagtaagagttttcttgagtgcttcttttgaaagaagagtctatttagaatttaagtagctttattccagggatatttgtgatctacttaggagtaaaagataatcctttggatttcctgggcagtcctcctgactgctgacaatgcagtatgcagtaagaggttcttagctcatagcattaatagacattttccccgacaccagaaataagaattgctagcgcaaatctgagtgcttgtcaagggtactagattattaaccaccaagggcaggttctctccttattaacacaacatgtgccagaagtgttcttcaacgtgtcctaccagttcccaacattccttggaatgatgaaagcacttaatattcattttcctttgactactatgcttttacccatattagagaatttctggattttccttatgtatatagagaaaattatttctttctacatttatcatcttattcaataaagatttgtgtaaagattctctaaacaatttctcattcccatgtgttcaagtgaaccttactttaagcaaaccagcctatatggattttttttttttttttttgagacagagtctcactctgtcacccaggctggagtgcagtagtgcgatctcggctcactgcaaccaccgcctcctgggttcaaacgattctcctgcctcagcctccccagtagctggaattacaggcatgcaccaccacgccccactaactttttgtattttcagtaaagatggggtttcactgtgttggccaggctggttttgaactcctgacctgaagtgatccacccgcttcagcctcccaaagtgctgggattacaggcatgagccactgtgcccaccctataatggatttttaaaaaatttctcctatttattaagaatgtaagttggagcataattatttacattgctacaaaacatacagtaagattattctaagtgacaaactcccctgaataaggttgaaatagtctttgaattataagatttgtattaacataccattttcaaaaatatactttttatgaagaaatagggacatatattataatctgtgtggaaaatggcagtccacagaatgatccccatttatttcagaattaccagtgttcctaccatctctctcatagggctgagctgcatatataaaaaagaaaaattctaattattttttcctgttaataaatattcattttgaataaatatgaaaaacttttgaaatacagctgcctgaatctcatatttagtcccgtagtcatttgccctaagccagtagaatatggattattttaatttatatttgcctatatattttagtctgaacatatttgaaagtaggtggacaaatgataaaatgttttattcatgtgtaaaactgcctcaaatgaagctgatatgaatgtcttttttgaaagagttatttgagattatttaatttgaagagatactgaatttaagatacactgaaattctttacttgcctaattatatttcacatttcctacagtacatatttttaaagaaagattaatatacctactttgcctgttattgggaattctcacaatttgtttatcaaagatatttttgtatcactagtttgttatgtaaggagcaagtgtaactttttatacaagttgctgaaatattttttttaatgtaggttaaaagaagtgttcttacagcaatctcatatatagaactatataaggtattatgtataaggtattaatagttgctccacacttttagagatgtctcttggaatgtgcctaagctacaattgagaaagcagttacaaaaatttgctgctggagaagattttgatctttgctgggatgagggacatctacatgccctttattttcagagcttgcattttgcatttttattgttactgaggactgtctaaattaatttgtctccctatcttcattttcaatatttaactacttgcaacattttatacttttagaatatatttcataccagttattgtgtgtatcatacattgggccagctctatacaggtggcccaaactcaacaaatatgaagttatggtttgttgtttttgcctacaatactcttatagacactctagattgtcccctgatttcttttatcttccacgaattttatagatctttgtggggctgtgttacctttgcctcaaaggtgatgacatcaatcacattatactgactacttctgtcttttaatgcccaaaataatcacaaaatcatgtgttcttggcacaaacaggttattctttagttttatgcctgcttttacctgaaggcttatttacaaactaattgcaatgacagggtaaaattatcatcattgacagttaacggaaagtggtacatttaagcaccataaaaaaaagtcttagatgcatctgggaaatagttctaggagataaaaaaggagaaagaggaggtgaggcccccgagatttgaaaaggagatagtcttaaggttgttccgtaaaggaggtatgcagagataggattggattctctttaatgttgaatgctatgcccagagaggcagtatccactgaaggcctgctgactccatggtttctgccccagcctctgtttggctgggaacacagtggaacctgtggtcagctgccttagacaaagctaattcagccctaactccatctgccacacaaaagcaactccacacccttcacttccacctgctgtgatggccagtggttacctagcccaaagaggactgctggtaattgaatctatgttttgtacccttccaggtcttagaataggtagggtgacagtaactatagaggcagaaagaagcagtaggtaaaggaaagaaagaaagaaagagagagagaaagagagaaagaaagaagggagggagggaaggaaggaaggaaggggaagggaagggaaggaaggaaagaaaggaggaaggaaggaagggagggagggagggaaggaaagaagagaggaatgaaagcaaaaatgaaaaatggaagaaaaaagaggtagaagtgagggtggcatgaatacattatgaaaagaatgttatcctgcttaatcttccaagaattttcccctctttatcttcttcctagctagtttcttttttttttttcttccacttcctttggtaaaatttagtgtagtttcaccatgttaacttatgaccccaagggagaacttgaccatataaaatcttgtcatgttagactgtcctcacacagtcccgtaaataatattgtaaggtaatactggtaccattttgttttttaggcaatattggacgttgttgtgaatcttcaatttagcctgatagaaaaattgtggcaaacattctggcgctattctccctctactccaactgatggcactaccattaccgaatcgaggtcagaatcaacatcttttccaattcattttcatggctgagtagatgtcacaactaataaattagagatatgtataccagttgtgaaccttacctgatgacattaattgaatagattgatgttttggccatcctagaaataaaccatgaactgctctcttgaggtttcagtgtgtgtatatagctcccatttgtactgatttgggggactgtggtagttatttcatcctcatggaattactatcatatctgcctttcataccgtcagaaaatacaaatgtgcatagacagctctgggggagtgttttatatatctgtctatctctctcggtatatatagccagctgtatggcaccagtgcaatggtggtatagttctaacctcagtaatatttggtaaacttaaactatttttaaagtccattttcttttttatcctcatttgccatctattcatttgctacatttattcacaccagcaatctgagtgaaatagaaagtcgacttccgaaagcaaagctgataactctgtgcaaacatgagtctatcctgaaatggatgtgtaactgtgaccatgggatgtaccaggctttggtggagattctcatccccgacgtccttagacctattcctagtaagttaaatgcagacgagtacggatgcttttgttctcatacattccacccaggaagttttgagaagtgacattgcaatctagaatgattctaatttcatttagatttgccagatagaaaacatgcaacacagaatattgcgtgaaagcagcctagagcaaaactgtagtaaaagggaaaagatgatctatttttcagtctttcttttctttttctttctttctccttttctttctttctttcctttctttctttctttctttctttccttctttctctttctttcttttttcttttttttgatagaaaagccaacctgtagatgtaacagccccagtaaactacttgtaagaacactagcaggccagtcaaccatataaaaattattctacccaaggacacagtctccttcataaagccaaaaattatggaaatctgtaattgctaggccaacctccttcacggttgcttttgacttgaagtgaatctatcttgatttccactgaagttgaattccattataaaagcatttactttgtcacctacatcatgttaggaactacagatgcggtttccattagcagtaatggttaactggcattttgagagaaaaatctttgtaactacacaagcattgtaatcccactatgaagaaaatgggaattacatagataggttagattacctttttaagtgatggtgctttttaaactactttgtagcaaacaaagctattttctcaagtatcgatataaacgctaccacagatactgttagaggcagctgaaactattttatgcctatatctatatgagtacacagtagtgaccttaactttttaagaaatgagacagttactactctacattgacatcaataaagtaaaagcaagcatatagcttgtgaagttggctactgtgtacttcaagtatactattcacagatgatttgtgttaaattattctagaaaatatgaaaataggaatttagtagaacaaaaggggaagatattaacatttgtatgcttatactttctttttttctaaataacaatagacaacagtagaaggtatgagatctttaatatgttcccggccaccttaaaatgtatgcttaaacatatttccatataatattaatgaacacacgtaaatttatataggaataagtaaaaaaaaaattagctgacattatctcacaattttgtaaattggtaatatattctactctacctacagcaagtttcctggctaaaggttgattaaaagtgatgttttagaaagtttcactagctaaattctctactgatttatgttccagaatcggattttccttgtttttctcttgctccctgtgctctgagtgataatctctagagatgtttataagaagttgcatagggtagctcattagcctatgacatcttactaccaacataaaatttttctcatgagataaaagaagggatgtcagcaagtactttcttttttgaggcaaatcaacaacatcagtattcattaaacagttctaaaatcttttgcttctataacagcaccataagactttaacttgtgagtttaacagttctctgttttaaatcttgtatcaattttagtttaattcaagcccataattttaagtacacaatacactggcctttgtcttttgcaaattttgatttgaaaaccagtttattctgtcaaatagcttgtctctacattaagcagacacccgaatagttttgtagtctctctgaaattataagatgcattgatataccaccctgccaagaaaatttggaaatttaattcccattctacaatgaggtgtagcaaagtaaagcttaaaatacaatttagatagctatcttctgcttgtatgcattttagtattaatcttgagcaggttgagacaagtcagctttggaatagagtttaaattccaaaccatccattcatgaggctttgaaagttgtcagagtcaatctgcacaattttgtacatacatgaatccctgtagagagagcaaacttaattttatttttaaaaattgtattttcctggctactagcacttcactctaccattttctgtccagatgggatttctttttttagctaaaaaaattctgcacatcacactaatttaatgtcagcttgaagctactatattctaaaatgcagttatctgaaaatgaaaaaaacgttaattgtatgagcactcaatgggtaacacttaaatgtacaattggaagtataaccagaggtggcccagaatatcatttagtagaaaaagtaaaaattcacaattatttaaaatgcaaaatatatcttttctcacctaattgcccttgcattaaatttatctagataaaacaaggcccgtaataaatatttttaaagtaatatttatagatttgggggttatttttcagattaaataattaatgtacactaattgtaggaaaaatggaaaatgcagattgccaaaatgaaccttgaacaaaattttactgtttcaaaagggattattaattttttttcactctttttcatttccattcatgcctgccctccatggttctagcacataatacaacagaaaaatatttttctttcctttttctttttttgactaacatgggaagctttgaaggtttcaaaagattagttctcaagaaatttccaattcagtgtttccagtagatgatcctcgtggttaaggatctgcactgcttgagtgtttttcctaaccaaaatttagcccattccaatctcgtctctccagttttgaacagttaaacaaatctcttaaaaacacatttagttgtctttattattggaatgggaaaatttatattgtttgcaaataacttgagtaagtgaaattatttttaaaacctggttttaacagaagcatagagaatcatgtcagactcatttgagcacagaaagaaaaaccaaggaatttaagcccatccgtaatattaatattcctggggacctcggcccgaaatataactgtgtttcttatagtagcatatgttgatacctaccccattatagagaacctacaaaggttacttttatgttgtgggtgcttcaggcacttgtctactaaatgtctctaattttcctctacattactatggagccttgggcacagaggaagtaaaatactattaactggattacttgttgaacaaggaaagtattctgtctcctactatatagcaatctcagtaagcagattttttcttataaaatagtcatagtcatcactgataactgaagatgcttctcattattttatgaccaccataaaatcttctgtcatgggacctatccctatttcaggttttaacagatatgtcaaggatacagaatgagctattttaggagtatcttaagaatacgggtttccgtaacagcaattttatcatactgatcgtttacctctacctgccaaatgaaatggaaaataattgcccaaaaatttcaattcagacaattttaatttttaccttttcaacaaggatgagagagaattactctaattcacagattctaagtaaatagatgcatagagaaacagagcaagctttgcattatttttctttttaataaaagaaatgaaaatagattaagagcttgaaagaacaagatgaagaattttaaagaaaatacatagcctttagcacaaaactgttaatgaaaggagtgtttttttccaagcaagaaaattctttaagtatattcacaactggtatatgttgctgtaagcaaaaatgtttgaatccttttttttcccaaaaaagcgtcataagtatctgggaacaaaataactttaaaagaaaaagcccaaaatataattcttggatgctttaaaaagttaggaataatgttaaataaagtttcatcaatgaggacaatatgagttctgtgctgtatcagatattgtgtacgagcattttcttttattctagcacaaacattaatattctttcatacttttttttatcctgcttttattctttaatgtttaggtgccttgacccaagccattcgaaattttgcaaaaagccttgaaggttggctttccaatgccatgaacaatattccacagagaatgatacaaaccaaggtatactttatgtccttgctttttcttttgtgttgaggaaattattctgaattgtgaactttacatctatcctatcaaatggtattatgtaaaatgttgaggttataacatacatcatcttttaaaactgatttttatatttgtattttataaccatgtagtaaagaacttgcacaagagatgtttgacaatgttcctttcaaagagaatagggaagcattttaagtgtggtgcatttataagctctttctaaacaatatagtagatatatatattctaaattatatctgtgagaaagatataaactataaatgtttaatttcaaatattaaaataatagcctagaatgttcaaatagttttcatttgaaggaattttctatttctaaaatttcctgctatacttatcatatcctgaaaagttcatagaaattaatattgttttgctttttcaggatgttttggtgtttttctaaacactggagaatgcttttgtgaataaagtgaacaattaactcataattaatcaatatatctcaggaatgtggattatttagctagagatacaaattttagtctctactttgtctcctactagccatgctgcttccagttaatctgtgaacatatcctcatagcaagattggactatttctaaattttatttaaatgttggtaacagaaatcacatttgtgacttcttgtcaatgactgtatttactgtcagactccagcaatatactttgcctttgaatcggggggcagagttgagcaattgaagttattttagctgataaacctctgtgggaacataagtagcctccagttcgtttgcttgggcttaaagtttgcaataaaactttctctctctaaaacatatagaaggcaacatttcattgatgtgcccatattagattgttcctctagaaatgtgctttcacagtagggccagccacgtgtggctatttaaattagaattttaaattaagtgaaatgaaaaaactagctcctcagtcatactcgctacattttgagtgctcagtagcctcctctggctgctggctaccatgttaggcagcatatgtgtagagcatgtccatcatggcagagagttctctttggcatatgtagagcatgtccatcatggcagagagttctctttggcagtgctgttgtataccacatggaggtgtgcaagaaagaaggtggcctttgattatggtcaaggaatccttttcaactttcagtcagtcacatttgtaacaatacctcaaagagctaaaagcacttcccttcccagtgttgtcaaagtgaatgtggtaacaatccaattgcaacgttggccatctcattgacctccggagtttggttgaatgattcaccacagtagagggtaccgtctgttcttctggtttcactgatatgcagtcttttttcctctccacattcaattaacagagacaatttaccctgacagaggaaacagcattccaactactgtggcttttggaatcaaaatgcccaggtcaattcccatcagtaatgaagtttctttgcagccttgagcaagctacttatcttctttaaatcataatatgtgtctaataagatagttatgagacttgaataagataatatatgtaaggcacttaacccagagcctggcacatagtatatactggattaatgtaaaccacaaaaatggaataaggttcttttttgaggacgtatgagcttccccccaagttccaaatagtcctcaaacatctcatgtcaagatagagcatcctgttccctgtgaacaccctctaccgctcccaattgatcattcaactgctcgtaccttatatacccatatagtgattgagtgcaatactatacattcctgtagatgtgtctatttttaaaatatatttttaaaagattaaaatcattagatctatattgtgcacataacaaatttccatgagattatgagatttagatttcatgtagacattttgcattatctttgctgtctttcaaaataaactgcttcattcagggtctgaacaggcaacaaatcgtgcatccaacggtggggataaacagagtttaagaagagtttatttccaaaggtatgaacagagttgaaaaaaacaaagaggaatagtaaagcatcccagggctagcaatagtgggaattctaaccatccctaggaatgaaggggtgagaggtgaaagttatggcattaggaaatccactctttccctcaggactgtggtaacattagaaaaggaaagcaggttccgctctaacaggcagcaagcagaggttgcagtgaataagtaccctggtaaccgctctttcttcccatccttccatctcctgccagtgcctgttattggtcaaacccaggtggaagccagagaacaagaggggaggttaatgtggtccattcggatcaatcttcctgggcacagaacaagatgaagaaaaatggaaagtagattttgagaggcaaatagaaatttcccgcatagcccttttaaagaaactctaattctgaaaaaaggttattctagttggttgcctctgataatctcgcctcaaaattactcgtttctataaaataaaggtagtaagaataaatctgaatggtaatgctctcacatgcatttttaaatacaatgtaaagagtaggaatgtccagatctctttttatttgaaagggcaaactgcacatccctacttttaaaatttgcctagtttctacttgactgtccaaagaacagtaaaaaaaagaaatgaaaaccaacatttttcttgcttccctactcaaagtcatttcttactgtggatgagtagtcacttgcaagactagtttaattaatgctacgctcagatgtcgaagaatgtgggagtttgttttagtcttgacctcaacctactcagaaggaaaataatacttggtttagagatttaaatgctgtaatttacaagtgaactctctcaccaaatgaattttaaataagtgtcagaggcaagcatttaaaatttgtgaagggaaagaagatttgaaaattgcagtggtttcttttactggaggaaacagaatcccaacttaattggattgcgttacaggttgccgctgtaagtgcctttgcccagactctgcgaagatacacgtcgcttaatcacctggcccaggcagctcgtgcagtgcttcagaacacttcccaaatcaaccagatgcttagtgacctcaaccgtgtcgactttgccaatgtccaggtattctatttccttgcaaagcatgtctcttaaggaaagatacccaatttgttcttcttaattgggatcatcaaatttcttttcaaagtctcatctatatatggcagcatctatattcacagtgttctgaaggagaggagtttgacccagatacagctgtagtgctcccatgtttgtggttaaagtaagctcacatttacagtcctaaaagacaacgtaatatatcaccagcatttgctgaatagttagtagagtaataaaggtcacagtcattgaagttagacaggcaagaaattaagctgtctcatatactagctgtgggatcttgggcaattgcgttacttaactgctctaggcttcactttccccaccttacaacacctgtcttagattattgtttatatatttaataatttgtaccatgacatgcagagatatttctattttgttgcccctccttgaaagaactaagaacaattctatttcagagtttactatagctgcctagtaaatatttattcacttgaaaagaattatatgcaataagttcaactattgtggtagttcaaatgaaaaaatattttttaaccttgtgatcacattacccacttgtactttaaagtatattttaaaagctaagttagaaacattattatagagtttcaatatcaataaatactttatttttgattctaaagtaatgaatctaaatgttaccaaataaaaacaatagcattgcccaccaaaagcataagcaacaagaggaaaaatacataaactgtacgtaatcaaaatttaaaactttggggtttcaaaagagaccatcaagaatgtgaaatggcaaaccacagaatgtgagaagatttttgcaaattatatatctgataaaggacttgtttatagaatatataaagaaccattacaacccagtaataaagaaaacctgattaaatatggacaaacatctgagtagacatttccgcaaagaaaacatacaaatggccaataatcacattaaaagatgcttaatgtcattagccaccagggaaatacaagtcaaaaccacagcgaggtaccatttcgtatactctaaaatgggtctaagcaaaaagacatataataacataccctattggcgaggatgtgaaaacattggaacctcatacactgctggtcagaatataaaatgctgtagccactttggaaaacagtgtggcagtttgtcaaaaagataaacatatagttaccgtatgactcagcagttcaacttcttgttgtatacccaagagaaatgaaatcatgtccacacaaaacttatacatagaggttcatagcagcactatttatattagccacataaaagcagaaacaacccaaatgtccgtcaactgattaatagataaacaaaatgtgatctatccatacaatggaatattattgggcaataaaaagaaatgaagttctgattcattctgcagtatagatgaaccttggaaacatgatgctaagtgaaagaagccaggtacaaaggatcacacgtgacatgattccattcgtatgaaattccagaatagatacatctatacagacagaaggtagattggtagttacctaggcctgggggattgagaagactgggaggtaacaaataagagtcatggggtttatttttaggaaaattaaaaaggtctaaaattgattgtggtcagtgatgtacaactttgtgaatatcctaaaagaaacctttgaacggtattctttagatgaatgaattgtataatatgtgaattacatttcagtaaagctgttaaaaaacattactgttgttttaaaaataagctaattagtaattattttattttctagaaattttaatttctacttcttgcctagttttgtcatttaaaatataccaaaaagtaacatttgggcttgatccattttagagtacgataaaaattagttgttcattgagactttcatggactgggttcaaacttctgagatatatatatatatagagagagagatctatatctatctaatattttatattagatatttatatctatttatatctaatttaaaactatatatatgaagttttaaaaaatatcatctatccatctagaaaaacacatacacacatacaagtacataatctttacaagaacaaagtttctcagctttacaaaaccatttactttacatatttccgtgggatgtattaactgaataagcaagagtattaaaagttaatattgccttaaaatctatactgtaatatttatttcaaatcttttttcagaaaagatttgtttaaaagtctcttaagaagagttgaagaagtaaggcagcttctagtttcagaaagtaatttaaactcagtaacagaaaacattttaaagaattatttataataatatccgaaaaagtttttcagtgttctgttagcattattatatgtataaatacatatatatatatttgtgtatctgcattccaatgaagtatttctacaaatgagttcttccctggttataagcattaaccttgggaacatttttgcatattagtgatcagtgatatgtctactgtacgacttatcctctacctgccaactttaagaataccctttcttttcctctatttttgactatcatgtttttctgggtccaccatgatagccattactcctgaaacccatatgattcggcatctgccctccaaaaccttcttcctttcttcagagtaccatgacacagtagtgagcccttcatttccccctacattttacttttcacagctctgtacatattaatgagtaatctctttctcaaggtagcacttttcctctttaacacccttatttctttccttttcttttcctagttttgccagattttcccagagtcccttgcctcccattttacctttatccccatctccagttcatttggaagtcgtcccagcttctataacatgaacctcaataatctgacaatataagaatgatgctcttgtaataaggagacttctatttaaaacaatgaaattacatgtgtgtcaatattataatacacttaagagcttgaaagtgctaaaaaattcctttcaggatatccatatatcacttttcactacttcattctcctctaattaaattttcttttctttatgcatttaagataatttttctattgcagtataactggtttcctgtttcatttaattgatagtattacgatggcataattctctaattttttgtgtaaatggtggtttttgagatctacattatgggctaaatagctttcggtgggctgacctgataacttagctattgcatatagttgtgtttctgtatttaaaaggcattctgattttgaagttcctgactacttttcattttggatatttttttttttctaatttaagaacatctctaagtgtccttagcttttttaattatagacttgaaatatctacattcgtttcacaagggaatatttacaatgcgctctattgttagtatattttcactttagagagtagtaaaatgaagtataatataaagtagtttgaaaagccagaataatgtgctgtggttttatttctctaagttaggttttagattatcatcttttcttggcaaaaactaactgccaagtaaatagtgagtttgaatttatggtaagaaatgaaattaaattccttcatggatactagtaagtttctccttccaattatcaacgtgcaaacaaacaaaaaaaacctctcctgctaatttcagctttatttgtaatactaaaatgttggaacaaacaaatgtctaactatgtgggattggttatgtaaataatagtatatgatgcaataaaacaaattcattcagtggacaatgaagataggtctaatttgcctacatggaaagatggttattaaatatttctaagtgaaactaagcagaatatctaatagaaaatataatatgatcctcttttattttaaacatttaagtatgtataagcatataataatataaaatgtatgtgtagatatatgtgttttataatacaaatatatatttaaaatataaatgtatgcataaataatatagtgtatatatatgatgatatatgcataaattatttctatatgcatgtgaaaagtttgaaaggtacatacatcaatatgctgtaatttcttactgttgccattttaagtattcttaatgttttgttccttttttgcttatttgtattcacagttttttctataatgatattttagtatacttaaaatatttaaaagtggtattcagaaggtaacatctgaatggatttatgattaattagataagaggaaaaaagacagtgaatagtatcatcagctgagatatagaagaaacagtaggtttccctgggaaaataaaataagttgagtttggggcattttgcatttgaagtgccttcaggttgaaatgtaccttgaataggtaaagtctgtaggatcaggagagatactggaactagaagatggagataatggatttattcagttgaagttgttaatttgaatgaacttgttttttgagagcatatagaaaaagaagctatagacactcttttgagaaaaatacatatgtattcacaaggttttattaggagcctcacagacacttctccaaagaaatctatcttgacaaaattatctggacacaatgaacccagcttaaaatttttcattaaatttcatttctttaattttatgcttagggaaactgaggcccacataaattaattgcttgaggttagttttgtttattcaggacctaacacctatgtcttctcattcccagtcaaatattacgttaccaaaaaattatgttttgccttgagtgaataggtttttttaaatcttaaaatacaacatagcactggaaacatcacagtacttatggcaaccactgaaaagtagccttaaaagttcctattttcattgctgttaccaaacatttcccaaccagaaccagaaggaaaattgcaataatcacagtttttggcaggaagcatgtctacattttctcaagagtttttgttgttgttgttattgtggttttcatttctctgaattaatttgcattcatagccttgccttgatagcccttgagatttctgttcccaatccatataactcacagcagcatatgcttctacctagtatcattcagtgtttgtttctgttttaatcttgaggggacctcttttggccaattttatctatttatctgtctgacttaccctaaatcttctcaaataaattggttttaaagttttatctgatggggaacaaaaagacaacttctgaaagcagtatgaaagctgaataggatgaaagaccctgcctactgtaggttcagacttctattttttgaagtcatcatgtattttagtcttttacacagactagttaatgtagaaaaaccaaatgatacttacatgtgtcatcacttttctgtgtaccagagtgagcaacgagaaatactcatcccttaaaactgataaagattgtgttaccctaacaattgacaagtagttttttattttctggattcatttaactgtgtgaagcttttattataattttctgttcttgcatctagtgtgtgtgctggcattcaatgaaaggatgctgaattgaacttttccttttctttctgtgttactgtctcaggagcaggcttcctgggtgtgccagtgtgatgacaacatggttcagagactagaaacagacttcaagatgactcttcagcagcagagcaccctggagcagtgggctgcgtggcttgacaatgtgatgatgcaagcactgaaaccctatgaaggaagacccagttttcctaaagccgccaggcagtttctgctaaaatggtctttctacaggtatcatctaggtttttcctaggctttcttcttcatattctgcaaatatgtgtgtgtatgtgtttgtatatgcttctgtgacaaaagaaaagaaagtaataaagactttagtttgtggaaactccctgttacaactaccttcaacccaactcagtgattacaacaccatggaaatgtaccaggaaacttagagaaataaactttctgctaggaaaagaaatctcttgctcaaagccctacatgtcctcagatgggaacgtctgagattccagtctagataatgtgttcagcagtaatcagaaaagggcaactgtcctccctcttgcaacatacattatttaggcttctttcttgaggcctaacactagtctcctttttgttctctgtttagtgatgttcagaatgtggtccctaaaccagtagcaccactatcaattggaaacatgttagaaatgcaaattcttagcacctcctccaaatctacctgtatcagaacctgtagaggtaaggcccagcaatttatgttttaaaaagtacttaagttgattctgatgcatacccagaaccatctatttaacttcttaattttatcaattataactgttttcaaacctggctgcacatcagaattaatgtaaaaaaaaaaaaaaaagaaacaaatcctaggtgcctcccaagacctactaaatcaaaatcttggtggtcaagagatagtgattagtggctgggcacggtggcttacgcctgtaatcccagcactttgggaggctgaggtgggcggatcacgaggtcaggagatcgagaccatcctcgctaacacggtaaaaccccgtctctactaaaaatacaaaaacaaaattagcggggcatggttggggttgcctgtagtcccagctactctggaagctaaggcaggagaatggcgtgaacccagaaggcggagcttgcagtgagccgagatcatgccactgcactccagcctaggcgacagagcgagactccgtctcagaaaaaaaaaaagagagagataatgattaggaatgaggctaatcaggatttttttcacaaagctctcctggtgattctaatgatcatcagtaatctcgtagacagtaacatagcttattaataagataaatcactttttgactaaaatagtatagatagaaacgtgtatttttgtagacatagaagcacccagaagaaaagggctttctgattacatgacatatatcaaatgatgggatgagctgttgaccataactcggccacaaagattaaaaacagcatttatgacctttgtaggtcagtgtctctaccatatatgtaggatggaattggcagagggaattcttccataagttgggtaaattatatttttaactctggcatttgttcttatggtgagagttcattttttagcttctttagataaagctggccccactgatttggccctaagattaatatctgctgtaaagtataggcagtctctactgtagattctgtgcagccatgcacatatcagaaagtggtggccacaggacatacacctgactgtagctgtggctacactatggtcatcctctggacatcagtggtgagtccaaagctagttgtgaggagggaaagactatgaatgagtaatggaatgtaggaactaatagtacttgtgaactcagtagacccagactataggatttccatattgctttgaccacctttggttataatgatggaatcagaggtcttttaattatgatggtagttcctttggttttattataagtgacttttttctttctcaactgatttggtccatattcttatttcttaaactgaagtagacgtatagatccacattatatgtttcataagagttaaattatccttacatcctgaaaatagctgtctagtgtctagcccagggtcaaatgcaatgaaagaaagccaaccagttttttgctgttgttttgtttttgtttttgcagtggtacaattccacagtcctgcctctcatatatttaacacctttagcccacataattcaagaagcacattattaaggtgttgtctggctctgtgacccactagtatgcatcagtgaagccagtgctaggtttggatctgggtgtttatgagaaatgtgttgatgagaaattaagttttcccttgatacagcaggaggatttgaaatgcgttatcacagtgttctcaaggtagatgcagcaacagttgtagtaatggtagaattagaaaatttaatttgggaatattttttaagatttcagccaggcacgatggctcacgcctgtaatcccagctactcgggaggctgaggtaggagaatggtgtgaacccgggaggtggagcttgcagtgagcagagatcacgccactgcactccagcctgggcgacagagcaagactccatcttaaaaaaaaaaaaaagatttcagatattttcccagttgcccaacagtttctttttattcatcaagttttttcccagataacaacgtaagtggtatatgtgctccatgaataattgatgaaacagcagtacactgactggctgttccaaaacttatatgaccaaaggcagagtccatcctctacatccaaaaaagcaaggtgctttttttcttcctactgctttcttatgttattagtgtcagacttgcccttacgtctacctgtggttggtttttttttttttcctatatttagttgatgtcattttagaaatacatccctggagccttcatctccacagagatctgttgcaggtatcttgaagggagagaaaattacttacttgtatttcttgttctctgcagatatacaaacccagtagatcatcacttgcctgccctctgtcctccctgagttgaggataattggcttgttattattagatactattatagttattattttcgtttcaaaaagacttgaaggcctacagttcagggccccagaaggaaaggcacattcagacagatgcatacctcctgctggtaggcaaagtcaatagctgagaaacttaagcctttaatatctgaactgttttttactgagacataagaacatattgagtaatgaaaattacattcacaaactatcagagaagcagaattagaatattttttaatgtttttggcattacagatgccaaaaatttgtaaatttgtaaatgccattataaatttggcagtcacatacacaggcccttcatgttctgaaatcagatgcttaatctaatttctaaaattttttgtatatatttacatgcatggaaatatagaaatgaacttgccgagaatcataatagcagttgatacagcgctacaaagaggttctgctctgaatgggggctttctccttgcctaacctggctgtcagtgactaattgtggttccctgggaggcagaaaaaaaaatcactgcctttcttgggcagaattggagaagttatatgggccatttctcagcttgtgtgttttggataacagaagagagcattcttcagggccaccctgaaggtcattcagatatcccatttttaaagagtggaatgtatagctttgatatttggcgtgaaagtaggcacagggtgcctagtttgcctacaactggacaatatatgaatcttccaaaaagtaatactcttttttgaatcaactgtaagcacttttcaaagagtgagttcacataaggatcacaggcgtgatgttctcacctgaagggtgtgatacatcttcaaacactcagaagaggcaggttggctatcgcatgttagggcatatatttcaatttccacgccatgagttataaagataaatacacaaagatatttcttgtccattataaaataattaacgtttacaactctgatcttaaaaagagttgaattcatggtaacttagcaacaattcagtggagtcaattttacaacatttcttacggaagtctgaatcggacaataggattccaattaaactgttaattgtgtcatttaatacttggcatgtaaagcggaggcctgacacagagagaataaagtagacatagcgttaatgatacaattcaactgattcttttctaaacatatgacaataatttcatgacatacatgtcagtattttttaaataactaggtattataattgaggatcaataaatttttttttaaacttccaacagaatttagtattacgtgtgcattttatgctgaaataaggtgattgcctaaccatccaaaagtttccaaaacactcagaatgaaatccaaaggccttatcatggcctactagaccctacacagtccagccactagagtcatccagaccctatcaggtattcttctctttgctcactgccttcctaccacattagcctcctggctactctttgaaaacagcaagcagttctgtctcaagctctttcatttgctctcctttctgccaggaagactcttcacctgtgttcgtttcctcacttcaatccagtttctgctcagatatcacctcctcagaaagaattttctagataccccaacttaaaatgcctgccctcatcactctccaatctctggccctgatttataggatctcttactccctaactttatatttttttatctacttgtgtatttaccaactgtctcacctaacagaacgtgaacttttttgaaaccaaattttgtctgtcttgtctgaaccaagaccctgccgcagagtaggaacacaataaatatctgctaaataaatgtgaattttattggaaaaagttgaatttgcatttctaaaatgatatcagaaactacttgttatgaacattctccttagttgttcacatgatttcagggttattatattttaacagaaggccgaggtgggcggatcacctgaggtcgggagttcgacaccagtctgaccaacatggagaaaccccgtctctactaaaaatacaaaattagccaggcgtggtggcacatgtttgtaatcccagctactcgggaggctgaggcaggagaatcgcttgaacccgggaggcagaggttgcggtgagctgagattatgccattgcactccagcctgggcaacaagagcgagactccatctcaaaaacaaaaaaaagagaaagagaaatagaaaggcctaaaatttgaacttagaaatatataaagaaagactcattctgtatctgtgatatttattcctgaaaagatttattaacattcacctgactcagtattgtttttctgtattattatataatgaatgacatcttttaaaataaatatttttattatgcagttaatatatgctcacattagaaaatgtggtaaatacaggccaggcatggtggcttgcacctgtaatcccagctatttgggggaggctgaggcaggaggatcagttgagtccaggagttcgagaccagcctgggcaacatagtgagaccccatctctaacaaaataaaataattagctgagcatggtagcaagtgcctatgggaggtgaggagcgtaagatcactggaacccaggagttcaatgctgcagtgaactataatggcatcaccacaccccagcctggacaatacagcaagacccctgtctctaaaaaaaaaaattaattaattttttaaaaagataatctaggaaatacaaaaacttctacccggaaattaccactggttaaatgtttctttttgggttaaataaaattgggatccagttgtttaccatagactatttaactatatttttctcttaacattttttatttgcaattatatcttaagcatttcttgccattaaatatcttcagaaacataatgtttaacgtcctcatactatttcattatgtttatgcctcatacattatttaaacattcccttattcttgaacattaagatgggttttggtgttttgatagagtttttaaaaatgctgttatgattatcttcatatacgattgtacgtatatctttggataagttcaagtaaaaggatataaacatttaaagtaactaatactagtttaatgaagtgtgtgatctcaatgctaataaagtattagatattccaattcacttgggggtaggaattttttgatgtatggagtgtttttatgtaaatgagctcatgtatcttgcttcaacttaacgattatattataaacatctttgtatgttactacttatgtctacttcatttttttaatgattgcataaaattttatatctggatgagccataacttgtttaatcagcatcctactagattatctttttaatgatatttactttcttttcctagtttctcattagtagaaatattgtgctgcagttgtgactatctttggtcaattgtgtaaatttctagaattagattgctgggtcaaaggttttgaccttttaaattttgacaaatactgccaaatttccctctacaaaagttttatgaatttatattcatagggacagtaaaggagagtttttccaaaccagctataacattgggtcttttaacctctgacagctttatagattatatagggtatcttactttaattttcatttctttaattccaagtaaaattagtcatgtttttgtatgtttgttaggcatttgtcttatactttaaatttttaaaatttgaaaattttaaatacttgctatctttcttcagcaagataaatgcaattaggagcaaatattctgttcatgctttactttaaaaatcatttatttcaagtctttgttagtatgggtaaaaacgttatgtaacattttctttttatttttgtgttgtttttgcttttttagtaagtgattcactgctttaaaattttttttaccataggaatagaaatatttattttcatataactcttatattgtaatcttataaattatttttacaaattggtgatatgtcactgaattttaggaaagacgtggatagagttatatatagaattttgtcatatatgttggcatgcaaatgaaagtattcatttatttttaataattatttatagagctgtaaacttaaggaattcgttgaagtagtcaactctaagatatcattcactagacctactatttatgataatgaatatattattaacactaatgtaggtaacagtatagttacattggtagttttcttaagatttcacatacattatgtcatttgactcttaggctaaactttgaaccttacaaaaaattatatgatcacaattgaaatcacatagtggcaacccgggtctgtgtaacttcaaacccgtgcttattcttattattattattttagtaaatagatccacagaattgagaggtcctctgccatcatcatataataattgctattcttgccaccataaataaatgagaatgagaaagtcagcttctcctattctgtgtattataatcacaatcacttatatttgaatagcgttctagtcattcataagttgatttcacatcctttaacttattttatccttgaaataagcatgtaagttagataagactaaaggcaatgttttgttttcatgcaagaggaaaaacatctcggggaaatgatgtttttgagatcaacagtcaatgaagagacagaatcagaattcaaggcttctgtgtttcagatggacaatgatgatctgtcacttgccaagttgaatgcatacaatttgatgtattagtagcctctatttaaacaaggttgaaaaataaaacagaaaacaaaagtacagtcttttgtttttccatttgcctgatgtcttataattctttactgtaaaacgaggcataggtgagtttttacctctttctcctgagaatacaatggttgttttagtgttcatctgccaaaaatctttagaaaaaggtcagtaaatgaaagtgataagaaacacacacatacacacactcacacacacacatcactctgattctaaattatgactattttaagatttgaagtgcatgaacaagcttaatgattggcatgttgaagccaagattttattttggactcatttccattttaaatataatagagtttattataagtattttataaatattgcttatattttcgtattatatactttaaatgtttgcattttcaaaaataacgcatttcttaattgattttattgtgcttatttctaatgtaaatgtgccttaatttaagtggaaatcattaagaaactggaaacacttaatacgtttgccttccaaggaaacttgctggaatccctgtacgtacttgcctatactctgtattgccacatctgggaacattgcttattatattttgtgagctttgtctggcagaaatgcatcttttttctaaggcctaccccagagatcgttatcactgagaggggacagactgccaaccttcatcaataggattttcactaaagttgtttttcttagggtagtaatgagtggtcaatctttcagacatttttgtgttcaattctgatttatttgtgagtttggtagaagcagcagacttgcccatgatagtagaatgactttttccattaagactatctatcttgaataaggatcaagtctccgtgaggattacctctttatcattctatttaaatgagttgcaactgcgttcaataatgaaatgctttcatggcaggttttatactataccaaccatatagactcccagcttgacttttttttaagaggaaaaataggtagaatgctaattcttgtcactaatgttagctgcatatttgtcttttctcttggaacagctcaatggttattcgggacttaaccttacgcagtgctgctagctttggctccttccacctgatccgtctactctacgacgaatatatgttttacttagtagaacatcgtgttgctcaggcaacaggagagactcctatagcagtcatgggcgaggtaagagaggctgaaagagctgtgacccactgggttattaaaaataagccagaattacacttcagtctaaatacattattgattaaaaccatggttcctaaccaagtcagcctcagagccaggagggactgtggagttattgcaagagttccttaaattcctctgttcttatgtgcttaatcaaaagattctaaaattgtggattatatcatgtgaaagttcatggaatgtgtctctatattatacaggtacctatgtaaaagaaaaacttgagaaccactggaatatgaaaaatattttaagtgggaaaaagattggtgctcctgataaagcaaagggctaggaatacaatggaaaggattaaatatgtattttgtagactctttcccggtctccaagaacaaagtaaatgattctattttagaaggataaaaatggtaatgatgataactaacattttttggacacttactatgtgcgaggcacagttctatgttttttacatgtaataaagcacttaatgcaagtctttgagatacgttctactttattctgttttacaataagcatccgaggtttatgcagaaagctaaggcacagaaaggttaaatgattactcagctaaaaaatggtagagatttttttttcaaacacagtctgattttcaaacccatatgcttctaaccactaatgatgtaagggggaaaattctcttcttcagaatttctgaatagtcatcaaaatggcttatcaaaaagcttaaactctgaatataaacaagggctggttaatataatgaggaatagatgcaaatgctcagatggttcagcactggcttattttgttatattgaatgcaggaggcgggggtagtttataccttgtcgaatcataccagattattaaatgtgacaaattacccaaggcggtaaaaaagacatgttcacttttaagctatgtgtatgtgcttatataaataaaaaagagtgaaaacagatattattcaatgcttttcctagtttaatataataaggtataaataaaaatacattaaaatacttcaaggacctccctaatattctagtataaataaaatgcatgtcaaacttgcctagaaggtcagttgaaatattcatcttttccacttctttaaaaccccttgctgtatatccatctaaatgtctttgtatgatgttccctgttgatgataaagcttaaatgatgccaaatatatgtgtgagattaagcaggaatcactgtggcttttcattgtaagcaggacctcatgtgaccaaaacaatctggacttttcttatatttgacttcccctcattgcctctttctttacttgttttatagatgccttgttggaaaatgcccaggtagcacgtggactcagtactctaaaatttcttaactcagggttcaagacttcagaaatggaccttgccttttagtatacttaacacatttgccactacctcatatgctcaaggacttctttaacaagataaataggataatgatggcggggattctcatgaacaccatgtggctaatcttgatgcatggcctttgctttccttgcatctctagggaacaaaggcagtggatgtgagccagtcacacagtgtgaaggcttagcaacctcctggtatgcttgcacaggcggcaccagaattaaaatgggctacataatctatagtgccaactccattctaatagttattctttttttttttactacatgtaaacgatctaaatgaatatgacagattttacatgaggcaaagatatatacgtaaaatctaaatttaaaaaatggtcaaagatctaatcatacttcttgatttctttgcttactcagtttataggaaagccctttgacctgcctatgctcatccattatttaccccaaaaggcaaattcagactaattttataggtttgatctcctcatacaacactgatgcctcatacacctgtttgctctcatagatctattggccatggtcatactatcatatctaaaatttcttgatttggggaaaaggagaaggaaattcaaaaaataaaaagtttgttttctcatgttctcctcacattatcctaagcctaccttctcttggtcccttgggtgacttccttttccaatcaccaaatccagacgtgcctgtgtacatagtgggagtaacacatcaggccaaaatccattgaaatccatacaaatcaccataactcccagtcacagcaaatggtttggaataatgagtaataatagcaaccacaaagacaataacaattgtcactatttactgagagcatattatatacttaatgaagataatagtcttgctgtatctactaatggctctttctcagtaaatggcgccacgatcctcccagttgattataccagacacgtgagccttctttttttatgtccttctatcttgactcccatctacaaccaattaccaagttctgtttctcaaatccctcagagtgcagtcagtatcgtcttgtgaaaatgcaaa

SEQ ID NO: 15403 - DNA, 98864 bp, Human
  misc_feature (1)...(98864): n = A,T,C or G
gcatggccctaaacccggctaatttttgtatttttggtagacgggatttccccatgttggccaggctggtctcgaactcttgacctcaagtgatccgcctgccttggcctcccaaattgctggaattacaggtgtgagccatcgcgcccgggactattctccctttcttgatagtttcccttctgacatttccttccttctttctttcttttttctttttttttgacagtctcgctctgtcgcctaggctggagcgcagtggcttgatctcagcttactgcaatctccaccttccaggttcaagcgattctcctccctcagcctcccaagtagctgcgactacaggcacgtgccaccacgcccggctaatttttttgtatttttagcagagacggggtttcactgtgttagccaggatggtctcaatctcctgacctcgtgatccgctcgcctcggactcccaaagtcctgagattacaggcaagagccaccgcacccgggtccccttctgacatttcttcagatcttcctcggacacccaacgaccttaaaatccctctaaccttctttctctcaaagtttactttctataaagagctgataaactcattcatactaaagtctacagggttgtaaatcttaatctattatcgcttaaaagatgcttgtatcaatttacaccaaagggatgaagctctaattgtggggatttagtcatcagaaaatctagtaggggaaattctccctacccacaatcagagtagattctacaatagcaaaaagggttccaggctcacttaactttaggaacgctgataagaagaccgcttacagctgcggaggtactgatttggtaaagggagggaaagagattgtatacgtgagagtgaaaaaattgggtagaaaaatggaagagcatcagaaattcacttagcaacaccaaatatatttggcaccactaacctagtttctcctgtgtttgcctttccaatccgttggaccttaggggatggaccgcccactttctccccagagcggctcccgggtccggttctcagtcctaatcactgccccaagcctccatgctccagggcctgtggtcacagagcaagtcccaaggagcagaagtaaagttctaagagaaatcaccatctccttgtgcagggaacactcccaagcccagtgtccacagacaaatcacctccagcgactcgaagaggagaataatccctgtgggggcactggaggctccgcgtgaaagtttccaaagccatgttctgccccaggactcctttctctcctcccagaagcttcaggctttcgcggctgctggcacatcccagcctgagtagccgagcaagagggacccaaggcaggatcagcttcccccgacttgaaagggcacccgttctgcaggtgccggcgctggaaatagctggtgtggagaacggagagggagacgtgcaggaggaagtccgcgcccaggagggcagtggctccgcctctctgggttagggacagaagaaaacccttaacccaaagccctagcatgagtgaggcgtggaaagcgagacagactccagtggaaggctgtggggcgggactcagggttcccggagaggccgccccagctcctgccgcagcgctgggcgccctaccacgcctgctccctagggaccccgggcgtcccacgcacgcacccaccctccttcccgggcctgccgctcctccctccttcctcgctggttggcccaggcgccgcagagcgcggcggcagcaggaggagccgggcgcgcctgccacgcaaaactaccgggctggcagggcggcgggcgcggtgcgcgatcccgggtggcggcggcaacggcggtggtgacggcggcgactgcagcggccggctctcacctctcccctgtgcacccgcatctcgccgcgccgccgagcagccagcagtccccgggtcgcccagcccacgcgcgcacggccgagcccagcgcacaatagcggcgacagccatggggaaaccggcgaggaaaggatgcgagtggaagcgcttcctgaagaataactgggtgttgctgtccaccgtggccgcggtggtgctaggtgagcggcgcggcgggtgggcgatgcgcgcaccctcacgcgctctctgcgcccaggccgcgtgcggctgagggtgggcttggcgctggcgcactccatgcagggtccctcgatgccccctcggccttagcctcgggccccctgcgggggctttcccccaagcgctctaattactgcacaccaagaacaaagctcctctgggactcccatttgagtgctccttgagctgctggttcctgctctacccaaaatgatcaaaggggcttgggggtagaaagggaagcaagtagctcttggttctgctcgtttgaaaacagggttcgatttttttctttgttaatcccgcaccgtatctccccctatcaccgccaccttcctcaccccacacccccagcctcgctgcgcgggcagagattgagtgtggattacagttctcagtcgaattggaagaggcaccctggcctccgggatgggccggacccttaggggagggaggctgagaacgctgtcgccgctcatcctgggcagtgcgtggaaaggtgccttcccacgcggcgagcgccgactgcctgcacccgggctctgaaaagctgccagattcgtgcctgaattctgggatgtgccactgtggcccgcgggaggtcaccggggaagagagctaagagaactcagccgtctcttctcctgccttccttgctctccacgttgtttttgtatttaagataatgtttaagccatccttgcctgtttttaaacaagggtgtatttaagtgatccacccctcacagatcactggaccaggtggatgtctgagccattgctcagaggtatgagttattcctatttagattctgattttttaccaaggttgtgtgtttctagctccggcccggggatgcacttccttgggattagcgccatatctgtcgccttcccagtgatagctcctcagcaggtgagggctgttgcaccctctgaggaatgtggattcctcggcaggctccaccttccccttggaaactgcagctgtgtttgctgaaaaggcaagtggggacagcttgtttcctcccaacctcaggtaccttcctctccaactgctgctcctaaatctcagaatatatggtgttgcttgcttctcctccgaaccgccccctcccctcagggtggggatagggcatggaaatggcctttggaagttaatgggattcttggggtcagattggattctccagaaccttggggaaaggaaagtcaggtttctagtaaataaataacatcctggaatggccctagcagaggctatttgtaggaggaaaggagagaagtacagaagcaaatcttgactatttcccccaagaagtgccaagtggttttggaacttttttttttcggttttgaacatttttaagggaaagtttatcctactctaccatatttaaatagcatacgctacaaagaacgacttgatttcctttaggccaaagagaagagatggccttgtttgttttcctagtgataagagtcgaggattaattgttaaatctctttttgaagactgagagatgccagggcaaggtggctcatgcctataaccccagttactcgggaggctgaggcaggagaattgcttgaacccagaaggcagaggttgaagtcagccaagattgtgccactgcactcccgcctgggtgacagagcaagaatccaccaaaaaaaaaaaaaaaaaaggaaaaggacttttagagggccaggcacggtgactcacacctataatcccaatattttgggaggccaaggaaggaggattgcttgagcccaggagttggagaccagcctgggcaacatggcaaaatgccatctctacaaaaaagtacaaaaattagcgtggtggtgcacatctgtagtcctagctactcaggagactgaggtgggaggatcacctgagcccagggaggtcgaggctgcagtgagccgtgatcgtgactctgcactccagcctgggcaacaagaatgagaccttgtctaaaaagaaaaaaaaaaaagactttgcaggataaacattggcttgagtctccctcctgattccctgtggaagtggagttatcctgccttttcagcatggggctctccagagatactcacttgctacccaagtgttgcacaccactcgtcagcatgcgattcactggagactggtttggagaaggttttaagcaattgttccctggcctttggaatcagttgcgtgaataagaagaagtacatgctcattttgcagacatggcctttggtctcagatgggcactttcctccaattttaatgtctgtgagccccaagagcttagtttgagtacttttctccagaaaggaaagtcaccacttaaaaatcaagtgcccagctgaaatcttcctagatatttgttccttcagatggcaacaaagggcagtcctgcttctggtctgagaagtctcaaacctagaccacccccgatatgcccattaacaggggtccttttcttgtcctttttcttcagagtactgggcctgagtggaaactcatacttgtttgtgtagtctgtaagggctgatttgtttaattgacagtgaaattccagtgacttataacagtggcactgagtctattcataaacccttgctagataatgatagtaagagcttattttataactgccttaactgatccagaaaaatcgcaagagctctaatgcagcctcccttttggacttttcagcatgtggaacttaaagaagaaaaaaaactgtgaaatttattaactatcatgacaaaacatcttcttctgattatagccgttcaaatgtttggtccctgaccaggtgcagtggctcagacttgtaatcctaggactttggaaggccaaggtaggaggaatgagtgagttcaggagtttgagaccagcctgatctcatctctatttctaaaaaaaataatttaaagaaataataatgcaatgaaatgttcagtcactactataattcagtagccctaatactttgaaatatttgattatagaaataagaggcaaagatttttatgagccagcttaaagcctgatttttcaagatacagcacatgaggggaaatgtaataagggtcatctttattaggtgtggaagttcactcttttcatggacaaggaaatgctaagaactaaacatttctcaaattcttgttcacaagatgaagggattcaatagttaggtgaccatctttttaaatttctgcgacaccctacatggtcctgaaaataatatcttggattttcacaggaaaatcctctgctaaaataccactagaaacactttcacggctttcattacaattcttataggcttattctctgcttccatagaatggtagaatgagcacagagcctggagtgaagagtccttgggatttgaattctggtactatcaagctctatcatgcaggcaaactgtgtatttccctacaagcctcaatttcctcatctggaaattggagatattacttattacttcgtttgttattagaggtgtgaaagatactcagttgtgtggctggcatatattcagcactcaatagttgttattttaaggtaaatctgaataatttgattatgagaaaattaatattttcttatgaaataaattctctcatagtatgtctctttctgtgtcctgcttagtgtcccgcctataatttagggtgactcaagtgttttgatgacctgctctgtctgagctaataactgtccctgtagtattattcatttctttaaagaggaaatggaaagaatgaatcatttatttttgtgccccaccggctaatcctcaattcatttaaatataatatttaaatatataatttatataaatataatttaagtatgtaaattctgaaggaaggttttatgctctaagtgggaattctgtccaagcagaattactgagtgagaattctgccagccttctaatgcgggtcatccaataatgattatatagtatatgatgttgttaaggcacttcttatatcctcaccctattcacaatataatacctaatctttctctccagaccagttatgccattacttctgtcatttgaaaaatctgtgatttcaacttagagctattcagaaaaagcaataggtattggcatttacatgacagagctggcaagcttattcattctaaattgttttctttggagcgctaaggaagcaatcatgcatagattctgattccattatctaaaatcagaaacagctccttcatggtcttagcaatacccttgcccagcctcgtgtctctaccctggagctcatgtagcgtgcatctggcagtgctaatttgagacgtggcataggctttcccgctttgtctgtgaagcccctgaggacagggcccagcggcggttcacgctggttccaggcccagcccctcacctgcatagaaccttggctcagcagtgtttaggaatatccctgtaataatcaacacttaagccattcattcatttaacagatatgtatcagacccccactgtgcaccagggattgttctacagccgggtcacacagcatgtcctcatgggacttaatgttcaagtagagagaggtagaccataaatagaatacataggtaacctactgtatagagcatgttagatgagaatagtgttctggagtagtatagagcagggagtgggctggcaaggtggggggttgcaattttaaacagggtgacaggggaggccatactgagaaggtgacagttgaatcaagacggaggagaggtgaaggaacaagttgcacaggtatctggggagcatcctagtttgtgtgagaaacatcaaggagtagaatgagggagggaaagagtaggaggagatgaagtggaggtgaggctgggggcagagcaatagggtggttcaggtccaaggtccaggaaaggggaaatgggtgcctcagctgagcagccaggagtggaacagaatgaaaagacagctgcttgaggttaacctgcagggcttggctggatttggtccaagggagaaggcagtggctatctccagcaaaacagagagtcctggaaggggcaccgacttggaaaagaacatggcatgttccacggtggacgtgttgagtttgaggagccagaagggtgtttgggtaaaggtaggcagcaaacacctggctaagtgagtctggtgctcaggagacaaatgtggagtggagtgtcgacttaagacagcatgtcagggacctggttaaggctttgggaatgaatgaacctatcctgggagaaaagggagaagagaagaccaaagacagagttctggacaaccccaacattggaggtctgggaagagaaggggcccacaggagaaaccggacgtggtgtgatagaaattaagaacaggaacagtgatgggtgagaggctcgggggcaggagtgagagggtctgaggaggaagttcaacagcgttggggatacaaaggacagggatgtgaccttctgggcttttatttggaggcacttaggtgtgaaagaattcagagaaagtggaagtcacgtttaagatccagagagtatttttctttctttttttaagagacagggtctcgttttgttgcccaggctggtcttgaatgcctggcttcaagctgtcctcctgcctcagcctcccaaagtgctaggattacaagtgcaagccactgcactcagccttgttttgttttgtttttgtttgttttttgttttttaaggagacttgagtctgactgaacctgaagagaagtgatcattaaaaataaaaatgcagctgagcatggtgactcatgtctgtaatcccagcactttgggaggtgaaggtgggaggactgcttgaggctaggagttcaagaccagcctgggcaacacagcaggacccctgtctctgcaaaataaaaattaaattagccaggcacgatggtgcgtgcctgtggccccaactactcaagaggctgatgtgggaagatcacatgaggccaggagttccaggctgcagggagcttgatcacatcattgtacactccagctgaggtgacagtgcaagatcctgtctctgaaaaataataataataaatgcagaagagagagaaaataatgaatgctgttgggtggagtgaggcctgggacagtagaagacagtgtgaaatggagggacctagttggggattggccagagaacgggactttatactcctgagatggaagggaggagttaagggtgaagcgttgtattcctttcctgtggctgccctaacaaattaccacaaaccgggtggttttaaaaaacagaaatttttttttgagacttaggtgtatccattactctgtgccaagaactgttctgagtgctatataggtattaaatgatttaatctttccatcaagcatattttcaggaaacagaggcacagagaattaagaaacttgcccaaggtcgagggcagagccgggattcaaaccctggaagtctggctctagagcctctgcttctaaccactatcctctcccgctgctgtgtgatattattaccctatattctgatgtttctgcctccctcaccaattcaggaaccctaagggaaggaagtttgtgttgctcttctctgtgcccatagtacctatcacattgcacagtagggtgaatacatttgttgaattgctgagccatttatgacccagagagttagtaaaatgttgtccttgtttgtcaagggaacaaatgagcctaaagcttaaatcaaactctattacctccataaattctcctctgcctgtttcagccccctctgatctatgtcagcaacatagattaacacttgatgaatctatataaatatcaagcatgttgatcttttctttctcaaaactagattacagaccccttgaggtccctcttattacatttcacaggcactaaaaaataaaatgaggccataaagtaatgagactgactcttaactgtttttttaatttttaaaaaagtatatctgatacctatactctctgagtctttgtttcttattaacaagaaagggacttagattagctgggagagcaaagaagattctattcatgcatctattaccacttataggtagtggactatctggtatgatctttattgaaaaagagttgaaaacaaaagtctgaaattgattactgctgtctggcactggcttaggatcaggaactagtggtatgcgtgctgagtaattgttgacttgggttataaaacctctgagagtccttctagctttaagaacctttagctttatgactgtatattcattcctcagttcattgctgggagccagaggaactcttctgtaaggagctaagggggttcaaagggcattacaagatgataaaatgacctagacattgagtcaactgttctgtgtttgaactgctgatcagtgacatagggataatcatgtaaattgtatatggggctattaccatggtaatatgttctatgtcagtattattagatggtttattacaacagtaatagaaggtctaatatatgtatgtttttggactttatatgtctctaatttaaaatatttgcaaagtacacaatactccaaaaacactaaataaaataatagtttcttcaaaatgacaggaatagcctagttcctatatcctcaaaaccagtgatttccacaacaataatcagtttgacatagggaaaacaaaaaaaagcatagttattcatatataatggggacttttgctttcaatgaggaatatagctttatgtttatgtatttctgaaaagtgatgaaaacagacaaggttgctagtttagtcatatatatttaatttgtattaatatatttattccatagcatgccacagacatgacaatattagcaaaataatgagcactactaattagtttccataatattttctagaaatttgggagttgctagtgagttaagttcatctgcaaaaaaatatatatatatgtgtgtgtgtgtgtatatatatgatattgcttatactttctctaaaatactgagagatatgtggtctctgtctctgtatatattacatgtatacatacatatacatatgtatgtattatatacataatatatacatatatattatatatgtatatataatcttatatattatatataagattatatattatatatatataagattacatattatatatgtatatatatatctttttttttttttgagaacaagtctcactctgtcacctaggctggagtgcagtggcacgatcttggctcactgcaacccctgcctcccaggttcaagcgattcttctgccttagcctcccgagtagctgggattacaggtgcccaccaccacacccagcgaatttttgtatttttagtagagacaaagtttcaccatgttggccaggctggtctcgaactcctgacctcaggtgatccacccacgttggcctcccaaagtgctgggattacaggcatgagtcacggggcccagccatatattatgtatctccatctatcttatctccttagttaagtaccttagagaagagatccttctggcctcgccaaagttctacatattaaagaattaggaaaagaaactgggctttgaatgcttatgcctggtgttttcatttttgcaactaaatcagaatcagatttgaagcatcactgaaatgattctgatttttggttgttctatgcaaggtatatatgactcaagtctatcaaaactccaaacaaaatgatctaaacacaaaattataaaatgaatctttaaaatgattttacatattagactctgcacatgcaggttggtatatacaatcttaatgcctcctatgaggaagactgaatataaattgctagtggttggcaaatattgaatatcttgttagatgttgcttaatttaagatacggtgttttatttagtacagtaaaactacaaaattgaagttgctcacctgttaaaaatttgagcactgggcataagaaataaagaaagcttcaaatgaaaacacgctgtgtagaaaatttttgtgtgcaaattcaggatgtggtggagctcaggtgggtaaagcctgggttatgtcagacaaggtaggattaggaatcagttgttagagagcatgtatgcatgtgagagcacttgcttataaagagagaaagctttccacattaattgcttgtgagaaattgtgattacctttaacagagccgagactgaaaataactgtcctagggagtccgtgacacactggcctggtgccagggaagctgtgttcgcctgaggtattgcaaatttcccgtgtcgctggagatttggggtcacagatgctgtgacaactcaagcactctcgaagaaaatgaactcattttagatgacattgagtggcccgtttaaactccccatagcagtgtctattaaagtagaaagtgttttaaatggccttttctattttgtttgttttattttgagacagagtctcactctgtcacccaggctggagtgcagtagtgcgatctcggctactgcaacctccacctcccaggttcaaacaattctcctgcctcagcctcccgggtagctggcagtacaggtgcctgccaccacaactggctaatattttctatatgtttagtagagacggggtttcaccatgctggccaagctgctctcgaactgttaactgcaggtagtctgcccgcctcggcctcccaaagtgctgggattacaggtgtgagccactgcactgcgcccaagaaactgatttagaaagagttaatacattatacttgctgaggaacagccccaaactgcaacaaagagtactctgttgtaattagtacagcccacagtaacacctctgttaatagaaaggaagtgtttcagtgactcactctttttcagaaattttactactttactttgaaaattatctgctgactgcctgttccgttaccaaaggtagaatatttcctttccaataaatagtcctatactttctgggatggacagatctcatcccagctcacagatgcttcatgttcctctcccaggcccagcctcggctatgtgagctccgggcagcggttcccactcagccaagacagggagggatacagtgccctgttctctaccactaatccccagacccagccctgagaagataagacgtcccaccagtcctgcactcatgctgaggtcaccactcccgagccctttcttagtctcagagtccctaaccgtgtccaacacaggacaattgtcacagcagatctccgcatgtctaggaaggctcttgatagtagaaagtgttttaaatggccttttctattttgttttgttttgagacagagtctcactccgtcacccaggctggagtgtagtagtgtgatctcggcaactgcaacctccacctcccaggttcaaacaattttcctgctatcatcatgtgactctctgcttggtctgcatgttgaagcaatagcagactttgggactggaacttggcttcggaaacaccctcagagagggtccacatggccacatggtgtgtttattcttataatctctctgagacaactatttgggtataacacttccagatgtagttaaaactacagcactttggccaggtgcggtgctcacgcctgtaatcccagaactttgggaggccgaggtgggcagatcacctgaggtcaggagttcaagaccagcctgaccaacatggagaaaccccatctctactaaaaatacaaaattagccaggtatggtggtgcatgcctgtaatcccagctactggggaggctgaggcaggagaattgcttgaaccctggaggcagaggtcgcagtgagccgagatcacgccattgcactccagcctgggcaatgagagctaaactccatctccaaaacaaaacaaaacaaaacaaaacaaagaaaactacagcacttactcaaccaagggggaaatccttataggagagagcttaggtgagaatgtacaattatttttctaccattgttctattgcttaagagttacctcgttactaataattcagtaaggaattaagtcaacataaaaaaatgcaccatcaccagaaatgcctaaactacagagagcctaatctctgagcctctccccattactggaaaataaactgatactgttcaacttctgtgggtatctcaaagacttgttttctgagccacttagcaggtttcatttaagatttccccaaattatgggccaggcacagtggctcacatctgtaattctagcactttgggaggccaaggcatacagatggcttgagcccaggagtccaagaccagcctgggcaacatggtgacacctcatctctacaaataatacaaaaattaaccaggtgtggtgggtcacgcctgtagtcccagctactcagggggctgaggtgagaggatcacttgagcccgggaggttgagtctgcagtgagccaagatcacaccacagcactcctgcccgggtgatagaatgagaccctgtctccagaaaaaaaaaaaaaaaaaaaaaaaaagattccctgaagtatgagacattgagagagaaagtgagagtgacatattttctcccttgaaaagttctctttggctaaccaaccctaatatcaatatttattgagaatttaccacgagttttatgtacatttatctcccatttgaccctcagtacaatgagttagggggttcccattttaccagatgaggaaactgaaatttacaaggcttaggtcatgtagctgagcacacagagctaggattagcacccaggactgtctgattccaaagcttaggttactaattattaatcattaagcaagtcttcttccttcctagtaaaccttgatacacctacacctaattggtagttagaaccatacttggagacaggcttctttcttgcaaagtggccaaataaagcctattctcctccttcttgcttcatcctttctcagtcttgtagctcatctttattgcgtgtggttagtcctttccgctacgcttctcctacataaaccttctgtttgagcttgaattctagtgaaactcatctagttgctttcccagaactgttgtactttcatgccctaatccttttgctcaaatgtttcactcactgttatcctgcctatccttgaagatggatttaattaccacttttatgttgtagacttctctgactgcagttggagataatctcccttctctacattcttaacccttgatttatatgcataaattatcaccattagcaccaccattcccacgtctgttctgtggcagacatcactgattacagtactcttcactactgagctctgtcatggcctcagaatcctcgaaactttgctccaggcaaccactgttaatcaaacagaattggtgcctaagatgaaaagtattgtttgttgctgggaaaagtttattcatttggcaatcaattaggaactgaatttaaattgagcaagtactgatgttactgataagagaagcagagtcaaagtctgtattttgtcctctcagtccattggtggcaatacatccacaatcactaacatgatcctgagtgtggtaaatgctgcaaggaggctgcagcatgctgtgggccttcaaagaaggtgcaactgggaaagttcctggaggaggccataattggaatggccttgagcaggtgtggtaggatttctgggcttgaagactggaacgagcaagtctgtataaaggtgatgatacacataaggagggcttatcatctcttaggttcaatttcagtattacatggaactataatttaatatatgtgttgctgtgctttcgcactttttcttacctgtttcctaaggacaagaatgcaatactacacaggtctgtcacatcatagcatccagcattgtacttacttcacaggaggtgcccccagatatatctgactgattacaaccttcttcactgaagaattaaaacaggtaaatctttgatgaaccaatcccattgatcccctagaagcccactcagttgtatgagtttttgagtgaagaccatgaggaactcttatgctagcctaagtcatcccaaacatacttaactcctggaatggggaccccagaagaagagcaagtctggttgctaacagttttgaagccattttattgtgagcactgcatgaccctgaagctcccagactggagagcatctctgtaccctaaggaagatctgatcttctcaagaaaccagcaccagaacccacctgatctccagataattctctgggctaattagagaaaatggaagatccatctctttttccataattgggctacagcttggcactgaatcaaccctggatggtagagccttttcagctacggtatttagcaactcttacaccattcattgaatttatttctggattttccccctccaagtgtcctttcacatccttatccaaattctgcccacttctctccctgtctggagattatttctatgataagaaattaattagcctgtctgtactacctgttccaggagactttgaacaactgcgtggataaacactagatgtggtcaccaaagagtcggaaaataagtttttactttttcattagcaaaagttaattgtcaaccaggagatgtaacaggcttgctccatttctgctgccgcttcttggatttctttcttgcatgtggagaatttcctgaggtttcaccagactgaagagattctgagttcttgaagtgatggagataaagatcttgttgtcataaaacagcaaagagcactgtgattgggtttgaaagatttttgattgtgttatggacagtgctcttactggtttttaaaaagttgatgttttcttctgtgtaaatttaaataatttctttaaaggcagtaagcttttatatttaatatacctttcactgtgcaatcacaacaggaagattttctaaattagacatctttaccttgaagaagaaacttgtctgtttcagtgtctttttgtagcaagattgaccaaaacaagtggtaaataagtctgtaatatttaactgtcatgaaatacctttgctaataaggaaatggcctcggtttggattaggtggagtttcgtgtgtgcgatgtgggggtgtatgtgtacatatatttcttttttttttttttttttttttgagatacagcctcactatgtcgcccaggctggagtgcagcggcatgatcttggctcactgcaacctccgcctcccaggttcaagcgattctcctgcctcagcctcccaagtagctgggattacagatgtgcaacaccatgcctagctaatttttttgtatttttaataaagatggggtttcaccatgttggccaggctggtcttgaacttctgacctcaggtgatccacctgccttggcctcccaaagagctgggattacaggggtgagccaccgcacccggcccatatttcctttttttatactggatagcaatatagggtcttgtctttcaccttttaagttcacagaacagtttgtcctgaccacacataagttaccagtataatgttttatgaaggtttagaaatgagctcccagaaaaataatattttaatatctacaaataaataatctgaggatgtttctcaattcagcatcaatgctgggttgtgccttgtggatttccattggctctacgtgcaaaagattaagttagttagaatgaggaagacatttttaattactgtgaaattctttgttgttgttgttgttgtttttctttttgttttgggaaggtgtctcacactgttacccaggctggagggcagtggcatgatcttggctcacttcaaccttcacctcctgggttcaagcaattctgctgcctcagcctcccgagtagctgggattataggcatgtgccaccacgcccagctaatttttgtacttttagtttttgggatggagagtctctgtcacccagaatggagtgcagtggcaccaactcagctcactgcaacctccgccttccgagttcaagcgattctcctgcctcagcttcccaagtagctgggattacaggtgcccaccaccacgcctggctaatttttgtatgtttttagtagagagggggtttcaccatgttggccaggctggtcttgaactcctgacctcaagtgatccactcacctctgcctcccaaattgctgggattacaggctcctgccgtctgacttaatttttgtacttttagtagagacggggtttcgccatgttagccaggctggtctagaactcatgaccttaagtgatccacctgcctcagcctcccaaagtgctgggattacaggcatgagccatcatgcccggccaaattactatgaaattctatcctgccagtgctttagaataacttgcattttaaagtacatttgcacattttacatataatgctatatggttgtgtttgggctttgtgtacagatgacttttgttattaagtggaaaaggcctgaaatatgctgttctatgttaagtaaattgatataacctaagaaaagatcttgttgccaattcagaaaccataaccttaaatagcatgcctgggtctcctctgtatctggtttaacatctgcattgaatattggtattttccaataatctccaactagcttatttattttgaaaaaaaaaaatagaaatctacgtctacttttgcttaagtggaaatacttgagtaatgcttggttgcttttttaacctcaagtcagtaactgtgaaagactggacttactgcacctaagatctagaaccctgaagttatctaattggtgctcatcactgagcttgtgtaggcttcctgaagcctattcagggccctgtgtactagggaaaagggttggcagatcacagtgtgtggagtatgcagccagtaattctttcttagattctctctcccctcttagaacctcccctcatttcccagggaacatctgttttccatgagggcagtactaagggggctgaagattcccacagacatataataaaaggttccaagagtaggctggcggcagtggctcacgcctgtaatcccagcacttcgggaggccgaggtgtgtgaatcactaggtcaggaaatggagaccatcctggataacatggtgaaaccccctctctattaaaaatacaaaaaaaaattagctgagcgtggtggtgggcacctgtagtcccagccacttgggaggttgaggcaggagaatggcgtgaacccgggaggtggaccttgcaagtgagccaaagtggcgccactgcactccagcctgggtgacacagcaagactctgtctcaaaaaagaaaaaaaaaaatagattccaagagtaaacaaaatcctcaagtgttactgtgcaaagattatactcaccatgtttgatttttttggtctctggtggtcatcccagatgcattcacagtcatttctggacctttaatgtaatccactgttgttattaaatgagctgatccacatggagttactttttgaaatcatgaagttccttatgaatgtttgttattgtgtcttaaattctttaaattcttaaaatatgtcttaactcacttaaagataaaagtaaatgtttctgtggtccttctgggagtggggaaagttacaactccacaaatgttaagagagaagggtgaacagttagcagtcaggcagcatggttgggagtcatgaggaagagcattcaagatgacacaagttttgtaagcagacctaaggaacgggctgaagaatgttgtggagacccaggtacttagacttagcattctgagttcagagttcgcccaggagttccaggcttgtggcaggtttagaaaatccaggatgatcggccaccttctttctcccagaggtcgatctgatcttaagttgtacctgactaaaacctgctgcaggagagatggtcagattttatttacacacagggagatggcttcctaagattgtgtagtgaaccaagaaggtgtttacaggcatgtgaaactggctattgtaaagaggcagtgatctgggacacgtgatgttagttaaagtggaggaaaaggtgtacccttcaagcagaggattccagggcctctccaaaccgtacaagtctgagccaagggacagaaattccatcagtggcttggaagccaaatatttgccctgatactgaggaagggaaagagtggaacgtgaccgtgggatagataaagggtcttcacaggaatgcaaacaagatgataggtagaatcacccatgagattagcaaacaaatcactttaagaggaaaaaagtagaataaagagagtcaaccacaggtagaaaatgcaagactttggaatccacaagtcatagatatgtatctcgggaaataatccaagcacacatgcatggtactgatacacctgtgggagagtgagagtctggttgtcccgagactgatagattcacccacctgctgggctctaagccagttggatatttgctcgagagactagattcctgtgggctggtcctaactttcccaactaagctcaccctcacttgagcccaaaggactcctaagactccatccccaggaggcatccccaggtgaggagctgggcacttgaattgtcatgtgtacagcaccatagccattgtaaaaggagaacatctcacaagtcaggagttactggagagactgtttatgacacacttctgggttcgatggccctgagacaataaattcatccacattcctgtggcccagttttcatgctttgctcatgacatcctccctcagtgattttctcctgcctttcataatcaggtttgatgagcaaaggttagaaagtgcagtggcttcctgggcatgtgcattaaatagcaattaaaatgcagtcctggttcggctcaatgcagcaggtgtcaatcaaacacctacagtgtgtcaagcttgatgccggggcggtggggtacaggaatgagcagacaaatgcttctgccttgggagcttgagatgaaagggaaggagagcacgaattagacctgtttgagggggtaatagaaattcagataaaactgagtagggtccagaggagagattctttccacctgagaagacagcctaggaaaggctttctggaggaggtggctttttaactaggctttaaggggtgggtaggagtttattaggcagagatagtggcaaagggctttcaagggagggcgatctgtgtgaacaagagtgtgaaagcaaaaaagcatgtaaacaaaaaagcatggagcatctttaagaaatagcaaggagtttgctgtgactggatctgctgggattggggggtgagaaggacatgcaggcctgtattggttagggacctggcaggaagcagactcaaaagagtttcactgagcagaattgaatcaagggactatttatagagttcagcagggtaaaaggaatcagcaagggatggtgaggcacccagggatgaataactgggaagctattagctcatctaggcctgaacagacaagagagggtgatggggtttccacagtacagtgagggctgagttgtggcagggaaccaaaaggcagggcctatgtggctgcagaagaacaggggaagggagggcgggagaaaataaaaaaaaaaacccaacctctgtctctttctaccattaagatctacagctactgcctctcatttgctaaacccagccaaaaccagaggcaaggaaccctggatcagccctcccagtgcacagagcaggacaaagaaagacagagggtgaatcggagggcaaatggagagtgaccagcacagagccatatggcatgaggtgccatgctgaaaggttttctcgggacatcaagaagtgttgaaaagatacaaagtctaggaatgatggcagggaaattattatttatttactgagatggaatcttgctctgtcccccaggctggagtgcagtggtatgatctcagctcactgcaacctctgcctcccaggttcaagcaattctcttgcctcggccttccaagtagctgggattacaggcatgtgccaccatgcctggctaattttttcatttttagtagaaatggggttttgctgtgttggccaggctggtttcaaactcctgacctcaagtgatccgcccaccttggcctcccaaagtgctgggattacaggcatgagccactacgcccagtctattttgataacatctggtgatactggtggctgttgcttaagggcattatgggaaatgagaggtaagaatggcttccacagcctctagctatataccagcaggaccatctcctgctgttcacacaagcctagccctaggcctctacatctagaaagcattgcccgtgcatctaccagcctttcttccatgcaaggagggcaaatgtggctggcggagaaggcacctagaataccagtggcagcttctctgtctccccactataatttaggactcttctaattgtaagcaacagaaaatccagttcaaacaggcttaatccagaaaggtgtaaggaggcgggggtgacatataaaatttatggctcagataccataagagtctagaaacagtacctggcttccagtacaggggtttaatatcatctggacctgttgtctccttacatacagtctctttacacctgtgtcattttcactcccaagcaagactcttccctggtgttgatacagctgccagcacaggtcaaggtttctttttcccagttccacacccagcaggagagataaagtttctgatccctattagttcaaacaagactccatggccttagccttaggctaactcagccctgagtcagagctccattcctcaatatagtcttgggaccaaaggaacatggtgatctgattggctagaccagggtccctccctcatcctaccatgttcccccaagcttctggactacttagggcttcagctccaccgtaaacaaattgagagttagaaggtatgctgttcactgcagggacaagggatactgtcccttagcaagagcaacagacctgccttttatctgttatgttcttgagctatttcctgaaagcaatcaatacaacactcataagttaaattttattgaattcatagttacaaaagccaggaagtcgtttagttattaaccacatggtttgaaattgatggaattgagacagaaatcactttaaaaactgagagagggtgtcatagtctgttctggctgctgtaacaacatcccacagactacgtagcttataaacaacagacatttatttcttatagttctggaggccaggatgtccaagatcaaggtgccattagattccgtgtctgctgagggcccacctcctggctcatgaatgatgccttctagctgtttcctcacacagtggaagtggcaaggcagctctctgggactctttcaaaaaggcactaatcccattcaggagggctctcccctcacgacctaatcacctctcaagggccccaccttctaacaccatcacattgatgattaggtttcaaaatatgaatttgaaggaggacatacacattcataccatagcagaggagaagaaaaattaagcatgttttgccttaaactcttaagaattctacacacacacacacacacacacacacacacacactacactacactacagcttatatttaatgctgaaagtctgaatgctttccccctaagagcaggaataaggcaaaggtgtccattctcaccatttcttttgaatatctcactggaaacctgggccagtgcaacagggcaagaaaaagaaataaaaggcattttgaaaagaaagaaacaaaactgtccctattcacagatggcatgattttctacacaggaaatcccaagaaattacaaaataaattttaagactaataagtgattttagcagggctgcaagatacaaggttaacacacaaaaatcacttgttatttctatatgttaacaatgtacaactgaaaatggaaatttaaatacattgtgtgacatagctccaaaaggtaaggattaggtatgtaacaaaatatatataggatctatactctgacaattataaaacactgatgaaagaaatcaatgaatgccaaagtaaatggagagacataagttgttcatggattggatgactcaacatagtaatgatgtcagttctcccataattgatgtatagatttaatgcaattctgatctaaatcccagcagggatttttgtagatatatcagacaagctgattctaaaattcatatggaggcagggtgcggtggctcacacctgtaatcccagcacttcgggaggctgaggtgggcagattgcttgagctcaggaattgaacaccatcttgggcaacgtggcaaaactctacaaaaaaatacaaaacttagccaggcatggtggcatgcgcctgtagtcccagctacttggtaggctgaggtgggaggattgcttgagcccgggagattgaagctgcagcgagccatgatcacgccactgcactcaagcctgggtgacagagtgagatcctgtctccaaaaaaaacaaacaacaaataaaactcatatggaaagataaaggcattagaagagctaaaataattatgaaaaagaagaaagttggaggaatcatcctatcttatttcaatatggttttcaagatatcaagtgtaatattggtgaaaaggtagacatggcaaaaactgcaattacttttgcaccaacctaatagatgaatgaagcagaacagagattccagaaatagacccatagaaatatgcccagttggtcttttttatttttttttaaattgagacagggtctcactctgtctcccaggttggagtgcagcagcatgattgtagctcattgcagccttgaactcctgggctcaagaagtcctcctgcttcagactctcaaagtgctgagattgcaggtgtgagccactgtacctggccctccaattgatttttgacaaaggtgcaaaagctattcaaagagcaaaggatagtctttccaacaaatggtattggaacaactagacatcatatgcagaaaaaaaaatgaacctcaacctaaaatcacattacattcaaaaattaactccaaaaggaaaagagtaagatataagacttttagaagaaaacataggggtaaaatctacatgagctggagttaggcaaagagatctagatgccaaagcacaattcataaaagaaaaaaattggtaagttggactttaacaaataaatctctttctctccaaaaggcacttaagagaatgaacaaacaagctacagactgggagaaaagaattgcagatcatatatccaacttgtctaaatttgtatccagaatatatagagaaactctcaaaactaagtaataagaaaacaaatgatcaaactttaaaaataggcaaaacctgaacagacacttcaccgaagagggtatactgatggcaaataaacacatgaaaaaatgttcagcatcgttggccgttagggaaaagtgaattaaaaccacaataagatgccagtaaatacctattagagtggctaaaaaaaaatacaacaccaagtgctgatgaggatgtggagcaactggtactattaaacactgctgatatgggaatataaaatggtacagccactctaaaaaacaatttggcactttcttatcaccttaaatacagctttatgatatggcacagcagtcccactcctgtgtataggtcctagagaaaggaaaacatgttcacacaaaaatctgtatgtgagtgtttatagcagcactctgcataatcaatcaaaatgggagacgagtcaaatattcttcaataagtaaataaactactgtctatccataaaacgtgatctattcagcaagagaaaggaacataccattgatacgtacaaaactcagatgaatcttagaggcattatagtcagtgaaaaaaccagtctcacaacttacatagaatatgattccatctgcatgatagcctcaaaaagacaaaaccatagtggtggaaaacagactagtggttgctagaggttaggaatggagaaaggtgtgactagaaagatacagcatgagagagctctttggcgtgatggagctgttctatattctaattttgatggtggctataagaattttaacatgttaaccatagaactgtacactaaaatagtcaattttattgtatgatcaacacatgtacacacacatacaaacatgcccttaagagtcagttggtgcatacatgtccggcatttgcaagagagggtctgtgtttactggtggggaattcctgttttctactgagttctcatccctgaaaagagcaaaaccttgagtggcctgatgctgccgtaattcccattgaggatatctgacctaattgttttgggtattgttgggcatggaaggttcactaacatcttaagataacattcacacggccagccagagcctccctggttatctggcttggggacgcacatgtcacatggatcttggaggaggttgggaaggctttccaaatacacttgggctgagttttgaagtcactgaaatggtaatcagataaatgagagagcagagggagcaataaataaaggctcaaagacatgagcgcagggcagaactgacacagtgggcatggttggggttggggctggggctagggtgggtcagagagcttgcatgccaccctatgttaggggaccactgaaggggctttaagctggagagtgactccgccagatttgcatcctggaaagatagctctgacttagtttgcagaatgaactggcagagacaagattgtatgcagaaagagttttaggaagttgatgaagtagccttggtgagaaatgcagcggacctgaaccaagacagtgtcagaggccatcactcactttacattacattacattactttacattacagtgtaaaggccatcactcacttgtcttctgactgggctggcaggattcaagcagccggggctcctgtatcccttttctcgctgactctctctctcctcttctctttctctctctctctcccccaacccccacccccactatactccctcttgctctggttttcccatgttgcctctccagcatggcagcttcaaggcagctggacttcttacatgatgcttcagggcttcaaagtgagtgtcccaagaagaaaactaatcagatgctggcctcttctaacctatctcagatttcacatagcctcactactgctgcattttgtctatcaaggtgatcacgaaggccaacccagcttcaagagacagggacagagcctccattttctgatgggaagagtatcagatattctataggcctatttttaaagtaccaggggacccagaatgaaaagtctgaggttttctgaagggaggatagatacgtttatttttcctttgttgggtctcatgtgcaggtatccaggtagagtcccagcaggtaattgtatattgagtttgtcactggggaaacagcatgaggcaacagatagagatggaaatggaagctataaaaacagatgggatccctgtgggagagtgtgctgcccaagaagagggtggaagacaaacccttgatgaacatcaacatcagtgtgaagcacaatgtcaaaggtggagagatgagaacttatccagctggctgagttcctctagacatccaactggttttcactcctagagtactgcagtctgagacttctctgggattcagtattctcttggtaaaagagtcatctttccagcaggactgaacccttgcttgcccagatcaagggtcctcttccacctctcacagctggctgctgagtcagaacctcctaccttcctcccaaggccaggctgtgttgtggagccttctgtcctgtgtgtttccagtatgggacaaggcactagatcctccaccctcttcccagttagctatgttccctggagtaaaagagtctttgaacaagttgttaggaaagtttctcctcttcaaccacttcaaaatgtccttttgagtgtaagccacatccaaataattagtcttcagttccagatcctgttagagagccacactggtacaggagctttcctgattcctcttttgtgagttgccataaagaaagaggaaatgacctataatctatgaaagagccaggttctaaaacagatcattctgacttcagagctcagcccttcaccctaggcatccctccaagagacaccagcatgaacttacccagaacgggcctgaacatttgaacaactgaacacaatacaccccagctggctcctggcagattgcactccagtgtggtgagtttaatttgagcaagcagttgaaataaaacagggctggctgtggggatgtggcagagccagaatggcttctcttgatcttttttttctctctgggaaacaagatgaattaatgaactgattcatactcccttttacccaaagtctgaaataaaccacccttatcatctcatcaaacctttacccgacccaaactatggatctgggattcttactcttctcttgccttcaatctatcccactcctgatgaagttccttcccaacttccaatcccatgggcttcactttcctgcctataaacagctgtcaactgcctgatttccctatgctaatccattctacacattttaaccaggcttttctccaatctaggctggcttttacacaaacatgttcaatggctattcattatccttaaaaactaatctttgtatattatagtttaacacacggtttatctcattttatcctcacaatgaacccattatatggaagggaacttagggtcagagaagtataaattctcctccctggcattcaagggctttcatggtgtgccccaagtgatttcctagtcttggttttctaaaccacccctcaagcaccagccaaactactgactgaacacactcttatcacctctttatggaagaaacagaactttggtgtccaacagaactggatatcgaagctggccatgtgactttggacaagtttcctaacctgtgttacattattatctttatctgtaaataacaggctttttagatcagatgattaaataaaataacgtattataaaagtgtttgggccttaggcacctgacacgttaatttcttcttcccctgcccctctgtctttaggtgttctctccactctccaccgtcctcaatagtccccgcctagtgaattccttctcactctcacatccaaggttcatctaaaattctttcttaatctcacctagtgtgaatttcaagggtagctctgaactcctacaactttggggtggccgttcctatagactagcttgttctcttgtcttctgtcttgtcctgcctactagaatacaatttctcagtggcaggagcagcgtcctctctttgacctcacaacatagcacctctgtggtgctggcacgaagaagtcatccagaaaacatttgtaagattgactcaagaccacgggaggcttcttgtgttccacgtgctgatttcctgattgctgtgatatttgctttcggctgaacactggtcaccttccctcttctgttattgtgtaccagaatgaaagatgacagccaggaggaagtttgcttgcagaggtatgtgggctgagctcacaaaatttaacaattgtttttagcttttgttcacattttaaaaattgggtggtctcacacaaagacctagatttttagtttctctttaaaaattcaggagaaaaggccaccatggaccctcactttcatgtgatggggcttgggcagagacatcaagaccaccacagacccatgggcctgcttccctcacttctgccctgatccctgtagccttgtacgtttgcagtctttgatgtcaactgaaaattgttgaaatgtatttcaaccctatctttaagaatgaagttgtagccgagcacggtggctcacgcctgtaatcccagcactttgggaggctgagacaggtggatcacttgaggtcaggagttcaagaccagcctggccaacatggggaaactccatctctactaaaaataaataataaaaaaacttagccaagcatggtggtgggtgcctgtaatcccagctactcaggaggctgaggcaggagaattgctgaacctgggaggcagaggttgcagtgagccgagatctcaccattgcactccagcctaggtgaaagagcgatactccccctcaaaaaaaaaaaaaaaaaaaaaaaaagaatgaagtccttactttttttttgattttaggacagatgaccaaggaggtgttacttccttgagtggtgaaaaggttcttctactgcatggggttttttgtggttttgttttttttttgtttttgagataaggtctcactctgtcacccaggctggagtgcagtggcatgatctcagctcagtgaagcctcagcagcctgagctcaagcgatcatcccactttagcttccctaatagctgggattacacacgtgggccactgcgcctggcctacagtatggtttttaaatatctttgtgctctccctctgtagacatctttcatttgcttagaatctgtggtgatggaggcctcatgccctattccaactccagctgcctgtcaatgtagtgtctgtagcttctttcacatggagaagctatcagtcccattctgtccatcaaggtagagtgaaaaatatcaggtcactctgctgcctctaccacctttcagcactgatggctccactccctgaggggagaggcacaagtgacagggaaggaagaaagaagaagaattttctcactttgtgatttattgcatttaattctcaccctgagtctgagttgggtatcattccttcttgacttatagcaaaatcaaggcacatagaggctgtcctttatgctccatcccaaagctagaaaataaatgatgagtggtttgggcccggttgtgtctaattgtgtcatgttttttcactattctgtctgccttagggtctccaacccctttcagctgtatttataagactgatgtttgcagaactgtttattagtttgcaggactgtttattagacaactacaaacggagctgaaataaaactttggtttctgtttgctctaaagagaagtttctgttcaatcctccactgggagtgtgtctttaggcctctaaattttataccataactatttgtataatttgaatggtctccaatgaaatggatacaaataataataaatacattctaaaatagcaataatgcatgacattggtttagatcacagtgtttcctatgtacattttctctttgggttcacccaacattctcgagataccctcactcaagtttttagataaagcaatcaaaaagcaagaggatttaaatgacataggtaagtatgcatgtggtagaaatggaattagaatccagattcttagctcctcttttcattatctgatcctgcttggtttttactcacaccaggcaataattttgaaagctctgctctctctacttgtgatattattatctgttgttattattcaatcataaatatttattgagccttcctgcaggccaagggcagggctaagtcctgtgcattcattatttcacttaatgctcaggacagccatatgacataggtactcttctcatttctctttaactgatgaggatacagaggcttagagggattcagtaacttatgtaaggtcacactgctagtaactggtaggacatactcaactccagataggtgactcatggaaatttctgctgtgtcttacatcttcacctagattgtaaaccacatggggacccggaccacatgtcctccacagagcttagcaaagtggttgtatgcacaggtatgcaagtcatttattaatgacagttgattttttctcggccattagcttttattttactttttctatagggattttcagatcacactgttctcaaaataatcctggttttctgttggctgttttgatttatctttagacactgtaattgaaaattaagctcttaagcatctcctttacaggctatgttccacaatctgtaatcacaacttttctttaaattgatcatcatcttttgagctgttaataaacatgtctggcttcatttgggttttcaaattgttatttccagacggtgagactttcagatctgataggctcacacacatcctgccaagtggaagtttgagcaaaatgtcacatctttggcaatatttgtgctattagtatgatgattaaaggaaaaagaaaagtttcactgtgatgtcagcagctttcccacctcatgaaaaagccatcaaattatcaaccaatcaaaattaaatgaatcccatttaattttattattatctatttttcttttttccccgttttaaaaatgaatttggttcatttgctttctgcttctggatttgcctgttctggacatttcatataaatggaatcatataatacatggacttttgtgactggcttctttggcttgtttcacttagtgtaatgttttcaaggctcatccataccacagcatgcagcagtgctttattcctttttatggctgaatattattccattggatagagatacaatattttgtttatccaataataaattgggcacttagattgttttcacatttggctattaggaataatgttgttgtgaacatttcttgtacagtttttgtgtaaggacatgttttcaattccagaggctatatatctaggcatgcaattgctgggtcacatggtaactctatgtttaatttttgaggaactgccaaacagtcttccacagaggctgcaacattttacattctcaccaaaaaggcaaaaagattccagtttctccacatcctcaccaacatatatcattttctcttttttgtgttttttaaaaatagccattctaatgagtacaaagtaacatcttattgtggttttgatttatatttccctaatgactaataatattcgacatctttttatatgcttactgtccatttgtatatcttcattggagaaatgtctattcaaatattttgtctatttttaacaatttggttgtcttttcattgttgagttgtaagaattctttatgtattctagacccttaccagatacataatttgcacacttctcttttttgaataaattgcaaagcaacatttttcaaaaaaatttttaatttttttctgccatattgtgaagcttggttgtctctaccaggtactacctcctatttacccataagtatttggaaggtcatcaggatttatgctcaaaaatggagtttgggggtgagaaggaagcactttgtttggagagggttttactgttgaggccctgcattaatcccctctgccacctccaggaaagctgtggtcacatctggtatagtagaaagtgccatggtggctgaggaagcttgtgggtttatcacatttttatccatggtggcatggacaccttgtttttgcttccgaattgctcttaaagaaaaattctggggcggatgaaccccatcatcatccaggaagaatatttgcagcacattttttcttgtcatgatgagtttgctgtttgagacggtatggtaagaagctttataatggctggctagtgtcattttccctcatttaggctcaaccgtgactttatatctgtatactttatggaaggcctggagcctcacactgaggcagaagagggaaggggcaagtgcagttgatggtggcagctaagtgggagagaaagtcagcgaagacaattatttattcaagacctttacaaagggagcggccccacttgtttgcatgttgattgaaccataccttagtgtccagttgcttgaggcttgcagcagcatctttatgctcttcaaagtgagtgctgccattggtagcaaggtcttatggatgcccttgctaggcccatttccttctttgttattccaagtatacttctaatgaatcagaacctgcctcttttttttttttttttttttttgagatggagtcttactctgtcgcccaggctggagtgcagtggcacaatctcagctcactgcaagctctgcctcctgggttcatgccattctcctgcctaagcctcccgagtagctgggactacaggcgcccaccaccacgcccggctaattttttgtattttctgtagagatggggtttcactgagttagccaggatggtctcgatctcctgaccttgtgatctgcccgcctcagcctcccaaagtgctgggattacaggtgtgagccaccacgcctggcctgaacctgccttttaacaagaccccaaggtgattcaaggcacatcaaagtttaagaagcatagatttacattatattctgtctatccctgcacatctcacatggttattcagcctaatgtccgtgtgagtcagtcttcctctttcttttcatgccttccatggatttcacctggtgtactcttgataccatctgtattagcctgttctgacaaggctataaagaaataccggagactgggtaatttataaagggaagaggtttaaataactcaaagttctgcgtggctggggaggcctcaggaaacttacaatcatggcaaaaggggaagcaggcaccttcttcacaaggcagcaggagagagagtgtgagcgtgtgaaggaggaactgtcaaacacttataaaaccatcagatctcatgagaactcattcactatcatgagaacaacatgtgggagacccccacctccatgatccaatcaccttccaccaggtcacctcccttgacacatggagattatggggattacaattcaagatgagatttgggtggggacactgccaaaccatatcaccatcctagtactggctgcagcttcctttaattactggatgaagaaacacaatcttttgatcaactagcatttccctgaagcacttgtaaacaattccataaaaatcctgagataggtacctatttgtgtttactcttgaactttccccagcctcctcctccccatccctgtcttcccacagctcaatacttccaccttccattgttcagtaccccgctgtgactcctgcctgtgctgagttgcatctatgattgactctcattagatgtgagctccttgagggaagggtcttacatcatccatttttataccttgattcccacccctggacctaacacaggtccttggacatagtaaatatttgcagaatttaattaagttattgagtcacattggaaataatttcagaagataccaaatgccttttctttttttttttccacatgccatttgttctcgtaccactaagaccctaagacttttattttgttgatatcaagtggtataaatattaacaaacattgtattatatatcataattttaactctgaagtttttaatttatagaacaaaagttaatatttctctaccaaaataaatgtcatagactgaggaaagaattttgttaatttggtcataccaaaaatatttaacattaatttctctcctcaacttctgactctgctgctccttaactctgtaaccatgacttacctgtcaaagccaaaactcttttgagcatttcatgagaaaatctataaagagtatatagcctacaataatagctaacatgtattagctgtacttacagtgtgagccaggtactttttattctaagtactttacatatagtctcattttaaaatctcctaatgactccatgaggttgatattttgttcttcccattgttataggtgaggaaacagaggcacaggctacagggtattttgtccaagataacacagctaataaagtggtgaggccaagatttgaacagtctcttcttaaagagcctgcctcctgaagggttactgatgaattcctttcttccttcaaaatgcttcatgtgatttaacatgccttatttcattgtgtatattaaaggccctttgtttatacattactctcatctatatttccccatttggccaatgcattgtataaattaggtgatctgtaaatgattgttggctaattgatcctatgtgcatacatgggaatacttggaaaagcaatgattgttttaatataacaagttcttgatgtagcaagattgttcctatacattgtggaactctcaattttaatatttactgactccattatccatcttaaaatgggcatatcggaaagggtaaggaataaataattgatggtggtgtcacacatctagtaatatgatagttgagctaatatgaattggttctcccaccatctcaaacacatagaaatacaaaagtcccctccagaccaatgcagagccaaacccaaactcaaaagcaataaaggaaatgcccttgtgccagaaataaaaagggaactcaaagccagaagtataaacaagatctggtgctaaggtctagacctgtcttaatctgttttgtgtggctgtaatagaagacctgagactgggtaacttataaagaaaagatgtttatttaggtcacagctctgtaagttgggaagttcaagggcatggccctggcttctggtgaagactttcgagctgcatcaaaatatgatagagaaagtcatctcatcttgggccatgtgtatataatttaattttaataactaatataaaattattgttaaaatatggtagagaagatcaaaggggaagcagatctgtacaaagaggaaaaacccgaggggtatcctggctttataacaacccactcttgagtatactaatccattcccatgagaactaatccagtcctgccagagtgagaactcgctactgcaagaatagcaccaaactattcatgagggatccagctcatgaccccaagggctcccactgggccctgccttccaatactgccacagtggggatgaaatttcagcatgagttttgctgaggacaaaccaaccatagcaagacccacttacaggctttaataatgggagataggggtcttaatatccacatggggaaaagtgatatgatcttggcccacgtgagtgaaggagtctaaacgaaaccttgacataaagtctggaaccacaaaatttggccctgcccttggaaacaagagcagagaaattctacctagtgactaaggaaaaccttaagaaagtttgccatttgtccatggctaaaataagaggttaagagggtacccatgagaagattaaaatccagatttatacttccctcagtgcatcatctaaatttacaccactgtgtaatgccgatttatcaagctgaaaaattaatatgaaaactgtcctggaggacttgaaactcctaagtccccagaaaaaataagtagcctgtaggtagactttcacaactcagaaaaaagccaaccccctcctcaaaagacaagcctatgatcaaaaattacaaattacacaggaaaagacccagtaggagaataggtatcccccaaactggagatgatagaacagtctgaaataatatatactaaatatgtttagaataactaaagaaaaacaggtggaatagaaactagataatagaaaaatgatagtgtgaaaaggatactgtaagttctagaaatgaaacttagagtggaattaaaaattcagtgaatgaattaaacatccagtaaatgcaactgatgtaaggactggaaactgcaagataggtgtgagaaaaatcagtcaatgcatcacagagagataaaaaatggggaatatataaaaaccctccaaggacccatagatttggaaactgaaaatcatattttttcaaagaatttacagttcaaagaaaaaaatcacaacatagatttataagatatttagaactaaacaaaagtaaaaataccatataataattcacaggacaccaacacagaatttagaaggaaatgtcttatatgcatatactgaaaaacaaaaacaaagctataattccagcactttgggaggccgaagcaggagggtcagttgaggccaagagtttgagaccagcctaggcaacacagtgagaccctgtctctacaacaaaacaaaacaacaacaaaaaaactcacaaagataatgataatgagctaagcgatcaactccaaaagggagaaaaataacatagtaaacctttaaaaattagatggaaagaatttattagataagagcagaatttagacatatagaaaacaaaatagggaatgtgatatggaatactgaacagcactttgaatgaactggatctacttgtattaatattaataaatctcaaaaacacaaaagaatttcaaaaacacaaggcaagagaatacatccagactgataccatgtgagttagatttttcaagcacaaactgacgtgagtagtagatgtataaaggcatggacaaaaagtaggctcaaattaagtgattatctaatctatctaagagaagatggaattggggaggatgcaatggaccctcaaccataatgttttatttggaaaaaaagatctgtggaggatttgttcagtctgcgtggtggatgtatacatgtttatgtatttttacttttcattgaaacatttcagaatactctttcaaagaatcaataattcagattctgtatactgaatagaattctaacaaaattacaattaagaaataaagttaatgccagtgttgcatgaggtttttactcatgtggtttggttgtagtaaggaatctacaatagttgtagtaggcagttctgagacggcacccaagattgctacttcttggcaaacataccctgcataatccccttactttaagtgtggatatgatgggatttcacattcataattagattacattctttggcaaaggtaaagagacttttgcaaatgtaattaaagtccctaatcagttgattttgagttaatcaaaacagatgatcctgggtaggcctgacttaatcaagtggaagcccttaaagagactgggcccatcctgctgactctgaagagggaagccactgtgttgtcagagggccacatggcaaggaacagtaggacttgcaggagccgagaggagcccctgttgacagccagtaagaaatcctacaactaccaggaagtgaatcctgagaacagcatcatgagcctggaagagaaccctaagctccaggaaggaatacagcctaattgacaccttactgaagccttgtgagaccctgagcagaggactcagtgtagctgtgctcagactcctgatccatggaaattttgaaatattacccgtgtgttgttttaagctactaaatttgtggtgatttgttacacagcaatagaaaactaatgcagtagctctatctaccctgttgtatgaaagcagtttgtaaattgacatgctatataaacagtgctggttttgttatggcattgattattcacattttatctgagtactatgatcaatacactagactgttatggtatactacatttgccattctgctataccttctcttagagcacaattttgatggagataatcaaaccaggttctcattttagataaaatttccacaaaagatctacagaaattgtttctaagcttatattacaaaaatggcagcacctatccaatgctaatgtctatgcgaacatctctattatatggagtttgagttttgagaccattttcttaccgttttgaagccatactatggggctcacttcactgatctagtagatgttctgggtatctgtcatggcaaagtggtaagtcttctgaaaagaagtggcatctcaacttgaactttagaaaatgcaagaaataaaaccctcctgaagtaagaccaggagcacatcagaagactcccttattggggtcacaaactaagaacgaaagaatacccacctcttgttactcagcttattctgtgcatgttatcctctgtgtttatttccctctcgtcaccccctagtttttagtaaagtctcatttaaaccttctagtgtagcttctgttatgccagggatattaggagcatggacactttgatgcataccacgatgcggtgatgacagtgctaattgatcagagtctccccaagggaaagacatctgcaggaacaagacacaaaactgtacagcccacctccccttctcacaagaagatacttcctgcatggaaaatcttggaggactggagtttgattttattaaaaatgcaagttaggaggtgggcacagtggctcatgcctgtaatcccagcactttgggaggccgaggcaggcagatcacggggtcaggagatcaggaccatcctggctaacatggtgaaaccccgtctctactaaaaatacaaaaacaaaattagctgggcatggtggccggtgcctgtagtcccagctactcgggagactgaggcaggagaatggcgtgaacccgggaggcggaggttgcagtgagccaagatcacgccactgcactccagcctgggagacagagcaagactccgtctcaaaaaacaaacaaacaaaaaaatgcaagttagattttcttatagtttgagagtattctggtttaagaaggtgggaagaagtaaaattggttgaggatctaaggtataaagagatgataccagaggtttgataaattgagccctaaccttaacagtacatgcttctcagtctacattccgagttggctgtaatatatgcggcctcatccactcttacctttctttgtgacactgataccctaatcaacacacttcatccacgtctctttcttgtgctctatacacacatatccgtgtcttcattaagcatcttcccctcagtgtcccatccaaaactgaactcatcatctttagaactatccatattacccactttggtaggtatcaccatccaccctgttacccaagctagaaaacaagaaccccagaacttcactttcttcctcatctctactgccttccaccttcagacatataatttatcaccaaatactaactcgtccacctcctaaatttgttccccttctccactctttaacaccgctcaccttggatcacagcagccacttacaggattcgcacactgctttctaatgcaaaactccttccaatgaaggagtaaatcctccagaggcttcccactgccttcaggatcagcttcaaatccttagcttggcgtatgggatccttcaccacctgcttcttcttacttgtgcagttacgtacatctacctaattatgggccacactgaattgcttgaagctgtttaaatgtgccaagatatcccagatttctgacctttaagcctttgcagtagtcttacgaattcatactcgtcctttcccagacaaatgtctctactcttttgatgaaactgtactgtcttccatccttaagggcaggggacatgcatccagctgtctttgtagtcacacagtgtgccatgatgcctatttctgtaggtgctcaataagtgtttgatgtgtatttattaggataatatacctatgtatgagtgaacaaatgaatatgcagatgaatgaataagtgtaaggaggaatgaaggatgaattagataattaaaagcctctgccaccagtcaaaatgaaactttttttgtgtgtgtgtgtgtgttgtagagatggtgtctcattatgttgcccaggctgatctcaaattcctgggctcccaccttggcttcacaaagtactggagttacaggtgtgagccaccatacctggactcatttttaaaatatatatatacttgattacttcaccacaatagtgtccttttgctcatggcccatgggcctagtcccttttagagttctcagtcacctgtaagatacatgccttgaatgctaccaggtgataaatttgagttggacaatgaagaaaatattgtacatgtattttcttatttatttagaccaaataggctgagagagtaacttgaatatttaagagcttccttaaaatgcaccataaataatggaaagtgaatgacttgattacttcccttatttttctcttatttttatttgggttgataggaaggaggaggtttgtggagggggagaaaatataaaacagtggaacatgcaaaaagagggcccaattcttccctttctctcaatttccatgatataactaactctgatctctcatggtgggcaatggaatattgtggataaagtctggataactgaattgtcaaaaccctccaatatggaccactaattaaagcactgaaagcacaactaagtgtactcagtatgttaatgatgcagaatacaatgtaacctttgattcaggagcggcttcaagatccaagcgtcctgggagaagcagcaatccctcttcctgggcgcagagatgctggtttaacacagtcatgtgtcagagaaaactagtttttcctgcaggcccaaatcctaccctagagaaacccattagacctttaccaaaatcaacttttcttctgagtcagaccgaattcttaattgtaggtgatagaccaaaagggaaagatgactcaatgtaaataatcgttgctattgacaaaacagtgcaaaccacatttcctgttgatggtggagtcacccatgacggaaaacatttttattgctttaataacacaattatattattttttaactcttccccttcaaatcctctagcacttaatatagtgcttgggatatatttggatattaataaatgcaaaagtgttattgcctctttttgaattaacatactacaaagaatgtgtttactgtactttcttaccttaaaacttaaacctaaaaatgtatgctaatatgaacctttgcttgatatttcatgcttgcctctttggtcgctaggaaaagtcagcaacattcagcaaaactgtcaaggattggagcatttaatagttggctgatggtccacaggcaagtccatccaaacagccaaagttgtattactcagtgtttttaaaagatgaagatttggggtggagccaagatggccaaataggaagagctccagtctacagctcccagcgtgagtgactcagaagatgggtgatttctgcatttccaactgagataccaggttcatctcactggggagtgtcggaaagtgggtgcaggacagtgggtgcagtgcaccgtgcgtgagccgaagcagggcgaggcatcgcctcacccgggaagcacaaggggtcagggaattccctttcctagtcaaagaaaggggtgacagatggcacctggaaaatcgggtcactcccaccctaatattgcacttttccaacggtcttagcaaatggtacactgggagattatatcctgcgcctggctcagagggtcctacgcccgcagagactcactcattgctagcacagcagtctgagatcaaactgcaaggcagcagcgagactgggggaggggcgcccatcactgtccaggcttgagtaggtaaacaaagcagccgggaagctcgaactgggtggagcccactgcccctcaaggaggcctgcctgcctctgtacactccacctctaggggcagggcagtgccaaacaaaaggcagcagaatcctctgcagacttaaatgtctctgtctgacagccttggagagaatagtggttctcccagcacacagctggacatctgagaacaggcagacagcctcctcaagtgggtccctgacccccgagtagcctaactgggaggcaccccccagtaggggcagactgacacctcacatggcagggtaaccctctgagacaaaatttccagagaaatgatcaggaagcaacatctgctgttcaccaatatccactgttctgcagtctccgctgctgatacacaggcaaagagggtctggagtggacctcaagcaaactccaacagacctgcagctgagggtcctgaccgttagaaggaaaactaacaaacagaaaggacatccacaccaaaaccccatctgtacatcaccatcatcaaagaccaaaggtagataaaaccacaaagatggggaaaaaacagagcagaaaaactggaaactctaaaaatcagagcgcctctcctcctccaaaggaacgcagctccttaccagcaatggaacaaagctggagggagaatgagaatgacgttgacgagttgagagaagaaggcttcagatgatcaaactactctgagctaaaggaggaagttcgaacccaaggctaagaagttaaaaaccttgaaaaaaaaattagacgaatggctaactagaataaccaatgcagagaagtccttaaaggacctgatgaagctgaaaaccaaggcacgagaactacgtgacaaatgcacaagcctcagtagccgattcaatcaactggaataaagggtatcagtgatggaagatgaaatgaatgaaatgaagtgagaagagaaagtttagagaaaaaagaataaaaagaaatgaacaaagcctccaagaaatatgggactatgtgaaaagaccaaatctacatctgattgttgtacctgaaagtgatggggagaaaggaaccaagttggaaaacactctgcagaatattatccaggagaacttccccaacccagcaagtcaggccaacattcaaattcaggaaatacagagaacgccacaaagatactcctcgagaagagcaactccaacacacataattgtcagattcaccaaagttgcaatgaaggaaaaaatgttaagggcagccagagagaaaggtcgggttacccacaaagggaagcccatcagactaacagctgatctctcggcagaaactctacaagccagaagagagtgggggccaatatgcaacattcttatagaaaagaattttcaacccagaatttcatatccagccaaactaagcttcataagtgaaggagaaataaaatactttacagacaagcaaatgctgagagattttgtcaccactaggcctgccttacaagagctcctgaaagaagcactaaacatggaaaggaaaaaccggtgccagccactgcaaaaacacaccaaattgtgaagaccagagaggctaggaagaaactgcatcaactaacgagcaaaataaccagctaagatcataacggcaggatcaaattcacacatagcaatattaaccttaaatgtaaatgggctaaatgctccaattaaaagacacagactggcaaattggataaagagtcaagacccatcagtgtgctgtattcaggaaacccatctcatgggcagagacacaaataggctcaaaataaagggatggaggaagatctaccaagcaaatggaaaacaaaaaaaggcaggggttgcaatcctagtctcggataaaacagactttaaaccaacaaagatcaaaagagacaaagaaggccattacataatggtaaagggatcaattcaacaagaagagctaactatcctaaatatatatgcacccaatacaggagcacccagattcataaagcaaatccttagagacctagaaagagacttagactcctacacaataataatgggagactttaacaccccactgtcaacattagacagatcaacgagacagaaagttaacaaggatatccaggaattgaactcagctctgcaccaagcagacctaacagacatctacagaactctcctccccaaatcaacagaatatacattcttctcagcaccacacctattccaaaattgaccacttagttggaagtaaagcactcctcagcaaatgtaaaagaacagaaattataacaaactgtctctcagaccacagtgcaatcaaactagaactcaggattgagaaactcactcaaaaccactcaactacatggaaactgaacaacctgctcctgaatgactactgggtacataacgaaatgaaggcagaaataaagatgttctttgaaaccaatgagaacaaagacacaacacaccagaatctctgggacacgttcaaagcagtgtgtagagggaaatttataccactaaatgcccacaacagaaagcaggaaagatctaaaactgacaccctaacatcacaattaaaagaactagagaggcaagagcaaacacattcaaaagctagcagaaggcaagaaataactaagatcagagcagaactgaaggaaatagagacacaaaacaacccttcaaaaaatcaatgaatccaggagctggttttttgaaaagatcaacaaaattcatagactgctagcaagagtaataaagaagaaaagagagaagaatcaaacagatgcaattaaaaaatgataaaggggatatcaccactgatcccacagaaatacagactaccatcagagtaatactataaacacctctacacaaataaaccaggaaaatctagaagaaatggataaattcctggacacatacaccctcccaagactaaaccagcaagaagttgaatctctgaatagaccaataacaggctctgaaattgaggcaataattaatagcttaccaaccaaaaaaagtccaggaccagatggattcacagccgaattctaccagaggtacaaggaggtgctggtaccattccttctgaaactattccaatcaatagaaaaagagggaatcctccctaactcattttatgaggccagcttcatcctgctaccaaagcctggcagagacacaacaaagaaagagaattttagaccaatatccctgatgaacatcgatgcaaaaatcctcagtaaaatactggcaaaccaaatccagcagcacatcaagaagcttatccaccatgatctagtgggattcatcactgggatgcaaggctggttcaacatatgcaaatcaataaacataatccagcatataaacagaaccaacaacaaaaaccatatgattatcttaatagatgcagaaaaggcctttgacaaaattcaacaacccttcattctaaaaactctcaataaattaggtattgatgggacgtatctcaaaataataagagctatctatgacaaacccacagccaatatcatactgaatgggcaaaaattggaagcattccctttgaaaattggcacaagacagagatgacctctctcaccactcctattcaacatagtgttggaagttctggccagggcaatcaggctggagaaggaaataaaggggattcaattaggaaaagagaagtcaaattgtccctgtttgcagaagacatgattgtgtatctagaaaaccccattgtctcagcccaaaatctccttaggctgataggcaacttcagcaaagtctcaggatacaaaatcaatgtgcaaaaaatcacaagcattcttatacaccaataacagacaaacagagagccaaatcatgagtgaactcccattcacaattgcttcaaagagaataaaatacctagaaatccaacttataagggatgtgaaggacctcttcaaggagaactacaaaccactgctcaatgaaataaaagaggatacaaacaaatggaagaacattcccatgctcatgggtaggaagaatcaatattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacatgaaaaaatgctgatcatcactggtcatcagagaaatgcaaatcaaaaccacattgagataccatctcacaccagttagaatggcaatcattaaaaagtcaggaaacaacaggtgctggagaggatgtggagaaacaggaacacttttacactgttggtgggactgtaaaccagttcaaccattgtggaagtcagtgtggcgattcctcagggatcttgaactagaaataccatttgacctggcaatcccattactgggtatatacccaaaggattataaatcatgctgccataaagacacatgcacatgtatgtttattgcagcattattcacaatagcaaagacttgcaaccaagccaaatgtccaacaatgatagactggattaagaaaatgtggcacatatacaccatggaatactatgcagccataaaaaatgatgagttcatgtcctttgtagggacatgtatgaagctggaaaccatcatttctcagcaaactattgcaaggacaaaaaaccaaacactgcatgttctcactcacaggtgggaattgaacaatgagaacacttggacacaggaaggggaatatcacacaccagggcctgttgtggagtggggggaggagggagggatagcattaggagatatacctaatgttaaatgacgagttgatgggtgcagcacacaaacatggcacatgtatacacatgtaactaacctgcacattgtgcacatgtaccctaaaacttaaataataaaaaaaaaagatgaagatgtttaatgtgggggaaatgcttatgacttaacattaaatgaaaattgctttttaaaaaaatcacatgcggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccacagtccggcctgggcgacagagcgagactccgtctcaaaaaaataaaataaaataaaataaaataaaataaaaaaaaaaaaaatcacatgctacaacatggatgtaccttgaaaacatgctacgtgaaataagccagatacaaaaggctgcatcttgtatgattacatttataggaaatgccagattaggcaaatccatagagacagaaaagtagattagtggttaccaggagcccttgggggtagggagaagtggggagtgactaacaggtgtggaattttgggggggtaatggaaatactggaactagacattggtgacagttgtacaacattgtatgttaaaaaccatggaattatatactttaaaatggtaaattttatgttatatgaatttgatctcaaaaaaaatttacaaaaaactacatatatagccattaaaaattatgagatatttcagcagaatacagattgtaaataattttttaaattataagagataatacaaaagacaattcatttgaaatgtttagttcaaggcctgacatatagtatgtgtttagtatatctgagacaggtctcagttaattaagaaagcttattttgccaaagttaaggactcacctgtgacagcctcaggaggtcctgaggacatgtgcccaaggtggtcagggcacagcttggttttgtacattttagggagatatgagatatcaatcagtacatgtaagatttacattggttcagtccagaaaaggcgtgacaacttgaagcaggcaggcagcttccaggtgacagttaggtaagagacaaaggttgcattcttttgagtttctgattagcctttccaaaggaggcaatgagatataaaattatctttgagcggagggataactttgaatagaatgggaggaagatttgccctaagcagttgccagcttgacttttccctttagcttagggattttggggctccaagatttattttcctttcacagctgcaatatataaggaaaaatagaaacaatacaaccttggatgtatttgagttgattagtttgtggatgaatttttgcatttatttttattgcaggcagagctgctataatatattgccagtatagtaaatactttatttaaaggatttgaaaataaaaaataaaagctttatggactccagcatctgtgctttgagccggaattcccatgaagagcctgtattggtggagctactcagctctttagggaggcaggaagagatgagaaagggatacagattattacagcctaagggcaggatggagaaactatccgtctatttatccactgaatgcatgtagtcatttgtcagtaagtgttcttctaaacttatttactcatcatcaacgttcatcttagattagctcccaaagggcaaaaagacacataattaatttgcttaatgtagtgcctagcatgatgacatggtgagatatgttttagcaataattaaaaatactttttcctttgccagtaattcttatttaatcaagccaaaattaatttacatagagaactactctatggctttcatttaaaaaaacaacagatgatttcaatctcttttctgcaaataccccaaaagaagaacaatgctgttttcataaatcttagtcaaatgaaactcagctactatccccaggttaattttataactgtaaaaagtgtgtgtgcataagaacaaaggctggttaggacctggaaaaaacgagagagggagagatagactgatgtaatgatatgtgacttttttgttcttttctgattcccagtattgtttcctgaacaatattttttttataaacttagcaacaaaaaacaaatcacttcagaacctctgagacaaggctgtggactggcagttgttttttgagacaacatggaagaaatgatattctgtgcatcttctcttttaaactttcatctttgaacttaaagatgatccctagctgagatcatgggtgttttcctcccatgtttctttctttgtgttttaccaacttatttatttatttattttttgagatggaatctcactctgtcatctaggctggagtacagtggcatgatctcggctcactgcaacctctgcctcccaggttcaagcgattctcctgcctcagcctcctgagtagctgggactacaggtacacaccaccaagcctggctaatttttgtatttttagtagagatggggtttcaccagcttggccaggatggtctcaaactcctgacctcgtgatccatctgccttggcctcccaaagtgctgggattacagccatgagccactgtacccgaccttaccaacttacttatatttagcataaaagctggagaaagcgatagggacaggaggcagagaaattctgggcagaagagggcagtccccagcaagggcctcactctgaagcctggacccatggcccaaagtgagaacatacattcttgttttcctgctcaaatgttgccttttccaaaaccacccatggccctcctgccacccatcatgtgcccataaaaaccccagtctccaacagcagagaaaggagaagaggagaagcagctagacattggagagaagcagcttgacttcaaagggatggcttgacagtgttacctcagggaggagtctggccagggatggccagactctgggggaagattatcccgctccatccccttttcagctcccctccattgaaagccatgttcatcagcaataaaatcctccacattcaccacccttcaattcattcatgtgacctgattattcctggacaccaaacaagagctcgggtgccatgggtgaggatgctaaaggctgtcacactgaccctgtgctctcggtagagagcaactgtctcatgcaaaaaggcagagggcccactgaactgttgacacttaagccgtccgtggatggcaaaagctaaaagagcgctgactaaaacacatgccctctgggccttcaggggtaatgggcacccactagacactgcctcaggactctgcacggagttcactccagctgatgcccagaagcactcaccctggctcctgtacctgctcacctgtggactcccttctgcaaggggtgaagtgcaacgggtccaagtgagtggagtttgcccctgccagtgacaaagcggccagctagatccagcacccgtgcactgcagttcccacctgcaacggtgtcagggaaatttcctgcttcaaaagcacaggcagctttcttggaaatgagataatgtgatctcattttaaagttgaggacatcaaggctcagaggtgattagaggcattagaagggacttctgaagacagctaatctaacccttgaaaataggagaagttaaagttatggcccaggttccacacctcacaattggtggaaccaggcttgagcctgcttgcctaataccagtgtccttcccaagcttcccaagcatctgcttgaaattacctgtgtctgtggtgggaaggaagcgcaagaatggtgtcctgtgtccattgctggggctttgggggtccaggtacttagtttacttttgagaattccttgttggctctgctgaagtccttcctgctacaccgttcagggaaattgttgatcttgtcaacctgaaataatcaaaaggatcagaatccagttttaaagagtttattcaagcaaaaagctgggaatagccatccaagaatcatggactctagagaaatggggtcagtgcttcgaagttaaaagttaagtacttgcttctatacagcaaacaaagaagtttagtaggattataatattttctatacaagcctggtttatgagtgacaatttagttcgtttgttttcttttccatacagcttgttttcgtttcctttccaatttaaaagcaagtatttaacattccatcctagttagtgtgataaccatgaagcctttgtgtgaaagaggaaagagggaggctagtctataatgaagatccatacttagagagaaagggtcttccctggcaccctttagtaatttataacactttaccaaacaatgtaggtaaggaaaaggctaatctataatcagagaaacaaaggttacagctgcctatttatgtgactcaggttccataatcacattcccttaaggctcaaaataaagtttcaacggctgagattttcaattatttattttcacaatctttacctttcttagttctgggagtggccttaccaggtgggcctggcctgcgtactcccagaagggcagttattcctagcagcctttggctttgggaacctctccataattcttaatccagcccaaggttctgactctgttaatgggtaaagaaaggttatgccctatgagactctgacctcttcttgggacctggaaaatcttctggtgattttcctcatcccgaatctgctgtttctaaactgcttgagaccaagataaagcacaccaatttacaaggcataactcctaggtgaggtcattcactagccatttcttgtatttgagggtctcagtgtgacatcccaacttcatttccagcactagattggtatttctattcttctttttagaaaggaaaggagaggggaggggaaaaggaaagggagagacacggagggagggaggaaggaaggaaggaatattggagtacaatttgtggcactcaatttcaagaacaagcttgatagaaagttgtaattgccaaatacagtaacctacttggggtacatgtcaccttttattgctttcaagctactgtacctggcaactcttatttctccctttaaaaaaatcctgtatctggctaaaggctgaaaaatagcaagtacatatctttctaatgaccctacattaatttagcatagagataattagaggcacagttaatcattagtaatataagccctgagattggggcacatgggtttctcttgctattcaacagagtccttgtgtggctagtgtttgagtacagacacatctttattttttacatactgagctttctttgacatacaagccaaaaatttacttgaagcaacctgaatagtatgagagagaatatttgttttttaaagtcctgggaattacagcgtatccttagggcataatataggtatgttcatatagaacagctgaacacaggcagtttataaagcaggaagtgagcacatcgtactttttaaatttatttaaaatactttgaattcttggtgttcttatccattcaagagtctctaacactagggttgtaaaatagaaaccaaatagcattgataatagagttttgtttcatctttgtcttagctacagtttgggaaatgtttatatgtttgttccaaaaatgatttaaaattgtgtattcacaatgcagtagtgtgtaaacactactgaatcaccagaaatgcatccagtagtgcatgcacaaaatagagatcaaggcaaaggtagaatagggaaataaaattaagctaaggataaggttagtatacaaaatgcatcttgtgaggttcatctatttggtctactagtgggcatgggaaggatgcctgaatttaaatgaaaattctagtactgattataattcacatattctttcattgccctagagtttttaattgtgcccaaataagtcttggtattcacaaactaattacttgagtttttaggttcacataccagtgatatcctccttgaatctttctgccacttagtcattttacttccaaatatcatgacatccaacagaggccgatgaaggaaaaaagatgcaaaagtcatcccatttatttttctgccttaaaataagagtgtgtatattgggagaaggaaagggtaaagcagttagatgttattagaaatacttggaagagaatagaaataaaaatttgtgatttttagttattaaagtcatcattaaattgtgttatccatacaactgaaggatttcaatatgggcatcttgttaaggaaaagctttcagagaatggtaacatttcttaatagtgaacatgtccctacactcacataattataagacttcatgtacaaggtactcaaaatcagaaactttgtaaaaagccttttaatcagataaacctgaatatatcattatctagaaataactgaaaagagtgcaaaacattagagaacagtcatttgataatatggtaaataaatcaataggctattatattcctattaaaattataaaagttgcataaacaggaaagattatacaaatataccataaaaagtacttataataaaaatatgagaaaaatacaaactgatatgtaaactataaaatatgtaaaatagccaagcatggtggttcacacctgtaatcccagcactttcggaagtcgaggtgggcagatcacttgaggccaggagttcgagaccagcctgggcaaccgaatgaaaccctctcaagaaaaaaatacaaaaattagctggacatggtggtgcgcatatagtcctagctactcgggaggctgaggtgggaggatcgactgagcctggaaggttgaggctgcagtgagccgagatggtaccactgtactctaggctgggtgacagagtgagaccctgtctcaataaaaataataaaatatgtaaaatatctctgcaggtagaaaaaggtggtgtgtgaatgcaaaagagttatactggattgactaagatgattttttttctcacagtattctttgatattttgtcataataagtgtaattgatagcgaagaaatgacaacaaagctttcatgtatagaatactttttacagatttactgaataatgtgtactttctgttcactgtcttttaaaatataatttcagtctagattttacagactcatgggaaatgatctaaactatttttcttgccattaaaatgtgcatttgggagtatttttccatagacatagatacaggagaactcaataatgttcctcttccttctttccaactcttgttttccttaggcattaccacaggagtcttggttcgagaacacagcaacctctcaactctagagaaattctactttgcttttcctggagaaattctaatgcggatgctgaaactcatcattttgccattaattatatccagcatgattacaggtaccttgagaaaacagatgttctctatattagtccattttcatactgctgtaaagaacttcctgagactaggtaatttataaaggaaagaggtttaattgactcacagttcatcctggctcagaaggtctcaggaaactcacaatcatggcggaaggcaaaggggaagcaagacaacctccttcacaaggtggcaggaaggagaaaggctgggcgaagcaggaagagcccgttataaaaccataagatctcgtgagaactcactcactatcacgagaacagcatgggagaaactgccactatgattcaattacctccacctggtctctcccttgacacctggggattatggggattacaattcaagatgagatttgggtgggaacacaaagcctaaccatgtcattctctatgattatttaaaaagctttcacctaagttgttcttttctaattacgggaaaaattgaaatacattagatgtctctctctctctctctctctctctctctccacctctctccacttggaatgtctatatttgcttctgtggaaacattttactgttctcaacatggcattgctttgtcatatgctgtgcctacagctctgtccaccactgctcaaatcttcatttgaccagcatgtgatgtcttgggaggaaaatgtcattttcaaacatataaacaaaacgttatctggggcatgggaaaaaaaagcatatttggtcactgaaatgtcagctagtgtcctcaggaaaaatatagttgtcaattttgatcatgttttcagccattcactcatttatttcccaactgcagctgtgctgcccccagcctctcagcagctgccttcagggtctctgcactccttacccactttctactcaaagccagaacttgctatgtgtctgccctgcatatttgctgtggggaccagcagtcaagttctgtgagaagggtttaaatatggaagtgcaccatattcgaaaagcctagtatttttaaaacttgtgacacagttgcatttggaaatgacttttcccttattgatcattacattgcagggctcctttgaagaggaagcttccttaggtagatagagatgaatttggtttacaaaaatgtcatttgtctggctgtgataagtttctctgcattgcagtttcttgtacttaactctggcaattagtaaaatgtggcatgacagtagctggtggtgttagattgaaaatcaaggttttatgtaaacatgcaattagaagtcgtgacatgtccccttctagaacatttttctccactgccactgtaaaggtctgggactggccctggtagagtactggacgttggtgggggcacgggagggtgggggtcaggatctgctgcattcagggactgcattgcttgaagagctgtcacatttggcctttgaatttcccaaatgccaaactcgaattagactagagtcccttgggagctttgtccttaaatggtcttgatgttctcggcttatgagaaacctaaagagaacatttaattatttttatgaatgtatttaattacgtttggaaatgcctggttccttttaaccctagcaacctgattgacacagccgcagaccaattatttgtcccatgtaatatttgtttatttgtttaaattgtcataagcatttaaaattggaaagatttcatgtaaatatccaaattgctggctttctctgaaaaaaaaaaatgaagatctgggaacactggcccagtatttccacctatcaacggtggtctgaaaccaagagacaactactccatttagctggagcaaatgcatttgagaatgccatagtctccactactcccgattgcccagtactttgtccacttcactcttacgttacctgcctggccgccgtaaggatggcagttataatcccttagaatcttctccatatcaaagattctttaaaaaaatgtttttaaacatggggtcttgatatgttgcccaggctggtcttgaatttctaggctcaagcaatccacccacctcaacctcccaaagtgctgggattatgggcatgagccactgcatccagcccaagattcctaattttttcttgggctcctttgagaatacaatgcaaactttggacttcctttcgagaaaaatcttcacaattgtacatatatactatattttgcacgcaattgcacaaggtgcataaaccacctgatgagcaatactattgaactcatgtgtctatgaggggaagtatagaagattgatccaaattatgcagcaaacccaaaactcgaggtaaaacaggttttagaagaaaaggtaaaaatacatgtatgaatgtctaattctgtaatatcagatgtttgaaaatacatgccactcttgacagtcaataacaagtgagttttgttttggtttggttttttttctgggaagtatagcctttggccagaagccagaaacagatacttcctctagtgagatttttgcagtctggatgttttgtgtgttagctcagccttgcaaataatctaggaaaataatttacaactcagcattccactgacatagcccagctacttttgaagctatagcatgggtcaagtagtttctccacttttcctccaccaaacccccagcagccagtcaagaactagaggcagcgagcaaaaccaccaccccatcttttgatttggagcaatgaaatagtcaaagattcaagggatatgaacaaagcagggtggggacaatgatggcatatccatgttttaaattgtcagattagagggaaaagcaacaagactagtgttggcacagttataggaaaataagttcattcatacactttcagttacctaataaattggaacaaactttctggagaacagtttggagcatgttctgatctcttcacccagtaattctgtttctcagaattgatcataaagaaataatcagagatatgttcaaactcctaagtacaaggatattcatggtagcatttttttgtaatggtgataaattataagcaacctaaatgtatacaaatttatattgtatacatatgtatacaaatttatcttttatactatgtatacatagtatacaaattttcatactaagcaactattaaaaacttgtcttagaatcatatttaattacatgtgggaacattcccaatacagtataaagtgggaaaataaaattacacaacaggatagtgtatacaatccaaattttattaaaatgtatatacatttttaaaagttgtgatcaaaaccaaaaggttaacatccagaaagtaagaaaacatgatctgttctgctttctttacattttcaactgaacctgtgtttttgtttggtttgtatttttaatgaaagagatggggatggagtctggcctgagatcctccaattttgcctctggtcgcttctctgcctcatctctgctcccttcccctgccggctcagtgccacctttacctggtacacagctccttcctccagaccctgaagtagtcttcagcctccctacccagaagatggccgtggaaaacacacaggaagggccatttcacattgcaaatgccctcatgaatccagcaggctggtagcttaacgtatacagttattaggccgaaggaggatgcaggtgggaagctgaggagggttgaatgagtcccctaaggatacgtaaattagaagcagaaacacagctagaattcagacccaagattaataatctgtgctcctgcataaaggaaactctcttgccaaattaacaggtagaaaaaaaaattctgccatcaaagcctctggtgagattaaaaaaatactttatagcttttttaaaaaacaggaagaacccctttttatgtgatgataaggttaagaagccaaatttaccagggaaatttgaacatagactggctgttagatggtatcaataatttgttaatgattttgttagagatgatgatggcatatagttgtataagaaaatgtccttactttttaaatgcatatggagttatgaaatgacataatgtctcaaatttactttaaaacagaaaaaaaaatggcacagttgatataaactcaagacattttcagagacaatcattgtgggtaccaatagaatcctaccgataaattacattgtgaagaacatgctcccgccctgctgaggaatatctgtgtttgggatctgctaacatttaggcttgtaagccgtatttatgtcaaagcaccagagaaataacaggaaatagcttatgaatatgcctgagaattgtggctctggaaaaatcctggtccagccagtgagtttaaattcaggtcacattttctttactacttcccaaaattaaactatgatgattggagcctcctatgaccaacacagggacagaacagcacctccagtcccgctcccagaggtcccctgagcatccttcccggatgctcataactttgctcaggaagaggttgcagctcttccactttagcctctgccacccccgcctgggccagaagcactccagtgggcacagctgcgcctcctggtgtctgctgtggctgccactaccccggtgacctaaggagttccgctctttgctcctccatcctaagacaggagcagaagcttaattctccaaagtgcagctgagaccacacttctactcaggacataatctttgctaaaggtaaccaaaagcagatgaaacactaatggtgacatccaactgctccctgaaggggctcccagggccccttaacagggatgcccctctgcttagctgcttgcctccaggaggctagagttcatctctaaaggtgttccaagctttcctgcaccccagatcccagaacctgacaccaagttctaagaaggaaaaattccgctatcacacaggccatcctgtcctgacctggagtgacctcttcctgggatgcttgccattgtggaatatccacttcagagaaaacccccctcacggccacagggggatagcctttcctcgtggaccccatcaggagccttccatagactccataccatagtacctgctgggttattgcaaccaccctgcttgtagaacctgggagtctgtccaggtcaggctgggccaagtccatgccagttcctgtgcacatttcttcctccagagcaaggagttgctcattcctaacccttcctgtgatgtcgcagctctggatttcctaaaaacgcctgctcaaacaagggcacacacagctcctcaagaaacagcaccagtttgcagctcagtggatgtcaagccaagcagatatcaagccaagaaaactccctcctttccctcctctctcccccaggccactgagtgtgagtcctagtactgattctgcttcctggacaagtcacattattaaacactagacgtcaggagaaaatatttgcgttttgtttatcaatgactttcagtttccaccagacactggttgggtgattggatttacaattgaggatcttctccaaagataaatttaacactctacccttggaagatttaaaaaacaaaaaatgctccagacttttagatgattgttactccagctttcatgttaggatttcaaaatttttagggcttgacctcaaccataggatcagaggttttctactactttttgttgggaaagggtgggaagacagggtctcattctatggcccaagctggaatgcagtggtaccagtatagctcactgtagtcttgaactcctggactcaagccatccttccacctaagccttcctagtggctgggactacgggtggcccacaccaccatgcctggctaattcttacttttgtcgcgatagggtcttgatatattgccagggctggtctcaaactcctggcctcaagtgagcctcccaccttggcttcccaaactgctgtgattacaggaatgagccaccacacctgccctactttttaaccaagtaaaaaagtttaaagccttataaaaccttaggtatattcagtatttattaaacaacagccagatgtagaatgcatatgtgagttggttgcctttcaagcaaggatttttctatgaagggcccaatagtaaatattctaggttttacaggtcctgtgtattttgcccaactacccaactctgtttgtcatgggaaagcagccacagaccgtatgtaaatgattgagggtgactgtgtgccaatgaaacattcatttacaaaaacaggaggccagccaggagctgacccctgcccagctagactctgacactccagatgcaatctagttgaggttgaatccaggtaacaaaataaactaccacatcaggcaaggagtatgaatgcactgaagagactgaagaatagagggtgagcagaataaagtgcagttggtgatagttttagagcaccttatttgtaaactcaggctttacagcagatgacacacttaaatctttggggctgaggaaggcttttttttaaaggctatgtattcatttactcagaggcagctgtgtatctggaaacaatcccacatcctcctatgaaaagaaccatgccacgtgcctccccgagacaaggttcagttttattcagctaacatttgttaactccagctgcatgaaaacagactaacagaaaaccaggtataagagggtgaggccctaccactcacatggtcatggagctgaggtcatctgatagtcaggtccaggagtccctcgttagcaagaattgtaagacttgaagacgcatatcactttgttgtacaacttgctattaaatgtaagctactgttcataaacataggtggctaagagcatttaatgtcaattttagctacgagggaggagtatgcattcttttcttgaaacattggtggtccattatacagtttagtttctatgaaaattgccattcaaggtggtttataaacttaaaactccaggcaggaagacaagtttgttgcctaagactgtacagtctgagagtgaacttcttgcctcatttgcaacatctggaaccagtgggctcttcatgcactttaagtgctcctttccctaagattatcaagaaatttgtgttgagttagaatacagctgttgaagccaaaggacttattgtatcaatttgatttctgaaatgcctggcctccaaagacaaaacgaccacatagtgtataaggaagagctcccataatgaacatgccatttgcaagtaataaaatgaatagtggcaagagataaatatgccctgctttagtctttcctgagacagtgaagcccagagaatcaaccatgcatgagccttctttctgactaaacaggtattagacttgttcatagctctgttcagctgtaagataacctgatttgattacttaaaaagggattctaaggaccttctatatattggaggcatggacctggaagaccattcgttcatttatttatttattcattctatctttaatgagccaggctctgctagacacacaaggtgtaaaattaagtcttatctcagcaagaaagagtacattacaatgctgtgtgataagcactttctgggaatgaggtcagtgcaggggacattggaaggagccattttgaaggaagcatagaaatcaagtgaaaggaagagggtgggtattccaggcaagagaaaatagcatctttgtcctcccaaaatagcatcttgggaggacagtgagacttgaagtgcgatgctggaaacgtgggcaagaggaatgggatggaaagggggagcacaagggtttactggcctcgtgtgccttgccaaggggactggacttgagcctgcaggcgagggaagcaattctagcagtgactcccacctgtgccattctctacagagggacacctgaataagtatccatcctagaggggcaggagagtccagtggttaagagtacagacaggagccacactgcctgggtttgaatcctggttctgccatggattagctgtgaaaccttggattttacttaacttgtcctcagctttaaaatatggataataataatgtttcatagaacatctagaatgccatacaatttttttacttactcttttttgtctgagaccttcagaagttcctataaagtacctgaactggcagcagaatctacagggccaatatcagaattgagctacgcagatatgaacacactgaatgcattcattctggaaatgagaacaatataaaaagacttgctctgccatcagtttgtaaagttcaccagcatgtaagaagcttttgcctagaagtccgagataccaattttatggataaagagaagcaaagagacagctcagtcatatttaggttgtggcaaaaacccagaaaagtctcactgagccattagctagctgctgctgtcagagcattcatatggactttggaaaagaacagttgagttcctcagattctttggggtatatttaatgcttttactggacaataagttcagggagtcaaaaagttcatggagtcttctgaaaaactggtcctaactacaaataccaccgtgttccatagtaatgaaaaaaatgttaaaacagctcctggactgctgaaaccaggacacagcccaccgcttcttttttttttttttttttttttgacagagtctcactgtgttgcccaggctggagtgcagtggtgcgatctcagctcacttgcaacctccacctcctgggttcaagcgattctcctgcctcagcctcccaagtagctgggactataggtgtgtgccaccaccaccggctaatttttgtatttttagtagagatgaggttacaccatgttggccaggctggtcttgaactcctgacctcaagtgatccacttgcctcagcctcccaaagtgctgggattacaggcatgaaccactgcacctggagagcccactgcttcttgatgcatgttttgaacttcaaatgtggaccagctgacagaggcttcaaggggacctttagctgattctgctcaaggaccagtttattttgttaacatcaccaaatagcctagagtggtgatattacctattttaagagagttcttcatgtctctaagaaaagtagatgtcataggtgatgcatgcacagaaagattttgcatgctcctctttgcctcttcctttccctttgaacatccagggagtactaatcaaggctgcagagatttccctatgccctggattaacaaagtaagatcatatcctgccttgttttctctggggaataaaagaaacattttggaatttaaaaatcatgaacctgtttatttaatcctcatagcagccctatgaagtcatcaagtaggtgggaccttaactccatctttagagataaggaaacaggaggttgaagacagattaagccactttttcaagatcacacagatcataagggcagcagctggaactggcaagttttgttctggcaacactctgctgccaaggggccagagcctgggagagggatccagggcagtcagccatacttaaatacctgttagtcattcaatcagcatgtttactgagcatctcctatgtgctgggcactgagtatacattcgtgaacaagcagatagctaggtctcctgccttcatggagcttaaaacctagcaagaaagagatataaaataatgaaccaatgataaaaattgttgagatatgatatgcacaggatgccaagcaaggaaatcaggacaccctggtttagggtggataatcagggaaggattctgaggaaaggacttaaaagccaaatgaagagtgaggaagagcactccaggcagagggaagagcctgtgcaaaggccttggggtgggaaggagcttggtctgttccagaagaggctggaggaggggatgagacaggaagatggcacaaagaggggctggagaggcaggcaggtgcctcccctgcaaggcctgttggccaaggtaaggattttttctttttatcttcagtgccattgaagggttatcctgatgtataaaatcacctgatttatgtttttaaaggatctctttagtgaccgtgtaatgaaggaatgaatgagggagggaatgaatgaatcagttaatgcttgttgaataccttccatctgctcagtgatgcacatcatctttatcatttattcagtaatcatgcaggctatttactaagaacacactgtgttctgggcactgtactaggcctgttatagacattatttctaatcctcacaacagctacgcaagctgaggttgttcactttgttcctcacaattaacctaaaggcgatagaggcatttcagatcctccaatttatagatggagaagctgagtctgggaggaggctgggatttgagcccagtctgtcccaccaaagcccatgccttctctctgcacaggtggcctctctgccggtgacagagacaggagtcatccacatggcgagttttaactcctatgcaacaatgagtttcttggatgtggtgtccacttataatggcataacaccaccaaatgtcagacctaaaagaacttccaataaggggttgaattttgataccttaacagcaatgtggagagattgtcacgaaagctttgttctcagtgggtggttgcttaatcagagagctctaggaggagtcttttgccctcagatgtttatttttaaaacatgctattgtttagccaggcaactgcttcctttggagtgtttttgtaaaaagttcagatgattactgctttggctgggagccaacacccttgctcatcagagccttctcctgaggtgaaaaaagcaaataaatgcttttacctaaaataaagagctagcaggtgcccctgacttccaaggacaaccggggattttatccctgtttctaggccacagccgagcctcaaaactgtcccaggttctaatggataaccctgggttcacagggaactggaatcgtgctcttctttttctgcccaattcaggtgccacctgttccatcaagcctctcctgctcatctcaatctggtgacagttcaggctcctctgaaagcccacagtaactggtctccgcaccagggcttcacaaaacatctagtttttaaactggatggagcaaatccagttgttaaaatttctgatctgttacagatcaataaccttcgaaaactatagttagagcaaattactagaaaagttatattaaaaatagacatacaaaatactagccctattttttttttttttgagatggagtttcactcctgttgcccaggctgaagtgcagtggcatgatatcggctcactgcaacctccacctcccaggttcaagagattctcctgcctcagcctcctgagtagctgggattgcaggtgcacaccatcacacccagcaaatttgtgtgtgtgtgtggttttgtttttgtttttttgtttttttaagtagagatggggtttcaccatgttggccaggctggtctcaaactcctgacctcaggtgatccacctgcctgggcctcccaaagtgctgggattaccggcgtgagccactacgccccgcccctatcttttattattacattcaacagaaataaagttactgtccaattactataaacattttaaatactcactgttgatttctgtgcagatgccatcacacctgcttagttcattctcatttatcaccccctataggacagctttcaactcccaggagaaacgagttctgatagtgaactgtaaagagagggggtccttcagacctcgccagccaccaaagatggcctgagagcaagaaacccgggggtccattgagaataaaaactcagaactaaagggcaaatgaggttttacttgtttgggactaagttgggcctgatcttcgacgtcaacgccagttaagagtctaatgcctggattctcattctcacagtcaacattcattgcgctagaccacaagttctcaccaagacaatatcgtccccaaggcagcaaaagctgtttttatttggtggtggtgagttgggggagaaaatcttactctttttatgtaaaaaaacacatgtatcatttactatataaccagatatacagtttgcggttttagaatttcagaggggtggtgattaggaaaacggctttggggggtggttttgcacaacaacaacaacaataaaacaaggttgaaaaagactgagatgttacatgtgttcccctgtggagtcttttatggctgaaaagtgttctcgttggctgccctgggaaccaaactaaaccaccatgtataagcggtttctaaggggactacctgctgaggtccaagtttcggacccagaaatggatctttgaaatggggtcatttgtaagcagacgattacttgcaaaaatgcagctctttctgtcatgtggaaagcttcaagtacaaacattcgtagagcaccttatttaaggcactgggggcccagtgaagaataagcttcaggccttacagccatatgatcagtgcagtgatggaactacgtgccaggagatttgcgcgtagcatcttcctttcccctgcccatgcttgcaaggcaaagagcttttcctgaatttgataatggagttaagctatagtttgttcattcgacattgtcgagcacccactaaatgctaaacactggtagggtctagagagattgggctgtccaatatgatagccattagccacgtgtggctacttaaattgagattaattaaaactggccaggtgtggtggctcacaccaataatcctagcaatttgggaggccgaggtgggaggatcgctggagctcaggagttcaagaccagcctgggcaacatagtgagacctcatctctacaattaaaaaaaaaaattaaaatagattaattaaaatgaaaactcagtttgtcagtcacactagccactttccaagtgcttgctagccatatgcactttgtggctactgcaggggacagcacaaaaacagaacgtttctatcatcaggaagctctactgggcagcgctagtctagaattttgtagcacatggatagagccaatatggaatagtggttaagaatatggcctttgaggtaaaatgtagattgagatcccagctctaccactcaccttaccagctttatgatcgtatggtacttagcctttctgagctatagttttgtcctctgtaaaatgggggtaataatgcccgcctccttgggttgtaatgagaattaaagatgatgcattaacatgcagtcaatatagtgtttattgtcatcattattatttgtattatgattatcatcctcatcattattgacattactcgcagatggggtgtttacaaccatccagacagatattttatggtcattaagttctgtaatgttcctatttatagaggttttcaaagattaggctgtttccctgtatctgttctctccctctatggtggtcaccacccttatccccaacaatgcattataaatcatccaacagcctggacttgggggccagctctgcccccatgttgatgactagagaggtagagggtaactatagagtggtaactatacagaggtagaggtaactatacagtgtagagaagtataatcgttgatttgtgtaaatatctgatatatccgggaaattggtaggatggaggtggattagaggaatgggaaacaaagacccgtgctgaaagttactacaagatagttgctgtgctccaggacagaggggaaattggatgactacttggggatgtatttgtttaagatattttcaccaagatctcattattatcaagccttttattgccagctgagtcctggagtacaagcagaggcaccagcccatggccaaatcattaagacaaattaagacatattaacatatgctgggaacaattatccacatagatttaatttgtttcactgctggaagaaaatcctgagagagtaccaaacacatccccgagaacagctctgtaactactctgtgactctcacttgtcagcacttcaggggctggaatctgcttaaactggacatctaccaaagaaggacgacatatctgaaaatagatcccatattagggctacagatgagttacttggagtctgttaaggtggtgattctttttgtttctttttaacctatgcatcttagaaataattattacagttatcaaaacaatataccaagctctaaaatgaaacaggcacatattttataatcatataatatacttagcaagcttacatatttgtattatgatttgctctttctttaagagacctaaactaaatatgagatagtgaacttgtttctgaattttggccttcaatctctcttgacttttttgttgttgctgttgtcccttgcctaattgttatctttcattgtcttactgggaggaaaagaaagactcttcaacacagcaaactgcatttttctcaaatcgaatagaatctatcatcaagattattctagaatgtgactattgcagtatgcccattatatggcaattgcacaatcttttctcagtggttgatgaatggcgccttaacaacatcctggggtagctgctacagaggccagagcaccttctctcaaaatattaacttccaaaggagcaatcaacagccagagaaatggtgtgtttagagtgagaaatgacttgttctgtcatcataatggtgatcacttccttgcagattttcttcctgtacatcaaatatgtatgattatatatgagaagcataaacccccagtcacttaaaaaaaatggataggccttttagtgtgggaaatgaacataaaagttacctatgcatgctgatagccatacaggtttactgcctttcccttggggttgccttgtgacaacctcttcctttttcctgctaccctgtaccttaggctttgcaaatggttatgggacaactcatgcgtgttgaatatgcaaaatcattttctataatgctcctttgactcaaaatatgaccctcattttggaaatcaggcttggtagtgtctgaaacctccaatgacagcttgccgaaagatgattcagttgtttctcaacttggcccattccccacgtccaagtccaattggagaacggcttttgactccgtttatatgagcatctttgatagagagcaaaggtttctggcaaggcgggatgcctgccttccacctctaatccagctgtccttgacactccagacagccctttcaaatctgggcaacacttagtcatcttactggtagccaaggaccatttgaagtgagatctaacaatatgatcgtaagtctctgacattacctgtgccctgggaaattatttattaatatctttcctttttcaaatagaaattttaagatgtctcacaataaaagctatacacaataaggttgtttacacagaagcaatttgaaaatcatgaaaagaggaaggaaacacactaaccagaatggataatgacattactgtgaatgtggccccgggaccatttaaagatccagcaataagtggatcattaaatacattctggtacagccacatgacagattactgagccattaaaattatcctcagggtgagtttgtaacaatgtgggaaaatgcttacaactataatattaagaagaagagagagggttagaaactataaaattctcccagctgtttacaaaaaattgagaaaaatattagaagaaaatcaccagaatattaacttggttgatgagatgatgtgatttttgttgtcatctttaccttttctcctttttcagatagttgtaatgaatatatattacttttataattgtatataaacattattttttccagttaagcctaagcttcctgacagaaaaggcagaaaggaaaactatcatgagttacatgattctcaagtgttaaaaaaaaaaaaaatctcaggcaggacatgatgactcacacctgtaatcccagcactttgggaggccaaggttgtggatcacctgaggtcaggagttcgagacaagcctggccaacatggtggaacctcatctctactaacaatacaaaaattagctgggtgtggtggtgtgcacctgtaatcccagctactcgggaagctgaggaaggagaatcgcttgaacccaggagatggaggttgtaatgagccgagatcacaccattgcactccagcctgggtgacagagtaagactctgtctcaaaacaaacaaacaaacaaacaacaacaacaacaaacgatctcagttctttgagataaatttttcctagataactgaattccaaaggaggtttatcacaagggatgttgaatgatataatacaaatcttggtaaagttcttagtgcaaatgtgggacagggactccttatgattatttcctgaccaactccaggaagatctgaaggcaggacactcctggaggtgaaggctgtgggaagctgcctgcaggggaacttgcacctgactgggcttccctctcttaaatctgtttggaattttgaagtgttgcttttgcccattgcatgttattgcccattgtctgtagatgagaacgcctctcagctctttatttcacaacctgaggattaaatcgcgggtcctggaaacctgtcttttaaaattaatgtaatttgatttctgtctccccttcaggtgttgctgcactggattccaacgtatccggaaaaattggtctgcgcgctgtcgtgtattatttctgtaccactctcattgctgttattctaggtaatacttatttctgaatccttactactttatgtaatggtgattttttcattcgaaaagtagttggtggccagatgcggtggctcaggcctgtaatctcagaaatctgggaggctgatgtgggcagatcccttgaggtcaggggtttgagaccagcctggccaacatgaaaacccgtttctaccaaaaatacaaaaatattagccgggtatggtaacatgcgcctgtagtcccagctacttgggaggctgaggcaggagaatcacttgaacctggcagacagacttcaaaggaaaaactttatggtactttgacaatactactttctgattttaaaaaattgtatgttaagaaaagctcaactactttttaaaatatgtatttttttaattaaaaagagacgtggggagtcttctatgttgcccaggctggtcttgaactcttgggctcaagggatctgcctgcctcagcctcccaaagtgctggaattaccggcatgagccactgtgcctggccctaactacttttttttttttttttttttttcaagagggagtctcactcttgtcacccaggctagagtgcagtggcatgatctcggctcactgcaacctctgcctcctgggttcaaatgattctcctgcctcagcctcccgagtagctgggattacaggtgcacaccaccatgcccagctaatttttgtattttttaaatagagacagggtttcaccatgttggccaggctggtcttgaactcctgacctcaggtgatctacctgccttggcctcccaaagtgctgggattacaggtgtgagccaccatgcccagccacttacataattcttaaagtggatgattggtctataatagtggagttgagtataattataaaatatttccagaaatatagcattttagtgcatttcacgtagtaacaagagctaacagctaatagatccttgttaaggataaatcccacttgtaagagggagaaaattctaataagggaggagctgctcttatacccttagcatagttttttgaagaatgcttggtctttgtaaccctgagtgacattttaagaagaatgcccaattcccacctatgagtgagaatatgtggtgtttggttttttgttcttgcaatagtttactgagaatgatgatttccaatttcaaccatgtccctacaaaggacatgaactcatcatttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttagatcacatggacacaggaaggggaacatcacactctggggactgttgtggggtggggggaggggagagggatagcattgggagatatacctaatgctagatgatgagttagtgggtgcagcgcaccagcatggcacatgtatacatatgtaactaacctgcacaatgtgcacatataccctaaaacttaaagtataataataaaagaaaaaaaaagagagagagagaaaaaaaaaaaagaagaatgcccagagggggaagacagaaggagcatatactcagatgtggcagcagctcggcccttgtagccctgcttcaatgagctgataagaaggggtgggatgtggtgaggctttagtggtattaggccaagggacccaggagggcttgaactgtaccataaaacaaaaccacatcatctcatgagtttcctgaggaagacagacacagagaaaaaatagcaatgagaatcaagatactgctctcttattagctggaggcgtatagcccttctacaaccctgagagaggaaaagagtgggccatgcccagtcatggccccttattgcccaggagttcctcccattagcaaaatggacccattcagcatcccagagccctaccccctggattaccattgcctcttcttgagggaggagcaataaagagcatgaggacctttttcttcttcacttccctccagtcaaacaccctccaatgtcttggtctcttctacagcctcccatcttggcttggatactcaagtgacaggaacccattacttcccaaggccacaatgatgctgtcagatgctctgccatgtagacagttcttccttacagagagatgaaccttctctccctataaatcccatctatttgtcctcattccacccccggaacagcattttcctacatgactgctttctagatacttgaagacctacggtatggaaggaaggcaaggcttgttttgtatgatcctcaggagaataaccagcatctgggtaaaagttgcagaaagacatcagatgcattctctgggctagaaaatggatcatccttaccctaacaccttcctaggctggtctcataagttcaagaaaaagaatattctcatcagcaggtgtttccagaagcaattctgggatgcagccccttcatttaaaacacacatacacacacacagacgcacacgcacgcacgcaagcacatggagttctttctgcttactcatttaaatggaagagtaattaaggtggctgctgaggttccagaggaggctcagcattttggctggacctcagggtcctccccatcacactattgcctggtacaaccatgcccattgttctaaaggtgccagctgtgccaggtgccctggaaggttcctaatgctctgtggacgctgttcttggccacaggtattgtgctggtggtgagcatcaagcctggtgtcacccagaaagtgggtgaaattgcgaggacaggcagcacccctgaagtcagtacggtggatgccatgttagatctcatcaggtgagtgttttgccacaaggtggcttcaagggcatgcggatagcagcacaaggccttgtatgtggtttaatattctgctgttactgtattgaaatttttaataacttttgaattattgtgcactttcattttgcccaggaacccacaaattacatagccagtactgtttgccaagtcttggttccaagagggaagggaagaaacaggcttccgcatcaggatttaggatgaacagagatgcagctacatgttccagagagatgctgggatggattggtagtcagttctgaagcgcacttagaaaaatacatcttttaattgtacaggagaaactctcttatctaaagcaaccagaggggtaaataggtcagtcaataaaaaataccagttaaagcagagactcataaaaaaagacataagatacacattacaattttgttttcacttaaaacttagtgcatttattcaccaattgtttgacataaagctaaggtcttttcttcaagtttgttagctcatggtaatttcttacgggttctgttgcatatacagcccttataaatatatcatctgcaatttccaggtaaagtttctatagaacagagcaccaaaacttttagacattgcaaagaaagctaagtgcaaatctttccagtttttctttttaatttcaataatcttcccatacctaatctaaccataaaaattttagtcactggcctttattgagtttccaggtatgtggcttagattttatagaaaccataccttctttttatgctcatatttcactggtttacataatatgaaatgcagtaattatgatgatatttgcaactggtataaagaatttgggaacaaataaaatgaacccttggtaagtgtattagtccattttcacactgctataaagaactacctgggactgggtaatttataacgggaagaggcttaattaagtcacagttcctcacggctggggaggcctcaagaaacttacaatcatggcagaaggcaaaggggaagcaaggcacatcttacatggctgcaggagagagagcaagggcgaagggagaagtgccacacactttctaacaaccagatcttgtgagaactcactcatgatcatgagaatagcatgggagaaaccaccccccatgatccaatcacctcccacaaggcccctcccctgacatgtggggattacaatttgacatgagatttgggtggggacacagagccaaaccatatcagtaagcatacaacctcattgatgaaaacagaagtgttcagaatattaaagaataaatagtctcttgactgtgagtgtccatttcaccaaggagcgtaagcatgtcagttactcagtgaatcaattaagtgatggttgattacagagctttctatacttgggtgaagctcagcaggaaaaaagaaatctcaatacaaggaagtattacgcaaagcaggggccagaagagaaaccagagtactagttttatgttatactaatttctaccaatatattaggtatgacaaaacaatactttttgccctaacataatactgccttttatgtctccaacaggaatatgttccctgagaatcttgtccaggcctgttttcagcaggtaatattaattacttgtgcccttaacttgctaccctcttcccattatcaattaaaaatgtttttttctgctgtgactcaagaaatggaattagccccgtgaaaatggcagcaggaagtaaacctgtgactggccaagtttaaggtgatgtctctgttttgtatgcagcctttctggctcacagtaaggtgcatgtcacaatttacactgcttccttttcctttatgctttttcccccaaaaaggctcaaatggtacaaatcagaaatctgtcaaataatgagtattttaaaatgtggcctccagtacctatttttggagaaccatagtatatttgtactgaagtttaaactttctgcagaaaaaaggtagctctctatctcctctttgcttttcctctggtattagaacccaggatctaaccctcatggtgtggtccacatctgggttcagtcttctccttaatcattgtgtcccagagaggcgtggaagctcacacctgtaatcccagcactttgggaggccaaggtgggcagatcccttgagctcaggagttccagactagcctgggcaacatggcaagaccatgtctctaaaaagaaataatttaaaaaaaaaaataaaaaatcgttgtatccccattgctggagctctacaatgcagtgtaacaaagccatgatttttttttctgtaggaaaattgaacaatctcttcactccatttacttcaagcctttccctcctatttatctatgtgctttaagacagctgagtccatcacaaactgctgtattcattcacataagttacatgaacacagacttctgtgtataccaacaaaaatggcaactctgttgctctctgccggcctccacgagggacagaacctcctctattacagggggcctttgcagatcagtcacagtggttgtttgtaaggttctcagtgttggcagagcctggtagtgggggacatttatgcctggtgtaataatatactcactctttcttaaatccccatgtggaagctccacagaaccaaacagggctgaaagaagagaattcaactgcagtctcactcactgaatagccccaaggggactgttgattttggaacaaccatatcgttaaacctttcttgatgcttattaaagttgtagtgatgttatcaaagtaatgaagtgtgtttgctcagattaaaaatcatttattaattaataaaaacaaaaatgattgacaggaatccttacagagtctgtctctgagagcacctgcagatcaagcctgtactttcttttgtattattcttctatcaacttgtcgtttattgtgaaagtgaaggaacattttgacataattgaatggtgatcgtgggagtcaggggtttaaatttctgcctcgcttttagttccaaaacctgatgggaggtaccgttgacaactggagccaacagaggcattggatgtagatcccttcagtggcactgtttggccaaaataacatgttcctgtgatttagtctcaaaagcttaaaaaaaattctttttttgtttgcttgtccttgattttctccaacatgcagtacaaaactaagcgtgaagaagtgaagcctcccagcgatccagagatgaacatgacagaagagtccttcacagctgtcatgacaactgcaatttccaaggtaccattcttatttcctgttcctcttccccaggagacaggcactgagtcatgactgagcaggaaatacaatcaatcctcgtcattcacagaatcgcatttgcaaattcacctacttgctaaaatttatgtgtgaccccaaaatccatacttaaggggctttcatggtcatcatctcgcacacaaagagcggcaaaatatttgagtcacccgacaggcacgttcccagctaaggtgaaaaaggctgtgctctgctttcttgctttgattctcatgctggaaacaagtgtcccttttgcagtgtgtttagtgtcatattttttgcatttttgtgatttttcttgctgatttcgctgtttgaaatggaccaaggtggggttcagtgactcatgtctgtaatcccagcatgctgggatgccgaggcgggaggatcgcttgagcccaggagttccagaccagtctgcgcaacatagtgacacctcacctctacaaaaaatgaaaaatagccgggtgtgatggtgcacacctattgtcccagctactcgggaggctgaagtgggaggattgcttgttccagggaattcaaggctgcagtgagccatgattgaatcattgcacttcagcctgggtagcagactgagaccctgtctcaaaaaaaaaaaaaaaggaccaggctgggcatggtggctcacacttgtaatctcagtactttgggaggccaagacaggtggatcgcttgaaaccaggagtttgagaccggcctgggaaatatagtgagaccccatatgcacaaaacattttaatattacccaggtgtggtggcacatgcctgtagtcccagatacttgagaggctgaggcaggaggatcgtttgagctatgattgcaccactgcactcagcctgggtgacagagcaagactcttgtttcaaaaaaaaaaaaaaaaacatacacacaaaaaagcatcatattgaagtggtctccagtgttcctaagcacaagaagactgtgatgtgccttagggagaaaatttgtgctttagataagcttcattcaggcatgagttatagtgctgttggctgtgaggtcagtattaataaattaacaatctatatgaaacaaggtgtctttaaaagaaacacatacaacaatgttatatattgattgtttgctgaaaaggatgtgtccaaggttcccagaaacttaaccctgtatttcccccaggagcaacggttcagtatttgctaattcagtgttcatgagcactttatagaacataactaccaggaatagagagagtcgaccacaaagagcaaaaaaagagccctgttgcctctacctctctgggtctgcttacagtagagctggccatctctagaaactgctatagatttgtcaggtacataagcatgcaatgcaggcccacaattcctagtctgaatctctctgcccagatgtaattcagagttcagagtttctcagactttagaaaggccatgtggtgtatatactgcatattatgcaacctttataagtgggatgggcaacaacatgccagaatcaaccacatcaatgtttttataacaaactcataaatattctgccaaggagagaaatggacccttagtagccagtagcctcatctcagtttaggatgggatttgctgccaaaagagtttgctataaacttatcaataaaatcaacatgctttgagagcttttgggatttcagaattggagatcagaatgtgtgggcctgcattggtacctctgtaagcctgtagcagatttctcccgaatgttctctcaacttcacacaggaaggaatgatttaaggagaaaaggagtgttcattagacttaagaattcaaattaaataaaccaccgttggctccctgcttcctactgcagaaagccttaactcctctggctgagttcagaggccctgcatgacctggcttctctctagttttcacagcttacttccagtgggcacctctcttctttccagattcacctcctccatcactccttattcctgccttttgatgttgttccacaaatactttctgagcaccctctataccccaggccctgctgggcattgggattataatggtgaaaagacagatgccaggcctctgtcctcacacaaagaatgatgagtattataatcaggaagaatgggatgtttgggaggcattcagcaagggatgttaaattagtctggaggccataatgaatgagcaagaattattcaagcagggtgcaaaggcccagtgcatgatcgtttttgcctttgcttgccatctttctgaaacatgctttttctcctggctgctgattcctcagccctagctttccctaaccttgaaacccacattcatgtcccactcttcatatgacgcttgtatctcatagtttgggcgcacaattaattacataccttcctgctattattggctcatgcttctcacagtcagtcttgtctctccagctgaatcttaagaccttatgctatagccagtgcagtaatactctagcttttccctaaatatatgtttgatcataagtaagaaatgactggtagcccagtgggtcctcaacataatttttttttttttgagatggagtctgactctatcgcccaggctggagtgcagtggcgtgaccttggctcactgcagcctccgcctcctgggttcaagcaattttctgcctcagcctcccaagcagctgggattacaggcacgtgccacaatgcctggctaatttttgtatttttagtagagacggggtttcaccatgttggccaggctggtcttgaactcctaacatcaggtgatccacctgcctcagcctcccaaaatgctgggattacaggtgtgagccaccgcacccagctaacataattctttataaacatagttggcaccactcagttatctctctgtaaatctcaggctatttttacccaggataaagtgaagaaattaagccaggcatggtggcatgcccccgtagacccagctacttgggaggctaaggtgagaggatcacttgagccctcctttgaggagtttgaggctgcagtgagctatgatcatgccactgcaccccagcctggacaacatgagaccctgtctgtttaaaaaaaaaaaaaaggtaaaaacatgattcacagtagtaggtatttggctaatttttatatgtctaaaatcctaccaatgatagactggataaagaaaatgtgtacatatataccatggaatgctatgctgccatttaaaaagaacaagatcatgtcctttgtaagggacacggatggagctagaggccattatccttagccaactaacacaggaacagaaaaccaaatactgcctgttctttcttataagtgggagctaaatgatgagaacacatggacacatagaggggaacaacacacactggggcctatcagagggtagagggtgggaggagggagaggatcaggaaaaataattaatggatactaggcttaatacctgggtgataaaataatctatacaacaaaccccatgacaccctgtacatcctgcaccacatgtacccctgaatgtaaaagtttttttaaaaaaatcctggctgggcacagtggctcacacctgtaatcccagcactttgagaggctgaggtgggcggatcacctgaggtcaggagttcgagaccaccctggccaacacggcgaaaccctgtctctactaaaaatacaaaaaattaattgggtgtgggggcggatgcctgtaatcccagctactagggaggctgaggcaggagaattgcttgaacccgggaggtggaggttgcagtgaactgagataccaccactgcactccagcctgggtaacagagcgagactccatctcagaaaaaataaataaataaataaataaataatcctattggtcatccaagaccgcaggcataaagagtgttactgtgcttcattatcagggtaaaacagaaggtaaaatgtcctaaaagtgttcacactggtaagtattctgtacttcctgcattattaattcctgtgtttttttaagcagactccaaatgtagctagcagttaaaatgaccctgaaaagtgccttcaatctaaaattcataataaaaatataaaccattccagaataagaaatctttataagaaatattcaaatatggacttgttgaaagaagagaaagcattttaacttcggggagcaagggtaaagtttgttacatgcataggtgtttttattattgtttttatattttctatagttttgttgactctgcctgggagatcaccagtttattatgtttggtcattgtatcttctcatttctggacctgtgctttctaacaagattataatcgtgcatcaatatgttttcttggttttgatccacagaacaaaacaaaggaatacaaaattgttggcatgtattcagatggcataaacgtcctgggcttgattgtcttttgccttgtctttggacttgtcattggaaaaatgggagaaaagggacaaattctggtggatttcttcaatgctttgagtgatgcaaccatgaaaatcgttcagatcatcatgtggtgagcagacactgtttaatgtcattttgcttcccctgacaattctgtctcctcaaaattagaaagaagaggttttatgtttgtcaactgacgaagctagagaagttggacatttaatattgaaccaccagagtattttgtgggggcttttgttgctgttctttgtttttgttttagaggcagagtctcactctgtcaccccagggtggagtgcagtggtgcaatctcggctcactgcagcctcaacttcctgtgctcaagcgatcctcccgtctcagctacctgagtagctgggactataggcatgtaccaccatgcccagctatttttttgtattttttgtagagacagggttttgccatgttgcccaggctgatctcaaactcctaggctcaagcaatctacccacttcatcctcccaaaatgctggaattacaggcattagccaccacacccagccaccactagagtattaaataattccacatattacccaggagttagttcatgaacagaagtctagctatcaaccattgtcttttccctcaaagccttgggagatcatcttgcactcaaccagccttcgtgtaagaagtaattctttaaaaaatgatttgaaggatttcactgtacatgagaacacaaagtgctttccctattgcaccccatgcaaaagtgagtttcaaaatatttataactggcactgcatgggcactaacccatctgaatgaaagctaccatccgtgagcataccagtgacaccatttcagtgtctgtcctctccctgaaaatgccaaaaagtccacctttcttaggatgcatctgtctcacttacctcatatttaatttgttcaacattatttaatccaaagtgtagatactgacagtgatgtaaagggttcagtaaaaatggcaaggcaggtcacttaatactgcagaaacctcagcttcatcatctgttaaaaaggataataaaagctacccccagggataggagaagtacattaaatgaaatgatgcatgtaaaatactttccctcatgcaagatacaacgatagctccacaaatagagctattatgatcacttccagtactaatactatcgcctctattgctgatacctgggaaacagatgaccgtggctagaaagagccatatttggcagtgagggtcaagctcaagtgagatctgcagataggacaatcagcaggatatatatgcactaggaacacggcatgaggtgcgcacccatctaaccacatgttcttgccaagtttgcaaactaccctatggtagtttggatgggtagaatttaaggtgcacacaggtactaaaaactagagccaatattgttcacccaggacttgaaacaactcttagcttcaattcccatcctgtgctccaccaagtgtgcatgccaagctgagggtgcccacactggagtgttccttccccaccaacctagcatgagaaagcacttgatgacggaatcacgcctctgttgtgcttcctttccagttatatgccactaggtattttgttcctgattgctgggaagatcatagaagttgaagactgggaaatattccgcaagctgggcctttacatggccacagtcctgactgggtatgtcagactcaagagaagagacagaaacctcctttgatctaataggatggccgctgagaggttgggtttcagttggttaaaactggcttctgccctatgtgctgggaaagatagggttcagagataagacagcagggggaggagggctgccctttaacagctgtactgtaggtggatcatgctgtgctaattgtcagctcttggcagaacagcctggaccaggctttgtcactgcctttattggttatgttaaaataattttttacaacaagagagaaacccactcgtagcctcccttggctctctcctggccttcatttccttaagaatgtaaactagccaagcaagcaagaatagcctccatgtaccctgaacctgaaagaaattagcaagggcctaaatgaaatcagacttgagcaagtaggagcaggatggctgttggttcaaacactgttgctggggctgttaaccaccaccatgtcctgcagcatcagagtgtcagagagggtgccaggagaatcttgaggctgggaggaattgtgtgggcctttttggaagccattaaacaggaaggcagcaggggttgggtagtttccatatttattacagcctagctactgtttccttgagaaaagatgaggtgggataagttatgaatggtgcccctggacacctagacaggggcagaatatgtcacataccctaagaaatacagactaagggaataaataaatatcattgatttgactctcacaagtcaatacctacaaacacccaacttgagcaatgaactcacctattggaacttgatcgtattggagatttccaacacagcgcatttggttcttaatctgtgtttgccaaaaacacagccctgccagccaacacagaggcagatttggtccctacagtgtgaggcccctggcgctaagggaggtgggacctccaattcactggaggccaccctgctgtagggctgctgaaacaggcagtgccagggatcgtgtctcagcagtgacgtggctggggtgtatgagctgagccatttcataaccgagttctgctggtttctattctcttaccccagctaggtgtctaacaggaaactaaaagtcagttcctcatggtttttagctacaagctctctatcaagaagatcctctcgccagaactccaggatctatatttttgatggccatttcctatttcaaacacacataactgatctgtaaactctaagctgccagttacatatatatctatctgtgaaatgagtctcatttcttaagcctcctagttcatgtaacctgtgtatttccatgtgaaacaatgaacagtttgagaaggcaggaataacaaagaaagaaataatcctaaagtatggctgtggaagagctgagacttttttccttactgtaactctgacttccctcttagacagtgggcgccaccagcaagacagcagcttggtgcagggaatggagtgggtgaggactgagcgctgtgataaggggtataatgaggtataaggtagtggtgacatacagggtgccaaggaaggaaggctcagccctacctgaggaagtgagggaaggcttcctggaggaagggggatgcctatctgagtcttaagaggagaagaactgagcagcaacagaaggaaaaaagggcacttttgtgcatgtggcaggaatagcacacacaggggtgtggcagcatgatataattctgttctgtgaagccttgaatttggattcagctactggctttgtcattaactctgacaagatgcttcatgtgctgagagagcctctaaaccctcatacatggaatgggacgtatattcctgccctactcccatttcttattgggccattatgaaagtcaaacaattttataaattaaaaagatgtttgataaaaggattaagtgtggggaggtggtattatctttgaaactttaatttctctttcttgtttacaggcttgcaatccactccattgtaattctcccgctgatatatttcatagtcgtacgaaagaaccctttccgatttgccatgggaatggcccaggctctcctgacagctctcatgatctcttccaggtaaacagaagaggggtttctggaagaagcctccaggctcaacgttatcaactctcacctcactttacaaaacagactccagcttgcggtttttgtagctgtctttgagaaatgacctccgtattctcggcccctggccctgaacacattgcttcatgctgttgcatatttcctgctctcttggcatgacctgcagctcaggaaggggttatggaataactgggagcagtggtgggcacagcaccttctgattcctggacctgcctaaagggctagcatgatttggatcctttgtttcattttgttttgttattttctttacttttctcgacaagattacctaaaaggaccctttgtttactttttggaagacaggcatgtcttcaggcagggactaaggtccagcatttctagacataagttcctttctatttttatcacacagttcagcaacactgcctgtcaccttccgctgtgctgaagaaaataaccaggtggacaagaggatcactcgattcgtgttacccgttggtgcaacaatcaacatggatgggactgcgctctatgaagcagtggcagcggtgtttattgcacagttgaatgacctggacttgggcattgggcagatcatcaccatcaggtggggcatggtgtcacattcattgtcatcactgatacagggattaccgccagtaaaaattgtccatgaagggacaccaagaatgtcccagtgatgaattctttttcttgatctataaagtcccttcccaagattaaatacgactatatcctggtatgcaagatttctgcttcggggtctgggtagccaaagccatcactctgtgctcagtttactgaagccagtaggatctaggcacaggctagcacaaagactcaaggctgagtaagggccagtccctgctttcaaactatccctgctagatgggcatgcacatatccaaatgaatgctgaagaccatgatgagggatgtaagagaactctgtatggtgttcacagaggactccagagagggaagggctggttctagctgggaaggtgaacgatggcttcccagaggaggggaacatttagctgaatcttagaagaataggaatttagcaggcaaaagaaaagctaggagcatttggagtggcagaaatagcttgtgatgcagccatgggctagttacagcatacagatttcttgctatggctggcataaaggatacataaacattcctttatgtttaaacgaatgaggaggcaggggtcatgtcatgaaaggttttgtacgaagagcttgtggaaagctcttagatgctttgtcatattatggacagatttgcattttatgtatttatttattttttgagatggagttttgctctgtcgcccaggctggagtgcagtggcacaatctcggctcaccacaacctccgcctccagggttcaagcaattctcctgcctcagcctcctgagtagctgggactacaggcgtgcaccaccacacctggctaatttttgaatttttagtagagatgggtttcaccatgttggccaggctggtcttgaactcctgacctcaggtgatttgcccacctcagactcccaaagtgccgggattataggtgtgagccaccacgcccggcagatttgcattttacaaagataagcagcaatatggcagatatattggatgggagcagggaccaaatctaggaaaccagttaggagaccactgcagaagtccaggcagggtattagaaggcactgacactgaggttggagaagagctaatgaattgaagcagcatcagctggattcagggtgaaaggcgagggaatgccaggatgactcccaggattggcagatgattctaaattggtgggtggggcttaccagaacaggaacgagtgtaagagaagcacatataggtgggaaagataaatagtaaatactttttgacagattgaatttgaaatgcctttaagacttccagttgcacatatgcaatgagaaatataggtctggctgcagatacagacatcaggaacatgggcttaataatggtcttcaaatgtgtaagtcacaagttattgcttgtattggaatcgcggctacatcatgattagctgtgatcttgggcaagtgacttgaatttttaaacttctgttttctcatctgtaaaatgaataatagtacctacaacttattcaagtagtggcaattaagtaatatgcatataaaatgtttataactgtgcctatgtagtgagtactcagtgaatgttgaaaatggatgacatgacgtagggagagtttgcagagaagagaaggagattaaggactgaggcttggaaaaatcctaatactagaagcaggtagagaagggaaaacccaagagggagagggagaaggacagagagatgggagggaagccagtaaaccttggtatcatggaaacccagaaaagagagattttcaagggtgaaatggtccacagagtcagaagctgcagagaattctagtgaaatgaggatagacattgtctgcccaagtagatggtagaactgtcattagtggattttgccagatttgtttctctaggacagcactattcaatatggtaaccactagccatgtggcccactgaattggatagcacagacacagaatagtttcatcattgcagaaagttcttttggacagcactatgttagagtgataggctgggattagagttaacctgaagacttttgttcagtttagaatggaagtttaagactaaactggtccctaggcctgctcaaggttgaatctgaactttttagagttaattcattcttgtgtcccagcctaaacataaattctagggataaaatcagagtttgttaactaacaatgttctaatacaatgcattttttaaatcctccccaaccctaaatcgcaaagtatttctgttggctgaagacaagtgcaaaatacaccatttggcacaccagctggggaactatcccaatgctgtgtaatctataaaaagtgttagcggctaaagaagcctgtgccaaagagattgagcaaagtcctgtaattataacagcagagggtatgtcaaaattgaaaccttgaatcatgcctgaaaaagtttctgctccacaaccacccctgtgcttccaacagttgttacttttacatttccaagggttttttcccacttccctcaccctgggctgtggaacccagtcttcactgaactgatttccaaggagtggtttatgaagtgcctattcttttgtgtatttgacactttgtgatgaaatccctccctcttttttggttgtaagttttctagatctttctaatcatttttttaatctcactgccagaggaatgaactctgggcctagaagctaaatagtcaattctcattaaagcctctccggctacctctggtatattcttaaatcagatttgctgaaaactactggcccagagccaataacaactgtgaggcccaaagtaatcattggcttaaaattaaaaatcctcactggctctacatggaaaataataaaagttggttttgcttgacagttaccattatagttcatgtgactaatggttaaagagatttttagacccaaagtatatttctgtggactggacatcaaagaaacataggtaccatctacccaaaacatacccttttgtggctttatcataatactcaaaggttacaacggattgaaaattgtgtgagaatatgtgtcaaaatggaaaaaaaaaggataaattgtcttataaaaataattagggccggaagcgatggctcagacctgtaatcccagcactttgggagacctaagtgggtgaatcacttgagtccaggagttcgagacaagcctgggcaaaatggcaaaaccccatgtttaccaaaaatattctaaaaaagaaaaattagccaggcatggtggcatgtgcctgtagtcccagctactcaggaggctgaagtgggcagactgcttgagcccaggaggcagaggttgcagtgaactgagatggcgccactgcactctagcctaggcaacagagtgagattccatctcaaagaaaagaaagaaagaaagaaagagagaaaagaaaaagaaagaaagaaaagtaaagctaattatacagcagggcgcagaggctcacacctgtaatatcagcactttaagaggccaaggcgggcggatcactttagcccaggagtttgagaccagcctgagcaacaaggcgaggccccgtctctacaaaaaatacaaaaattagccaggtgttatggagtgcatctgtggtctcagctactcaggaggctgaggcaagaagatcgcttgagcccaataggtggaggctgcagtgagctgtgatcatgccactgaactccagcctgggcaacagagtgagaccttgtctctggaaaaaaaaaaaatgtgtgtgtgtgtgtgtgtgtgtgtgtgtgtgtgtgtgtgtgtgtgtgtgtgtgtgtgtatgtgtgtgtgtgtatataaggaataaagaagaaagacaattgtaggatttggggcctagaaagagctgagagaaaaaaaaagtagcagtagtaatagtagtagtagtagttgttgtaatagttgttgttttggttgctgcagtagcagtagtaataataccagtggcagcagcgacagcagcaatagaggaagcattagcagcaactgctgttgttgcagaagtagcagcagaaatggcacgtttttaatctttttgtttgttttttgttttattttactttaagctctgggatacgtgtgcagaacatgcaggtttgttacataggtatacgtgtggaaatggcatgtttttaagcatctactatacaagtgctatcccagatgccttacgtgtattaacctcatttaatcttcccagcagcttgcagtagacatactgtccccatcttacaggcaaggaattgagattcagagaagtaacttgcctgaagaaatgccatcagtaaaatggtagagcccaaagtacatcacccaggtgtgtctgacactaaaacctgtgttccctccaagtcacaagccatccttcaacctgtttagagagccaagtccaatggccggtcctaaaactaggacctcagtgtgaggaaagaactttgtaccactgatatttatgttttcttctgtggaaatcctctaactcaaagtagaatatgttcaagcagcaggaataggtttttatattattttctcccatctgaaggttcatagttctgagtttcagaccaatgccagtcaaacagcagtagtctggtaagcaaggtcaaggctcaaggacagagttttctttgactaaatgaattttgagtttcaagcccagcctcaggctatagagacatggattactgtgacacgtcagggtttccaagagggatcagctggcatggacacaaatcacttctgacaaagaaaacctgttgatgcattccatttaaatttttttcaaccagcattaaaataaacttgggctttccaaagagtacttaggtcagaagagatccaaagggttatagaggccagaaacctttgagactgaggcctgaaacctttagagtaattggtacagccccagaaatctctaatttactataatttggtggtcaaaaccactgaatgaaaatacacttgtcaaaaaactctggcctgtgtttgactgtaccctcaaatgctttctgcaacacctcagtaggcagatgaatgggcagtagaatcagcttcctaagaactctggctttttttagccccaaagaatatgaatgtgtggatagaatcagggattcttccagtttaaattgccaatttttacattttcacctttcaacacagtggaacccgggcaacagttcaggccttggcccaagggcaaggacttgtctccagaaagcattgtaggtgtggcctccagcttatccaagtcaagggatttttcagggcatgttgaacccttgtttccttcagaatgatccaattaaaataaggaagatgttgctgataaagagactgcacattacaaagaaaaaaatccctactgcctcagctgatcttaccaagagggatctttttaaatacctggtaataaagttcacctggctgcccctcctggattccagatctttctttcccacaaagtgcatctactggcaaaaaggagcagtcaggagtaaatgcttgtaccttggacaggatcagctatttctcaattcagtgccctgaagagcagttcccagaggtaaagagtcctgtgatgtcaagagagtgcataaagcctgcttaaccattgtctcattcctttgccttcacctgaaatgcccttgcccatctgcccctacaactatccttctgtccatccttcagggcaacttaaattcctgccatatattaggtgctcagtaaattattgggtggtgagtagatggaacaagggagtaggaaggcaggtgcagaggtacctggcacttatttaggatgagtgtatgtatacatagatgagtacacgaagcctcctattaacaccccatttagtaaactcctgctttcctcttgagtatctctcttacttattttttggtgccacttatgcagttcttccttgcattagagtgatgtgccatatctccgtctgcaaggagatggcatcatacccctcatagtccccctccccccacagctctaatcctgtaatgaggcagagctggggctcagcaagtcacagattctaactacccaatttagggacacagcagtaatagccatcgggactaagcgggagtaaccatttcaggccagggctttaacgggagaggtaagtgtctaactcctttcctgctggtatgtttctgcagtatcacggccacatctgccagcatcggagctgctggcgtgccccaggctggcctggtgaccatggtgattgtgctgagtgccgtgggcctgcccgccgaggatgtcaccctgatcattgctgtcgactggctcctgtgagttggaataaatgcactgccttagctggatgtgcaggcgggcttcccagcctcgcaggcgctgcagtctgtcatcattctctcctcagattgcctaatgagccacctgttgctgctttaattttcctctgaccaggccatctgataacatgcctaaaaattaactcctcataacgtggagcagtgattttaaaaagccggtgagctccattagctcattatacctggtaacactcaagcttaggagctgggtgtgggacagagataaacacagaacaaggtgagaagccaggcagggccccagagccatcctgacctatcccagccctggttcagcatcataggctcagaaccacctagttcaaaatcagtccgtcttcctaagcatcttccgaaccatcagggacagtggcacaagcacttgggtttgaatctccgtcctgtgtcttaccagcttcttgacctcgagcaagtttccttaacctgaggcccagttgcataatctgtgagatgggaaaaaatctgcctatgtcattgggttgttttaaggactgagtgagctcatgtgagtggagcatctagaacagcgtctggcagcccatacatgctcaataaatggcaagttttattgttatgattagaatgagttggaccattcaggccccaatcaacaacacttctctctctctctctctctctctctctctctcacacacacacacacacacacacacatatggaatacagcagaacatctgggtgagaaagtaccttcagtgaccctcaaggttaaagttagaaccagcctggctccaagctttacccttgatgcccacttctgtgcatggatcttacagcatttaggtctggctctgtcccctggcattgcaggtaagtattgctccacatggagcctttgctcagaaccagctcaggctcactggggagtccagtgctatgtactgtagtttgcaggtgacagatgagatggaaagggaagcagagacatcctattgggcttgaaaacacagattcacatttcaaatggcaaaagcccctgcacctggcttggaagctgtgccatgaggtggcccctcagtagctaactgggctataggcccaaatgaggtggcacccttcttgcaaagatatcctatcattgagtcaagatttggttctttctagtgatgctggtggatttgcatttttctcctttccctgagtcttcctggaaccagttaccttccctgccaagatacccagatgagtcaaaggtccaattggaggtatgggataaaaagacactagggccagttcaatccctggacttgttctaaataacagaagggcatccagggtggtcatgtgtaagcattgtcagccttttctgttctgcaggtgtagttttcacaagattccccctgcatgcagttcctgtcaacaaagtgccagtatcaaaatggatcctctcctctgcagtgtgccttctctacctgtcttcctgccaccagtctcttccccaggctctctggaaattaagactggatgagggtggcccacagagaaatccattcctgggctgacctgtgttttctgaccccgtgctctgcaccatgcctcctggtttgctcataagtagagtgacctagattggtaaataaacaagtacaccatggacctgaacaaacacatacataccccacatgcacatggtacatactccacccacaaaacacccaagttctctgacctttgcccaaagagagcccacaatggcatttgcattgaatctagaaaatcccaagatagaggttagggctgaaaaacttactgaattctgaacctccctcagtcccccaaaaaatatctggaacgactctattcatgtttctttgggagaagaggaaggaatttagggagacttaggggagtcattgctactttgggggagctcatgctgtgcctttatgaacaaccccaggcctgtgaggagccttcagtcagtcagccatgaggacagcactttctgcacttactgaaatctaaactgaacatgtcaggtccttgcatctctccagtgatgaaggaaaatgaaatctgggcctcctgtctgactcctcccgtctctccccagggaccggttcaggaccatggtcaacgtccttggtgatgcttttgggacgggcattgtggaaaagctctccaagaaggagctggagcagatggatgtttcatctgaagtcaacattgtgaatccctttgccttggaatccacaatccttgacaacgaagactcagacaccaagaagtcttatgtcaatggaggctttgcagtagacaagtctgacaccatctcattcacccagacctcacagttctagggcccctggctgcagatgactggaaacaaggaaggacatttccgtgagagtcatctcaaacactgcttaaggaaaagagaaacactaatggccaagtgtacatttgatttgatatacagacctccagattattttctatatttggattcacagcctttgcgctctgggttttgggatttgggtgtggggtaagttgaagggaaatcaatttaaaggaaagttctattatctgggttttagaaattctataagagacaaagtttggaagtacataaagtaataactgttagaattaggtaatggatatgaaagagaaaatgctttctcatgcatagacaagtgttttgggtttttaaaaaaaatattctgtcattggttacaaatttttactcaggctttctattggcatggatttcctttgacctctcacttttttataaattataatgcatctaaaccacctgtccccagttaatgtgccaaaatgtcaatttttaacttatctccagccaatttcaaagaaaacagaccagcatagttctgcaataacagttttaagatgggcatagggtttggaagaaagggagaaggattcttttttcaatgtactgtattgggacgctggtaactgttaacccagtgttcagcatagagctatatatatatatatatgtatatatttattattttcatataatttgccagacagagatcagaattgaaccgtcaatgtgaaataaagagttctccttgtacttgaataataaccacgattccaacccaggtctgctttggggcttatcagaactcctttctaaggagcactagaatgagaaatcatgttgttcgatcgtttcacatctgtatatcagctctaaagcagagatgtattatggtgatactccaaggtggcatagccattcatttacaacttccagatttgagctgcctggagggaatccatatcagctctgcataagattatatacaaagctgtcactcacaaaaggctggatgtgctttcatccaactggaaggctttattcttccaagttcattcatactcaaagaggccagtactttgccatccttgcacttctgttatcagggcccaaataacagtggcaagctaccaactaagttgtattttaataaagattccatgggttgaacaagccacgttgcagaaaaagagcttcccctaacctgggttgttgcagagtaaatcccacgacataagctggtatcagtggttcgggggaaatagttccattctatgactcttgtctcctcctccaggaggactgttctaactagtaatcttggccctattcattacatcctctgcttgtcattctgctaatttatgaagatagtttattatagtctgtacttcagttctcatcttgtaaataatgcttaacataaacttgtacttacactgaaatccaaaatagtcatgtttctgcagtattctgtagccaacttaaacctgtgctttcatgtttaagaaatgagaaattgtgccaaagatagcagaagagtagataagtgctcagtattgacgacctacatctgaaatctacaacataatgatactgaattgttatgtaaacatcataaatagtaaataatgattcaatgtgaattttaaaatgcaaatattgctattgtttataggaaataaatctaaatataaatgaaattgaatcagtaatttatcttgggctaaatggttctaccccttactaggttgccccaattagtggcactagttggcagagctgttcatgagctgccagttatcattttggagtcagtttgaaaccagcctcttaacacactgctgttaactcataaaagagaagagtgttccatttcagtctcaataaacacttccctcattctttccccctgcctttttcttcttgttatctgttgttttatcttacttggatgggtgtgggaaggcagagatgtggtcagttgaatcagattttatacagttttctttttctttttttgagacataatctcactctgtcacccaggttggagtgcagtgacatgatctcaggtcac

SEQ ID NO: 15404 - DNA, 107926 bp, Human
ttagagaccagcctgggcaacacagtcagaccctcatctaaacaaaaaaaaacgaacaacagcaacaacaacaaaaaacagaaagaaaagagaaaaagaaaaaaatatttgttctgggaaaccagttaccaatccatactgtcgactatcagctgaaagtcagagtctaaaattaactctaagtaggcattttttttttcttttgtcatacattttaagtaaatccttttttttcctttaaaagagtcctcaccgccaggcatgattgctaacacctgtaattccagcactttgggagaccgaggtgtgtagatcacttgaggccaggagtttgagaccagcctggccaatatggagaaaccccgaaagtaaaagtacacacacacacacacacacacacacacacacacgcaagcaaaattagctcggtgtggtggtgcgtgcctgtatttccagttgctcaggaggctgaggcaggagaatcgcttgaacccaggaggcagagatcacaccactgcactccagcctgggcgacagcacgagactctgtaggaaaaaaaaattccagttgagatgctttccagggcgctagtcaagccccgcatgcttatttgtgggagtgaaaacaccaatatttcgggattgttgtgaggactaaatagtgtctgtaagatgcacagagaaagcgtaaatagacgtcaatagcacttgttaggtctacacactccatttttcctctatattaatcgaattatttaaagattggttagctttttggggaaatgtctctccattgtattccacttattaggatgaactaccttttctccttgcttttcagctttctctgctatgaaaaagatggaaaattttttagcacaaggggactcttctcaagcagtaaatcattttgatattaaaaacagataattgcaaacccagttttatttcagtatgaattccgcagtggagtgtgaatatgtgtgtgtatgtgtgtgtgtgtgtgtgtgtgtgtgtgtgtgtaattacctgtgattcaaaagaggaaagggatcagtattaaaggtacttgtacactggaagcaaaaaaaaaaggaagtttagttcctctgagctccttggcaattatagctgctaaaggtagcttttacaaagaaactgcctttgtgcctaaagtatttatttccttgtttgtatttacccctttgaggaggaatcgctgtgtcttgagtgaaaggggtacgctgcttgcttgcattaaactgtgagggtccaggcgcattacggctgatttcagtaggtagagcagacacactttagtttatttttctctttctcactccccaccctcaacctccgatgtacacacgttttaagattccctgaagtcaggaggtgggagcggagagtttcagttcagatcttgacatgagagtacttcgaccaaggaaaagaaagggaagaaagagggaagcggggtggagaaagcaggagcaaggaaggaaagaaggaaacggggagggagagtaagaaaaaagaaaacgaaggagggagggagagaggacatttaaatgaagaaggaaggaagcttggattcagggaggaaagggagcgggaaagagagcgaaagaagagcgtgagaagaggcaagcattatagtctccggtccacaggggagagatggagccccctcaggactagagaatcccgaagagcccgtgtattgttttcttgaaagccccgaagctaagcaattctaaaaatgtttagcaaagcccttttgggaatggtgagatggggggtggggaggatgggacattttcattgccaccgcccgccccccgtctccccggccccctcacatgaagtgactggatttgggagacctagcggaaaccttcaggtcacccagggaactgctcctctctctggtcctgcagcggcgaggcggggtagggggtggggggggtgggccgtgagagcgccgagacgcgcggggcgcggagatgtgcaagtggcgaagcttgaccgagagcaggctggagcagccgcccaactcctggcgcgggatctgctgaggggtcacggtgagtctctgtgggtgcgggtcggagggatgcccaggtgcctcgtcgccccacggcccgggcggaggcgggtccggaacctcccccaagtccggcctcagcctggagcccgcgcgccttgggcggatgcacggactgagaggcgcttggctgggctctcagcccgccactgccacccggccccgtgcgctcattggtcgggatgtgtcggctcagcagcctccaacttctcccgaatcccactggtgagtcccaggagagcgagctgagggagaaaggtccaaagggcgcgagcgcccagggcgctgggagcccgtgggacgggcacggggagggcagagccagccgaggggagcggctgccgggaggtgcgctgagcagggtccgcagctaaggtccagcgcgatccgagcgcccaggaccctgcggccgtggaggaggcgtgccctgggaaggagccgctactgggacctgaagagtgaggggagggagaggggcccagagggtgacctggaggagggctctggaagtcacgtcaggttggctcttcaggttcatttccatagttccctgcggcctctgccttggggagttatgttttgttaccgagatccgcgctaccagattgcaccggggctgatttgggggctgggaatttgccattctgctgtacagacactgatttttttttcttctttttaaaaagcaaggtttgttttcattttggtttctgtcggattttctcatttgtaactcacttttctatttttacttttcttaaccggaagatcttttcattatcccacctcttcatcttgcttttaacctgatttcctattatataattaatgcttaaatctcacaagggttggtcggtgcggggctggtgtgtccttttgtagatgaaagtttaagacctcttaactggtttcagtctatttgtctggtttcaaaataagggtaattgcaaccaaatatccctctttagcttctcgatcaagtcgattcctcccccatatatgattcaaatggcaattttattaaactgaaaactagtacctgacttgcagcgtcagcatttggaaagtgcttgtcggcaaatcgactgtatgaaggcgtgtagcttcatcccctgccatttttgtgggttctagcactttaaaaaattgtctggtaatttcttggacttaaccctgtgtctttggttgtagagcagcactaaccaggggagtaatatggttggcacttcgtgtccagaactccgtatttcaggctgggaaacacctaattaatgtctgggaaacaagaagatgatttatcctgagtacctctgtcctcagcttctgcagacacagtttaaatatggaaactgtttctccttcttcctgtgcctcagtttccatagaacaaactgtaattgcatagcacagcttcaggaacctgcagatataagttaatgttataatgtgcagtgaagatgaaaactgcttagctaagtctaagtctgtaagtcaatgagatttcctttttaacaaatcagttatccaggtttcctgctttgactgtctgatatagtaatgcttatgctcaactggtataagaattgctgctttacattgctttgaaattaagcttacacttaaaatagtaatttattctgttggtaatattgtcgagctgaagtttgcaggttcttgttatcttagacctcctaattctctattctcgtctgtggcagtgtccacttttccgtttaaactttttatttaacacatcttcagttgaagtgaaatattttaagaatacaggtatgtttttgcgtaccctgctttatatgggactataagcctcaacttggtattttttttttttttgtattcttttgtttacttgtcccccttactcttctctatgggattgggtgtggttaagttggatattcaggtatttggggtttagtcatatgttccacagtgagattccagatactgtcccctgatgtcttaaagaaaaattgtgaaccttccagaattaactggaaatgaacgacaaagttaattaggagattaaacttgcatcatttctgcttttgctcaatgcttttgaaaaaaggctactaagagcaaaagacttcctttaagaatttacagggcatttacaagagggggagatggaggaagactttgcaggtgattcaaagattatattgttttgatgcagcttctgtcactgtcttcatttctctgtaactgtttctgcaaacttgggtgctgacccattaagagcccagctgcttcagtacccagtctcaagggtaaggaggagaagccaagggaaagtaacttacagggagaaagaaatgcttatccactagctttactacaccacaaggcatggagtttccacagagcacctgtaatttaaccctgaggctgccctggttcaccccttcgctttactttacagggacactgactgtcatttctaaggaagaactaagaaaaaaaaaagtccttttataccagtaaaacatttctctacattgtcttctgacatatgcggggggaacaatattcaggaaagggaaatactttagcaaatgtgcttaacattcaggtgttctttaggacagtcatgaaacatggggagactgggagaattattattgtttacctctctgtaaagtgtccagagtattattaaatttgttcccctctttcctttgcccaaccaatacactattaaaataggactacaatcaatgcaattccatatcataaccccaggggtggtgagactaagccagcatgccttacataaccattaagtaagacattttaacattcaggtacattacattccacttttatttagcagacacggttttcattgtgtaataaaatatttttatttgatagtctgtccttgcttatagcctcatgtaatcaaggggacagcatgtttaagactttgtatccagaactttaaggtctagctgtggttcgcttattaataattcactgggaaggttaatttctagttttctgctgggtctcccagaccatacttcaaatgtagaatatgtttcttctttctcctatgcctcagtttccacaaaacacacccttagagaattgtgtgtgttcaacaaagatctttaactataagagcatttctgagccgccacttcatcctgggaccaaattctaagagcaatttgtattgagctataaacagctaatctgctagtttaagatgttcttttatacagtcatgcagaaaaatggaaattgtgtgttctaatccttggagactggctgataaagtgtcactaggcccctgatgaaatttaatatttaggcttatatccccttaattttccccctaaatttctacagtacgcttttactgcatgatgatacagctttattttgaacagtgaccaaatgtgttctttacaaagaatattgacgagttgtgtagtcttgaacacgttgcctgacttctctgtgccccagtttcctaattctttattctattctgtggcagtgtccactttttggtttaaagtttttaacacatctccagttgaggtgaaagattttaggaatacaggtatgtttttgcataccctgctttatacaggactacaagtatcaacttggtaactttttgtactattttgtttacttatcccccttactcccctcttaaatgggattgggcgtggttaggttggatattcaggtatcttttggtacagtgagtgaccattttcagaatgttgtctaaccagttaatagatactggtatcagtagtagtagtaattttgaactgtaaaaataaaggttgtttttatgactaaaataaactacttcatgtgttcattcgttttgctgtttatctatattaatatttcaaattattgcttagtcaaaacctcaaggtattagtcactggtttttgagcttataaaggaagccactggagcaagatataaaattaaccattgatgttagtccagagttcaaaagggtgagtttaaaactttcttaatgatggtacagcaattatttgcttataaactgctgaattaatcctacttgagtatttaaccaagtcttactgtctaattttgctgagattttcagtgatataccaaagcaaaacaaaacaaaacaacagcaacaaaaaacaaaaggttgtgactgagacctgtcaaattcatttggctctatatactttgcattcagcaacaaaattttgacttctcaacagcaaaaatgtatttctattttaaaataactgagccttttacttttatccagccacattaagcatttggacattttcttttttatttatttgtttttcattattagtattttcattttttgcagattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatggtgagttactcccacacctgtgcatccataagtgcaaaagagaaggaaatcttcctccatgcttttaccatctatccaacgaatgtgttaaggatagaggcacttaaagactgacaaagagattcatttataaaatgtaacatcaatatgtcaaaataattaactttgaagtacggtgccttttatgtttgagctaagttattaattgcaagtatatttagtgcgctcacgcttacttatgaggaatctaaagtatggttttatttgattaaaatatacacaattttatggccagctttagtaatagtcattagtcaacttttgttgtgtcattgaaattctaaagggcttcacaggaatttaacaaatttaatttgagtcttggaagttttttacaacaaggatgaaaaaagattgattgtttaatggttaaaaaaatgattaccaagcaaaaacaactgattatttcaatttaataggcctggggcttcgttggtagagaagatataataacacatttttcttcataatcaaaattttaaatttagattttacttattttattttcttatattttttctaaccactgacaatgatatataatgttcagtttttagttcttgctttaagaaattgcttatttaattggcagtttttaaaagaacaaaagaaaaatagaaatttaaaaatttgtgttgccaatatttatgtatattctctcctttttctagatggtatttgcaagtcatcagactgcataaaatcaggtaagaaatggtttttacgtgtaatagttatacaactgatgtataatatttaaaattaaatgctaatcttaatttgctttgtttacacttttattcattgtagatcaattatttatgtgtctggctctataatcaatggaaataaaaatatatttaagtagtagattaattaacttgtttactctgaaaaatatattactattttcagccctgggctgtatagcagggcaatagaaaactatatcgctatttgtatggagcttgccatgtagttgaagaaagaaaatgaacacatatgaaatggtaagtttcgtatcattgtgttaaatgtctcagtgcacctcactaggtgggtgagaagaagggagtgagatgtaggcatgtaaatctaggtggagaagttaaaatctgggaagaaatttcattttatttattttttttattttttatattttgagacagagtctcgctctgtcgcccaagctggagtgcagtggcgtgatctcggctgactgcaatctccgcctcccgggttctagcaattctcctgcctcagcctcccaagtagctgggactacaggtacccaccaccacgcctggctaattctgtatttttggtagagacggggtttcaccatattgatcaggctggtttcgaactcctgccctcaggtgatctgcccccctcggcctcacaaagtgctgggattacaggcgtgagccaccgcacccagccttaaatttgggaagaaccttgaagcagggctagaatttagatgtggcggtgcagaagagggaattccaaacacaaaagaaagaaactatgttattgagaagtagtaaaagtgtacgcttgatagaaggacacattatggagaaccttgaaatccatgtttagccttgatattgtaatacaggagaaacagatatttttgaacagaggagtgatcaggccaaaggtgaaagatgattctgcgaatgtgaggttgactggattgagtgaaaaggagggcaggcaggtgggggctgcttctgtactccaagtgtaagctgaagaggttggcctgtggtgagagaagagtactattgagataatggggagggagaattgggtgactcagtagaactgacttgctaaataaaatgaatgaattgagaatgatgccaagttttaaaacccaagggactaaagagaatggaggcagcccacacagaaatagagaggttatgaggtggatgtggatgtgtttggtctaagatgaaaatagacaggaggaaggtagagatgaggtttaagaagctggaatttggatttgagatctgtcagtttaggagtgatagtggaagccttggaagtatttgagttctcaaaagaagagaagaggttcaagggctaaacttaagaagaggttcaagggctaaacaacatcaatgattagaagagaagaaaaataagtcagagcagaaaacagagaagtgtatgaagctatataaatcccatcaattggagtgtggtgaaaatgggagtatttcttctttcttcaagaaaaaggaaggtggtagctgagggcagcacctgggatatgaacacaatatttgtgtcctttaacaagagattctaaacctcctttctaacatctatgtgtcttataagaaataaataaactgttccaaataattttaaccattttctgctggatatttttaattttatttatttatttatttgaggcaggatcttgctctgtcacccaggctggagtgcagtattgtgatcacagcttactgcagccttgatctcctgggctcaaggcatcctcctgcctgagcctcctgagtagctgggactataggcacctgccaccattcctggctaggttgtgggttttttgttttttttgtttttttttgttttttttttttgtagagacagggtctcactatgttgcccaagcttggtcttgaactcctgagatcaagcagtcctcctacttgtcttcccaaagtgctgggattacaggcatgagccactgcacccagtcttggatattctttacttggatttttgttattcactgaactttgcaaaaaaatgacgggaaaatatctggcaattctaggttatagtctaatatcctgaatctgtgccctttggtttttttttttttttgtatcgttttttgatggatttttttgctctgggtcacaagagcaatgactagacaccctgagatgtgatgtggggagcgtgagggagacttgatttagatgttagccatttgctgctcgacatagtaagtttttcccaaaaacgaagtttctttattccccagggaaatggctgcacaggtaccttggctgggggatctccgtggtcatgtgcaaaagtcagcatgtgcccaagttgtcaaagttaacgtttacttcctccccagatcctcctatgcttcctctctctaccagctaccctattatatgctcaggctgtcctgtttcgggaaacttccacttacatattgactactaagggttaattcctctgtctttaatacacttgacatgtctctttggtatcttaatctatagattctctcttctctcactatttttcctttttctcttcttttccttgaattttattttcgaagaaactggattttttgactaggtaggtgtatttctataaacgacaagtgattttgcctcagagatctaggcaggtttttcctcccaaggagcaatgtgacattcagaatctggaatcttaaatgtgacttaatgtttagagataggatttttaaatagtgtttggcaagtctcaactcactaaaatgtatttaacctgtatcctttaattgtagcttagaaatcaaaccaaatgtaaaacaccttgcaggatgtatcttggcagagaaatgtatacaatagaaataacttcagtggtaaacaaggttgctgtatagctgtatatttttcttcattctgctctgttggttcacaagccattagaatacttgttcacattggtagttactattcttcctaggagaataaataagatgacacacaccctcatggatacactctgcatactcataaacacacacactcgtgcgcgcacacacacacacacacacagtcttctgctggttaggaaatcttttctgccacagaaaaatacaactatttcttttagaagttgttgcaaattaggaaaaccctagaggaaatcttggacaaaagcaagtattaaagaagagtggccagagtagagtagatggaaagaaaaagaaatgtgaaaagagaaggctgggcacggtggctcacgcctgtaatcccagcactttgggaggctgaggcgggcagatcacctgaggtcgagagttcaagaccagcctgaccaacatggagaaaacccatctctactaaaaatacaaaattagccgggtgtggtggcgcatgcctgtaattccagctactcaggaggctgaggcaggagaattgcttgaacccaggaggtggaggttgcagtgagctgagattgcgccattgcactacagcctgggcaacaagactgaaactccatctcaaaaaaaaaaaaaaaagaaaagaaagaaatatgaaaagagagatgttgaaaaaatataaaatatcttaccagcaagtctataggtcactttaagagagtgggtgggttcaaacctgagctcagaaattcttgagaatgggaaaagcaagtattgacactcagggtgcttacattatatgaaagatggccccaacttgaacctttcttccagtggaagggaatgtcatagcaaatgtacttatctttgattctttgaagtcaaggaatacagaagtcaagccataccaagacagaagtaaaatattgcagaaggctgtttcaaatctgtttggtgttacatatttaaaatctgagcatctaggatttaaatatttatgatgtacataaaatgatgtttatgtatactttaaattaacttgcctatatgtgtaatgcatcagtatgaaagattacaccagacctaaagtaaaacaaataccacttaagaaataacaacttaaggcagggatcaaaatgcttcaaagtattattcatcgcttatttaccctataaggtcatcaaaaacttagagttataaaacttgtatgtgattttgcagacttttccgtgtaagtctgaatcctgaaactgatttccattgcattgtaacctccctaacttagatttcaaggaatcttgtgctttaaatcagggtttctcaactcaatcactattgatatttttgtgctagataattcttcgttgtggatgctattctgtgtattataggatatttagtagcatccctggcctctaccaactagatgtccagtagcagtcctctcctagttgtgacaaccaaaaaatgtctctagccattactaaatgtcccctgcaggcagcacggtcacttatgactgggtaccactggtttaaacggtctcaagatgttatcaatgcttccctcttaacggtaggcaggataatggcctctcaaagatattcacacccaattcccagagcctctgaatatgttgccttatatggcaacatgcctgtaatcccagcactttgggaggccaaggcgggtggatcacttgaggtcgggagttgaagaccagcctggcctacatggtgaaaccccatctctgctaaaaatacaaaaatccaggcatggtagcacgcgcctataatcccagagggaggagaattgcttgaacccaggaggcagaggttgaagcgagccaagattgcacgactgcactccagcctggaagacagcgcaagactctatctccaaaaaaaagaaaaagacaacagagaattgaggggtctgcagaagcatatgttagaagtgtggtcctaaattatccagaggccagagaagccaagctaagacgtgatcaatacagtttacaagagaaagtgggaccacctccacctgtatagtcatgcaggttgtacactgcatatttgtcgatggcagccttgacagacaggcttgtggaacatcaagacctggatgaaacacctctcagaactgtccactccttttattttaattctgcacataccaagaaaacttttgatgattacttaattattaatacaaggagaggtggcattctgttacttgaaagatattttcatcatggtgagataatgcacagcggtccccttcttatcctctgaggatcccccaagacctcagtggatgtctgacactggactgaaccctatatatgctatattttttctgtatacatacctatgataaagtttaatttataaattagacaaagattaataacaataattaataaaaaataaaacgattataatattattccagcatcactattcttatggtttggggccattattaagtaaaatagggttacttgaacacaaacaccatcatcctgcaacagttgatatgataataatggagaaggctccttcgtgactttcatcatgctactcagaatggtgcgtgatttaagacatatgagttgtctgtttctggaattttctatttaatatattggactgtagttgaccatgggtaacaaaccatggaaagtgaaaccacagatatgggggagactactgtacgcacatactgatttaatcagatttgtgtgctttgagctatgaccctggaactgaaatgaagcttgcaaatgtctgcaagggccagatcatggtgatgccctaggtgatgcatcttggcaacagctagccttctcctggctgtcacaaggcatctctgccttcttgcctgttaacaccttgaaacctccatgaaggaaaacagcacaattaggtaaatacaggaaggactgatggctaactcatgggggctactggccctgtagcagccttttagtgtaggaaatgaggctatttcattatgtagttaagtttggaaaaaatccttcatggaataagaaagcagcagacatcttagtaggaagaccactgaagcacacctttgttaatttaaatgtggcatgtggcaatttgctttgtgtggcttccctggcacaattctcgtgaaaattgtgtagggatattaccttacatttatccagtcaaaattagcatctgtcaatcagatcctttccaagaaagggaatcagttatatcataaatacacaaatatataacatgtgttttttaccctccagggaaactttaagcaagtagtacaccatcattttttaatgaatggtcaagaaattgaaaacatatataagttgagttaagcagttaaagggaaagacaattagcaatgcctggtaagctaagtggtactccaaaggtttattttatagctacagaaattatctacatgtagagggggtggatacaaactagcttagactggggtgagaatcctggtttgacatttaacattttagaataagagatatagaaagattcctctgtagttgaaggatcctgttttgtcctactcataagcaaatccatggggtagcaaggtgctttctggtaagcctttgatatgatatgaagctcaagttgataaaacagattaattgaaggaaattgaaaaatacgcaatttaaaaaaccataaggagaatgttgcacaagcttttgaatcctgtaaattttcattctttaagaccattcagaaaaggagattttgtcgggggccagtggtggcttgttttgatcctatttctgaaccagctgaaaactagaatacgttctttctgttcaaaacatcctagatgggccacatattagtcaggccttctccagagaacagaaccaatggtatatgtatataaagtctcagtatccaaaggcccaagaacctggagttctgatgtctaagaacaggagaaggtggatgtcccagttccagaagaaacagaggatttcccctccctctgcctcttgttttatctaggccctcaacagattggatgatgctcagccacaatggtggtagagtgtggatcttctctactcagtccactgattcaaatgccactcttttccataaacatcctcacggatgcacccagaaataatgctttagaaataatgctttatcagctatctggatatctcttaacctggtcaagctgatacctaaaattaaccaccacaggctacagtgaaaaagatagttccaactgtgagtgaggatgcggagaaactgaaccatcatacattaatggtgggaatgtaaattttagtacatctggatcaacatgttagaaacattttgaaaaacagtttgataatttttacaaaatgttaaatatatactttccatacaacccagcaattctactcctaggtattacttaaaataaatgaaaacacatatcctcacaaggacttcattacagcataatgctgtttttataaataatttataaaagccaaaatatggaaatatcccaaatatgtattaacaggtgaataaacaaaatgccatatagctataaactacgataccacacagcaataaaaaggagcaaactactgttatgtgcaatggtgtagataaacatcaaaaacattatgctgagtgaaataagccagacacaaactgcatattgtaaaattcaatttatatgaaatttctataagaagcaaaactataggggcagaagacaaatattggttgcctgaggctggagatgaagcagggattggctgcaaatgggcataaggggacttcttggggtaatggaagtgttctaaaattggactgtgacaaattctcagctttttggctaaagatcaagtgtaaattggattgtggtgatggttgcacaactgtgtaaatttaccaaaaattaatcgggtgaattttatggtatacaaattaataacccaaagccgttaaaaaaaaaaagcaaacaaaaattcaccttcattctttcccccatctctccaatgtccatttttacatagttatctcatgttttgatcttatgcttgctattgtatgttgagtccattgagctccatttttgcagtttaaatgattatatgtagttttcaatgtagttttcaaatcttcactaaataaactcaagctttttagtttgagtgagcctctattatttaattatattagcaatatattgacgaaaagtctctggaaatagtaaatcaactgggaagttaaaattatttcaggattaggtgttggaagtcctgttttcaccccctggggtttcacttacagaggaagtcaaagacatatgtgtccaggtgtaccagccatctggatcaaagccagaccacttggtctaccacagagcagttagcagttcctgcttctggaaaaatgtgttggtttttcacacaggtgctgcgagatgttttccttttcaccttaactgatagaaagtcaagagccaggacgggcgttttggctcacgtctataatcccagcactttgggaggccgaggcaggtggctcacgaggtcaggagttcaagaccagcctggccaagatggtgaaactctgcctctactaaaaatacaaaaactatctgggcatggtggtggacgcctgtaattccagctactcgggaggctgaggcacaagaattgcttgaacccaggaggtggagtttgcagtgagctgagatcttgccactgcactccagcctgggcgacagagtgagactctgtctaaaaaaaaaaaaaaaagattgaaaaaaagaaaaaagaaaaagtcaagaaccaaatttgaatttaacttgaaattgtaggacttctttgtataaacttgcttcatcagctttattcctattcctcttttctttctcatacaatgtatattagtttattttatgtatccctctaaggccactttgaattattttaggaagaatgtaggttaataatcagatgaatagaatataaattccaacaactgatatgtgcaggagaagggctgttaaattataaactttatttcaaagagatgcaagtgttatgagtaacggaggcacaatttttggaagcttactgcttctttttccactaagccaacttttagcatgggagatctgggatgtaagttttggccacatcctgtgtgattggtatgagatcctaattaagtcagttcagctttctgcatttcattttcattatctacaaaattggaattgaaagtgtctcattttacagggaaacagcaaagactaacgacagcctatttcatgttacacgcccttcagggagatgcaccataggtataatgcacagataggattcatagacatcttatttcatgaaaattgcaaatgcactatttaaaattttttattgagaatcaaataaaaatcaaatcaaaaggcgaacagtgtatttttaaagaggaagttgtagccagaaacagagagaaagaaaaaagagaatgtggtacattttacatattctcaaataaaaatgtgtcatcctttatgaacaacatttgatttgattgctgtgctctgtcttagtatgggggtgacagttcaggctttgaatcaattagaatgagcacaatcagaaatgaacacttgaatctgtgtttcctgtaaagaaaagcctaccatcagggacaccttagtttgtaaacctagctaatctgcactcacccttgccagtaccccttttctcacctctgattaatcccttaaagtaagtaagtcagaggtctgcatcaggagaatgactagatccttggtattcaatgcgtggtccatggaccaacaacagcagcagccactgagaatgtgcaaaaatgcagtctcgggctccgcctcagacctactgaatctgtggctgcactttcagtagcctcttcaggtgatctgcaaaataaggttgagaagcactgaggaatagtgattttcaaatatggctgcttattacaatgatttgggaagcttttgaaatgtacccatactactaaaccttccattcttcctgggcacacaaagtttccatttcttcagtggagtagtttctgttatgtgttaggaggaaaagcaatttaagtaaatgaatagatgttaaggggtataggaattgcctggatatttgcatttttaaaagaaggtacatattgaccaactgattgctttaacaggttcaatttcagactgtgtgctcagtgaagactttaagttagagaggagtgaagactttaagtcagagaggagagacactgagcctgattttctgcttatcgtggacaagctgaacctggaatatcttcctaaatttccccagtgtaatgcaggcatgctatttctgtagagacattagaacaactttttgcctcttccattcattcatttattgatttatctattcattagttaattaattttattttttattttttttagaggcagggtctccttatgttgcccaggttgacctcaacctcttgggctcaagcaatccacacgcctcagcctcccaagcagctagaacaacaggcacatgccaccatacctggcattcatttttttttccacaaaagcattaatcaagcagcttctaaacattgaacactagacattggaaatatgaactaaaataccccctgccgtcaggaaaatgaaaacctggtcagtgtgacagacataaacaacattaccatatggtttgataagtgctatgatggtgataagatttgtgtgctacaggtgccctgagagaggagcacctaaaccagagcgggtctgggagtgggcagctaaagtgatagcaatgaggccgggaaagcagtcgcacttcaccagctaagttctgaaggataattgaattgcccaaccagtgggagcagaggagagcatgtgcatagtctgtatgcaagatggaggcaagagctcaggaagtttaggacctactagtggttcatgatggctgggatgtagaagctagcaagacttgatactagagaagtaaccagggcccaggtcacacagggtcttatatgccatgataaatgggttgcattatctcccgaagtctacagaaaatgaataaaattaaaatgccgcaggggacatctaagggattttaaatagggatgtgtgacattgtcaagattggctgctgtctagctcaagcctggtaaagtggaggcaaagatttacccaaacaaaggaataacattttggtgcccctggtgtgtgagagagcttggcaatattgagaaactgaaagaatatctgtaaggctatcatagagggtgtgtatgaagatatgagagtggaggcaaggagaagtgttcactattggcaaaagaaataagcaggaattggattttgtagtctgtgttaaagtgaatgcacttccttctagtagcggtgggaggtcacagaaggaagggttttaaatgacgcatgactttatcagaattattgagaaagatcactgaatagaaataaagaatggctgtgggcaggaaattgggctactgcacttatttggatgagtattatggttgcctggatttgaatggcaacagtttttattgttgttgctgttgtttgtttgtttgtttgttttgagacagggtctcactctgtcacccaggctggagttcaatggcacaatcacagctcactgtagcctcaacttccccagactcaggcgatcctcccacctcagcctcctgagtagctgggattacaggcatgcaccaccacaccccgttaagttttgtaattttctgtagagatggagtttcaccatgttgcccaggctaagaaatggacagatttgagaaatatttactgggaagtagaattcataaggcacaatgtttctgtaaataggtgaggttgtgaaaaggaagtgaggaaaaggtaactcaagtttctggcttggtaaattgggtgataagtcagctgttcaccaagctagggagcactgaagcagagcttattgggtaataggctgggaccaatgcagtgaagagttcactgtgagatagtttaaatttgagatactggtacatattcgatgtggtagaattcagggaagatggtgttggaaataaagattcgggggtcatcagcatgtggatgatatggttgagatttcttagggaggaaatggagaagagaacccagaattgcatcacataaagcaacatttaaaaatgagaagaggaagaaactccaaaagaaaccgagaagtaatcagagaggtagaaggaaaatcagcgaagtgtaaaatcaccaaagcaaatggaggagcagctgtccaaaattagagagtgatcattggaattaagcacagctgagaggttgagtaggctaaatgttgaaagcagaaaggaagacattgaagattcaggtgaagatcaggtggaaaattgatggattttgtccagaggaagtaaaagaggatgtatatccagagaaaagaatataggatgattccgagataaaggatggcctcctcctcccccttttatttaatactagggagaaagaagccaagatggctgaaatgcaaacatgtttggaagctaggagggacaggaagttgaatgggtcatcatccagttgcctttgtgaagtaacaaacaaaaatctccgcctgggagtgagctggtagagaaagtaagtaaggagagtatgaagactggaaagtgtccatgtgaggagtgggccatgcacacagaactgatggctctgttgaaatggaaggctataacttgaaatggcattaaaccaggcagttgtggggtttctccagcatcaccgataatggcttcaacagatattgtcagcactgttttagatgctaaggatacttagcacctaaacgcagagtgagcaacacaatgtccctgcttacaggagcttacagcagtaaaggagacagtaaataaacacacacacatataaaaaaacattattagatagactagagttggaagggaaaaggaaggcagctggatcaattcagggtaggctcatttgcagggggcaagggaatgaaatactttggtgagatgatggtttcagggatggcaccacaggatgtacactggacagaagatataaaagaaaagtaaagtaaaaaatagagtggctggctgggcgcagtggctcacggctgtaatcccagcactttgggaggccaaggcaggcgaatcaccaggtcaggagatcaagaccatcctggccaacgtggtgaaaccccatctctactaaaaatacaaaaaaattagctgggcgtggtggtgcccgcctgtagtcccagctactcgggaggctgaggcaggagtatcacttgaacccaggaggtggaggttgcaatgagccaagatcgcaccactgcactccggcctgggcggcagagtgagattctgtctcaaaaaaaaaaaagagtggccatggggtgagagttttcagtgaagtcgaggaacaggtgtagagggaataaagaaatgaaacaaacaaacaaacaaaaaacacttctaagaatcagaagattcttattggagaggggggttactcgagatgaagatttcagaggtacaactgttctgggtgatgagaacattaagatgtcgtcatgaaaatgtgtagactaatgtgaagtgaaggtgaaagttaggagagttcagatggtcaagaaattcttaagctagagtgtagcagaggttgtccacagggtctctgatgttacatatcaagatggtagaacttatgtggaagggcagactgcacaaagtgccagagtcttaaacaagcagagatgaatgcctctggagtcagtagaagacagagataaagtaggtgaggcggggatggttgactggcagaagcttaaataagcagagtggacagtaaggatttggctattgcaccaagtgataacagaaaactagttttgcttttccatgttggggcaaggtggagggatatgccacctgatgggattagttcatatggattagtattttcagtacacgtgttgtcatatgtaattatcactcaaaagggtaagcagcaactaataagaagaggtgctggagggccacctgtctggcatatagtgtgggattccatttgatacaattacaaatgaattcatttttactcatttttatcttttcactatcctagataaaaactcaaaatgaatcaatgagttcttatcttaaaacaatatgttctgtttaaacatttctcagcggtataatcttcctttaatcttacatttcttcaatccagaggagtccaactacagtgccttcaccgtgaagctaatgaaaagggagttggtccactgtgtagactagactagatgattgcgaagttaaattgaagtaattgagcaggtacccaatagccagcagcggatttgtttctctgttcttgatgcttaagtaaaaacaagcaagccaagtattaaatggtggagctcctgacaacacagcttcataaaaaagaaactgcttgactcaaggagtgtgtccttgcgatagtttgccgagaatgatggtttccagcttcatccatgtccctacaaaggacatgaactcatcctttttatggctgcatagtattccatggtgtatatgtgccacattttcttaatccagtctatcattgttggacatttgggttggttccaagtctttgctattgtgagtagtgctgcaataaacatacatgtgcatgtgtctttatagcagcatgatttatattcctttgggtatatacccagtaatgggatggctgggtcaaatggtatttctagttcaagaaaaccgaggcaataccattcaggacataggcatgggcaaggacttcatgtctaaaacaccaaaagcaatggccacaaaagccaaaattgacaaatgggatctaattaaactaaagagcttctgcgcagcaaaagaaactaccatcagagtgaacaggcaacctacagaatgggagaaaagttttgcaatttactcatctgacaaagggctagtattcagaatctacaaagaactccaacaaatttacaagaaaaaaacaagcaaccccatcaaaaagtgggcaaaggatatgaacagacacttctcaaaagaagacatttatgcatccgacagacacatgaaaaaatgctcatcatcactggccatcagagaaatgcaaatcaaaaccacaatgagatatcatctcacaccagttagaatggcgatcattaaaaagtcaagaaacaacaggtgctggagaggatgtggagaaataggaacacttttacactgttggtgggagtgtaaactagttcagccattgtggaagacagtgtggtgattcctcagagaaataattttaataatgtttgagtgaatcaaatatacaaatagtattgtgatgcagtgtacccacaatcattaactcaactatgaattactcaaagcactgtagataatagtctagcaaggatctgacaatatgttgagaagaaatgatgcacatgaaaccttgaaagtcaccttaaagaaactcatatcatgcaaatatgaatattttaatagctactataaaatagtagcagctgagtgctgtggcacacacctgtagtccagctactcaggaggctgaggcagcaggatcacttgagcccaggagttggagattagcctgggcaatgtggcaagaccccatcttcaataaataaataaataacttagtagcaattggtgctatgaaactttttgatgtagcttggatatttgtcctcgcccaaatctcatgttgaattaatcctcagtgttggaggtggggcctggtgggaggtatttggatcatgggggcagatccctaatgacttggccctgtctttgcaatagtgagtgagttttcatgagatctggttgcttataagtgtgtggaacccccccacccactctcttcctcccgttcttgccacgtgagatgcctgctcctccttcacgttctctcataagtaaaagctccctgaggcctcccaaaaagcagatgctggtgttatgcttcctgtacagcctgcagagccatgagccaattaaacctcttttctttataaattactcagtctcaggcatttctttatggcattgcaagaacagcctaatacattttgcatggtgcatatcaactatggtaataaagtgaaaacaaagaagtgggaagctttgaaaagttgacaaattggttgagtaccatatggaactccagctgtaggatcagtcccattccaggcccaggcactcactggggccaaggtcagtagctcaaacattccacttccagtcagccctactcttggtgatctgcctctgaccccagctctagtaaatgggtttctgccttctcccatagggatttcactcctggctcattccccacttctggaaaatgagtttctttttttcttttctgtcttctgggactgaaatctagcttagctcttaacctcatgaccttttgccagaccacggagaactgaagtttccttggatcaacacacaccatctgctggttatagctccctcctcacagctgccgtgggtgccctccctgtgtgacttatttctgttgcttgtagctgagaacttcttctgttgatggtcctttatagtttaactaaaccgggattcagtctcactgggctagtcaaaccacttctaccagagcccagtttatgtgaatgatgaatgttttacatggaaaaaaaatgtttcttcatttactgaggaaggagcaccttcactgattttgtatgccaacacagacagcgaaggatcctgcttgtccttcacctatcagccatcacacctattaggaggggggaattggtcttttgttttgtttatttagtaaaaggaaatctaattatatattaaaagttaaaaaaattttagatcctgcctacatgactttaaaatgagcaataaaagtcattttttattcagggatagtaacaggaaaaagaagctagtatcagaatgttttaagattccgatacagtgcatatgcaggttttagtttacaaatagcagatggtgatgatttactataagaaggtgtaattaattgagaatgaaggatccttttggagtgtccattatgggctagtcattgtgctaggcgtaggaattagaatcctttccctgggtgggggtatacttaaaattattgcttttgtattctatggattaccttgaaataccctttgagtcatttctcaaaaattgtgcatatcataccgatctgataactcattgcactgttgatctgaggcttcatcccctcacctaaccacatggtcatccattttgcagtccacaagagcccttcctggattcatggaaagaacttgctctcacttgggcttgagaaagcataagtcaacttggcagggcatgtgttaacaagatgatttagaactttgcgaccagccagaaccataaagacagcttgtaataaaagtaaagctgttctcatgagatgcccatgatgagggcttctagggcaaggctgctgtttcttgctacctcagcaagaatgaggtctctttcccatgatcatttccctccccttcactgggcagggtgacaaagaccaggcctctgctcccaccagtcaacaacaggcagggctcccagcatgccgaaaccttgagagctacctcttcctcctttatcccttcttcagagggtagcctacctgtccacaccggcagagagtcactctgcatgtcagtcctctttcggttgcctcttttgtcaaaaacgtcacctactttcactgcctgggacacagctcagaacctgactcaaatatttgttgaatggccaacggaatgaatgaattgccctctctcctctaccttcaactggtagctcccccttcattcccagagcatcctatacgctttacctataactcatatcccacttgttattagttgttcaatgtctggtttttgtccactaaaatgtaagttttgactgtttctattttattcattattctatttctagcacccagcaatgtgtaagttaccaataaatattgattgaataaatatactctcaggttccttaccttgaagtcacaaaactattgatgcctatgcaaggtgacttgtaagcatacctaatacacaaatatagctgcctcaaggaaacgttttcagtctagctaggtcctgcttatgtcagatttctcagttcagtatttctgtatcaagcctcctaggtttagcccctttctatctgatccatcttctttgctagcaataaagtcaattacgctcttctcagttgtctaattcaccttgctaattctaccctcctaagctagaactaggttaatgaggaaacagtttccggatgtgtttctatttcccactatttttctgtttaagggaaaatttcaactaattttctacttgggtgtaagcatttccagctctctaggagcaaagtctctatcagtctggtttttcttttccaactgtggtttgttctgaattcctcccttctcaataatttatttcttctctcttttaacactctgtgttcttcttctcttgaacaccattatttagctaagtgttgctgttcttcaacaaccaccatcctctaaaactcctctgtccctgctcacttcattcataacacacaaattcaaattcctagccagctcacgcatacatgcataaactcacttatggaaggacattacaagagactccttacctctaggttaggaggagctttacttatcaactgaatacagtaggagctttacttgtcaactgaacactgagtaagtttgagaattgaaaatgagacctgagcatcacaaaacaacctttcatatctagatatagttaccatctaggagttcacgtgcattataaaagaaatggtcttgtttaagatgaaaccctgcaagctctgtgagggcagggattatgtctgtttatcacaccatggtatgttcagttcctaagagtgtcgggtatatagaggccgtcaatatttgttgaaattaaatgaaaagtttcagtcttttcatgcttcacaagaagaaaatcttttggagaaagccaatgatttaacataatcttctggatcttctatgacagaaaatagctatttaatccgtaaaaaatataaacatatggagccaaatactgccttgtgccaatcaaatgtttggtttattaatagttactaaatttattagtgctctctagaaaagagcctttttagaatttgatttcattttaggcagcattcgagaagcactgtcgactcagctttcctctggctgttgtctttttgtaccactccctaaccaaaattgatgcaaaggcaggatgctttgagttactctcagtaatcacatattattgaagtcagctggttattcttgacagacaatatgatccaaaataacacaatgtttaaacagaaggaacatgggtgtggacccccattgctccctcttcagagatgtctgccagggtccagggaacttgggatctacctgaagagtgttactaagggaacaatgtagccttttcatgaccttctatagctttagtttaaaaaaggaacattatcatcatttgctaacattacaatcaacagcagatctgataactcattttaagtgatatattgtatttaaattacagtataatccctaatagctttttgccagcagagtctttcaggattcaaaatgcaaattgcacctgaaaaagaaaaattatttttagacttatggcactttaacttaactgtaacacagttagaatactttttattattattattattaatagaatatgtttcggttgcgaattctggaggaatccctactggaaaataattgccagtcctcccttggctgtgagccattcattgaaatggactatgagataagactgaagaatttcactaatttcgggagtgccaactgaagtttattattgtgaatccattagacatgagatttctgtgattatctcaatgagttctaaaatccaggtccaaatgaggtggaaaaattttatatgactatatacatgttatagagcaattaatattttaattgggtgtcaagaaaagcagtggttgctctataacttaatttgggttcctctgcctctctgtagagtttctgaaaatttttaaatgtcatttggagttaaggcagaatgatactgtggaaaaagcatcagcttaaaattagacctaggctcagctttagttgaattccttaaatttacattggtgacgttgagtttgtaaccaccccatacctagattttcttaaaataggagtaatatgtcctactttataaagcagttctaaggaagaaaaatgattagaacccaaggcagtttcacatagtataagatcccagacgctggccaccaggtttcttgagttcaaacccactgcattatcctttgccaactatgtgaacttgggcacaaatcacttaccgtcaatttctatatttggaaaatggggacacaaatatagttaccatacaaggttaaaagaaaacaaacattaaagaaagcatttaaaaaacagccatcatgaagttggcacttggcgtttgacatatgtcaagtgttggcttctattgttattattattattacatttaagcgtctttggctaaacctaaatgaaaatcctataatttacattgtatatttaaatctgatagtgaatttatctgatagcaaatggattctaggttgattattcatatgcttgtgcctacgtgtgtgtatgcatatttgttgtatgtataagacctatggatttaagataaattagtcacatgtatatatgaaatatagttataaactaattactccccaaactagaacagcaaaaataggtctccttacttaagagtacagctgtacagagtaaattcactatgcttggaaacttctttcatatctatttgtgtaagtctgcagctagtttctgaacagttgtatagtgatggtttcatggtactcaccaattagacaagtataagtcatgaccttggctttcttggaacgtaaccagtggttgacagggagtgtttgagttaaatgataaactagcagtccagtttacactcagcatctggtatcccccactctccatctttcttcaaccaaggcatcacaaaagcaatttgggggcaggcattttcatttaaaaatggagagtggattgtggaagcatcctgagtgtttgtaatgaaagccatttggtttttattagcattagagtctacgtgcttgctagttttcagtcattttctcttcaaaaatggttccccagattccagttttcacattgctgccttttgaattgaatcctttgtgacccgttgtgattacattgcattttccttgtgttcttttaaaaagttctgactttctctgaattgtggttggggggatggtgggaggagggtggcagcaagggaatagggtcacttgtacttttagaatgttgtcaaaagagatttttaaattgtcaaaaattgcctagaagtaatatcaagcttagtgtctgctaataaagcaaggatttacaacagaaggttcggtcagaaatgggtgtcctaaggtctttacaaaagagcatttgctcctgggttccccaacatttctctgacctctgttggacaattctagaacagttataaatcaggctaattataatgatgttaggatactggtgttgtgtgtttggggttaggaagctgagagcttaggcaatttgaagacaacaagctgaaaacagctttgttcatataccattccctaaacattaattcagtgcagattaagaatagtcaatggagggaccgggcgtggtggctcatgcctataatcccagcactttgggagactgaggcgggtggatcacgaggtcaggagtttgagaccagcctggccaacatggtgaaaccccgtctctactaaaatacaaaaattagcctggcgtggcagtgggtgcctgtaatcccagctacttgggaggctgaggcaggagaattgcttgaacctgggaggtggaggttgcagtgagccgagatcgtgccattgcactccagcctaggcaacagaatgagactctgtctcaaaaaaaaaaaaaaaaaaggaatagtcaacggaggaattttgtcatggcactgggggtatatatgtggtatgtatgttgtaaatagatgcctaacctatttaaaacgtggctaatttatagtgaccaagagtttttaaaatagagtagtaattgagaaagaaatggtttgtatctttttcccacttaattttctttcctgttttgtacatttttctagatgcttcaaaaagacccaaagaaaagaggaatataagcacagtcattactcattatttgtggattctctgtttgctaattcacctactccctaaaatgtatttattacccccaaatcactatttgcagctctctcacagtcatttacagacatgcacagactggtgaaaaaactttgagtctttctacacacatgtactcagctgagattgaacaagggaactatagacaaggatcctttttgtagtccatttagtcaacgttttttgcatttttgtgctttttaatgatgatttcactgttaaaatgctccacaaccatagtgtggaagtgctatgtagtgttttgaagcacaagaaggctgtgatatgccttacagagaaaatatgagcaatggataaacatcgttcaggcatcagttatagtgctgttggtgtgagttaaatgttagtgcatcaacaaaatatattaaataaggtgtctttaaacagaaacacacataaaacaaggctatgtattaatcatctgtgtgtccagaagcccacaggaacctaaccttgtatttcccctagggtcaatgattcagtattcactaattcagtgtagtagggactttatatagaacaaaactcatataaataactagaataaaccacacttgttttttaattcctgtgaaataattcatatgggaaaccatcaaagacctgctaagtaatgatgaacattaaaaaaattaaactgggccgggtgtggtggctcttgcctgtaatcccagcactttgggaggccgaggcgggtggattacctgaggtcaggagttcgagatcagcctggccaacatggggaaaccccgtctctactgaaaacacaaaaattagccaagcatggtggcgggtgcctgtaatcccagctacttgggaggctgaggcaggagaatcgcttgaacccgggaggcagaggttgcagtgagcagatatcgcgccattgcactgcagcctgggggacaagagtgagacttcatctcaaaaaaaaaaaaaacaaattaaacccatataatagtactacagcacaaaactttatgctatctattttgttcatttgctgtttgtgactatcatatttatgtcaactttaccctgttttattgacaagtacccaggagcacttgaaaatgtagaaattcctttaaaccctcccccctccaccagaaaacaagcctccagggaatgcacatatataaatattaagatagttgttgtgtatagtgcccaaaatcctattttcagttagcaaactattggtaatgttggaaagcaaggcatccagataagaaaggggagatcttgtggcttggaggccattcaaaggcagacttaaggttgcgtcttcttaagggagacatgtagtgggggtcccgtgtaactggaatttcaccatgtctaatcgtgtctagcagaccaatggaatgctgtgcctcaagtttcttctgagaggcctatgagcctcatgagatatcaacaaaaatgtttcttggccatcagaagagagaagtgattttgaatatagtatagtttttgctattataatcactccaaaaccaggcctgttggtgcttgtggttcttgagagaggaggccatggggggtgaaattcaagagacctgtttacctataggcacaagagccctcctcaagacttgagacaatgaaagatgaggaagggaggtattttccctgcatcatccagcttcagcacccagcgggaactggatcatgggtggtgtctgggtaggaggctgtggaggctaaagtcagtggagcagagtggaagccttggggtcgtgggcttatgcatgagacacatgtgaggttccgtgcaacactttaccagccaattataagggactgaagtcactgcaaaacataggttgccatgatgtaagcccatttgcatttgcagactgaaaaggcaaaaggaaatattcctgattcaagtaagtatgggactatacttttttgatattggatctgttggtcctcatttctatgtttctcgattgtctaatgtggtggttccccctgactgcacattagacccactctagaaaaccttaaaaaaatgtctggaccccctccaaagattctgactgaattgatcaggagtagaattctgggcatccgtgtgtctaaaaggcttctcagatgattcacatgtttagccagggttgacaagtactgtcctaaaacatatttctgagatttttcacactccattttccaatgtgctccaaagatagcttaggcaggaaccctgctacatggccacttcaaaaagatgcacccctgcatgggcctttgagtgcatccacctagcgtggcctccatgccacttccctgtctggttactccactataaaaaattcatctgcggactctccaagtcctcaagctgtacattgtcctgcctttgtcccaacaagaattgttggtgataagtccgacagtggagaggctgtggctgcagagtggcaggaaagagagtaagtaaaggagaagacaggacaaaggaagagtaaaagggtacttgaaaaggactggaaaggagggccctgcaaggtgctgcttctcacgtgctccccaccagccttctgcattcaaagcagggagggaagagtgtgggctcagagccatacatgcttaagtgcaagccttggggccccataatttactagctgcttgatcttggaaaaattacttaatcttgtacagctaaaaagtggtggagctctgggattcagaactggtctgtctgggttaaaagagcccaaacgtttttcccagcgtatactacatctcccaatccatacacacacaatagacttttcagtgaggaatacagtaattaataacttcccagatggtagttgaacttgcttttaaattcctatagtcaaataagttgggagaatgttacaagaagattagttagaaagaaaatggtgtcatttattatcagctcgaaacattcagaattgtcatttgtaagaaataagctcattattaatagaagattacttctcttgtctttgtgtgaccattttcttaaattaaaaataacttttttcccttactgcaaaagtaatgcatgttcatctaatacaaattggaaaataaaggtaagcaaataatacaaaattaaacacactcttaatccctccgcccagatctaactgctgtaaatatgttagtatatatccttctagattttctgtgcttttatacagattttaaaaaatcatagtatatgctctttcactttacaatatctggtcaacaacattccatgtcaatacatttgcctttactacattattttttatatctgcttattaaggtgaacaatttagtctgattttaaaccacatttgtttactcagatgtcagagatccacagataaggaaacatctgaagagcccaggtgtggctatgtggagaggttgagtaattcaaaacaaagtacaaaacataaaaacaattacgaccagtttgacagttgtacgtctgtttcctacggccttctacccacaagtctaccgctgacttcaaagaaaagtcagcacagaggaggtccagaggataaggtgcaaaacgagaatcaaacccacgataagagattaaaggaaggttgatcaaagacccagcataaaagtgctagcccgtgacttgccttggcccatggccccaaaatattcatcagaacagagagcgctctttgaagtgattggatgcatccatgctcagacaagctcggtggtcaaagggaaattttaaagagtggccctggaaggagttagcaaagttgcctcttcctctctctgctctgcacatccctcacaaactgaatgttatttctttggtttgttgtgcagatgcaagtaatttaactgtactttttgccccctgggagatgtgggaagtacagttgcttttacaggatggagaatttgcactcatgatcagagaactgaaacttccagccatcctttttattcagagtgtttaaggaccggtggtatttccaaataggcagtagggcttgttcatgctctgcttgttcattctgcttgttcattaattgttcactacttttctgagtagagttcattgctctgtgatgtcgtgacagaagctttcatttccccagaaagaggaagaaaacagaagtgccccctccaaatggcatagccttcacaacattcagtttaaatgtttttaagtatcttaaaagagaagagttatatattgctaagtgtgttcttagaatgtctgtagttagcacttctttcaggctctagttttctggtttttcactttacataataatcctctatgtatttaggatctttatttttcacctttcccgttaccatatttttatttccttcaaaattcgagggaattgcttttttctctctaccttttttagatcagtttcctagtctttaactgaggtgttaaagttggagtttttactggcaagtcttgactgagcacagtgttaggctctgtgagagagaatatgcattttctattttcacagagccacagtccaggtgaggagataatgaatttgcatgcaaaaaatgaatatgttgtgagctgatacagacttttgtcaggccagtctttcataaagaagtatttggaatgggctttgaaaatgcctgaaattccaaaatgaaataatatgaaataatatttattagtacgtataggggctgggtaacatgctcaaagttacagaggcagaaaaccataaggtgtctcacagaaactgaatatactcatttaactgtgacagatggctcatgcgagaaagtagcaaaggagaagcttcattcgttctattagtgttagaatgtgctatagaatctggattttattatgattgcaaaaggatggtattgaaaactttggagtggaaaatgacattctgaagtattttgagaatatgaatctgcctgtggagtacagaatggacataggtaagaagaggcctggggccacaactttgtcaaaagggcacaaatagagtctgagagaaagagggtttgagacagaatggaaacaatgggaaagatggaatggactctggaggcaatgaactgagaacggatctgacctctgtggcaaggggagaggaggtgagtgatgggctgtaagagaaggtggtaagaagactcatagatgattcagtcacacataaccataattgcacccctgttacctaggtgctaggtgatacaaagagattaatcacatcaacaaaatggttaggtagacagagtaggtatttacaatgaaaaactcaaagtagtctcacattgaagacagagtgaggcaatgagctctcaggagtcaagagaaatattccttgaagtttggagtcacagaagcatcagggaagagatggaacatgagctgaatgttgaatgatgggtagaatttggaaagaatgacaggggcaatcaaagctgtgggatgaggaggttaaagcaaagacacaggactaagaaaacacaaggagtgtttgtgacacattgacgagggccatctggttggaacagagtttgcataaaccaccaaaagaggaaaaggggaaggtagggtgatacgtttattctggtaaaggtttagacaccaagctaaagattttatttttatttctgagatagtctctctctgtcacccaggctggagtgcagtggcgctgtcttggttcactgcaacctccacctcccgagttcaagcgattctcctgctttagcctcctgagtagctgggactacaggtgcctgccaccatgggcagctaatttttgtatttttagtagagttggtgtttcatcatgttggccaggctggtattggactcccaaagtgctggaattacaggcgtgagccactgtgccctgccaagcttttataatttaacctgggaaatgtcaagccactgacatttttcagcaaggttgtggccagtgtcaaagagtctttcgggaagtttggtttgtggaagatgtgtagaatatatcaagatgaagaactgggtgacttctagtcaaaaaggaatgatgatataaaccaggtaccaatcagaatgagaggtatggaagaggggcaaaggaattaccagtaaaccaaggggaaatagaaatacagttttacccaaagtttcaaatccaggaggctatgatagcaactgtgctgtatactaaggcatacaactcatgagatgactggtttggtaacagtcctgagcgttttgttttaaagagctgggtcctgaggttccagacaagcaaacatgccaaaaaagtggttcaatgggggggcttgaggctcagctggaaaccatgtttaccataccaagtttaaaaaatccacacagctcagcaattgtttgaagtttttaattaattaattaattcataaagtgaagtattttcaaaagctcatctgagagcttatattctcttgatacagatgaattctcaattgctcttttgttttcattgcaaaacagttcaacttgtatgagactcaaagtggggagggcaggagcagaattttctctgttccgggtatagacattatgggtattgggccatattctcctcttcgttggtaataattcctattttatacatctttctatcaattgcagctcctaccagagtcaacgtcttgattgtaaatactcagtgttggttgatttgcattttcatcatagtcctgaaagataaaagtggacctaagaaaaactaataagcttacagccagttttataatgacagactctatataaacaaatgcaaattggatgtcaaatttgaattacaaaatttatttgagcaaggtccaggaagtaataacagtgtcttcagatcttttctaaaatgataaaaattcattaacaatcttccatggcttggagtctcagagactttcaaaagtcacagcactttgaagagcagagttggcaactaaagttatcagagtgaagaatggcatgctaacctcaggtgcaggatggccaactcaaagtagacctctattctttgttcttctgagataggaactagccagaaacttagttattcaggggtggggtgggaaggctgtgggacccagggtggaaggacccacacagttcaaaataaaacgaaccaactatagtgaaggaaaagagaactatacacagatagtattcctcatccccctgaattgacttatataaaaaagaaaacggagcatccgacaaattgatgcaatcaaaagggagcaataagcctttttctccttttaagcctcttaagaaataaacccatcattttatctagtgttttctctgctcttgcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaaggttagtagagattgtgtctgtgcatcaaagatttctctcttaatatgttcattttttaaatatacaattgttagccattacaaggaatgtcacagaagattaaaaagttaataatccttccaggatttgtgtaccaccaccaagtcactctgatagtggcagacactgaaattaatgtgttgacatctcttagcattcctgctttcatttgtaggtatgcaaataataaagcggtatcatctctagagatggcaggtttggttttttgtttgtttgtttgttttttgagatggagttttgctcttgtcacccaggctggagtgcaatggtgctatctcggctcactgcaacttctgcctcccagatttaagcaattctcctgcctcagcctcccaagtagctgggattgtaggcacctgccattacacccagctaatttttgtatttttagtagggacggggtttcaccatgttggccaagctggtcttgaactgacctcaggtgatccaccagccttggcctcccaaagtgctgggattacaggtgtgagccactatgcccagccaagatggtagttttatgccattttacagaagaaaaaaaattaaatgattggcacagaaacctacttctgtagtctccctacccaaaccctgtgttaaagttactgtaagatgttactaagatttgccttcccagcacaggtatattctaacctggctaagactgtctccctgagaagttaagaaatctagccaagtccctcctatcctttgttctctgttctcccctcttctagaagttattttgtagaagaacaatttttgctactttttaacattgaaacaagtaggacaattcaattcattcatttggagcatgaacggtacagtcacacaaagataattattttccagccatcaaaaagactattcatactaaattccaaattcctctgtgttattgtttttttttaatctcaatttcaagaaaagtaactgttacctatggcagagccgtatgcatcactgttcataaaaaaaaaaaaagataatctagtcaaaaggactttcatctaaattggctgattaaactgactcccagttctgtgctaggaatgataatctggtaaggggtttggtttttcctataatgttttggaactggggggaggaaatgaatgtacctccagaaaagcaaggtttttttttaactgaacccactttgcaaatgttaattactgcaaatgagcaattatgtttgcatagtgcaaatgagcaattatgttgatgcattttattaaatgtcctatttcagatgtccttcaagaacccaaaactgaagatatagtagcagtgcagaaagcaaaagcattgtacaggtcttgtataaatgaatgtaagtgctcttcatttgatttcattaggagtatatatatatatatattggtgccaaactatgcctagatttctaattgaatttatgtttgttgtttccaaaagctgctattgatagcagaggtggagaacctctactcaaactgttaccagacatatatgggtggccagtagcaacagaaaactgggagcaaaaatatggtaaggcaattttcctactaaaaaagaaatttccatgtaaaatctatgttataatatcattagtgaactaaagcttctaaagatatattttatcttttattgctttaggtgcttcttggacagctgaaaaagctattgcacaactgaattctaaatatgggaaaaaagtccttattaatttgtttgttggcactgatgataagaattctgtgaatcatgtaattcatgtaagtttgtgtgtcaaataactaaagttacctttaaattgtaataaaacttccacatacattgttgttattgatatttagaaataatgctattttcaattgaattgaataagcaaggaggtagtatatccatgctctgtccctaatacctggagttccaattttgaaagtattttcttaatgctgttttcgacattcaccccttgcttctgctacctctgttttagatacctctcccttcacaaaacaaatgataagaagggctccaggcccctcctattcagaaaaagttcctaatttctttgtatagtacttgaaaggagcatgctttcgtttatagaagtaatgcaggtctagaaaccaaaaaataataattgctttcaaaaagaacacagaaaagggattttaaacatcatttttttcctcactaaagagtatctgtacttttttctcaactaaaggtaaataaaatgcctttcttttaaaatggatttattgtatttttacaaatgtaaacaatttgatttaggtgtcacctaagactagattaatgactatgtttggaatgtactgaaaaatataaagagtttttctttcttcctttttttttttgtttttttttttttttggtttcctgtgtaagaaattatacaaaaaattgcaggctactgaatcacctaatcatatctgtgtcactattgcataaatctttatggtcgtttttgttaaaatcatgaaaggaattgaacccaaatctcctgcagtgggctctctctcttctgaaactttctccttgcaggatcaccttgaggaccagggggtggggaaggatcagggcccttcatgtggagatatcttctggctctttccataccagttctttgggttatgttttcttttctattggcctaggctctccacagctgctaggattctctctttaacccagaaatgctctgtttggcctccacactcatgttgccatgcagtgagtaggaaacaatcttgcaaagctgcagtatgcccagatagctcccacttgggtattaaacatggaccagacacgttagcgcaaaactgagtttcctctttcacacccttaactgctatctgggtctactgaggttcttctgagcagagcagctttgaggagaaccaaggagaagtcgcctccattcccttagggtagagaatcttaaaaaacattttctggcacaagttacattagctaaaagattctggagttaccttagaggttttccacttctccccttctccccatccatccaaatcaacttgaagaatattaacccactcccaccaatgaaaggggatcccaactaagggtggaagcagatgagaatgttcccaggggagcacattagaatctcaggaagctgagaaatctgtgaatatgtaatttagaaatttccacgtcctagaatctaacatgtttttgttcacttgcaccttctgctctgcattaaaaatccctcctagtaaatcttttgttcactttcttttgttttccttaaatatctgcagcacagtcctccagattatctaactgcccgttagtataacacttacaagtagtgtagaaagcatttcctaactaggtatttattgagtgtctgatggtcaccccataaacagcaagagtaggatctttcacatacatagatagacatgcttgtatttttcaaacttttctatattcactgaatgatttattttcttttatgtatattttttatagattgaccaacctcgacttggcctcccttctagagattactatgaatgcactggaatctataaagaggtaaaaagaaaaaaaataatcaaaaccaaactacaaaatgatctggtgtaaacctacaagtaatgaaaaagataaagccaaattaaatttagccctctgatgtttttcattcatgacagggacttaaaatcacacataatagtgagctgtctttgatagaatgaacattctcaatagaatgaatgaaggtattttacaaaactaggaaacttgaaattccttatttgtatcttggtttttagtatttaaaacatatgatcgattttgaaaagttaatttaaaatattttaatccacctgtaaactgcattatttaaaaaatgaaaagatttatcatggtctagggtggtgctggtgaggaccagagggtcagtgagagatacactctgcagcatccttctggaaccatctgatttgactgtcagagaactatgcaggtagtgacattgggctcagacaaacttttgcagctaccttgtgactctaacattggccaggtagccagtgggcatcatatcccatagtggacgtttggatgttctggagtgctttcttattgtctcacaaccttgcctcccttgggctgatgttcacgtgctctttttttttttttttttttattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacatgtgcatgtgtctttatagcagcatgatttatagtcatttgggtatatacccagtaatgggatggctgggtcaaatggtatttctagttctagatccctgaggaatcgccacactgacttccacaatggatgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttaagttcattgtagattctggatattagccctttgtcagatgagtaggttgcgaaaattttctcccattttgtaagttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtcatgcctaggttttcttctagggtttttatggttttaggtctaacgtttaaatctttaatccatcttgaattgatttttgtataaggtgtaaagaagggatccagtttcagcttcctacatatggctagccagttttcccagcaccatttattaaatagggaatcctttccccattgcttgtttttctcaggtttgtcaaagatcagatagttgtaggtatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatgaaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcttctgcaaacagggacaatttgacttcctcttttcctaattggataccctttatttccttctcttgcctaattgccctggccagaacttccaacactatgttgaataggagtggtgagagaggacatccctgtcttgtgccagttttcaaagggaatgcttccagtttttgcccattcagtatgatattggctgtgggtttgtcatagatagctcttattattttgaaatacgtcccatcaatacctaatttcttgagagtttttagcatgaagggttgttgaattttgtcaaaggccttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttggtatcagaatgatgctggcctcataaaatgagttagggaggattccctctttttctattgattggaatagtttcagaaggaatggtaccagttcttccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtcgaggaatttatccatttcttctagattttctagtttatttgcgtagaggtgtttatagtattctctgatggtagtttgtatttctgtaggatcggtggtgatatcccctttatcattttttattgtgtctatttgattcttctctctttttttctttattagtcttactagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagttttttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatgtgtctaatgttgacagtggggtgttaaagtctcccattattaatgcgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcatgtgagatgggtttcctgaatacagcacactgatgggtcttgactgtttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagcacttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatactggcccccactctcttctggcttgtagggtttctgccgagagatccgttgttagtctgatgggcttccctttgagggtaacccgacctttctctctagctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtataccaatcagacgtagatttggtgttttcacatagtcccatatttcttggaggctttgctcatttctttttattcgtttttctctaaacttcccttctcgcttcatttcattcatttcatcttccattgctgataccctttcttccagttgatcgcatcagctcctgaggcttctgcattcttcacgtagttctcaagccttggttttcagctccatcagctcctttaagcacttctctgtattggttattctagttatacattcttctaaatttttttgaaagttttcaacttctttgcctttggtttgaatgtcctcctgtagctcagagtaatttgatcgtctgaagccttcttctctcagctcgtcaaagtcattctccatccagctttgttccgttgctggtgaggaactgcgttcctttggaggaggagagacgctctgcgttttagagtttccagtttttctgttctgttttttccccatctttgtgcttttatctacttttggtctttgatgatgatgatgtacagatgggtttttggtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgccggttctcagatctccagctgtgtgctgggagaaccactgctctcttcaaagctgtcagacagggacatttaagtctgcagaggttactgctgtctttttgtttgtctgtgccctgcccccagaggtggagcctatagtggcaggcaggcctccttgagctgtggtggactccacccagttcgagcttccgggctgctttgtttacctaagcaagcctgggcaatggcaggcgcccctcccccagcctcgctgccgccttgcagtttgatctcagactgctgtgctagcaatcagcgagattccgtgggcgtaggaccctccgagccaggtgtgggatatagtctcgtggtgcgccgtttttaagccggtctgaaaagcgcaatattcgggtgggagtgacccgattttccaggtgcgtccgtcacccctttctttgacttggaaagggaactccctgaccccttgcgcttcccaggtgaggcaatgcctcgccctgcttcggctcacgcacggtgcgtgcacccactggcctgcgcccactgtctgggactccctagtgagatgaacccggtacctcagatggaaatgcggaaatcacccatcttctgcgttgctcacgctgggagctgtagactggagctgttcctattcggccaacttggctcctcctccttttttttttttttttttttttttttttgagacagagtcttgctctgtcctgtcacccaggctagagtgcagtggcgcaatcttgggtcactgcaacctccgcctccctggttcaagcaattctcccagcctcggcctcctgagtacctgggattacaggtgcccgccaccgcgcccagctaatttttgtatttttagtagagacggggtttcaccattttggccagtgtggtctcgaactcctgactttgtggtccacctgcctcggccccctaaagtgctgggattacagatgtgagccaccacacctggcccatgtgcttttcttacagaaagtaaggaacagcaggagacaaaactaataatcttacacgttattagatattggggaaaggtgttggttctacaaaggtttgtcttataattattttgtagctcaaaagtaagttatctttgatgatcctaatggctcacagtgtagtgatgtgactaaaattacattttagttaaaattactagctaaatatgtttatgattggcatttattttgccaaattatgaagttcgaataacatggaatgaattcactgtaaggtatctttttgaatgactacacaacactgaaatgaagaaaaagatatatcatcaaaggccacaattaatagcacagataaatacatgggtatgggatatttgagttcagtacaatctagttgctgtgtggggtacagctactggctttaagagcaatgcagctgctttctgttacagatttgaaagtgattgaggaattttggttcactattgtacatttttatcaccatgaactgggatgcttttcatatttaggattgtgttcttatatcaaatttttcaaatcctatgatacatattttttttacattttaattctgatatcaaggtatacctggcagtcgatgtatatatttaaggcagtaaaagctttttttttttcattgttaagatgttgcatttttgcattttatactcaatgctatcccataatctcaaacaggtcacaaactggcagtctttggcttgaatctgatatagaagcatttttgtttaacctgtagtgtttttttttaaattttgaattagttgtcaatatttttcaaaattgaaagatttcatttgagaatccagatttcttagtaagtcagtagaatttgagcccctagcttgcattcttatatggcagcaattgaccagagtggtgttgtggttgctccttttagaaagggcatttattggctgggcgcagtggctcatgcctgtaatctctgcactttgggaggccaaggcgggtggatcacctgaggtcgggagatcgagaccagcctgaccaccatggagaaaccccatctctactaaaaatacaaaattagccgggcgtggttctgcatgcctgtaatcccagctacttgggaacttgggaggctgaggcaggagaatcgcttgaacccaggagataaaggttgcagtgagccaagatcgtgccattggactccagcctgggcaacaagagcgaaactccatctcaaaaaaaaaaaaaaaaaagaaagggcatttgttctccaggtttgaacagttttgaacagtcctcatcaacatgattcatcgatttatattgacttatcggctcctgtaggcacttgattttgcatattagtctggtcttggctaagccacagcagtaaaaacacaaatacagtagctcaaacaagaaaaagtttacttctgtctgtcatgccagtctggaagtaggcaggccatccagatgaggcaggaagctctgctccatgggaatgtctgggagccggctttctttgattttttgctctaacatcaacctcctctggtgtttttcttagtctatttggtcaaagttggttcaccagtgccctattcacatgtcaggccacaggaagaagaaaagagagaaagtggtagacaaatagttaacctttatgtaaatggcgcagaacttgcatacattccgttgcttaaaacattgtcatgtggccacaactaaatataaaggaggcaggaaaatgtagtcttgagcagtggccatgtctgtgtcttgttaaaacttggttggcagagaggaaggtcgtatcatttaaaagatgaggagtacatataccaatgtcatttagcatactctgccacagtttacatccactgatctagggaatactgtatttgtgatcaaataacacagtggtgatcaaatctagaatcagtaatatgtttatagagtttatgagtgagaaatctgagtctcagaagtttgctgtcaacactcagcagaacagtagtatagtggcaaactttggtccttctctcttcttcattctactacattattacaatttcttaagagttggtacttcatactagtagagttctttgaatgagcaaatgatagaagaaactaacctgcactggcacttacagcccggaagttattctcagcttaaattaggtgctcttcaacgatctgaatcagactagcaaacacgcagcatgcttgctgccttgctcctcttccataactatgtacttttggtgacatccttctttcctgctaacctgagatctcagaattcttcttaaggtagtgcttcaagctgtaagcaatctcctttcagtggaagggagttgcataaaaataaaagttacatgtcatcccagaaatgggtaattatctgaatatttctgcaccctctccctttttttaaatccattcttttgggcatgggggtgagagcgtgtgtagttacagtaagaattccaatgttacccttatttttcccatgatattttctactctctcctaatccctaccacctgcaatccctcagtttcccctgcatttctggcaaaattctagtttttccactactctgctatctttgaaagatgtcaaccaccttaagtatttctgtcttgtgtcttattgcttcatgaacaaaaaatggtgcgaagtgtagaataacaagtttaccttcagtagaggagttataaatctggaaggaatgttaatgtcagtgtatcattggccttcaatgattttctcccttataggcttttatatatgcttttccctttgcctagaacttgccccccacacacaccacctgcctacactctttcctctaatatagttttcctagcacccaggtttctgtatacttcttatttaatgtctttttttttctataaaactgtaaatgaagtggaagcaatgctgtgtctcattgccctttgctctttttctaatacctaccaaagtttctggcccttaaatactacagaatcagcaaatgaatgattgagggggaagatagcagggaagagaggaaacaaaagaaagaagaacccaatcttttggaagccctccttgtttccttcccttgattccgggaaacatgagctctagggcatcaatagctaatagcatacatttctttagcattttacaaactctgtgttctcttttctcttttcaatccccagttacttctttgctaaactcagtttgcctgaggtatatttatacaatcaatgggtatcatacatttgcagtttacattattttattggaaataatcaagagaagttttgagaattggcatagggtcaccaactttttttgtcaaagaaagatggtcttagaccagagaggtctggcttccttgcccgtcgctttagcctataattttaaaactttagtgtggggtctaccttctgcagatatgcctcagaggctgaggatcacagagggtcacattccctcttcagtcaaaagtactctaatcgtaggtctcctttatcagattattaactcagcctgtttccccaggtcttctttgatccttccttccaggatatccaggtcatccagaggtatcatctcccataatcttaaaaccaaacttcttatcgactatgaaaatagcccccacaattactaagaagatcatttcactttatagaagtcattttttttttgctttggataccctcataatggaatttttgtattgtaatatttgattattattataatctagaaagggaaagtgatagagaacagttgcatcatctcagaaaggggcccacattcaccgtgtctgctcttcctaacaaactgttctcaagatgttctcatcaaggagcttcttgtgctatatctttgttaaagagatggagcctgagttctgaggtattctgattatctgaagagattacttaatgacacaatgctatctcaaagaacagaagtagggagattcaagacaattctattccttacagaggtacaaatttctatgctaggaaaacaatacgaaagatacacatggcccataaacataaccattcccattcacaaaatttgtaagtgaaaccaaccagcaacctcatgtgagaatgttcttctatattgattcactgagagaaatgaggaccttaattttcttaagaaatcacccaccttcagaagagtctgaactctgtattgggggtgaattggaattggtctcaaagcttccctttctctaccttcttagcttttcaagagcaattgttatcttactttgttgtccttcataaggaaatctgaagattaggaatccaaaatatttgagcataattacataatagatatgtttatgctctgtactgatgtttgcctgagaaggagcaataagtgaggttagtggtttccaactctaaggactactttgtgtgtgccaattacagggctctgtgcagaaacacctcacatgtacacacacttcaaaagccactatgatttatttttacttgtgcatttatacatccacaaaacatttctttgagtagagcatttcaggtctaaaagaaaagtaagaaaaccactcaggctagagtttgagagcataaggaggcgggaaaggaactggagagtagaagctacagggtatactgctgcagggcatggctagggagaagaagccagagttataaagaagtgtagagccttcacaaaatctgaggttcataaaaatagagacattttagggatgaggatagaggacttggaacatgggcacaatggactgaagccagaaagcgatgacccagagtctgtgctcctagatcagaaaagccaggagaagtctccaaattatatgtacctgggaaagaacacaagctgagattggctatcctgtagatgagcaggtgcaagctggaactgggattaaacaagaggggattttctttgtccacctacccaatgtacaagctgagagaaactgttcaggacttgagctaagaatagaagttccgaggaaataggaagtgagagaaacttaatatatttacaatttaacttcatttttttttaattcaacagatcttcattgagcttatgctatgtgacagatacttttctaggcagtagacattccaaggaaacaaggtccttgttctcatggaactcatgttctaatgggaagagatagacaataaataaccaagtaaataatttaaggaaatgagacaaattgtgagtgttataaagaaaataaatcaaggtgatagaataataagtgactggggtaaggcatgggtgattcaatttggcttgctgaaaccatctctggctgttgtttgtagaatgtgttttaatggaagcagaaagatcagagaaggccacatggtaattcatgtgaaagataacgatggactcagatggcagcaagtcagatagagaaatctgagcagacctaagataatcttgtgtaggtggctctatcattatagggaaacagtttgtgtactttaaactgctcggccaatatgtgcctcagtgatacgtggcggagcttgtctcactgcataacacagctatgacatgataagacaggccctgcaagggaaactgctgacctcactttgtcctttctgggtaccaagtgactaatagtcagaaggtttcactcagttcagtaatctgtgtttaagaaaacaaaagggggcttttaaacatgagatttagtgaatatgacagagaatttttgagatcaactgaactcagtttgtaaaaagagctagattcagccccccaagcatggaataaaccttggaagttatgcaagaagttgtacaaatcttcaggttcttattgataacctgatgaaagccccaaacagtccctatgctggtccaagtttgggtcctcttaggtcccacgttcctcctgctctagcgtcctgctccactgggggctattttttatttccagtgcccagaaatggctgtgtgactatatgtttgcagtctgttggagggaagcaggtctctctgctaacaactgcacactagctgacatgctgcttaaattgagaaatgtttctaagcttttttggtaggaaataatctttcctgcttagtctccctctgtgttcccccagcaaacttcttgtgtagcattattaaatattccccaacatcagtggccaagaatgacacaattctgtgactcctcagtcacttcatgctccacattaagtggagtttcttcctagaatggggaaggcagaacattggtaagagctaggtgtctcagaatctttggaaataaaatccctgatccataggtagttggctcgctaggttacccagatatcaatctgacaggacagttttctgttcctccctgggtcttgattgtcattcattaggaatgaaattaaagtttgaaggacagtagtcaaatggcattcatttgctctcttcctctttggcaaatctaacaaacatcaggctttttccaggcaggaagagcctcatttctaaagagccaatttataaatatcattacctgattctgcaaaatgaagatagtcctaactagagtaactatccatggtgttgggtgttagtaaatatcatctcattggtagtgtgtgattttaaaacccacaaaactgctattatatggattttatctaactgtttaaaaccgatgatcacctttgaaactactgttacgagtactaggacttacaattttttttttaagaaaagctacataaatgttttggtggattcttcttcacgtaaacaatcattgatttgctatctcagagcttcaagaaatctaccttatgactgtcaaaaatgagagctgactctggcctctgttgtaataactaattgctctctcagtcacacacacacaaaattaaatttgggtttaaaaagtatcctggccaatctactttttaagtgttaaaatacatgttgatttgcctgacgtggtggctcatgcttgtattcccagcactttgggactcagaggtggtggatcacctggggtcaggagttcaagaccagcctgaccaacgtagtgaaaccccgtctctactaaatacaaaaaattagccgggcatggtggcacatgcctataatcccagctaaggcaggagaatcacttgaacccaggacgcggaggttgcagtgagccgagattgcaccattgcactccaccctgggcaacaagagcaaaccccgtttaaaaaaaaaaaaaaaaaaaaaaatatatatatatatatatgtataaagtttcttcccaaatcatgacaattatcatcatttcacattttccatatctggaagtatcataataaagaaaattaaaaccttaaggtagaatcacatctcgtacaatggatttagcacggcagtaaccttaagttctgacaccagataaatttggaagtcaggaaagatagtcatgatactaagacatatgttttaatcagttacattggagtagttaccaggtaatggaattcattaaaagaagtggtatattccatgtagctatattaaatactcgagcatcccagaagctagtgatactatatgcttccagttttctgagaaacttgaccagtttagcagactagaagcatcatccaaagttcttgtgcttgctttatatcaaagttctatagtctttaaatacatcggtaaggataaagagactggagcagaatcagtttgctgagtcaacaaagtgcccaagatgattactgttattgttttctcacctcatcaacaaaaagcatcccatatatatatatgtatatatacatatatatggtgtatatatatatgtgtatatatatggtgtgtatatatatatggtatatatatattttccaatatcaattttccaatatcaatctactgagatatatctcagtagattgatattggaaaattcgaactaccattttgtttatagtcagtagtaataccctgctaaaggtcgattgatttatatgctttgggaatacagttaattcaaaacactgcatgcttgtactttggaatagttggtcccatgaggtatgaactcagacatactcgtttacttcaaagtgaaacaaaaattctgattaccttaaatagaaaaaaattgagttgctgagaatatacgtaaaattgtcttttcatttctgttactttagtgattagagttttttaaaaatataatttcaagttttattttagattcagggggtacatgtgtagttttgttacatggatatattgcatggtactgaggtttagaatatgaatgaccccatcactgaggtagtgagcatagtacccaatagttagtgtttcaacccttgctccactctctccctccaccctctattaatcctcagcatctattattgccatctctatgtccttaaatgcccaacatttagctcctacttataaatgagaacatgtggtatttggttttctcttcctgcattaattcacttaggataatgacctccagctgcatccatgttgctgcaaaggacatgatttcattcttttttatggctgcatagtattccagggtgtatatgtaccacattttctttatccagtctaccattgatgattctctaggttgattctacgtttttgctattgtgagtagtgctgtgattaacaaatgagtgcatatgtctttggtagaatgacttattttcttttgggtatatatccaataatgagatttctgggtcaaatggtagttctattttaagttctttgagaaatctccaaactgctttctgtagaggctaaactagtttgcattttcaccacagtgtataagtgttcccttttctctgtagcctcaccagcatctgttcatttttgacttttgataatagccattccaactggtgtgagatggtatttcatcgtggtttagatttatatatctctgatgattagctatgtttaatgttgtctcgtacatttgttgaccacttgtatgttttcttttgagaagtgtctgttcctgtcttttcctactttttaatggggctatttgttttttgcttgttgaattgtttaagtttcttgtagattctggatattagacttttcttggatgcctagtttgggaatgttttctcccattctgtaggttgtctgtttactatgttcatagtttcttttgctgtggcagaagctatttaatttaattaggtcccacttgtcaatatttgtttttgttgcaattccttttgaggacttagtgataaactctttcccaaggctggcatccagaaaggtatttcctattttgttctaggacacttagagtttgaagtcttacatttaaatctttaatccatcttgaggtaatttttgtgtatgatgaaagttaggggtcccattttattcttctgcatatgactagccagttaccctagcaccatttttgaatagggagtcctttccctgttgcttatttttgtcaactttgtcacagatcagatggctgtaggtgtgctgctttacttctgtgttctctatcctgttccattggtctgtgtgtctatttgtgtacccagaccatgctgttttgactactgcagcattatagtataatttgaagtcaggtaatgtgatgcctccagtcttgttcttgttgcttaggattactttggccatttgggctcttttttggttttatatgaattttagaattgttttttctaattctgtgaaaaatgacattggtagtttgataaaaagagtgttgaatctgtatattactttgggcagtatggccatttgatgatactgattcttccagtccataagcatgaaatatttttgtttgtttgcttcctctatgatttctttcagcaatgttttgtagttctccttgtagaaatatttcatctccttagtcagatatactcttagatatttatgtaatgtgtatgtgtgtgtgcctattgcaaatgagattgtgttcttgatttggctctcagcttgaacattattggtaaatagatatgccaccaatttttattcatggattttgtatcctgaaatttttgtgaagttgtttatgagttccaggagccctttggcagagtcttcaggattttctaggtatagaatcatatcattagtgaaaagagagagtttgacttcttttcctatttggatgccttctctttcgttcttttgcctgattgattgatctaggtaggacttccagtactgtgttgaataggagtggggagaatggacgtctttgtcgtgtttctgttctcaaggggaatgcttccacattttgcctatccagtatgatgttggctgtgggtttgttatggatagttcttattattttgaggtatgtttctgcaatgcctagtttactaagggtttttattatgaaaggacattgggttttattgagacttttcccacatctattgagatagcccaatggtatttgtttttaattctgttgatgtggtgaaattgattaggatcttaatgcagattcacagatgaaaaattgttctattgagtagcaaatccatggatagcaatcacagctagatagtcacagcattacagagtatccatgaaaagaactgtttacttagcatttagtaaaagtcatagaataccagtatataaacctctggacttacaaattgataataattttgtacatttttcttaagttcttgcttgatcgaatatttctattttcctattagttttaggtttgattaatggatcactgtaaattcagatgcacctttgcactcacagtgaatatatggatgttccttccacttctaattgttccataaggatgtaaaatattcttaaaactgtgaaaatgttaaagcacattatagcacactttatagcctttctttgtatttaccctgcaaacaagtctttgaagcatagaaatctcacctatccataatcacaattgactgctttactaaattttaaaatgaggtggaatcgtaatgtattttaattgctaataggtaataatggctaataaatagcaattggttcaaacctaacaaaagtgggactccatttcctagtgttcttgccactgtgaacttgaatgaggcatttatatattctgtaaaaggttagtaatacaactattctatagtttacttttgcaaattaagatgtatgtgaagataaaatataaataatttgagttatcagaagaaaactaatatctaaatctatggtatcgtatagtgaaattttacagtaacaggagctatttatggaattaactaaaacctacaggtgtgtgttggtggagctcctgacaacacagcttcataaaaaagaaactgcttgactcaaggagacagataaaaagaagtgtgattatattatatgagtttgtggtcatttttccatgaatagttgagaaaatgactatgaaaaagagatttggtaaagaaatgtattattatggctgagcatggtggctcacgcctgtaatcccagcactttgggaggccaaggcaggcggatcacaatgtcaggagtttcagaccagcctggccaacatagtgaaatcctgtctctactgaaaatacaaaaaattagctgggtgtggtggtgggcgcctgtactcccagctacttgggaggctgaggcatgagaattgcttgaaccatagagatgtaggttgcagtgagctaagacagcaccactgcactccagcccaggcgacagtgtgagactctgtctcaatgaaaagtaaaataaaataaaaaaagaaatgtattattattcagcgaaaaaattagtatatgttattgcttatcaagtgttttgcaactcattctaatcaaggcaaaataactttattgaaaattgaaaattacagtctccataaccaagtggttatacattacttagtactttcaaagtgatacctcattgctctcctttaagctcttattcaaagatatattgactgtctaagaatctgtgcaggtcatttctttaaatacttagaaaaggatttttattttactaaggttatctattaccaaaaattaatattgaaatgaaaataaattttaagtaccatgatgaatatttagagctactccaacagtttagtgctatttttttcttgcaggcttgtacagcatatgtggattttatgatttctgtggccagattgattcgtcaggaagaaagattgcccatcgatgaaaaccagcttgctttggaaatgaataaagttatggaattggaaaaagaaattgccaatgtaaaacacatttttttttctgatacactgaataatgtcaaccgctttttttctttcccctctctatcatactttaagagtaaaaggtacagcactttaaccaagtagtaaaaatgcatggcttggtaatagatcattgacttcaaaaggacctttgaaactaaagaattttatagtaaactgggttcctgacatttaaaagacacactaaattggacaaatattaaactagaaacacttaattgccttttataagtggattccatcagaattctaccatttacagtcaaactgttgttagatgcccttcagactcagagcaaatgcaaagctgttttagttttgatatgtatagaatattactttattttaaagtttaaagtgatcacagagattgtctctatttctttgctaagaagtattaacccctgaacatagccatgtggcaatgtgatactactgagttcaaattgtcaggctgctgagctgacggagggtaagacaataattttgcaacaaagcccaaggagtgtattcctgaatttcttctggctctagatcaacccttggagtctgagttggcactttcttccctgatgattctttgatagggcactgcagtctcaagtgagtgaactctgagtctaagcagcatccaggttattgattaaacccatcgtcagagtcagtctaggacccacagagttctctttgtcattgcaaacgacaacctgcatccctgactccctatctgcttgcccctgccatctaagctcatcagaatcttgaagagttaagatcatggagggcaattttagctttcctggggctacgtgaaaccaaaaatctcctatcagaaccagggtgttcttggagctgccactgaatgaatggcatttgaatgggttacatgtggttctgtgttggaaacagacttgctagaggagaaatgtttcctgctctgggtttttgccacttgcaccttcccagaccatgcgctcctttgaccagcatcagctctgtagtgttgtgtcttacctcagcattatgtgtctatattctcactcttgtattagattcttgtattagattggcatgaggccttagacgtctttgaatcatttatgcatctctaacaaaatccagcatagtattgcacaaaggacatgctcaataaataattgttttcagtaaatgaataggtaagtgacctaaaggggaaactggagccattgtcactgagaaataattccaattttaaacctttaccttttgtctcttctcacttaaaattgcttttactcatttcagccactagttggggagttgttattgcaatttttctttttaattcagtgaaagaaataaaattggatgctgctggtctggcaggataggagaacagtcacaaaggtccatgatgttgccattctcagataacttgcaaccaaattgtgctctgtactaggaagtttctctgttacttgcgataaattcttatagaaactcttgcacctttttttccttgctgaattttaactaggacaccgaatggtaatggtgaagatgggagagagagtatttaagagagaaattggagatgactatatcaaagaaagttaaaatatgaaacattcacagacacaactgaactggccattagccatagctcataaatattgcttatatggcttggcagttgtcaaaatatagacagattttttaaaaattttaaacttgaccccacagccaaatctcaataattcttactacttctactccaaaaatctcttacatttcactttttttgaaatgacaaaacaaattacaaaaacaagtacagaataggacttaaattatgttgtacctatcctatatttttaccctcatatgtagttatatttttctaaagaattcttaattctaaaataatgattaaaaattaaatccataggctacggctaaacctgaagatcgaaatgatccaatgcttctgtataacaagatgacattggcccagatccaaaataacttttcactagagatcaatgggaaggtaagtggtaagttttttgtgctctcttattgtgccgttttctaaattataacattgaaatactctttctaaaattcgtcaagtttttatttattgaagtaaatgggacttcaattccttttttttttttttttttttttttgagacagggtctcactctgttgcccaggctggagtacagtgacacaatcttggctcactgtaacgtccacctcccaggctcaagcgattctcctgcctcagcctcccaagtagctgggactacaggcatgcaccaccacacctggctaattcttgtatttttagtagagatgaggtttggccaatctggtctcgaacccctgagctcgagtgatctgccggccacagcctcccaaagtgttagccacaggtgtgagccaccactcttagctggtaaaattccttttaaggcagctatacaataatactagaaactcccataggaaggggtttgaaaaatactaaaactgaaaatctttctgagaggccattatgtagtcatcagacttggacagtcacacaataaaagcactagatttccttttaactccaaaaaaggataatttattcatagaacttcccatgtgctcatcaaggccatctacagaggtgttcagaacaataattcagaaataggacacaaataaaaagaaaagctctctcatagattccatttataaacagcagttgacttctttttccttacctagtatccaataatctctttttgtggctatgcatttattctcgtgtattagttgatgcacacagccaagagatgaagcaatatccatgggaaaacctacaaactaccacattcagcgatgacattctctttggcactaattctagttaacaaggacttttccaaaggcataaactattgagttagacatcttacatagaattttttaatataataagtgtttaataaatacgttttgaaagaatgacctaaaccaccaaaggaaatgaagaaaattgtatagcatagcaccctatactcagtaagtgatgtgtgcttgtgtctgtgtgtgtaaaatacaacctaagatattgatagtcttaaacattatcaattcccatttagaaagacaagatttcatcttttggcaactccgtacttagcttctgaagtataaacatggcatgcctgtagacccaatatcgataattgaaaagatgctgttttctttgacttcataacatcactgtaccactgctataacagtatattttcatctataataggatttccactgagatgtgttactgtgtttgaatgaattgtttattaatacccacttttaaaagctaaacactttacacacatttccatttttgcataaaccaaaaaagctttatttttaaatttaaatttaaattatatttttattttctgtattggttagacaaagaagatgacattaagcctaatttctaggtatatgttccttaagcttaaaggctttgttttcgctcttaaatggttggcttaattatgctaggtaaataatcatgttgcagaactagtttttatttaaaaactgattgaaacaattgaggaagaatcccaagtgaatatcaaactgatccaaccctctaactataactgaatcttggacccaagaagagaaatccacaatttctgaatgtttcatgcctgcttttttccagccattcagctggttgaatttcacaaatgaaatcatgtcaactgtgaatattagtattacaaatgaggaagatgtggttgtttatgctccagaatatttaaccaaacttaagcccattcttaccaaatattctgccaggtaggtatgtcacagtccccatgtcctcaaagtttgcatttcatatcactcttcagaagctttgcagcctcatcttttctgttgctgggcggtggttttttttatacagagatcttcaaaatttaatgtcctggagattcataatggatcttgtaagcagcctcagccgaacctacaaggagtccagaaatgctttccgcaaggtgaagaaaaaatctctcttttcttaagacttaaagcataaagtgatacatggttatgaaggcttaccatgtacactgctaggacatggtgaactttgcaaagggacaaaatgccaaagttcgttatcttgcacatatttaggacatgttgctgaggaagataaatcttcatgggctttaccatcttatgatggtctatgtggcacgatgattgcattgtcctgtaaggagttacatttggttatttaaccagttcatgaaagaatactgtctggattttttgttgttgttactgtgttaaaagtaatttcggggttatctattttaattaatttgattttcaggtgctcattgcacactggacatatacacagatggacaatattgatgtgggcagtctattgaaagtacccctacctggagttaaataagaccttttcttagcctatacctatattatttaaacaatcactgttttggtactatggtgaggggagtaggcagtagggattgaggaaggagagactccagcaaacatgttagttggagtcttggaaagaaaataacgtggactgattaaaatttctagtttttatccttaaaaagaaaatgtagacatctttttaaaattaaagaatgcaaaaatgtattgtgctaaatctcccttacttaggttatcctgttattcttaaatttatacacatacaggttctgtaagtactcagagttcagctaaaaccttgaaaagcagtaatgtgttttctcatataccatatttcccccattacatttattgaatatgacttcacatttatgtttgtgcagtggttacagtgttgtatgtttttctaacgctttctacaatgatattaagttgtaatagcaaaaagttctactggggcatctactgaaaatatgcctagttttcagatcatatataagtaaacaatccatttggattacatttcatcataggctaggaacatgggccttgtgaggagaagtgatgaatatttcaagaacttagatgagacatttgtgaaatgtgtgctcttaacatgctccagacctttccttctggtcaaatgccatttcctttttcttttccgtaggccctttatggtacaacctcagaaacagcaacttggagacgttgtgcaaactatgtcaatgggaatatggaaaatgctgtggggaggctttatgtggaagcagcatttgctggagagagtaaacatgtggtaatgttttcagaataatacactgtcagttatacaggacactatcagtttgttcacactgatgagcaattacagttctccatcatttggctaaaattttattaatttaggcagagaacctctgaatcataatatgccattgtttcccaataaatcttcccttgccttccccaagagtctagttatgtttctgctcctaatactgtctagtctgaaaccaactcaccattttccagaagcagtgtatttggagtacccagtaacatgttctattgatatagtcatttataaactcttctattatcaaaattgcccccaaattagtattttcttaaaaacatagaaagtaaaacaggatttatttggagtataagaaatgtgctttatttttcattgttaggaaaatgaagacagtggaacttaatggtatggtgaaagaatttattgaaatgctactttatgcttagctaaaccactaatggtaatgacagccctaatattttacattagttcttccagtatgatagtgaaaccattatattctgaaaatgatttttaccttaatgcatatattaagacctatttaatcaagagtgtcgataatagcaatattgcttttaaaatataatggtcccatatatctgttagcttaggtcacagtttgtctataaatttacgtttattaacatattaagtcatacaaagatagcatgtagctctatttttaaaaatctgtgttacaaagaatgaattaatgacctatatttgtcttctgttctgatttgaggtcgaggatttgattgcacagatccgagaagtttttattcagactttagatgacctcacttggatggatgccgagacaaaaaagagagctgaagaaaaggtaaagagcagacagctaactagcaaagaaaaatctttgctagtataggaaaaattaactttaaaaacatttagaaaaaaatataatcaaagattgcataaaaacttgtaagctccttcaatatgtagtgtttccagaaagagtttttgtggataaagatatatttctacaattttaatcttttatctctgcaaccaatactctagcaaggtgaaaatattaagtttctgttcaagcaaatgtaaggtggtgcactattggtgcattataagatctataattaaagagatgttgaagaagcttttttataactattcatgcccacccataatgtgcagcttttattgagacttttactgagtttcataagaataggtctaagatttctcaggaaatcttaggtttaaatttactgtgatcatttgtctttataattatataataactagggggaacatgtcctgtgaaaactgttaacatgctttatgagcaacattcacatgcatcctgactaatctctgtagttaggttggcagaaaaagcagacgatttggattgatagaggagacaataataaatgtattttaataagataatcaaccttggtctagttttcttttagaattaaatcacatggaaggactatcttttttcagctctcaaagagccctgagtgggttaggcctagaacctctgcccccagtattgctatctttccatcactctggccagctcttcagacattcaggttggatttgctcctttcatgtcacagctgtgcatgacatggctctgcttggtaaagccagttggattgttctggatcggcatttccaaagtggtgtcacaaaatactggacatgcaagttattccacaagaggctcatggtcaaaagagtttggtgaacacttcttgtaggaaggcttccctcatctcaccctaggctgggttacatgctcctagggtgtgattttattatcatacgtgggagttaatatttatttcactgcttatcattgctgtttacaataagctctttatggttgggggcaggggggcagaaaatactgcctagcattatatcctcagccctttataacatacctggcccttggtagacccttgaaatatattgagtgagtaaattgataaattaatttcccatcctggacatttataataacttatgattctaaccttataatctaacccatttttaattgtaagaagtcctgcaataaagaaacttgcttaatgtttttgcgacagcatttacccgaagtaattcacaataatttttttgtgtgtttactaccttatactttctgtagaatttgtatcctttagaacactctttaaggaaatgtcttacagtaaataaagtatcattaagtgggggctggattgtcatgactgatggcaaacctacaagaaaatgggtttggcctcagtgacttcagtgatacatatgaggcctgatccactgactggggaaatcctgggctcatgtgacagatttgtaataaaactgcatccatttgatgggaaaccatgtaactcagagatacaggctaaaccccccatgaaaaatttaaattaattaaattatttaagagtgatacgaagtggtaaaatcaaaagtcaagtatcattgagaaaatcaagagagaaataaaataaaaatagaaataacaagtagtaaacaagtgataatgaaataataaaataagtaaaataaaccattttaaaataattaaaaatgaactttagaagtagtgataaataggccaggtgcagtggctcactggtgtaatcccagcactttgggaggccaaggcaggcagattgcttgagcccaggagtttgagactagcctgagcaacgtggtgaaatgctgtctctacaaaaaatacaaaaattatctgggcatggtggtgcatgcctgtagtcccagctatttgggaggctgaaatgggaagatcacttgagcccaggaggtggagattgcagtgagccctgattgtgccactgcacttcagcctgggcaacagagcaagaccttgtctcaaaagaaaaaaaaaaaagatagtagtaaatacataataaatatgagctggaataacaaggaaaaccccgttttccacttaactaattaatgtcatttattgaacttgagaagataggtacactgactttggagaataaaggagaacataaaaactccaggaaccaatatttaggactagtattagcagtaaacctataagcccatatctgttttctcagtcaaatcaatgaggcagaaaggtaattataacctgctggaatggaagctgtaaatattacttcttctaaaaaattgaaaaaaaaagctttgagagaaaaagttcataaaagtacaaaatatgtggaacaatgagttttgtcagtttttatgttggttttcttgagaaagctgcagcctataaggataaggcattagaaactcaatttcagacctgattttcatttattcttgaacctcccaggaaagagccattgcaaagatctctgtttaagtatgtcagacactcattttatgaacagtatggatcaagttattcaattgctagtcatgggcagattataaatttgtatctgaaagttatataatcatcttcacattcaatattataattttcataggccttagcaattaaagaaaggatcggctatcctgatgacattgtttcaaatgataacaaactgaataatgagtacctcgaggtaagtctctataaaatagactctggactactgatacttagggctggtagtagtgtcatttttagctatggggtgcctgaaattatatgaagtagcctgaaaccacaggttgtattatataaagccttcaacgctggtgccagaatgatatttgttttagcctttttgttttcattagccaggactatatttggttattgttcatttggtttccatatattccattttaagaaccgtaagtaaaatctggtgtcctttaaagagtatcaaggaagggatagacatcaaggtggtgaacaacaggcaggcttcttatcacattttacacaggcttcgagtttccctccaccttctaagttttcctctactggaaaaaccaattcatgcctactgtattttaaaaacaaaacaaaacaaaccctgatatttgagaactgaaaactattttgttctgccctggtaatgtaacagttaaaagagcagagagttgcttaaagtcactgcagtgctgatttcagactcaactgaaagtcttgctgctaactctgcagtcaccacaactacatgataccctgatgacagcgaggtgatccttgcccaggtcctgggatgacagtgattcctcattcattgattactagtctagcatggggatttgcaaaccatactgccttcttctctctttccatttgcagaagaaacttgactttttcttttaaatgagctggttatagcttgcaagacccaggggtccttatagcaggagcatagtggctacgaacacagactcaaaaccaagttccttgattccagatcccagttccaccactcatttaaacttggtcgagtgactaaactatatctcagtttccttgactttaaaatggggataggagcccttagttcatcggtattaaatgaacataatattagattctattagtataatagaattaaatgagtataatgtaaaatttaaagtacttagaatagtacttggcacatggtaagtactaaagaagaatgtgctattatccacatgtgttatgtgaagattaatgtcattaatgtgaggtttgtttgacacttggtttcatttgattattataaaataatacactgaatttgtgatttggctggaatactgacctgtgatatactaatagaattaggttaactggaactacatccttttttggtaagttttttaatgctctcttttaactttattgactgatataatttaagaaaatccctatgtttttagcaaaaatttagaagataccggttttaatatttcttcccaaatcttctttataatacagttgaactacaaagaagatgaatacttcgagaacataattcaaaatttgaaattcagccaaagtaaacaactgaagaagctccgagaaaaggtggacaaagatgagtgcgtatattctcatttctaatgtgatcatctagaagcaggtctttccctcctttctttgttggattaagtgaaagagcctcagttagaaaaatattaaaaagtacaaagtcctctttttattgagaacttctaaaagcatctaattatggtatactaaagatatggatcaagactttaaccagattaaaatacctttctcattaaggtatcctcaaatttacatgtctttagtttcgtcttatgtcattgcctatcagctcaatttatttgtgaacaagattctcaaaaaccttagcttaagtaagccaattcatagctcctttaagccttctcttaggccttactctgtgtccagaattttcttctgctgacagccccaccttttttctatcagtcaatcccacaactccatccccttcatagatagttaatgtaagacttttctaaccctgtggtagtcaaataggagatactaggaaccattcttattcacagtcttcttatgctcttaatctctgcttattagtgacattagtatttcctaataactattagtttagattttattttttctattaaatagatataactaacatatttatcagcatatgtgtttatgcaccgaaattcctagaaccacttatgttgactttttctccctaggctcttagcccctagacaacaggggctattccttttgaccataaagtctcagcatctagcatactgaagaatctcagttaaaacaaaattaatgagtgagtgagcaagtgaaaaataaatatactaacttgatttgtgtggtaactaacacagtaacatgccaaagaggtgcttgtttcattcatgcattcatttatcctttcatgcatttattaacattttggaacacgaagtccaggtgtcattgggtactgggagaatcaaaggtgaactttgattacattacaagagcagaaggtagacaagacatggtgtaataaactgcaccaccaagagggaaatgtcgtgccaagcaaagtacaaagtgctgtgggcttatttgatgataagactgttctgttctcagtaaaccaagtacaggttggacaaaactgctaatggaaatgccagtgcattttaatccttactcaacatgttgaactcttgcaacactgacgtgtcctgaaagagagagcaactcttttgctgacttctaagttcatattggaacaaatattgtgttatctgatgctaaaaatgggattgcaaatattatagaatgtttagtgtcccatctgggaaagaaagagagtgaatacacatgcttggcattataatcaagttaccatatcctgtctcttgaaacacacaaaaagttatgcaaaataattatctgggtgaatttatgatctgagaaatttcttataagtctgtatatttgtatttctttaaaaatagacatactaagatttaataattgttagcactataaaatatctatagacaaatactgtcaaatattatttctgaaatggccaaattaaccagtacccataggacatcaggaaatttcttcataattctagaaatagttgttgaattattgcttgatgttttcttttgaggttaacgtagtgccagtttcataatcattttgtcatataatttacactgttcattccctttcatcatatgggctgattttctctgcattcttctctttttaagatagataatcaaaagccaaaagtgtatacaatattttaatgaatgaatggtcaatagcacacatgcttcagtagtactttttggtcctccccatgagcttctgatgatcacaaatgcaatatgaattctaaggtcttctctgctatatggagccagctttcctttctttcctatagtctgcctgtataccagatacaaaggttcaaaactctagctgcacatgataatcacctggggaacattttaaaaaacactgattccccagctcaagcaccctagaatgtgatgtaattgttctgtagctggaacccagatactggtattctttttaagtaccacccaccaagtgagaacccctgagttagtgttatttcccttttgtgtgatatcgttcctgttcatattcaattttatggaatttttcacaagatgatgcctttaatttggcaatttaggtttaaaatttatttttatcttccaaaataatcagaaaccctctgacagtaattgcatcaaatcattaagactgagccctataggatacaacatgatcgaagctcctctcattttattaaggtttcttgcagggaaagttactgacttattttgaacctgcttaatagtaataaagttggctggacatggtggctcaggcctgtaatcgcgccactgcagtccagcctgggcgacagagcaagaatccgtctaaaaaaaaaaatgtaataaagtcattactcttttttcttttctctttttgtggagcaccaagttcaagtccttgctgtgtatgtttagacagataatttctgttgcttctacttgtccacatagcccgtagttacatcttagagaattacattttcagatgctcaagatcctcactcccaaagtcttgaaagagaaatatgtgtgcatacccaaaactgaagggacagagttgagacttttgtagggttgtattgtagggcacttcagagaaatgatgatgcattaaattttcaagacagcaactaatgtaaatgaattcaattagccaaatagtaaacttctagacacttttttcccccaattcacatgctctcactgggcaaactcattttacttctcgacatcttctatcatcatcatgtcagctgaatatttgtatttgactcagatccatttactaagattcaaatccaaatgtctacatgcttatgaaacatctccatgtagatgtcttattgaccctaaaaacacagcatttgtcatttaggcaaaaaataatatctgcccattttctaaaaacctccattttactgctaccaagacagaaaccaaggactcattttaatcatcctagacttatccctttctgttattcctgacatctacagtgatagttaattcaaatctccattttaaaaaaaaagtctgcatccaccagctgctatttaaatattacgtaggaatgggaagaggggatctctagctcaccattcccatggtcacttctgtaattcagacatttctcactgttcattgactcatctcaattattatcctactttttttaccaaccaccttctatatcttcagtttatcctccacactactaccttagagatttttttgaagacacaaattggcattttatttcctgatgaaaacacttcagtgtatccctgttgcctgtctcatgatgtgtgactgttttgaagagaaccaaggctcttcataccccacactagcactccagagttccttcacattcaccctacacctcaccattgtccaaagctccaaccatatgaattacttccaaatcctttctctgtctttcttacatccttgtctcttaccctggaccaccctttatgccctggttcatctaacagaaacctacacatgatttgattaaactttaagtgtcacctccttcctcacagcaccccattgcatatttctcttcaccttgggctgttctacactttgcacattttggtcaaagtaccagtacattttactacgtttagttggactagcccctattgaaagcaaaaaccagatatttgtgtcaccagagcttaaacactaatgaacagaatgtagctctttatgaatgtttatgggaagaataaatgataaaattgccaatttgtaataatgataataaaactaactcagctgctaaaataaaaatggtcacatctggctgggcccagtggctcacgcctataatcctagcactttgggaggtcaaggtgggcggatcacttgaggtcaggagtttgagaccagcctgggcaacatggtgaaacctcgtctctactgaaaatacaaaaattagccaggcatggtgccatgcagctgtaatgccagctactcaggaggctgaggcaagaaaatcacttgaacccaggaggtggaggttgcagtgagccaatattttaccactgcactccagcctgagcgacagagagacactccgtctcaaagaaaaaaaaaaaatggtcacatccaaacatttcactatcatggctggggaagatacacaacatcatctttaacaaattcaagaaattgaggaagtcaggaagtctgcatgtgagacacccaagttaataatttagctaaaagggcctccctctgctcttatgagtggctggcacctgcaaaggacagggatttacttttttttttttttttaagacggagtctcactctgtcacccaggttggagtgcagtgacaccatctcggctcccacctcccaggttcaagcgattctcctgccccagcctcccgagtagctggaattacaggtgtgcaccaccatgcccagctaatttttgtagttttagtagagacggggcttcaccatgttggccaggctggtctcgaactcctgacctcaggtgatccacccaccttggccttctaaagcgatttaaattttaaaagctcttgattcatgtggtttctgatgcctagtatgtgtttccaaaatcatctcaaacattatgtcttttaaggattttgcgccagtttgtaaagaattttaaacatgtcattataacatagaaatagtgctgaatcgggaatataataccctttggttacttaacaatatttctaaaatatttacttctagtaacatgaattttcatttagagttcatagagcaaacatgaatctctaaagaaaaagatgtacaagaacaaaacaaaatgagtctcttgtttttagacttgatgttattttgttagtttctcaggacagaacttcctgtgatataattgtgatgggtgttgctagtgtttgtgaatcataactgttgagccctggagttaactttttataaagtacaaagaggaatctcattggtgcatctctcttgctgttctgcatcaaaatgaaagcatactgacattgacaggagccaagtcaataaacatttattgagcagctagcttgtgcagagcactgtgctaaacaaaatagatgacaaagaggagaacaagatgttgccctttactcgggaggctatgatcttaaggggcagatgattaaaaattaaatctgatgaaaggcggggtttggttgctgctattaccaggaaacaaagtgctagaacagcacttttttcaaaccacaaagctttacttattagtaaaacacaatttttcaaaccacaattaaacctttacttattagtaaaacattctctggaatcaatatgtcagcatttaaattaatattgaggtgagcagaggattcacaaaaaacaaaacaaaaatgattggctcatttctgtctgccccttggttgcttcaagcatggtgttttttttctaatctggtgcaattggatggtggcacacctctgaaataagtggaacccctaaagctggcagctcaacatctgtgactccgtggtgcatatagaaagttcctgaaaggccagcaccaccaaaaatggcagagcagttggcaccctgggaagtgacactgtagttttgccactgcaatgagtgcctaatactcttttagtgttccagttctgccattcacaacctgtggccttttaaaagccctgtggtttccttatttataaaatgagtaggctgtgctagactgtagaatgtgtctgaggttctttctggcactaaaattctgtggaccttactgtgaagttttcataagagccaggaagttttcctccttggcttctccgcatcaaatgacccaagagaaaaaaacacattcttgagtggcagagaagtacctcgcttctttctaaaatatcccttctgatttttccacttcactaatgtttctagaaccaaccttctttctaactaagttctgtatagttcaacttgagtatcaaaggaaaaataattatgcagaaattatatgggtaaatatgatggcccagcagtggaaagttgatagtctctcgagggtgggcaggcggagcaccggacacttgagacaaatgactctccataaatgtagacggagatgatttgtaaaaaggactatttgactcagcaagtattagccagaaagaagagatacactaaacttgaacaaatcagtttaatttcccaaggcagtatctgccatggcatcctcatgttttgcacatgttgtaacagatgaaaattttagatttttacgttttatgcttccattaagccaacagagtctttgcagattttcattgtgttttggggttgttagcaaaatgtgttctattggcaaaaagatttctgctttttagtcagcatttgatgagggattctgttttgtttcgttttgttttgttttccagagggggaaggggaattagaaaaggaagccgaataatttaaaggctgaaattttaggtagttcttttttaaaaacaaaacgaaacaaaaatatcatcttcaaacaacacaattaaaaggtcctaaacttccatttaaactgaaagaactttgcaaaagaattctgatacatttatttcagtgtcatctcttgaaaggacaacattcaacggtgcacagtttctgacagccaccactctctatgacgtgcatagcaatggtgccctctgccctcctagagtcacaggatgaaatgggtcagcactctgggagcttggaggacccaatgctataccaaggcccaaatagccaagtgcctactatgctcccaccactggtcttagccttaggattcaattaagaacaaaacatggaatattcttgccttcatggaattaccttctaatgagctaggtagacaatagtcttatgtcaagttatgtaagtactgagggttatacagtatggaacaggtttcagttctttcctggaagttctcagaattactttaaatcaggagaaaagtcaccaaagaaaattctgacagaaatgatccacccacccaagtgtctccaaaattaggaatctctccgaaataaagcataccaagtgtgtatgcacatatatgtgcatgtacacatatataaggttagcaaagactaaaaagattgtgccttgttgccaaacagaactacacacaaacaactggtaacatctaggaaaacagtagtaattttccattaccttttgttgaaagagaagtggcttctcccagtttagtgtcaaaatcagagtcctagcctcagacagattcaggtaagtcacccagagtacttcagttatgttaacaaccatatgcaacaatagaagttctttggtcctactgtgcttttgcctttgggtaaaaagttacacttatggatcattgggaagagcctgtgctgtggagtcagggggtgaggggagtagacctgagtcagaattcctgctttgcctcctaacctctgaacctagaatttttcctttataatctggtgataatgacttcacttttgtcctgcatggttgtgttctacgttgtataatgcacctagaacataacttaggtgctcattaaatagtaaccagtgtgacacagtagtaagaaatggtcatcttcatttttaaagaggatggcaagaaaatggcattaatccctgtaatgaaattttgtgtatggtgcagatcaacagcttaggagtaggagatttgattggaaggtgagcaggttcctattcttcttagtttaaatataattttcccagttatataacgtagtttgtaggtgtattaggaaagagattaataaccatattgtgcctcagtttctatacctgcaaatatatggatggtttgaaagatgaataaaagtatacagaaaacttcgaagtcttgatgagagaatattgataattgtaaaggattagagtgattattgtgattacaaggtaagaattctttccacccaggcgactggaggaagacacagaaaatctatcgtattgcactgctgatttcaaaggagttgctttgagactactaaatgctgagaaattgaacactggcagtaccggctcactaacaattttgttgttttcagtttttaagttacacaagagtgggtgaaaaaaatttattctaggtgcttttgcaatctagtgggcttataatacccaaaaggctataggatcagtctgttgtcttctgcttttcttcccagctataaaaattatttctgcacactttcatcagcactaagcttcttcagggcaataagagatagaagagaaacacctggttcctctgtcaggtatatttcagttctattccccacccacattgttagctcagctttgagggccatactgcttctagtggcccctctttgttttactgccaaatgcccccaaacgagaataagcttacctgacaaaattacatctcataaattaaaaataaggtttcttccttcctgcttccccactcttcactttataccacatacatgcccacatttgtatgcatacagaccaccagaggaaggatgagaaatggaagaacagtggttcatctctaaagtctgatactgctctgtggaggctgttagtgtttggcctccacactttaaaggtatcttcaggtaacctacactatctattattttaggggcaagaatcaccaccatttcactttctctttgtgaattttctcttctctgtgctgccagtcagcatcaaatttggactgcattccaaccaaaagaacttacagtttttgttacatcactgtttagttggccctgttaatttagtttttatattaacattgagatattttgtgattgatcacaaatattagacattcagtctatagttgttatcatcaccttatttaagatgtaatgatctaatcacagtacttccagaggttctgattattaccagggacaaaatgtcctgtgcttttggtaattcccagactggtttgagggcacatcaagaaagatctcaaagaagaaaaggcaaatactacacactagtgctgtgtaaacccaaccaccataattctaattttatttgaatgtttggtggtcataaatagctacctattttctttaaggtataattcacagtggacattttaatatgcaaaactctccctgctggaaatttgcaaacataaatcaaaatgcagtcttaaagccctcaatgtaatgtaacagaagagcagaaaagcactaaaacaaaaggtatgacatttatttttacaaaagcaatagacacaagatggataatatataaacttcattcgtgtcctacttttgtgatctattgttatctgaaacattaatttcatatatcctgttcctctcctctgtaatcacagtttaaaaacaacttggattggcaccttttctatttcaatattaggatttttgactagtccagagccaaaaaatatgcaactgttatttgtaattacctgtaaaacccatgtagaattcactgtcactaaaccagaaagttcgcaattgagaaactgaaccctaaaaccactgggacctagatacctgttaaattaacttttatagcagttaaaactttaataactataagctgtttacctaaaaaatttgctgccacgtttgctatgaaaatgtcgaggacacatcagaattacctttcagaagtcatgcaaggaacaatgtttccccctaggagtagtaagagcacattttccattttgactttcttgccagacagcttggaatcgtatctgaacctgaattatagtaactgtctgaatatatataaacatagtcataatatatttcctaatcatgatttttgtttattttcttttataatacttcgtagtcacgtcaacgcaatctatttgttctacatcgtttctgatctctcaattttagtctaatatccctgggtttacacatacatgtttttcttgtgagtcaacacaaattatgtgggaagcaaatagagtttaattaaaataaataaaattatattgttgtaatcatcaacctgcaagaaatactaaaatactgatgactcggctgtaatgaaattaaggaggactgatattatcagtccccccccatcctgtttaaaaatgctttctcgatttaaaacaacagcagtaacaaactaaggaagaaacatgttgatcaatcattcttccccatctccaagctttttttcttcctaaagaaaaattaacagaaatgttaactaaatttttttaagtcccaaatcctttatataaaaagtcttgataagttgttgtagacaaaacccattcttagaatttatcagtcagttgttatatattgccctgtgctagttatttttaagagatcaaaataaaattcacttctgacagcccaaaatagttactgacattgtaactaaagcaacattgtaactaaagcctactttgtacagctcacctggcagagcagggtctagaaacagttctgatgtaacctaattgtgctaattactgtacaccccttctgtgagtaggataattgtcatactaacagttgccatgaaagtagaacaactgcagtgaagccattagatgatgatctctgactaccttaaatgtatgcatgtatgctgacatttaagaggttatctgaagtcaagcagtatccatttttccaatgagcaagtaacgatatatgtagtagtctactaagatgagaactttagtcctgttgcgcaaaatttctgaacacatgattattaatatgcagtcttcataacatctgagcagagagacatgggaactttggctcctatcctcatccctcaaattatcatctgggagccatttttttccattttttcattcagcctatagttatttatgcatttttctcatctcctcaactaaactagagtctcctgaagtcaggaactgtattttataaaatctctgggttctatacagagccttagacatggtatagacagacagacagaccgacaaatctacttaagaatgacctgggtttcattttaaagtcatacaaaaatatatctttgctcaattagctggaatgttgtattttttgaaaacacttttaaatggcaataatcagagacatattactctaagacaactacttgagatatcttagttcccaaaaaggttctttgtaaaccaggaattaactatttttaatatacttggatctgaagttttaatgacccacacttcagtattctgtcaactgctccagaatcgttgtcatagttacctagtatcaggaacataaagctaaataaatttcaatacaatcttaacccattgcaatttctgaagtgatacattttaataggttttgcaacatcagaggcctccataaaaatccatgcaaataaaataaaagattacagacttgaatatatgctgatgtttttcaagaaatagaaatgctttcaaatgagctctcacctagtgaactaattttaatttgttgatcatgtttcaaacagaaagttaagattcatctaggaatggtaataatgctttaattgtgtgagtgggttgaatcagataatgcagtatcatttgtaaagagttcttatgttttctacaggtggataagtggagcagctgtagtcaatgcattttactcttcaggaagaaatcagataggtaaggtgtattcttaaataattatttaatatttctctatcgttcccaacctgtagtgcattgtatgaccaattacaatacctctaaacaagcacagctgaggctgagttattgctctattgaatgcatttcttgaaagtaaatgcatccgtgtaccttctttcactatagtgggaaaattcagattggtacaaatcacgttaagtagttttgtttcttttacaatattcttatttatatctaaaatggtttatcttatttctaaatatttttattttatttctaagtaccttttttaaagtcccttgaatatatctatataaagtcatattgactttaagactcattaagcattagcttcttaaagtggtttaaggtttcaagagccaacttttcacagatccagtcctcctggcaattctgtatgctggctctgtgagagatgatcctattctatgtcatcttcattcaggaaggctccaaggggtttagaaagttggaatctcaattatattcgattgaatcgtatgaaattgtatttacctagccacaattgatcaaaaaagaaaaaatttcgtaagttcgcttatagtattattacagacatatatatacattaacacatgaataagttatcatatatgatgaataactgaatgacataatatgacaaaaatattttcttcttcttgggaaggcctggacatctttgaacatacattggctcacatatatcacttatcacatacattggctcattttttttcagggggtttttagcattagaaaggtactcaactgattcagtactgccagaaatattctaaacaaatagtagagcaagcttctgcaggtgcactcagttctccaggtacactcagtcctgcccttcatttctaaacgtggtctagaattaagagagatgataatctcagcattattctaaaccattcttcttatagctcagagtctgttgtaagcctcatttttattgaattctattaccaattagattagaaattataaaaaatcttacaagatatttatcattggctaaaaaaaaactaaccttaaaataaattgtatatttttaggttaaagtttgattatacctttccccgttgctttcaagtctaaaaagagttaggttaagaagttatctacagtttcttctagtatttttatgatttctatttttggagtaaaacctgaatccatctggaatttacgttggtacatgacctgaaactgaattatataaagtaaccagaaaagactgttttgtataacatataaataataagtaagatatgtttacttggcttaaaattacttagctcaaagtctaagctaatgctttctggctagggaaatgattacccaaacccataccagaacgtgcttaataatcaactcctcagaacctttgcagtcagtcctttataatatattatttgaaaccattcaaatcttgttttaaaatgcctttatctctagagagtcttcactttgaagccctctttttaatattcagtagttctgtcagtgtctagttcatttggtactgagacaaacgtaataattaactttcaatggaatcccaagtcaaagcaaggcaacttagactccttagtgctgcattagagcagaataagggatgcagcttcatttcagtccagcccagggaggaccctggatcctatcggagctcatgctggtgcatcctcagtaggaccactctggcatgttcagtccttcagcccttctctagagtaggctcaggcatttatgccaagcaggaccttgtttgattctgaattaccccaagcccctggaggtggctccaaattggcccacttcagggattccccgatcagagaagagctgaaaatattttcattttgagtataatgtcttgaaaccaaagaagcacacagaaaaaggaaaaagaaggtaaaagtggcccaatagtggtctatttcacaaaataaacaataatcctctggtaaatcaagaattagctataataacaattctgaatatataaaaaagaccttttccaagatccttaaaataaggatccaatggaaatataaaataagaaaacttgttaacctcttttcatatgcttgtctggttcttgaacagcagaagaagggaaatccttgaaatgtacactttttttctttcacaatttaaatcttcaaagtggggattgtcttaactaaaaatagttgaagagtcaaatctccatcttttttcttgataggaatgtttatgtgggctgggtgtggtggctcatgtctgtaatctcagcactttgggaggctaaggtgggtggatcacctgaggtcaagagttcgagaccagcctggccaacatggtgaaaccccatctctactaaaaatacaaaaattagcccagtgtggtggtgggtgcctgtaatcccagctactcggaaggctgaggcacgagaatcgcttgaacccaggaggcagaggttgcaatgagctgagatcatgccactgtactccagcctgggtgacaaaacaaaactctgtctcaaaaaaaaaaaaaaaaaaagaaagaaaaagaaatgtgtatgtgtatataaatacacacatacctacctatatacatgtcttctgcaacactgtcttaatggatttgggataatgtccattataaaattagggttggtatagagtaatatgtgccacgtaagtgagcccctccctccatacacacacatagacatacaaatactccaaattagactgcatacactttctcacgggattggtcattttatgttgttatgttaaaaaaagaacttgttttgttatatagagacttactcatatcaataatttctacttcttaattcagttttcaccattttgttagaactcacacatgtaggctacattccaatttgtatgcattcctactcttcatatcaacaaaaaagtcaatttccaagaaagaaggcaaactaaaagtgcttaatccactgttcctcttccttgcatgtttacttcatggagctctagaaggcccctgtgccatgacattaggaaagctgcgcttcaatgttttgtcatatggttctctgtaagttctaggtgctgttcagtcatcttattaaaccttaaaatcgcagtcaaggaaataatttagtgtattctcctttttcattaaaattgcagaaaggatcttttaaatcaatttttttaatttctcaaatgtgtaagttcttcagtgtgttcagtctgtgtcgactataaataccttgagatagttaaattttctaaattgccttatttattcttaggagttttattttcagacttgaaaattaagactgtttccaaacatattgttactccatttaatataaaaagaatgtttagactatgcatggtggctcatgcctgtaatcccagtagtttggaaagctgaggtaggctgattacttgagctcaggagttgataccagcctgggcaacactgtaaaaccccatctctaccaaaaactacaaaaaattaactgggcatggtggtgcatgcctgtggtctcagctacttgagaggctgaggtgggaggatttcctgagcctgaaaggtggaggttgcagtaagctgaggtcacaccactgcacttcagcctgggtgacagagtaagaccctgtttcaaaaaaaaaaaaaaaaagaatgtttaattattttccaccaaaaaaattacttaattgctgccttaggctacatatgaaatattctaaaattgaattgctagcagccttcagaaaataaaccacagaagttgtgctggggaggcaaaaacagggggaagaggagacatggtcttttgcttcatggcccaatgacttatttaattaactaacttgttgacaatcatgaacataaaaaatgcacaactaagcagttggttataaacaacagttgtgatgcctactaggtaacagcaataaggctagtggggaaaatcctccttacagagatttagctgacaaagtaaaaggggaggtcataattagcaaagttgaacttgaagactaatatttaataagaaccataaaagtcttatcacttgcctgaagaatggcatatcagggtatgattaaagcagcaggatctttgtagttaatatttagtcttgatagcacatttcataacagcattttatataatgggtggattttaatcaaagtacatagtgtgggagatagtattcactttaacttaataaagtactgcacataatttttatactttaaggtaaaaataagttcatggctccatttagctcaggctgctacacgtgaggtataactttcataaaaattctctaaagacaaaagtacttttttgttgtcgtgtcatttgaatgttatggcaactttccaaatttttgtagaggtctggggagcaattaaattgctcagatgctttttgaagtcttctctgtaaatatctaatatttatccctgaagcccatgcaaggttatactgtgttcagcccacctgaaagacaaagaaataacatgtgctactctgtgttaactagatcttaaatttcttaaggtcagggcccttgttttattttcttaatgtcctgcatagcaatgacccagggctttgcacttaataggtattgatactgaagggtttttttttaattacagaaagtaacgtttcagttattcagtggatgctagagttttaagccattaaagatagaattactaaactatgaacatttaattaatttaattttaatttctttctaaggtcaaagattagttacctccaaataacatgacccaaaatttgattaaacaggggaaatatattccaagggaagatactctccatcttttattagtatttaagacacattattagtatatttcagaaatagtgaaatatatttcatgagagtatatattataagaggatactggaatggggcagggaaggggagggtatgatggaggtggagaggtgggagaggaccctggggccataggccagaaagatgtgtttagctagagagcaatggtaagccttccaaagatttttagcaggagaatgatgatgcccagagttgtctttaatctggctacaggatagattcagagagtagattagatttagaatagattgtagttgtgtgagacagaaagtgggagactgattaggaaattaagtcattcctgagacaaggaatgagagtatgtgtaaacagtaatactgacaggagaagataaagatgctcctgaaagctacctcacccagcctctgcctaagcagacttgtaaaagactgtaaaagaaaggaggcatctaagataagtagaaacatttacttttgctgatagagacccttcaagggccattagcagaaataatacaaagactgagggcctagaggggaaaatgaatttgatgtttgatgcattaaatataacacatttgtgagacatctgaatggagaaagttagcaagttaatgcagatgtcagagtagacatactgaaaactacaattcatttatttattcactaaactctgtaggacacattagtaagttagggtgatcattcatttatttatcattgattattcattgattcagcacatttcctgagccctgattatgttccaggtactattctagttttaggcattgttcaattttaggcatttagataatgaactagaaaaatgtatgaaattaaaaaataaacaaatatatgtacagacacagaaatctctgctctcaaagggctaatatttgaggagctggggtaggattagggcagacaagaaaaggaaggactgtgatcataaagaaataaatagaatatgaggtagtcataagtgccttgatgaaaataaggtaaggttatgtgattgaggtataccttcaattgagtggcaatacttatttaagatattattgtagatggatacaatttctgcaataacattaaaaataatattggtgttactgagtaactatttcttccaaatatttataaggcagaaaggaccttctgaatgaaggttataacttccctttgcttcaaactccttacagcacaaaacaatcttggattgtaaagtgaatcgtgatgataaatcatagtttatagcaccactccaaggtgaactctgttgtcatccataataaaatgcctgcattggtttctattacagaaggtttttgtatataactaagtgaaactgacatagtgaacagcagcttagcaagcacaaagccaaccccaagcctgccatcactgaataatgccatggtggcatgcgcctgtagtcccagctactcctgaggagggaggactgtctctaagaaaataaaaattttaaaaacttatgccacaaataatctctaactatcttctctccttgtagtcttcccagccggcattctgcagccccccttctttagtgcccagcagtccaactcattgaactatgggggcatcggcatggtcataggacacgaaatcacccatggcttcgatgacaatggtaaagtgcagttgacattttcctttggctgaggtatatgctcataaatttgattaagagttattataatttattactacaaagctacatttattcaaacatgtatcatttctctaattttcaccacactttcaattttccctttaaattgttgcttaaagagatcagaaaattctcatagtgagttaagcaatgtgtgctttacactctggcagaatgaagtaaatattcccattgggaaaatactatggtgtttgtcagcggcagtgataatactaggtcttagtttcctggttgtatatgacgtatcttgtcatactcttaaaggacaggctgcatgtctatgtcttaaaatcagatgtaaaatcagaaaatattgcctctccaagagctcaaaagactcttaagctgcttaagagaccttttttttttcgtcttgtacctactacctagttcaagtctttgcaaacagttaggcacttaaatgccaccctaaatggaaaaatcaatttagagtttcaatcaaagctgaattcctgagaggaataaagacgtgaaatatgtaaagaggtgatagttcaatctatgacaaatttcattcacaaatggaaagtagagaacaatagagagaaaatacttaatccccattttagagagccagagaaagaaaaagagacagaaatgttagaattcttaaaaagacttactaagtgtctattaactcaaactatgcaacagtctttacaggtaggttctaatactgtttctgttttccaagtggaaaaaaataaaaacacatgaaagatttgcccaaaggtaacaaagataggaactggtagaaccagaaggtgaattcaagtaggttggctacatagcccttttcttaatcactacgtcataggcaaatatgaaaaagatggtaatattgtgtcaaaacacatgatacatataaatgcaattggagctcaaaagggagaaagatcgatgtagtttgtggttggcagggaagctgtaggagaaaaagactttttttgtgtgcttgaagtagagggaaactatgagtccacagtgtcctatgaagggtccaggaatataaaaatgccagaataaaaatgttggccattttaaaaatctcaaaatatcaaactaaacagacttgggtcaggtaaaaaccattcaacagaacaaggcataacttcaagaatattttgtctggcggcctcttctgagatatcaagagccaaatgggtgaaatgtctgggtcaatgctgagaagcattagcaaagaaagctctggcagtccaggctttgccaactctgtgatgaggagggatgacagtctctctcatcgtctgcctaatttaatgttctgtcacacagcagtatttcagtccttgcactttgaattaaacatatcttataattcttgttgcaatgagttcccattttacttaaataaatatattataggcagaaactttaacaaagatggagacctcgttgactggtggactcaacagtctgcaagtaactttaaggagcaatcccagtgcatggtgtatcagtatggaaacttttcctgggacctggcaggtggacagcacgtatgtcattagcattctcttgaaaagttttagacatgttcaatcttaagtgtattattggtggtttctttttttaacaatcctaataaagtgtcttttttaacagcttaatggaattaatacactgggagaaaacattgctgataatggaggtcttggtcaagcatacagagtaagtaaaaaagattttctttccattttagtgatttagagtgtttctcatatttaataattcatttaaaaccttttgcaaaaaaagaaactcatataagcagtaaatgatgaatagaaaatggaaaaaaatatgagaagaaagagtggtgaatatgctaaccataagggtcaatacattgatgtgacggagctgaacacttaagtttgcaaagagccaagaagaagagaaaatatggaatattatatcagctgaaatgaggagagagcaggttcacaaaggaggcaacatttttctaagaaataatctctggaataatttttttagaagaaatgtcccataagaaggattatttcagggtctttgaccaatataagaaacaggaccttcagttttgtagcaggtgaagtagcatttgggaacaaaaatcaatgtaaaccacaggcatattaaaccatagttcatatatgatacagtaagggactgacgtgatatggttccagcacatggccttgtagtcaaccacactattatacacagaggactattaacagtggagcatccgttagaatcccatttagccttccattcattcttgcattcaatacatattcattgaggcttaataggtttggcagtattcaaagagctggagataaagcaatgaatgctttatgaaaggtcattatttgaggatctgagcaagggttaaaaaatagtctggtggatgccatgtgcataagaaaaagcagggaatttcataaaagggtggaggaatgatggtctaggaagcaacaaaaaggaatgaagatgattttgagtgtttttctcaactatgaagtagcccatatgtaggagaaagagcagcatctacttgagatgtcacaaggaacaacttgttcctaggctagaactaggcttctctaagacaaggatggatggaatgatcagtggagtgaatgaggatgtagaatcatttgttcattatagaaatgtttggattagagtggaggaggtgaacatcaatggttggatcagggaagaggaagcaccagagaagtggagaaagaggtgactgatggggcctgcagtttgtcagtgaccaaagatgatcagagtgtgaagcttgggagattaagtcagctacaaggtttccaaaagaatgagtccaaccagttccagggacatgggagattgctgctactttgaatgtttagtaatttttttgttcgatgccagacattatgcattttacctcttttttttgagatggagtctcattctgtcgcccaggctggaatgcagtggcacgaactcggctcactgcagcctctacctcctgggttcaagcaattctcctgcctcagcctcccaagaattgggattacaggcatgtgccaccacacctggctaatttttgtatttgtagtagagatgggatttcgccatgttggccaggctggtctcaaactcctgacatcaagcgatccacctgccttggcctcctaaagtgctgggaacacaggtgtgagccactgtgcctgaccgcattttacctctttgggtctggatgttcttttgttcctgtaaatattcttgagctttattctaggatacagttaaattccttgaaaatggtttgatctttttgggtcttccttttgtaacttttattggttgggatggggacagtgttcagtctagggacattattctcaactgctgagataagaatctactctgtgaatcttggggatttccattcttgtcctgtgtaagtaccataaattattatctctaatccttttgagatattgttttcctagcattgggtattttgctcacacacatcttcagatcaagactaagctgaatgcttgaggatgaccatctgtaatctctgaggttctctttttgtgtagctttctcctctttagtaacctgttcttggtgtccctgaactctcagctccttatcctcaactcaaggagtacccccagctctgactggtttgctcctatgatatggcctgaaaactctcaggacaataagctcagcagtcatgggactcactgagagtaaagtttaacatctctcaggggtcattctccttttgcctgatgttcagtgttatgcaaaccattgttttaaatattttgttcatcatttagttgtttccacaagaagttaaatccagtccctatcattccatcttggctgaaagtggaaggcattggcactcaatattcccatggtgattctaatacacagccagattgagaatcactgctataaaatccagccaaagttgggattgatagtactcccatggagaacctcacctagagcaagtacagaattgttaatgatgaagcaaattacaattgtgcaaatattttattacactttgaaaatatgtaaattcttaacgtgtaatgccttgcccccctgctagattgcgagctctctaagagggagcaggtgcaagcctttcccatatccccagcatctttacatagtagaggttcaataagtctatgttgacggtaagtggaagaaatgaaatatattttctgctcatctagttggtcacattcctttgtattaaattggaaatgacacatctcagaacgtttattatgaattcgttttaaaagtttatttagtagaggaaaactcatttttttcagtagcataaatctttaagaattaagaggattttctgacattcaaattacctaaatattttccttcaaatgtacctgaggctcagtccattttgtcctgtcttcaaaagaccagaatagttgcattttattatcctcagactcattggagactaggcctctaagggatctcaagagaatcctttgacttggcaagaatcactcgatcttagtctggtgagtctattttgctaagatagtagtaactaagttaaatgtagcaattgcagacttccttggcaattcatttgtcctgactggtcttattcatcaatttataaaacaacatttagataagtttttcatcacttatttaggtcatccattcattcagttgacatttattgatcacttgacatatgccaggctcttgtcatctactattcagtagcttcttcttttcaaagcatttgtaaataaatttgatttgtctttctaatccataaaatagttgtaggttaccataactaaatgtattatcagggtgattttaacataaaatgttaattacttggtggcatgatcttttacataggtttatatataaccttaggaattaatattattgtttttctattttatcaactgcctaggcctatcagaattatattaaaaagaatggcgaagaaaaattacttcctggacttgacctaaatcacaaacaactatttttcttgaactttgcacaggtattgtgtctttcttgattgatagatatgaaaaccattttgagttataatttcacagtaagttagatgtcacatgctgagttcccttgttttacagagcatttgacttgattcactttcattgtttataatagactgttggatcatattaatgataaataactatgttcctggttgcctttcattgaacattatttgaagagcaaatggttgaggaatgcagaattccaatttaatttttctccttcccctcaacttgctcaaacaaataatccttgattgaacctgagtacatgctttgcttttcctattcctatctctaggtgtggtgtggaacctataggccagagtatgcggttaactccattaaaacagatgtgcacagtccaggcaatttcaggtgcgtggatatgaacagcaatcaaggtgctcttatattgggtccattgcttccacatttggaatttagacttttctaactctgattcttttacatttggaaattcagtgctttttttttttttttgagagtcaaaggtaggatcgagagaacacatcggagcattctacataagcatagccttggccactctctttcttagaatctacaataattataattccttagaatctacgaggctcagggcttgatctattccaacaaagatgtcgcctcagaacagtggctcaatttaaagctagcacaaagatatttctaagaggctgtgaatggtttaggcccagacccaatgagctccaacttgcaaagaaaaatttcaatataaaggaaactttctactaattagaggttcttcaatatggaataacattattcccaaagcttcaggagagagtacattgaagcacagcccatcaaggatgtgagagaaaaatgctctacagagtagaaaactgagctagaagaagttaaagttcttcccaaattagaaaatcaaagagaacaatgattgaagagagtcactccaaccaacatttgaatgttaaatcatagatcctatgtatttgtttaagaactgaattcctaatgctacccctttcccatgtactagaacacttagtcactcatttgctgatcaacaacacctctcaggcaagaaagttaaaaaaaaaaaacctaaaaattttgtagggtagttggaaaatgaaatttgagaacaaaagagaactaatgggctaaatttcaaaagctctacataaaatgaatgtaagcatactgcccagatcatttactcctgggaaaaaacacattcgattatggagaaaaacacatttaattatgaagcaataaagtagttcatttaaaaattaaagaatttattcagcttgctagtatcatcgttgtcatcatcatcatcatcatcatcatcatctagtatttgccctaacatttctttcaatattcattcactcaataactgcttatggtatgcctattatctctgtaatccaagctaaatttagttctgctaagatattcaaattaactgctttataggtaatgagcaacaaaagtgactggattaattcccattgtggtttattcaaaaaacttttagttttaatttttttaaagttgtctttttccttactaaagtgaacttaagctttgaggtaagaaacacttgagttccaaccatggcttcaccatttactagctgttaatgtaacctctgtacctcagtttcttgatatgtaaaataaggattaaattatcatgagagttgctagaggattaacgttaatataaatgaagagcctattttgtgtgtgtgtgtttgaaagtccatactaggattatttgtagacaagaggtatgaacagaataagaattcttatgcattttgtaatagttccctatcagtcaaggcttttttggtgctcatttcttatgttctgcacatttcagaatgttagtaactgatcagcagttaagtaaaacgtacataagtatataactgttttctagctccaattttaaactgaaaacaatattttgctataaattagttaaattatttgtatctttaagtctttattgttgttctggttccaaagatccctcatcgactatttttcattcataacaacagaagcgtgtgtgtgtgtgtgtgtgtgtgtgtgtgtgtgtgtgtgtgtgtgtgtgtgtgtgaagggtaaatggaatgggtaaatggaatgccaaccttttgtcaaggaaattattgttttctctggaggtaaggagattttcttggcaaaaggttgagcttacatttagttttggaaacaggccacttcctggctgtacaaagtaaaacatattttttaaaaaaactttaaaaattaatagatatcgagttgctatttaagaattgtgcttggtggttatatagaaatatttctgaattagagagagatttgtaaccttatgtttaaatagccatagtattaaaacaaaaggcaaaatacacttgatacaaagctgcatcataaaaccatatttgctatgtctaacctattgttgttttattcttcctgactaaagctttatttatgtactttaaaataaactttagaagttaaggtataagaatctaattctaaggatagcagctagcatttataagctcataaaaaccaccatgcaacctaatttgtcaagggtttgccctgcatatctccataaactaaaacataagtcataaaaacctaggtgaatttcagtaatattattgtaatacctagtatatctaccatcctcagagaatgagaggttgcaaattaagttttgataggtaaagtttgtctcttttaagtattaacatttttatcttaaccactggattaaaaattatctattaaaaacacatttctaccttcctgccttaaaacaatatcctgaaaaaaaaagcctaaccttttttaaaattttgatgacacagactactttatgattattagttatggttttactgtttattaatttagtctgtggagctatttattcttataccaattgtgatgctttttgacttattttgggtttttattagggtttttctgtgtgtttgtttctttcctagttttctttcctattattgtattgcctgcctttagttccctaattcctccattttgattagctcagaaaacattttgttaaatttaaatggtatttaatccaaaaacattcttcttttaatagtctagaaattgaatctataatttaaatattgacttcattttggaaatccagtttttggttagccatctatagtcatttcagggaatatttattataatatttatatgtaatctataaatatgtttctaaaattatttagctgtaattttctatataatatgtaagggtctgataattttgtaaagcaagtccaaatagacaaaatgatttaggtgcttagattactcaacattatcttccagtcaggaagaaagggcacttttagaactgacaccactatcaaagcaagaaatgtttctcacagcttaatttctaatattttgaaggaatattttgtctagtgttttatatagacatgttcaactaatatggctattttgttccttcataactctgtaatttagcatgctaataagccctctttgaaattcttctgtttcttccatttcccttcaatattagcattggttcctgatatttatagatatcaatatagattttagtgagttttgcagaatttctgttagcccctccaatctttagctgataactagaaatctattacagcatttatttatttatgactgtatagcagaacatacactcatcaatatgactttgctttgaaagaatcataaaaattagttaatgatgaagattggataccttattcctgaatgaaggcagttaactatgtagccaagtcattcatttacaagaattaacaaaaggttgtctgaggacccattaattgcaaacagtaattcagaagtccaattgtagtaggcaggaatagtcagataggatataaagtccattcttggtcccaatgccaaatctcttagatgtttttaatgcaagtaactgtttgccaagggaataaacatcagcagtacaataagttattttacataataaagtaaaaatttcaagtaaatcaccttaagaaataattaataaaagctttattatcttctgttattagaaacacaagcacacagttttgtaaagcatgaaaatcatgtacatatcttctaataacagaggataattcatgtaatgtgatctcactcttagaaaaaaagtgttttattaataatggattcacttttcaaaatagattatctaggcctggcacagtcactcacacttgttaattccagcactttgggaggccaaggagggaggatcacttgagctcaggagttcaagaccagcttgggtgacatagtgggacctcgtctctattaaaaacaaaaaaattacccaggcatgctggtacatgcctgtagttccagctacttgggaggctgaggcaggaggattgcttgaacccaggaggtcaaggctgcagtgagctgtgatcgtgcctctacactccaacctgagtgacagagcgagaccctgtctcagaaaaaatagatgatctattcaaagatttgatgtcataaacaccaaatgttaactaagaaagtaagtgaagccctagtgtgttgttgatctattcaggatcaaattaggtagagtctttggatggaaagaggatgggcagaatgggcatggagagctgagtgcacaccaggctgagtatttctgcagtgcccactctctgcggtgttatctgaagacgtttctttcttttaggtgttttttgtttgttgttttaacttaattttgagatttataaatataaatcctaaaaatactttttaagaaaaatatagaattaagtcgtgggtttggacattattaccgaagtacttgttcccatatgataaaatctaagaaaaaatcctttggaaaaaattaataaaataaaaacaaaaacatgcagctcttccagtcagtgatgctgatggcttaccctgtcaaccagggagcttgctccctagtgtgaggaatgcccaggatgacaggatgactgtctttagccagtagctaggcatcctgaattgggaagaaggttgcattaatgaatcaaagctcctctctaacataaagaatccttgagtcccgcaacctgaaagactaaagaccaatgcaaattcctaatttctaagctcttttaattcctacataaacagtcacttttgactacattatagaagtgatttttttttggctcatgaacaatggaaatttgtttctcacagttctggagaccggaagtctaagatcagggtgccagcatgatcaggttctggtgagggccatcttctggtttgcagactgcagacttctccttgtactctcacatggtccaaatagtgaatttgtttttcaatatttcagatgtaagaaatggacatttgtttttttcaatcaaattaagccaaactctgagctcttagaccaagctaggagatgagccatttactttcagtggtttttcaacgtactctttcagggttattcaggaatctgatatcatcacacaggcatagaaattagagaatagcctccatcttcagcccaccgtggtcactgctgagatccctacagtccaaatgctccagctggagtcagtggttccatttccttccaatgctcatgagctccagagcctccactcttcatgtccaggttctccaacaaccacacgccatgctatcagagggcctctcggggccttgctcagagcaggaagcatcttcttgtcattcacacaacctgccattactggaacctaccccattcttgggaaggccaatcatctccctgacaagtggactaatatataaattccccagcttctgactccacttcacctcaaccctcccacaccaggagattatttttcgtctttaagactcatctaggaatcctaaaaaacaaacaaccagaaaagattacatcctccatgaaagataggagagttgtggtggagagggatagagaagttagttgatgcgttgatgggtgacatattagaaagtcagacttacaaaaaatccatatggatctctcttttctggaatgaggaaagggaaagaaaatgctttctttctcttccagttggtccataatatcaaacaaacaacagaaacactaagtcgtgtttttcttcctaataccctattgcttctctacaggtaatcactgtgaccaaccaggtcacaggttaattcattcagtatgtactgagtcctgtgctggactttgggggtgcagcagtgagcaagacatacacagtacagcatcttccctcagcatctgtgggggtttggttccaggctccctgcagatatcaaaatttgtggatgctcaactccttgatataaatggtgtagtatttgcatataacctatacaccttctccctcctatactttgtcacctctagattacttataatacctaatacaatgtaaatgctatgtaaatatttgttatactgtattctttagggattaatgataagaaaagtaagtccatacgttcagtagacaaaatatttcccccacatatgttcagccgcatttggttgaatccacagatgtggaactcaaggatacaaaggctgtattttgccctcatagaaattagtctagtgggtgtgtcaggaagtaaaaaaggagaacaaatcattgtaaatgtggtaagtgctttgatagggatagtccctgtaagaggagttagtttagatggcattcaaagaagggggccaaggaaggaatatttaagcaaaggcatgaaggctgaggagttagccatgtactgactggtgagtaactttccagggagtagggtctgcaggtagcaggaagctctgaagagggacagggtttggctggtttgaggaactgaaggtaggtcagcatagtttgagcctaaggaggaacaggaagagaaatgtaccacgaggaggctagagaggagactggagccatcaggaggacattggaagccatggacaggagtttagatttccttcaagtccatggaaggttttaaatctgagattatggaatctgatttaaattttacagatcattctgactgtggtgtggagaatggttggaggagagagaagtcctaagatgtacacacagtagtacacctgccacgtagggagaattccataaatcaaaatggactcacctgtcatttgtgcctagtccttccaaaccagtccacttgtctctgggcccctcctcccaacccaagcaaacgtggtaggctggccttagcaggaggagaagggaaggaggtggttcagggttcagggtgggtgtgaaaacatcacctctgcatcaatgtactgacccatctctcccctcaaacactgctaggtgcagatagtgagttggactgtgttgtttttgcccactggggtcagagataagaggaaaatggcattttgccagccctttccagttattcaagctgaatccagcttctgatatttaaggagcccttttggaaaaaaggaaaataatcctctataaaagcaacaaaaaatatctatttaaagtctattatatttaagtcattatgtgagccctttcaagacatagtgagaaatcatgattatattctttgaccaaactcttattataatacaactccaaatacctgcattttcaaatgtgaattattcatgttttacaaacacatataatgcttataaattattaactctccatgacaaccttaagatgcatgttctattgtgcagaaaccaaggcacaaagaagcttcataagcaggattcaagccatgtagtctgtctcccaaattgcttttaactcctgttctttgttacttctccatttaaaaattctgttaatgagaaggcactgactcattgtaccaggttattttaagtttaactttaaattccaaattcattcacttgacctgcagagggaaatgcttcagggctccagtgtggtatggacgtgagtatcaaatgctgacggtgactttttttgtttgtttcaaaggattattgggactttgcagaactctgcagagttttcagaagcctttcactgccgcaagaattcatacatgaatccagaaaagaagtgccgggtttggtgatcttcaaaagaagcattgcagcccttggctagacttgccaacaccacagaaatggggaattctctaatcgaaagaaaatgggccctaggggtcactgtactgacttgagggtgattaacagagagggcaccatcacaatacagataacattaggttgttctagaaagggtgtggagggaggaagggggtctaaggtctatcaagtcaatcatttctcactgtgtacataatgcttaatttctaaagataatattactgtttatttctgtttctcatatggtctaccagtttgctgatgtccctagaaaacaatgcaaaacctttgaggtagaccaggatttctaatcaaaagggaaaagaagatgttgaagaatacagttaggcaccagaagaacagtaggtgacactatagtttaaaacacattgcctaactactagtttttacttttatttgcaacatttacagtccttcaaaatccttccaaagaattcttatacacattggggccttggagcttacatagttttaaactcatttttgccatacatcagttattcattctgtgatcatttattttaagcactcttaaagcaaaaaatgaatgtctaaaattgttttttgttgtacctgctttgactgatgctgagattcttcaggcttcctgcaattttctaagcaatttcttgctctatctctcaaaacttggtatttttcagagatttatataaatgtaaaaataataatttttatatttaattattaactacatttatgagtaactattattataggtaatcaatgaatattgaagtttcagcttaaaataaacagttgtgaaccaagatctataaagcgatatacagatgaaaatttgagactatttaaacttataaatcatattgatgaaaagatttaagcacaaactttagggtaaaaattgccattggacagttgtctagagatatatatacttgtggttttcaaattggactttcaaaattaaatctgtccctgagagtgtctctgataaaagggcaaatctgcacctatgtagctctgcatctcctgtcttttcaggtttgtcatcagatggaaatattttgataataaattgaaattgtgaactcattgctccctaagactgtgacaactgtctaactttagaagtgcatttctgaatagaaatgggaggcctctgatggaccttctagaattataagtcacaaagagttctggaaaagaactgtttactgcttgataggaattcatcttttgaggcttctgttcctctcttttcctgttgtattgactattttcgttcattacttgattaagattttacaaaagaggagcacttccaaaattcttatttttcctaacaaaagatgaaagcagggaatttctatctaaatgatgagtattagttccctgtctcttgaaaaatgcccatttgcctttaaaaaaaaaagttacagaaatactataacatatgtacataaattgcataaagcataagtatacagttcaataaacttaactttaactgaacaatggccctgtagccagcacctgtaagaaacagagcagtaccagcgctctaaaagcacctccttgtcactttattactcccagaacaacaactatcctgacttctaatatcattcactagctttgcctggttttgtcttttatgtagatagaatcaatcagtatgtattcttttgtgcctggcttctttctctcagccttacatttgtgagattcctctgtattgtgctgattgtggatcttttcattctcattgcagaataatgttctattgtgggacttattacaatttgttcatcctattgttgatgggcacttgagaactttccattttggcgctattacaaatagtgcaactatgaatgtactgcatgttaccatcttacttgagcctttaatggacttatttcttcaaatccttccaaaaattattataagcattgaaattatagtttcaagccaactgtggatacccttaccctttcctcctttatcacaaccaccgttacaagtatacttatatttccctaaaatacatttaaaacttacctaagtgacatttgtagttggagtaataggagcttccagctctaataaaacagctgtctctaacttattttatttccatcatgtcagagcaggtgaagagccagaagtgaagagtgactagtacaaattataaaaagccactagactcttcactgttagctttttaaaacattaggctcccatccctatggaggaacaactctccagtgcctggatcccctctgtctacaaatataagattttctgggcctaaaggatagatcaaagtcaaaaatagcaatgcctccctatccctcacacatccagacatcatgaattttacatggtactcttgttgagttctatagagccttctgatgtctctaaagcactaccgattctttggagttgtcacatcagataagacatatctctaattccatccataaatccagttctactatggctgagttctggtcaaagaaagaaagtttagaagctgagacacaaagggttgggagctgatgaaactcacaaatgatggtaggaagaagctctcgacaatacccgttggcaaggagtctgcctccatgctgcagtgttcgagtggattgtaggtgcaagatggaaaggattgtaggtgcaagctgtccagagaaaagagtccttgttccagccctattctgccactcctgacagggtgaccttgggtatttgcaatattcctttgggcctctgcttctctcacctaaaaaaagagaattagattatattggtggttctcagcaagagaaggagtatgtgtccaatgctgccttcccatgaatctgtctcccagttatgaatcagtgggcaggataaactgaaaactcccatttaagtgtctgaatcgagtgagacaaaattttagtccaaataacaagtaccaaagttttatcaagtttgggtctgtgctgctgttactgttaaccatttaagtggggcaaaaccttgctaattttctcaaaagcatttatcattcttgttgccacagctggagctctcaaactaaaagacatttgttattttggaaagaagaaagactctattctcaaagtttcctaatcagaaatttttatcagtttccagtctcaaaaatacaaaataaaaacaaacgtttttaatactattgcttttatgcctagtcaactctgttccaaactgccaactcctgtgtaaatctctaccccatttatttcttgaaaaatattaagattaaatggagcttttatctctgtagtcttgcatttcccactagcttcaaattgaatttttagaaaatgaatgatataagctttgtatccattatgtccttgttttccccaccctttttcaaagatcaccatgactttctgattggattttttttcaaaagtgaaatggccatcaaatgttatatggagtcactagcataatcagatgacttaggcaaaagccaaaagtaagtgtctttatccacagtctctagtctgaagaagttgaccatttggttggtcaagtggacagaggagtcacatctgactggtggtcaaactggcacatgtttatcgcattctaatcttttatctaacaatggtttcttaatttctgcttctttgtattttgcatttcctctaaaacagtgagaaacactactttcactttcaacctcatagacaaaatgttgtgcttctattttgcttgacaaaacagatcttctcagttgtacaaaggaagtctggcagaaaaataatcattggctcttgccagaaataatgatgagtttccaacttggggaagtatagaaagactggaaagactaatatttatgataaatgtttatactctggattttccttctacccagaaactgacaattttgcgggtattaggcatattagcatcccatttcgctcttataaatacacttgatagaatctccaatctgacatttatgctatatccaggaagacaaatggagccaagtatctgtattatcgttttaccttggtgtaaatccttcttacatgctatgaatgctctatgtcctctgacatactgcatcaaagatgtaatgctaagacgtatggcagctttataacaccaaagaaatagggattcaaacactaactagggctgggtgcagtgcctcacacctgtaatcccagcactttgggagtctgaggcaggaagattgcttgagcccaggagttcaagaccagcatgggtaacacaaggaaaccccatctctacaaaaagtaaaatacaaaattagccaggcatagtggcacatgcctgtgaccccagctactcgagaggctgaggtggaaggatcgcttaagcccaggaggtcaaagctgcaatgagccatgattatgccactgcactctagcctaggcaacagagcaagactgtctcaaaaaaaaaacaaaaaataaacagaaaacctgaccagcagaaaatatttagatgtagtaaatgaaaatagaaaaaggacacaatgttgagtatgcattatcatatcaactatgttaaaatattattccatagaaaaagagttggaagaatatatggcaaaaattaaccagggctatctctgggtggtagtattataagcagttcttattttccttttttggttttctacattttaagtttttctgtgataggaaaatgttactcttaaaaagtcattttaaaaatattatttggaaagaaaaagaaaaggaatatgaaagggaggggagtgagggggaaattgacccaaaaagaaaaatataatttccctaaataaaagggttgttaattctttttaggacctattcaatttgatgtctcaggcaacttagacccaaggaacctggtgaagtagattttggtcaagagcttgctgcctccaggacaggccagatctgtttataaagtaactttgacacacactgtataacacagaatggaggaagttgctggaccttcctctggtacttaaagtgcttctgtgagaacaaagcatgtaatctagaggaggttttgggctttttcctgaaaatgctaaaaggttgactgacccagccacactctcccacctggtcctccgcacctccccaacccgccccaaaccccagcatttgccaaaccctgacccagatg

SEQ ID NO: 15405 - DNA, 107926 bp, Human; identical to SEQ ID NO: 15404

SEQ ID NO: 15406 - DNA, 107926 bp, Human; identical to SEQ ID NO: 15404

SEQ ID NO: 15407 - DNA, 107926 bp, Human; identical to SEQ ID NO: 15404

SEQ ID NO: 15408 - DNA, 107330 bp, Human
gccccgcatgcttatttgtgggagtgaaaacaccaatatttcgggattgttgtgaggactaaatagtgtctgtaagatgcacagagaaagcgtaaatagacgtcaatagcacttgttaggtctacacactccatttttcctctatattaatcgaattatttaaagattggttagctttttggggaaatgtctctccattgtattccacttattaggatgaactaccttttctccttgcttttcagctttctctgctatgaaaaagatggaaaattttttagcacaaggggactcttctcaagcagtaaatcattttgatattaaaaacagataattgcaaacccagttttatttcagtatgaattccgcagtggagtgtgaatatgtgtgtgtatgtgtgtgtgtgtgtgtgtgtgtgtgtgtgtgtaattacctgtgattcaaaagaggaaagggatcagtattaaaggtacttgtacactggaagcaaaaaaaaaaggaagtttagttcctctgagctccttggcaattatagctgctaaaggtagcttttacaaagaaactgcctttgtgcctaaagtatttatttccttgtttgtatttacccctttgaggaggaatcgctgtgtcttgagtgaaaggggtacgctgcttgcttgcattaaactgtgagggtccaggcgcattacggctgatttcagtaggtagagcagacacactttagtttatttttctctttctcactccccaccctcaacctccgatgtacacacgttttaagattccctgaagtcaggaggtgggagcggagagtttcagttcagatcttgacatgagagtacttcgaccaaggaaaagaaagggaagaaagagggaagcggggtggagaaagcaggagcaaggaaggaaagaaggaaacggggagggagagtaagaaaaaagaaaacgaaggagggagggagagaggacatttaaatgaagaaggaaggaagcttggattcagggaggaaagggagcgggaaagagagcgaaagaagagcgtgagaagaggcaagcattatagtctccggtccacaggggagagatggagccccctcaggactagagaatcccgaagagcccgtgtattgttttcttgaaagccccgaagctaagcaattctaaaaatgtttagcaaagcccttttgggaatggtgagatggggggtggggaggatgggacattttcattgccaccgcccgccccccgtctccccggccccctcacatgaagtgactggatttgggagacctagcggaaaccttcaggtcacccagggaactgctcctctctctggtcctgcagcggcgaggcggggtagggggtggggggggtgggccgtgagagcgccgagacgcgcggggcgcggagatgtgcaagtggcgaagcttgaccgagagcaggctggagcagccgcccaactcctggcgcgggatctgctgaggggtcacggtgagtctctgtgggtgcgggtcggagggatgcccaggtgcctcgtcgccccacggcccgggcggaggcgggtccggaacctcccccaagtccggcctcagcctggagcccgcgcgccttgggcggatgcacggactgagaggcgcttggctgggctctcagcccgccactgccacccggccccgtgcgctcattggtcgggatgtgtcggctcagcagcctccaacttctcccgaatcccactggtgagtcccaggagagcgagctgagggagaaaggtccaaagggcgcgagcgcccagggcgctgggagcccgtgggacgggcacggggagggcagagccagccgaggggagcggctgccgggaggtgcgctgagcagggtccgcagctaaggtccagcgcgatccgagcgcccaggaccctgcggccgtggaggaggcgtgccctgggaaggagccgctactgggacctgaagagtgaggggagggagaggggcccagagggtgacctggaggagggctctggaagtcacgtcaggttggctcttcaggttcatttccatagttccctgcggcctctgccttggggagttatgttttgttaccgagatccgcgctaccagattgcaccggggctgatttgggggctgggaatttgccattctgctgtacagacactgatttttttttcttctttttaaaaagcaaggtttgttttcattttggtttctgtcggattttctcatttgtaactcacttttctatttttacttttcttaaccggaagatcttttcattatcccacctcttcatcttgcttttaacctgatttcctattatataattaatgcttaaatctcacaagggttggtcggtgcggggctggtgtgtccttttgtagatgaaagtttaagacctcttaactggtttcagtctatttgtctggtttcaaaataagggtaattgcaaccaaatatccctctttagcttctcgatcaagtcgattcctcccccatatatgattcaaatggcaattttattaaactgaaaactagtacctgacttgcagcgtcagcatttggaaagtgcttgtcggcaaatcgactgtatgaaggcgtgtagcttcatcccctgccatttttgtgggttctagcactttaaaaaattgtctggtaatttcttggacttaaccctgtgtctttggttgtagagcagcactaaccaggggagtaatatggttggcacttcgtgtccagaactccgtatttcaggctgggaaacacctaattaatgtctgggaaacaagaagatgatttatcctgagtacctctgtcctcagcttctgcagacacagtttaaatatggaaactgtttctccttcttcctgtgcctcagtttccatagaacaaactgtaattgcatagcacagcttcaggaacctgcagatataagttaatgttataatgtgcagtgaagatgaaaactgcttagctaagtctaagtctgtaagtcaatgagatttcctttttaacaaatcagttatccaggtttcctgctttgactgtctgatatagtaatgcttatgctcaactggtataagaattgctgctttacattgctttgaaattaagcttacacttaaaatagtaatttattctgttggtaatattgtcgagctgaagtttgcaggttcttgttatcttagacctcctaattctctattctcgtctgtggcagtgtccacttttccgtttaaactttttatttaacacatcttcagttgaagtgaaatattttaagaatacaggtatgtttttgcgtaccctgctttatatgggactataagcctcaacttggtattttttttttttttgtattcttttgtttacttgtcccccttactcttctctatgggattgggtgtggttaagttggatattcaggtatttggggtttagtcatatgttccacagtgagattccagatactgtcccctgatgtcttaaagaaaaattgtgaaccttccagaattaactggaaatgaacgacaaagttaattaggagattaaacttgcatcatttctgcttttgctcaatgcttttgaaaaaaggctactaagagcaaaagacttcctttaagaatttacagggcatttacaagagggggagatggaggaagactttgcaggtgattcaaagattatattgttttgatgcagcttctgtcactgtcttcatttctctgtaactgtttctgcaaacttgggtgctgacccattaagagcccagctgcttcagtacccagtctcaagggtaaggaggagaagccaagggaaagtaacttacagggagaaagaaatgcttatccactagctttactacaccacaaggcatggagtttccacagagcacctgtaatttaaccctgaggctgccctggttcaccccttcgctttactttacagggacactgactgtcatttctaaggaagaactaagaaaaaaaaaagtccttttataccagtaaaacatttctctacattgtcttctgacatatgcggggggaacaatattcaggaaagggaaatactttagcaaatgtgcttaacattcaggtgttctttaggacagtcatgaaacatggggagactgggagaattattattgtttacctctctgtaaagtgtccagagtattattaaatttgttcccctctttcctttgcccaaccaatacactattaaaataggactacaatcaatgcaattccatatcataaccccaggggtggtgagactaagccagcatgccttacataaccattaagtaagacattttaacattcaggtacattacattccacttttatttagcagacacggttttcattgtgtaataaaatatttttatttgatagtctgtccttgcttatagcctcatgtaatcaaggggacagcatgtttaagactttgtatccagaactttaaggtctagctgtggttcgcttattaataattcactgggaaggttaatttctagttttctgctgggtctcccagaccatacttcaaatgtagaatatgtttcttctttctcctatgcctcagtttccacaaaacacacccttagagaattgtgtgtgttcaacaaagatctttaactataagagcatttctgagccgccacttcatcctgggaccaaattctaagagcaatttgtattgagctataaacagctaatctgctagtttaagatgttcttttatacagtcatgcagaaaaatggaaattgtgtgttctaatccttggagactggctgataaagtgtcactaggcccctgatgaaatttaatatttaggcttatatccccttaattttccccctaaatttctacagtacgcttttactgcatgatgatacagctttattttgaacagtgaccaaatgtgttctttacaaagaatattgacgagttgtgtagtcttgaacacgttgcctgacttctctgtgccccagtttcctaattctttattctattctgtggcagtgtccactttttggtttaaagtttttaacacatctccagttgaggtgaaagattttaggaatacaggtatgtttttgcataccctgctttatacaggactacaagtatcaacttggtaactttttgtactattttgtttacttatcccccttactcccctcttaaatgggattgggcgtggttaggttggatattcaggtatcttttggtacagtgagtgaccattttcagaatgttgtctaaccagttaatagatactggtatcagtagtagtagtaattttgaactgtaaaaataaaggttgtttttatgactaaaataaactacttcatgtgttcattcgttttgctgtttatctatattaatatttcaaattattgcttagtcaaaacctcaaggtattagtcactggtttttgagcttataaaggaagccactggagcaagatataaaattaaccattgatgttagtccagagttcaaaagggtgagtttaaaactttcttaatgatggtacagcaattatttgcttataaactgctgaattaatcctacttgagtatttaaccaagtcttactgtctaattttgctgagattttcagtgatataccaaagcaaaacaaaacaaaacaacagcaacaaaaaacaaaaggttgtgactgagacctgtcaaattcatttggctctatatactttgcattcagcaacaaaattttgacttctcaacagcaaaaatgtatttctattttaaaataactgagccttttacttttatccagccacattaagcatttggacattttcttttttatttatttgtttttcattattagtattttcattttttgcagattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatggtgagttactcccacacctgtgcatccataagtgcaaaagagaaggaaatcttcctccatgcttttaccatctatccaacgaatgtgttaaggatagaggcacttaaagactgacaaagagattcatttataaaatgtaacatcaatatgtcaaaataattaactttgaagtacggtgccttttatgtttgagctaagttattaattgcaagtatatttagtgcgctcacgcttacttatgaggaatctaaagtatggttttatttgattaaaatatacacaattttatggccagctttagtaatagtcattagtcaacttttgttgtgtcattgaaattctaaagggcttcacaggaatttaacaaatttaatttgagtcttggaagttttttacaacaaggatgaaaaaagattgattgtttaatggttaaaaaaatgattaccaagcaaaaacaactgattatttcaatttaataggcctggggcttcgttggtagagaagatataataacacatttttcttcataatcaaaattttaaatttagattttacttattttattttcttatattttttctaaccactgacaatgatatataatgttcagtttttagttcttgctttaagaaattgcttatttaattggcagtttttaaaagaacaaaagaaaaatagaaatttaaaaatttgtgttgccaatatttatgtatattctctcctttttctagatggtatttgcaagtcatcagactgcataaaatcaggtaagaaatggtttttacgtgtaatagttatacaactgatgtataatatttaaaattaaatgctaatcttaatttgctttgtttacacttttattcattgtagatcaattatttatgtgtctggctctataatcaatggaaataaaaatatatttaagtagtagattaattaacttgtttactctgaaaaatatattactattttcagccctgggctgtatagcagggcaatagaaaactatatcgctatttgtatggagcttgccatgtagttgaagaaagaaaatgaacacatatgaaatggtaagtttcgtatcattgtgttaaatgtctcagtgcacctcactaggtgggtgagaagaagggagtgagatgtaggcatgtaaatctaggtggagaagttaaaatctgggaagaaatttcattttatttattttttttattttttatattttgagacagagtctcgctctgtcgcccaagctggagtgcagtggcgtgatctcggctgactgcaatctccgcctcccgggttctagcaattctcctgcctcagcctcccaagtagctgggactacaggtacccaccaccacgcctggctaattctgtatttttggtagagacggggtttcaccatattgatcaggctggtttcgaactcctgccctcaggtgatctgcccccctcggcctcacaaagtgctgggattacaggcgtgagccaccgcacccagccttaaatttgggaagaaccttgaagcagggctagaatttagatgtggcggtgcagaagagggaattccaaacacaaaagaaagaaactatgttattgagaagtagtaaaagtgtacgcttgatagaaggacacattatggagaaccttgaaatccatgtttagccttgatattgtaatacaggagaaacagatatttttgaacagaggagtgatcaggccaaaggtgaaagatgattctgcgaatgtgaggttgactggattgagtgaaaaggagggcaggcaggtgggggctgcttctgtactccaagtgtaagctgaagaggttggcctgtggtgagagaagagtactattgagataatggggagggagaattgggtgactcagtagaactgacttgctaaataaaatgaatgaattgagaatgatgccaagttttaaaacccaagggactaaagagaatggaggcagcccacacagaaatagagaggttatgaggtggatgtggatgtgtttggtctaagatgaaaatagacaggaggaaggtagagatgaggtttaagaagctggaatttggatttgagatctgtcagtttaggagtgatagtggaagccttggaagtatttgagttctcaaaagaagagaagaggttcaagggctaaacttaagaagaggttcaagggctaaacaacatcaatgattagaagagaagaaaaataagtcagagcagaaaacagagaagtgtatgaagctatataaatcccatcaattggagtgtggtgaaaatgggagtatttcttctttcttcaagaaaaaggaaggtggtagctgagggcagcacctgggatatgaacacaatatttgtgtcctttaacaagagattctaaacctcctttctaacatctatgtgtcttataagaaataaataaactgttccaaataattttaaccattttctgctggatatttttaattttatttatttatttatttgaggcaggatcttgctctgtcacccaggctggagtgcagtattgtgatcacagcttactgcagccttgatctcctgggctcaaggcatcctcctgcctgagcctcctgagtagctgggactataggcacctgccaccattcctggctaggttgtgggttttttgttttttttgtttttttttgttttttttttttgtagagacagggtctcactatgttgcccaagcttggtcttgaactcctgagatcaagcagtcctcctacttgtcttcccaaagtgctgggattacaggcatgagccactgcacccagtcttggatattctttacttggatttttgttattcactgaactttgcaaaaaaatgacgggaaaatatctggcaattctaggttatagtctaatatcctgaatctgtgccctttggtttttttttttttttgtatcgttttttgatggatttttttgctctgggtcacaagagcaatgactagacaccctgagatgtgatgtggggagcgtgagggagacttgatttagatgttagccatttgctgctcgacatagtaagtttttcccaaaaacgaagtttctttattccccagggaaatggctgcacaggtaccttggctgggggatctccgtggtcatgtgcaaaagtcagcatgtgcccaagttgtcaaagttaacgtttacttcctccccagatcctcctatgcttcctctctctaccagctaccctattatatgctcaggctgtcctgtttcgggaaacttccacttacatattgactactaagggttaattcctctgtctttaatacacttgacatgtctctttggtatcttaatctatagattctctcttctctcactatttttcctttttctcttcttttccttgaattttattttcgaagaaactggattttttgactaggtaggtgtatttctataaacgacaagtgattttgcctcagagatctaggcaggtttttcctcccaaggagcaatgtgacattcagaatctggaatcttaaatgtgacttaatgtttagagataggatttttaaatagtgtttggcaagtctcaactcactaaaatgtatttaacctgtatcctttaattgtagcttagaaatcaaaccaaatgtaaaacaccttgcaggatgtatcttggcagagaaatgtatacaatagaaataacttcagtggtaaacaaggttgctgtatagctgtatatttttcttcattctgctctgttggttcacaagccattagaatacttgttcacattggtagttactattcttcctaggagaataaataagatgacacacaccctcatggatacactctgcatactcataaacacacacactcgtgcgcgcacacacacacacacacacagtcttctgctggttaggaaatcttttctgccacagaaaaatacaactatttcttttagaagttgttgcaaattaggaaaaccctagaggaaatcttggacaaaagcaagtattaaagaagagtggccagagtagagtagatggaaagaaaaagaaatgtgaaaagagaaggctgggcacggtggctcacgcctgtaatcccagcactttgggaggctgaggcgggcagatcacctgaggtcgagagttcaagaccagcctgaccaacatggagaaaacccatctctactaaaaatacaaaattagccgggtgtggtggcgcatgcctgtaattccagctactcaggaggctgaggcaggagaattgcttgaacccaggaggtggaggttgcagtgagctgagattgcgccattgcactacagcctgggcaacaagactgaaactccatctcaaaaaaaaaaaaaaaagaaaagaaagaaatatgaaaagagagatgttgaaaaaatataaaatatcttaccagcaagtctataggtcactttaagagagtgggtgggttcaaacctgagctcagaaattcttgagaatgggaaaagcaagtattgacactcagggtgcttacattatatgaaagatggccccaacttgaacctttcttccagtggaagggaatgtcatagcaaatgtacttatctttgattctttgaagtcaaggaatacagaagtcaagccataccaagacagaagtaaaatattgcagaaggctgtttcaaatctgtttggtgttacatatttaaaatctgagcatctaggatttaaatatttatgatgtacataaaatgatgtttatgtatactttaaattaacttgcctatatgtgtaatgcatcagtatgaaagattacaccagacctaaagtaaaacaaataccacttaagaaataacaacttaaggcagggatcaaaatgcttcaaagtattattcatcgcttatttaccctataaggtcatcaaaaacttagagttataaaacttgtatgtgattttgcagacttttccgtgtaagtctgaatcctgaaactgatttccattgcattgtaacctccctaacttagatttcaaggaatcttgtgctttaaatcagggtttctcaactcaatcactattgatatttttgtgctagataattcttcgttgtggatgctattctgtgtattataggatatttagtagcatccctggcctctaccaactagatgtccagtagcagtcctctcctagttgtgacaaccaaaaaatgtctctagccattactaaatgtcccctgcaggcagcacggtcacttatgactgggtaccactggtttaaacggtctcaagatgttatcaatgcttccctcttaacggtaggcaggataatggcctctcaaagatattcacacccaattcccagagcctctgaatatgttgccttatatggcaacatgcctgtaatcccagcactttgggaggccaaggcgggtggatcacttgaggtcgggagttgaagaccagcctggcctacatggtgaaaccccatctctgctaaaaatacaaaaatccaggcatggtagcacgcgcctataatcccagagggaggagaattgcttgaacccaggaggcagaggttgaagcgagccaagattgcacgactgcactccagcctggaagacagcgcaagactctatctccaaaaaaaagaaaaagacaacagagaattgaggggtctgcagaagcatatgttagaagtgtggtcctaaattatccagaggccagagaagccaagctaagacgtgatcaatacagtttacaagagaaagtgggaccacctccacctgtatagtcatgcaggttgtacactgcatatttgtcgatggcagccttgacagacaggcttgtggaacatcaagacctggatgaaacacctctcagaactgtccactccttttattttaattctgcacataccaagaaaacttttgatgattacttaattattaatacaaggagaggtggcattctgttacttgaaagatattttcatcatggtgagataatgcacagcggtccccttcttatcctctgaggatcccccaagacctcagtggatgtctgacactggactgaaccctatatatgctatattttttctgtatacatacctatgataaagtttaatttataaattagacaaagattaataacaataattaataaaaaataaaacgattataatattattccagcatcactattcttatggtttggggccattattaagtaaaatagggttacttgaacacaaacaccatcatcctgcaacagttgatatgataataatggagaaggctccttcgtgactttcatcatgctactcagaatggtgcgtgatttaagacatatgagttgtctgtttctggaattttctatttaatatattggactgtagttgaccatgggtaacaaaccatggaaagtgaaaccacagatatgggggagactactgtacgcacatactgatttaatcagatttgtgtgctttgagctatgaccctggaactgaaatgaagcttgcaaatgtctgcaagggccagatcatggtgatgccctaggtgatgcatcttggcaacagctagccttctcctggctgtcacaaggcatctctgccttcttgcctgttaacaccttgaaacctccatgaaggaaaacagcacaattaggtaaatacaggaaggactgatggctaactcatgggggctactggccctgtagcagccttttagtgtaggaaatgaggctatttcattatgtagttaagtttggaaaaaatccttcatggaataagaaagcagcagacatcttagtaggaagaccactgaagcacacctttgttaatttaaatgtggcatgtggcaatttgctttgtgtggcttccctggcacaattctcgtgaaaattgtgtagggatattaccttacatttatccagtcaaaattagcatctgtcaatcagatcctttccaagaaagggaatcagttatatcataaatacacaaatatataacatgtgttttttaccctccagggaaactttaagcaagtagtacaccatcattttttaatgaatggtcaagaaattgaaaacatatataagttgagttaagcagttaaagggaaagacaattagcaatgcctggtaagctaagtggtactccaaaggtttattttatagctacagaaattatctacatgtagagggggtggatacaaactagcttagactggggtgagaatcctggtttgacatttaacattttagaataagagatatagaaagattcctctgtagttgaaggatcctgttttgtcctactcataagcaaatccatggggtagcaaggtgctttctggtaagcctttgatatgatatgaagctcaagttgataaaacagattaattgaaggaaattgaaaaatacgcaatttaaaaaaccataaggagaatgttgcacaagcttttgaatcctgtaaattttcattctttaagaccattcagaaaaggagattttgtcgggggccagtggtggcttgttttgatcctatttctgaaccagctgaaaactagaatacgttctttctgttcaaaacatcctagatgggccacatattagtcaggccttctccagagaacagaaccaatggtatatgtatataaagtctcagtatccaaaggcccaagaacctggagttctgatgtctaagaacaggagaaggtggatgtcccagttccagaagaaacagaggatttcccctccctctgcctcttgttttatctaggccctcaacagattggatgatgctcagccacaatggtggtagagtgtggatcttctctactcagtccactgattcaaatgccactcttttccataaacatcctcacggatgcacccagaaataatgctttagaaataatgctttatcagctatctggatatctcttaacctggtcaagctgatacctaaaattaaccaccacaggctacagtgaaaaagatagttccaactgtgagtgaggatgcggagaaactgaaccatcatacattaatggtgggaatgtaaattttagtacatctggatcaacatgttagaaacattttgaaaaacagtttgataatttttacaaaatgttaaatatatactttccatacaacccagcaattctactcctaggtattacttaaaataaatgaaaacacatatcctcacaaggacttcattacagcataatgctgtttttataaataatttataaaagccaaaatatggaaatatcccaaatatgtattaacaggtgaataaacaaaatgccatatagctataaactacgataccacacagcaataaaaaggagcaaactactgttatgtgcaatggtgtagataaacatcaaaaacattatgctgagtgaaataagccagacacaaactgcatattgtaaaattcaatttatatgaaatttctataagaagcaaaactataggggcagaagacaaatattggttgcctgaggctggagatgaagcagggattggctgcaaatgggcataaggggacttcttggggtaatggaagtgttctaaaattggactgtgacaaattctcagctttttggctaaagatcaagtgtaaattggattgtggtgatggttgcacaactgtgtaaatttaccaaaaattaatcgggtgaattttatggtatacaaattaataacccaaagccgttaaaaaaaaaaagcaaacaaaaattcaccttcattctttcccccatctctccaatgtccatttttacatagttatctcatgttttgatcttatgcttgctattgtatgttgagtccattgagctccatttttgcagtttaaatgattatatgtagttttcaatgtagttttcaaatcttcactaaataaactcaagctttttagtttgagtgagcctctattatttaattatattagcaatatattgacgaaaagtctctggaaatagtaaatcaactgggaagttaaaattatttcaggattaggtgttggaagtcctgttttcaccccctggggtttcacttacagaggaagtcaaagacatatgtgtccaggtgtaccagccatctggatcaaagccagaccacttggtctaccacagagcagttagcagttcctgcttctggaaaaatgtgttggtttttcacacaggtgctgcgagatgttttccttttcaccttaactgatagaaagtcaagagccaggacgggcgttttggctcacgtctataatcccagcactttgggaggccgaggcaggtggctcacgaggtcaggagttcaagaccagcctggccaagatggtgaaactctgcctctactaaaaatacaaaaactatctgggcatggtggtggacgcctgtaattccagctactcgggaggctgaggcacaagaattgcttgaacccaggaggtggagtttgcagtgagctgagatcttgccactgcactccagcctgggcgacagagtgagactctgtctaaaaaaaaaaaaaaaagattgaaaaaaagaaaaaagaaaaagtcaagaaccaaatttgaatttaacttgaaattgtaggacttctttgtataaacttgcttcatcagctttattcctattcctcttttctttctcatacaatgtatattagtttattttatgtatccctctaaggccactttgaattattttaggaagaatgtaggttaataatcagatgaatagaatataaattccaacaactgatatgtgcaggagaagggctgttaaattataaactttatttcaaagagatgcaagtgttatgagtaacggaggcacaatttttggaagcttactgcttctttttccactaagccaacttttagcatgggagatctgggatgtaagttttggccacatcctgtgtgattggtatgagatcctaattaagtcagttcagctttctgcatttcattttcattatctacaaaattggaattgaaagtgtctcattttacagggaaacagcaaagactaacgacagcctatttcatgttacacgcccttcagggagatgcaccataggtataatgcacagataggattcatagacatcttatttcatgaaaattgcaaatgcactatttaaaattttttattgagaatcaaataaaaatcaaatcaaaaggcgaacagtgtatttttaaagaggaagttgtagccagaaacagagagaaagaaaaaagagaatgtggtacattttacatattctcaaataaaaatgtgtcatcctttatgaacaacatttgatttgattgctgtgctctgtcttagtatgggggtgacagttcaggctttgaatcaattagaatgagcacaatcagaaatgaacacttgaatctgtgtttcctgtaaagaaaagcctaccatcagggacaccttagtttgtaaacctagctaatctgcactcacccttgccagtaccccttttctcacctctgattaatcccttaaagtaagtaagtcagaggtctgcatcaggagaatgactagatccttggtattcaatgcgtggtccatggaccaacaacagcagcagccactgagaatgtgcaaaaatgcagtctcgggctccgcctcagacctactgaatctgtggctgcactttcagtagcctcttcaggtgatctgcaaaataaggttgagaagcactgaggaatagtgattttcaaatatggctgcttattacaatgatttgggaagcttttgaaatgtacccatactactaaaccttccattcttcctgggcacacaaagtttccatttcttcagtggagtagtttctgttatgtgttaggaggaaaagcaatttaagtaaatgaatagatgttaaggggtataggaattgcctggatatttgcatttttaaaagaaggtacatattgaccaactgattgctttaacaggttcaatttcagactgtgtgctcagtgaagactttaagttagagaggagtgaagactttaagtcagagaggagagacactgagcctgattttctgcttatcgtggacaagctgaacctggaatatcttcctaaatttccccagtgtaatgcaggcatgctatttctgtagagacattagaacaactttttgcctcttccattcattcatttattgatttatctattcattagttaattaattttattttttattttttttagaggcagggtctccttatgttgcccaggttgacctcaacctcttgggctcaagcaatccacacgcctcagcctcccaagcagctagaacaacaggcacatgccaccatacctggcattcatttttttttccacaaaagcattaatcaagcagcttctaaacattgaacactagacattggaaatatgaactaaaataccccctgccgtcaggaaaatgaaaacctggtcagtgtgacagacataaacaacattaccatatggtttgataagtgctatgatggtgataagatttgtgtgctacaggtgccctgagagaggagcacctaaaccagagcgggtctgggagtgggcagctaaagtgatagcaatgaggccgggaaagcagtcgcacttcaccagctaagttctgaaggataattgaattgcccaaccagtgggagcagaggagagcatgtgcatagtctgtatgcaagatggaggcaagagctcaggaagtttaggacctactagtggttcatgatggctgggatgtagaagctagcaagacttgatactagagaagtaaccagggcccaggtcacacagggtcttatatgccatgataaatgggttgcattatctcccgaagtctacagaaaatgaataaaattaaaatgccgcaggggacatctaagggattttaaatagggatgtgtgacattgtcaagattggctgctgtctagctcaagcctggtaaagtggaggcaaagatttacccaaacaaaggaataacattttggtgcccctggtgtgtgagagagcttggcaatattgagaaactgaaagaatatctgtaaggctatcatagagggtgtgtatgaagatatgagagtggaggcaaggagaagtgttcactattggcaaaagaaataagcaggaattggattttgtagtctgtgttaaagtgaatgcacttccttctagtagcggtgggaggtcacagaaggaagggttttaaatgacgcatgactttatcagaattattgagaaagatcactgaatagaaataaagaatggctgtgggcaggaaattgggctactgcacttatttggatgagtattatggttgcctggatttgaatggcaacagtttttattgttgttgctgttgtttgtttgtttgtttgttttgagacagggtctcactctgtcacccaggctggagttcaatggcacaatcacagctcactgtagcctcaacttccccagactcaggcgatcctcccacctcagcctcctgagtagctgggattacaggcatgcaccaccacaccccgttaagttttgtaattttctgtagagatggagtttcaccatgttgcccaggctaagaaatggacagatttgagaaatatttactgggaagtagaattcataaggcacaatgtttctgtaaataggtgaggttgtgaaaaggaagtgaggaaaaggtaactcaagtttctggcttggtaaattgggtgataagtcagctgttcaccaagctagggagcactgaagcagagcttattgggtaataggctgggaccaatgcagtgaagagttcactgtgagatagtttaaatttgagatactggtacatattcgatgtggtagaattcagggaagatggtgttggaaataaagattcgggggtcatcagcatgtggatgatatggttgagatttcttagggaggaaatggagaagagaacccagaattgcatcacataaagcaacatttaaaaatgagaagaggaagaaactccaaaagaaaccgagaagtaatcagagaggtagaaggaaaatcagcgaagtgtaaaatcaccaaagcaaatggaggagcagctgtccaaaattagagagtgatcattggaattaagcacagctgagaggttgagtaggctaaatgttgaaagcagaaaggaagacattgaagattcaggtgaagatcaggtggaaaattgatggattttgtccagaggaagtaaaagaggatgtatatccagagaaaagaatataggatgattccgagataaaggatggcctcctcctcccccttttatttaatactagggagaaagaagccaagatggctgaaatgcaaacatgtttggaagctaggagggacaggaagttgaatgggtcatcatccagttgcctttgtgaagtaacaaacaaaaatctccgcctgggagtgagctggtagagaaagtaagtaaggagagtatgaagactggaaagtgtccatgtgaggagtgggccatgcacacagaactgatggctctgttgaaatggaaggctataacttgaaatggcattaaaccaggcagttgtggggtttctccagcatcaccgataatggcttcaacagatattgtcagcactgttttagatgctaaggatacttagcacctaaacgcagagtgagcaacacaatgtccctgcttacaggagcttacagcagtaaaggagacagtaaataaacacacacacatataaaaaaacattattagatagactagagttggaagggaaaaggaaggcagctggatcaattcagggtaggctcatttgcagggggcaagggaatgaaatactttggtgagatgatggtttcagggatggcaccacaggatgtacactggacagaagatataaaagaaaagtaaagtaaaaaatagagtggctggctgggcgcagtggctcacggctgtaatcccagcactttgggaggccaaggcaggcgaatcaccaggtcaggagatcaagaccatcctggccaacgtggtgaaaccccatctctactaaaaatacaaaaaaattagctgggcgtggtggtgcccgcctgtagtcccagctactcgggaggctgaggcaggagtatcacttgaacccaggaggtggaggttgcaatgagccaagatcgcaccactgcactccggcctgggcggcagagtgagattctgtctcaaaaaaaaaaaagagtggccatggggtgagagttttcagtgaagtcgaggaacaggtgtagagggaataaagaaatgaaacaaacaaacaaacaaaaaacacttctaagaatcagaagattcttattggagaggggggttactcgagatgaagatttcagaggtacaactgttctgggtgatgagaacattaagatgtcgtcatgaaaatgtgtagactaatgtgaagtgaaggtgaaagttaggagagttcagatggtcaagaaattcttaagctagagtgtagcagaggttgtccacagggtctctgatgttacatatcaagatggtagaacttatgtggaagggcagactgcacaaagtgccagagtcttaaacaagcagagatgaatgcctctggagtcagtagaagacagagataaagtaggtgaggcggggatggttgactggcagaagcttaaataagcagagtggacagtaaggatttggctattgcaccaagtgataacagaaaactagttttgcttttccatgttggggcaaggtggagggatatgccacctgatgggattagttcatatggattagtattttcagtacacgtgttgtcatatgtaattatcactcaaaagggtaagcagcaactaataagaagaggtgctggagggccacctgtctggcatatagtgtgggattccatttgatacaattacaaatgaattcatttttactcatttttatcttttcactatcctagataaaaactcaaaatgaatcaatgagttcttatcttaaaacaatatgttctgtttaaacatttctcagcggtataatcttcctttaatcttacatttcttcaatccagaggagtccaactacagtgccttcaccgtgaagctaatgaaaagggagttggtccactgtgtagactagactagatgattgcgaagttaaattgaagtaattgagcaggtacccaatagccagcagcggatttgtttctctgttcttgatgcttaagtaaaaacaagcaagccaagtattaaatggtggagctcctgacaacacagcttcataaaaaagaaactgcttgactcaaggagtgtgtccttgcgatagtttgccgagaatgatggtttccagcttcatccatgtccctacaaaggacatgaactcatcctttttatggctgcatagtattccatggtgtatatgtgccacattttcttaatccagtctatcattgttggacatttgggttggttccaagtctttgctattgtgagtagtgctgcaataaacatacatgtgcatgtgtctttatagcagcatgatttatattcctttgggtatatacccagtaatgggatggctgggtcaaatggtatttctagttcaagaaaaccgaggcaataccattcaggacataggcatgggcaaggacttcatgtctaaaacaccaaaagcaatggccacaaaagccaaaattgacaaatgggatctaattaaactaaagagcttctgcgcagcaaaagaaactaccatcagagtgaacaggcaacctacagaatgggagaaaagttttgcaatttactcatctgacaaagggctagtattcagaatctacaaagaactccaacaaatttacaagaaaaaaacaagcaaccccatcaaaaagtgggcaaaggatatgaacagacacttctcaaaagaagacatttatgcatccgacagacacatgaaaaaatgctcatcatcactggccatcagagaaatgcaaatcaaaaccacaatgagatatcatctcacaccagttagaatggcgatcattaaaaagtcaagaaacaacaggtgctggagaggatgtggagaaataggaacacttttacactgttggtgggagtgtaaactagttcagccattgtggaagacagtgtggtgattcctcagagaaataattttaataatgtttgagtgaatcaaatatacaaatagtattgtgatgcagtgtacccacaatcattaactcaactatgaattactcaaagcactgtagataatagtctagcaaggatctgacaatatgttgagaagaaatgatgcacatgaaaccttgaaagtcaccttaaagaaactcatatcatgcaaatatgaatattttaatagctactataaaatagtagcagctgagtgctgtggcacacacctgtagtccagctactcaggaggctgaggcagcaggatcacttgagcccaggagttggagattagcctgggcaatgtggcaagaccccatcttcaataaataaataaataacttagtagcaattggtgctatgaaactttttgatgtagcttggatatttgtcctcgcccaaatctcatgttgaattaatcctcagtgttggaggtggggcctggtgggaggtatttggatcatgggggcagatccctaatgacttggccctgtctttgcaatagtgagtgagttttcatgagatctggttgcttataagtgtgtggaacccccccacccactctcttcctcccgttcttgccacgtgagatgcctgctcctccttcacgttctctcataagtaaaagctccctgaggcctcccaaaaagcagatgctggtgttatgcttcctgtacagcctgcagagccatgagccaattaaacctcttttctttataaattactcagtctcaggcatttctttatggcattgcaagaacagcctaatacattttgcatggtgcatatcaactatggtaataaagtgaaaacaaagaagtgggaagctttgaaaagttgacaaattggttgagtaccatatggaactccagctgtaggatcagtcccattccaggcccaggcactcactggggccaaggtcagtagctcaaacattccacttccagtcagccctactcttggtgatctgcctctgaccccagctctagtaaatgggtttctgccttctcccatagggatttcactcctggctcattccccacttctggaaaatgagtttctttttttcttttctgtcttctgggactgaaatctagcttagctcttaacctcatgaccttttgccagaccacggagaactgaagtttccttggatcaacacacaccatctgctggttatagctccctcctcacagctgccgtgggtgccctccctgtgtgacttatttctgttgcttgtagctgagaacttcttctgttgatggtcctttatagtttaactaaaccgggattcagtctcactgggctagtcaaaccacttctaccagagcccagtttatgtgaatgatgaatgttttacatggaaaaaaaatgtttcttcatttactgaggaaggagcaccttcactgattttgtatgccaacacagacagcgaaggatcctgcttgtccttcacctatcagccatcacacctattaggaggggggaattggtcttttgttttgtttatttagtaaaaggaaatctaattatatattaaaagttaaaaaaattttagatcctgcctacatgactttaaaatgagcaataaaagtcattttttattcagggatagtaacaggaaaaagaagctagtatcagaatgttttaagattccgatacagtgcatatgcaggttttagtttacaaatagcagatggtgatgatttactataagaaggtgtaattaattgagaatgaaggatccttttggagtgtccattatgggctagtcattgtgctaggcgtaggaattagaatcctttccctgggtgggggtatacttaaaattattgcttttgtattctatggattaccttgaaataccctttgagtcatttctcaaaaattgtgcatatcataccgatctgataactcattgcactgttgatctgaggcttcatcccctcacctaaccacatggtcatccattttgcagtccacaagagcccttcctggattcatggaaagaacttgctctcacttgggcttgagaaagcataagtcaacttggcagggcatgtgttaacaagatgatttagaactttgcgaccagccagaaccataaagacagcttgtaataaaagtaaagctgttctcatgagatgcccatgatgagggcttctagggcaaggctgctgtttcttgctacctcagcaagaatgaggtctctttcccatgatcatttccctccccttcactgggcagggtgacaaagaccaggcctctgctcccaccagtcaacaacaggcagggctcccagcatgccgaaaccttgagagctacctcttcctcctttatcccttcttcagagggtagcctacctgtccacaccggcagagagtcactctgcatgtcagtcctctttcggttgcctcttttgtcaaaaacgtcacctactttcactgcctgggacacagctcagaacctgactcaaatatttgttgaatggccaacggaatgaatgaattgccctctctcctctaccttcaactggtagctcccccttcattcccagagcatcctatacgctttacctataactcatatcccacttgttattagttgttcaatgtctggtttttgtccactaaaatgtaagttttgactgtttctattttattcattattctatttctagcacccagcaatgtgtaagttaccaataaatattgattgaataaatatactctcaggttccttaccttgaagtcacaaaactattgatgcctatgcaaggtgacttgtaagcatacctaatacacaaatatagctgcctcaaggaaacgttttcagtctagctaggtcctgcttatgtcagatttctcagttcagtatttctgtatcaagcctcctaggtttagcccctttctatctgatccatcttctttgctagcaataaagtcaattacgctcttctcagttgtctaattcaccttgctaattctaccctcctaagctagaactaggttaatgaggaaacagtttccggatgtgtttctatttcccactatttttctgtttaagggaaaatttcaactaattttctacttgggtgtaagcatttccagctctctaggagcaaagtctctatcagtctggtttttcttttccaactgtggtttgttctgaattcctcccttctcaataatttatttcttctctcttttaacactctgtgttcttcttctcttgaacaccattatttagctaagtgttgctgttcttcaacaaccaccatcctctaaaactcctctgtccctgctcacttcattcataacacacaaattcaaattcctagccagctcacgcatacatgcataaactcacttatggaaggacattacaagagactccttacctctaggttaggaggagctttacttatcaactgaatacagtaggagctttacttgtcaactgaacactgagtaagtttgagaattgaaaatgagacctgagcatcacaaaacaacctttcatatctagatatagttaccatctaggagttcacgtgcattataaaagaaatggtcttgtttaagatgaaaccctgcaagctctgtgagggcagggattatgtctgtttatcacaccatggtatgttcagttcctaagagtgtcgggtatatagaggccgtcaatatttgttgaaattaaatgaaaagtttcagtcttttcatgcttcacaagaagaaaatcttttggagaaagccaatgatttaacataatcttctggatcttctatgacagaaaatagctatttaatccgtaaaaaatataaacatatggagccaaatactgccttgtgccaatcaaatgtttggtttattaatagttactaaatttattagtgctctctagaaaagagcctttttagaatttgatttcattttaggcagcattcgagaagcactgtcgactcagctttcctctggctgttgtctttttgtaccactccctaaccaaaattgatgcaaaggcaggatgctttgagttactctcagtaatcacatattattgaagtcagctggttattcttgacagacaatatgatccaaaataacacaatgtttaaacagaaggaacatgggtgtggacccccattgctccctcttcagagatgtctgccagggtccagggaacttgggatctacctgaagagtgttactaagggaacaatgtagccttttcatgaccttctatagctttagtttaaaaaaggaacattatcatcatttgctaacattacaatcaacagcagatctgataactcattttaagtgatatattgtatttaaattacagtataatccctaatagctttttgccagcagagtctttcaggattcaaaatgcaaattgcacctgaaaaagaaaaattatttttagacttatggcactttaacttaactgtaacacagttagaatactttttattattattattattaatagaatatgtttcggttgcgaattctggaggaatccctactggaaaataattgccagtcctcccttggctgtgagccattcattgaaatggactatgagataagactgaagaatttcactaatttcgggagtgccaactgaagtttattattgtgaatccattagacatgagatttctgtgattatctcaatgagttctaaaatccaggtccaaatgaggtggaaaaattttatatgactatatacatgttatagagcaattaatattttaattgggtgtcaagaaaagcagtggttgctctataacttaatttgggttcctctgcctctctgtagagtttctgaaaatttttaaatgtcatttggagttaaggcagaatgatactgtggaaaaagcatcagcttaaaattagacctaggctcagctttagttgaattccttaaatttacattggtgacgttgagtttgtaaccaccccatacctagattttcttaaaataggagtaatatgtcctactttataaagcagttctaaggaagaaaaatgattagaacccaaggcagtttcacatagtataagatcccagacgctggccaccaggtttcttgagttcaaacccactgcattatcctttgccaactatgtgaacttgggcacaaatcacttaccgtcaatttctatatttggaaaatggggacacaaatatagttaccatacaaggttaaaagaaaacaaacattaaagaaagcatttaaaaaacagccatcatgaagttggcacttggcgtttgacatatgtcaagtgttggcttctattgttattattattattacatttaagcgtctttggctaaacctaaatgaaaatcctataatttacattgtatatttaaatctgatagtgaatttatctgatagcaaatggattctaggttgattattcatatgcttgtgcctacgtgtgtgtatgcatatttgttgtatgtataagacctatggatttaagataaattagtcacatgtatatatgaaatatagttataaactaattactccccaaactagaacagcaaaaataggtctccttacttaagagtacagctgtacagagtaaattcactatgcttggaaacttctttcatatctatttgtgtaagtctgcagctagtttctgaacagttgtatagtgatggtttcatggtactcaccaattagacaagtataagtcatgaccttggctttcttggaacgtaaccagtggttgacagggagtgtttgagttaaatgataaactagcagtccagtttacactcagcatctggtatcccccactctccatctttcttcaaccaaggcatcacaaaagcaatttgggggcaggcattttcatttaaaaatggagagtggattgtggaagcatcctgagtgtttgtaatgaaagccatttggtttttattagcattagagtctacgtgcttgctagttttcagtcattttctcttcaaaaatggttccccagattccagttttcacattgctgccttttgaattgaatcctttgtgacccgttgtgattacattgcattttccttgtgttcttttaaaaagttctgactttctctgaattgtggttggggggatggtgggaggagggtggcagcaagggaatagggtcacttgtacttttagaatgttgtcaaaagagatttttaaattgtcaaaaattgcctagaagtaatatcaagcttagtgtctgctaataaagcaaggatttacaacagaaggttcggtcagaaatgggtgtcctaaggtctttacaaaagagcatttgctcctgggttccccaacatttctctgacctctgttggacaattctagaacagttataaatcaggctaattataatgatgttaggatactggtgttgtgtgtttggggttaggaagctgagagcttaggcaatttgaagacaacaagctgaaaacagctttgttcatataccattccctaaacattaattcagtgcagattaagaatagtcaatggagggaccgggcgtggtggctcatgcctataatcccagcactttgggagactgaggcgggtggatcacgaggtcaggagtttgagaccagcctggccaacatggtgaaaccccgtctctactaaaatacaaaaattagcctggcgtggcagtgggtgcctgtaatcccagctacttgggaggctgaggcaggagaattgcttgaacctgggaggtggaggttgcagtgagccgagatcgtgccattgcactccagcctaggcaacagaatgagactctgtctcaaaaaaaaaaaaaaaaaaggaatagtcaacggaggaattttgtcatggcactgggggtatatatgtggtatgtatgttgtaaatagatgcctaacctatttaaaacgtggctaatttatagtgaccaagagtttttaaaatagagtagtaattgagaaagaaatggtttgtatctttttcccacttaattttctttcctgttttgtacatttttctagatgcttcaaaaagacccaaagaaaagaggaatataagcacagtcattactcattatttgtggattctctgtttgctaattcacctactccctaaaatgtatttattacccccaaatcactatttgcagctctctcacagtcatttacagacatgcacagactggtgaaaaaactttgagtctttctacacacatgtactcagctgagattgaacaagggaactatagacaaggatcctttttgtagtccatttagtcaacgttttttgcatttttgtgctttttaatgatgatttcactgttaaaatgctccacaaccatagtgtggaagtgctatgtagtgttttgaagcacaagaaggctgtgatatgccttacagagaaaatatgagcaatggataaacatcgttcaggcatcagttatagtgctgttggtgtgagttaaatgttagtgcatcaacaaaatatattaaataaggtgtctttaaacagaaacacacataaaacaaggctatgtattaatcatctgtgtgtccagaagcccacaggaacctaaccttgtatttcccctagggtcaatgattcagtattcactaattcagtgtagtagggactttatatagaacaaaactcatataaataactagaataaaccacacttgttttttaattcctgtgaaataattcatatgggaaaccatcaaagacctgctaagtaatgatgaacattaaaaaaattaaactgggccgggtgtggtggctcttgcctgtaatcccagcactttgggaggccgaggcgggtggattacctgaggtcaggagttcgagatcagcctggccaacatggggaaaccccgtctctactgaaaacacaaaaattagccaagcatggtggcgggtgcctgtaatcccagctacttgggaggctgaggcaggagaatcgcttgaacccgggaggcagaggttgcagtgagcagatatcgcgccattgcactgcagcctgggggacaagagtgagacttcatctcaaaaaaaaaaaaaacaaattaaacccatataatagtactacagcacaaaactttatgctatctattttgttcatttgctgtttgtgactatcatatttatgtcaactttaccctgttttattgacaagtacccaggagcacttgaaaatgtagaaattcctttaaaccctcccccctccaccagaaaacaagcctccagggaatgcacatatataaatattaagatagttgttgtgtatagtgcccaaaatcctattttcagttagcaaactattggtaatgttggaaagcaaggcatccagataagaaaggggagatcttgtggcttggaggccattcaaaggcagacttaaggttgcgtcttcttaagggagacatgtagtgggggtcccgtgtaactggaatttcaccatgtctaatcgtgtctagcagaccaatggaatgctgtgcctcaagtttcttctgagaggcctatgagcctcatgagatatcaacaaaaatgtttcttggccatcagaagagagaagtgattttgaatatagtatagtttttgctattataatcactccaaaaccaggcctgttggtgcttgtggttcttgagagaggaggccatggggggtgaaattcaagagacctgtttacctataggcacaagagccctcctcaagacttgagacaatgaaagatgaggaagggaggtattttccctgcatcatccagcttcagcacccagcgggaactggatcatgggtggtgtctgggtaggaggctgtggaggctaaagtcagtggagcagagtggaagccttggggtcgtgggcttatgcatgagacacatgtgaggttccgtgcaacactttaccagccaattataagggactgaagtcactgcaaaacataggttgccatgatgtaagcccatttgcatttgcagactgaaaaggcaaaaggaaatattcctgattcaagtaagtatgggactatacttttttgatattggatctgttggtcctcatttctatgtttctcgattgtctaatgtggtggttccccctgactgcacattagacccactctagaaaaccttaaaaaaatgtctggaccccctccaaagattctgactgaattgatcaggagtagaattctgggcatccgtgtgtctaaaaggcttctcagatgattcacatgtttagccagggttgacaagtactgtcctaaaacatatttctgagatttttcacactccattttccaatgtgctccaaagatagcttaggcaggaaccctgctacatggccacttcaaaaagatgcacccctgcatgggcctttgagtgcatccacctagcgtggcctccatgccacttccctgtctggttactccactataaaaaattcatctgcggactctccaagtcctcaagctgtacattgtcctgcctttgtcccaacaagaattgttggtgataagtccgacagtggagaggctgtggctgcagagtggcaggaaagagagtaagtaaaggagaagacaggacaaaggaagagtaaaagggtacttgaaaaggactggaaaggagggccctgcaaggtgctgcttctcacgtgctccccaccagccttctgcattcaaagcagggagggaagagtgtgggctcagagccatacatgcttaagtgcaagccttggggccccataatttactagctgcttgatcttggaaaaattacttaatcttgtacagctaaaaagtggtggagctctgggattcagaactggtctgtctgggttaaaagagcccaaacgtttttcccagcgtatactacatctcccaatccatacacacacaatagacttttcagtgaggaatacagtaattaataacttcccagatggtagttgaacttgcttttaaattcctatagtcaaataagttgggagaatgttacaagaagattagttagaaagaaaatggtgtcatttattatcagctcgaaacattcagaattgtcatttgtaagaaataagctcattattaatagaagattacttctcttgtctttgtgtgaccattttcttaaattaaaaataacttttttcccttactgcaaaagtaatgcatgttcatctaatacaaattggaaaataaaggtaagcaaataatacaaaattaaacacactcttaatccctccgcccagatctaactgctgtaaatatgttagtatatatccttctagattttctgtgcttttatacagattttaaaaaatcatagtatatgctctttcactttacaatatctggtcaacaacattccatgtcaatacatttgcctttactacattattttttatatctgcttattaaggtgaacaatttagtctgattttaaaccacatttgtttactcagatgtcagagatccacagataaggaaacatctgaagagcccaggtgtggctatgtggagaggttgagtaattcaaaacaaagtacaaaacataaaaacaattacgaccagtttgacagttgtacgtctgtttcctacggccttctacccacaagtctaccgctgacttcaaagaaaagtcagcacagaggaggtccagaggataaggtgcaaaacgagaatcaaacccacgataagagattaaaggaaggttgatcaaagacccagcataaaagtgctagcccgtgacttgccttggcccatggccccaaaatattcatcagaacagagagcgctctttgaagtgattggatgcatccatgctcagacaagctcggtggtcaaagggaaattttaaagagtggccctggaaggagttagcaaagttgcctcttcctctctctgctctgcacatccctcacaaactgaatgttatttctttggtttgttgtgcagatgcaagtaatttaactgtactttttgccccctgggagatgtgggaagtacagttgcttttacaggatggagaatttgcactcatgatcagagaactgaaacttccagccatcctttttattcagagtgtttaaggaccggtggtatttccaaataggcagtagggcttgttcatgctctgcttgttcattctgcttgttcattaattgttcactacttttctgagtagagttcattgctctgtgatgtcgtgacagaagctttcatttccccagaaagaggaagaaaacagaagtgccccctccaaatggcatagccttcacaacattcagtttaaatgtttttaagtatcttaaaagagaagagttatatattgctaagtgtgttcttagaatgtctgtagttagcacttctttcaggctctagttttctggtttttcactttacataataatcctctatgtatttaggatctttatttttcacctttcccgttaccatatttttatttccttcaaaattcgagggaattgcttttttctctctaccttttttagatcagtttcctagtctttaactgaggtgttaaagttggagtttttactggcaagtcttgactgagcacagtgttaggctctgtgagagagaatatgcattttctattttcacagagccacagtccaggtgaggagataatgaatttgcatgcaaaaaatgaatatgttgtgagctgatacagacttttgtcaggccagtctttcataaagaagtatttggaatgggctttgaaaatgcctgaaattccaaaatgaaataatatgaaataatatttattagtacgtataggggctgggtaacatgctcaaagttacagaggcagaaaaccataaggtgtctcacagaaactgaatatactcatttaactgtgacagatggctcatgcgagaaagtagcaaaggagaagcttcattcgttctattagtgttagaatgtgctatagaatctggattttattatgattgcaaaaggatggtattgaaaactttggagtggaaaatgacattctgaagtattttgagaatatgaatctgcctgtggagtacagaatggacataggtaagaagaggcctggggccacaactttgtcaaaagggcacaaatagagtctgagagaaagagggtttgagacagaatggaaacaatgggaaagatggaatggactctggaggcaatgaactgagaacggatctgacctctgtggcaaggggagaggaggtgagtgatgggctgtaagagaaggtggtaagaagactcatagatgattcagtcacacataaccataattgcacccctgttacctaggtgctaggtgatacaaagagattaatcacatcaacaaaatggttaggtagacagagtaggtatttacaatgaaaaactcaaagtagtctcacattgaagacagagtgaggcaatgagctctcaggagtcaagagaaatattccttgaagtttggagtcacagaagcatcagggaagagatggaacatgagctgaatgttgaatgatgggtagaatttggaaagaatgacaggggcaatcaaagctgtgggatgaggaggttaaagcaaagacacaggactaagaaaacacaaggagtgtttgtgacacattgacgagggccatctggttggaacagagtttgcataaaccaccaaaagaggaaaaggggaaggtagggtgatacgtttattctggtaaaggtttagacaccaagctaaagattttatttttatttctgagatagtctctctctgtcacccaggctggagtgcagtggcgctgtcttggttcactgcaacctccacctcccgagttcaagcgattctcctgctttagcctcctgagtagctgggactacaggtgcctgccaccatgggcagctaatttttgtatttttagtagagttggtgtttcatcatgttggccaggctggtattggactcccaaagtgctggaattacaggcgtgagccactgtgccctgccaagcttttataatttaacctgggaaatgtcaagccactgacatttttcagcaaggttgtggccagtgtcaaagagtctttcgggaagtttggtttgtggaagatgtgtagaatatatcaagatgaagaactgggtgacttctagtcaaaaaggaatgatgatataaaccaggtaccaatcagaatgagaggtatggaagaggggcaaaggaattaccagtaaaccaaggggaaatagaaatacagttttacccaaagtttcaaatccaggaggctatgatagcaactgtgctgtatactaaggcatacaactcatgagatgactggtttggtaacagtcctgagcgttttgttttaaagagctgggtcctgaggttccagacaagcaaacatgccaaaaaagtggttcaatgggggggcttgaggctcagctggaaaccatgtttaccataccaagtttaaaaaatccacacagctcagcaattgtttgaagtttttaattaattaattaattcataaagtgaagtattttcaaaagctcatctgagagcttatattctcttgatacagatgaattctcaattgctcttttgttttcattgcaaaacagttcaacttgtatgagactcaaagtggggagggcaggagcagaattttctctgttccgggtatagacattatgggtattgggccatattctcctcttcgttggtaataattcctattttatacatctttctatcaattgcagctcctaccagagtcaacgtcttgattgtaaatactcagtgttggttgatttgcattttcatcatagtcctgaaagataaaagtggacctaagaaaaactaataagcttacagccagttttataatgacagactctatataaacaaatgcaaattggatgtcaaatttgaattacaaaatttatttgagcaaggtccaggaagtaataacagtgtcttcagatcttttctaaaatgataaaaattcattaacaatcttccatggcttggagtctcagagactttcaaaagtcacagcactttgaagagcagagttggcaactaaagttatcagagtgaagaatggcatgctaacctcaggtgcaggatggccaactcaaagtagacctctattctttgttcttctgagataggaactagccagaaacttagttattcaggggtggggtgggaaggctgtgggacccagggtggaaggacccacacagttcaaaataaaacgaaccaactatagtgaaggaaaagagaactatacacagatagtattcctcatccccctgaattgacttatataaaaaagaaaacggagcatccgacaaattgatgcaatcaaaagggagcaataagcctttttctccttttaagcctcttaagaaataaacccatcattttatctagtgttttctctgctcttgcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaaggttagtagagattgtgtctgtgcatcaaagatttctctcttaatatgttcattttttaaatatacaattgttagccattacaaggaatgtcacagaagattaaaaagttaataatccttccaggatttgtgtaccaccaccaagtcactctgatagtggcagacactgaaattaatgtgttgacatctcttagcattcctgctttcatttgtaggtatgcaaataataaagcggtatcatctctagagatggcaggtttggttttttgtttgtttgtttgttttttgagatggagttttgctcttgtcacccaggctggagtgcaatggtgctatctcggctcactgcaacttctgcctcccagatttaagcaattctcctgcctcagcctcccaagtagctgggattgtaggcacctgccattacacccagctaatttttgtatttttagtagggacggggtttcaccatgttggccaagctggtcttgaactgacctcaggtgatccaccagccttggcctcccaaagtgctgggattacaggtgtgagccactatgcccagccaagatggtagttttatgccattttacagaagaaaaaaaattaaatgattggcacagaaacctacttctgtagtctccctacccaaaccctgtgttaaagttactgtaagatgttactaagatttgccttcccagcacaggtatattctaacctggctaagactgtctccctgagaagttaagaaatctagccaagtccctcctatcctttgttctctgttctcccctcttctagaagttattttgtagaagaacaatttttgctactttttaacattgaaacaagtaggacaattcaattcattcatttggagcatgaacggtacagtcacacaaagataattattttccagccatcaaaaagactattcatactaaattccaaattcctctgtgttattgtttttttttaatctcaatttcaagaaaagtaactgttacctatggcagagccgtatgcatcactgttcataaaaaaaaaaaaagataatctagtcaaaaggactttcatctaaattggctgattaaactgactcccagttctgtgctaggaatgataatctggtaaggggtttggtttttcctataatgttttggaactggggggaggaaatgaatgtacctccagaaaagcaaggtttttttttaactgaacccactttgcaaatgttaattactgcaaatgagcaattatgtttgcatagtgcaaatgagcaattatgttgatgcattttattaaatgtcctatttcagatgtccttcaagaacccaaaactgaagatatagtagcagtgcagaaagcaaaagcattgtacaggtcttgtataaatgaatgtaagtgctcttcatttgatttcattaggagtatatatatatatatattggtgccaaactatgcctagatttctaattgaatttatgtttgttgtttccaaaagctgctattgatagcagaggtggagaacctctactcaaactgttaccagacatatatgggtggccagtagcaacagaaaactgggagcaaaaatatggtaaggcaattttcctactaaaaaagaaatttccatgtaaaatctatgttataatatcattagtgaactaaagcttctaaagatatattttatcttttattgctttaggtgcttcttggacagctgaaaaagctattgcacaactgaattctaaatatgggaaaaaagtccttattaatttgtttgttggcactgatgataagaattctgtgaatcatgtaattcatgtaagtttgtgtgtcaaataactaaagttacctttaaattgtaataaaacttccacatacattgttgttattgatatttagaaataatgctattttcaattgaattgaataagcaaggaggtagtatatccatgctctgtccctaatacctggagttccaattttgaaagtattttcttaatgctgttttcgacattcaccccttgcttctgctacctctgttttagatacctctcccttcacaaaacaaatgataagaagggctccaggcccctcctattcagaaaaagttcctaatttctttgtatagtacttgaaaggagcatgctttcgtttatagaagtaatgcaggtctagaaaccaaaaaataataattgctttcaaaaagaacacagaaaagggattttaaacatcatttttttcctcactaaagagtatctgtacttttttctcaactaaaggtaaataaaatgcctttcttttaaaatggatttattgtatttttacaaatgtaaacaatttgatttaggtgtcacctaagactagattaatgactatgtttggaatgtactgaaaaatataaagagtttttctttcttcctttttttttttgtttttttttttttttggtttcctgtgtaagaaattatacaaaaaattgcaggctactgaatcacctaatcatatctgtgtcactattgcataaatctttatggtcgtttttgttaaaatcatgaaaggaattgaacccaaatctcctgcagtgggctctctctcttctgaaactttctccttgcaggatcaccttgaggaccagggggtggggaaggatcagggcccttcatgtggagatatcttctggctctttccataccagttctttgggttatgttttcttttctattggcctaggctctccacagctgctaggattctctctttaacccagaaatgctctgtttggcctccacactcatgttgccatgcagtgagtaggaaacaatcttgcaaagctgcagtatgcccagatagctcccacttgggtattaaacatggaccagacacgttagcgcaaaactgagtttcctctttcacacccttaactgctatctgggtctactgaggttcttctgagcagagcagctttgaggagaaccaaggagaagtcgcctccattcccttagggtagagaatcttaaaaaacattttctggcacaagttacattagctaaaagattctggagttaccttagaggttttccacttctccccttctccccatccatccaaatcaacttgaagaatattaacccactcccaccaatgaaaggggatcccaactaagggtggaagcagatgagaatgttcccaggggagcacattagaatctcaggaagctgagaaatctgtgaatatgtaatttagaaatttccacgtcctagaatctaacatgtttttgttcacttgcaccttctgctctgcattaaaaatccctcctagtaaatcttttgttcactttcttttgttttccttaaatatctgcagcacagtcctccagattatctaactgcccgttagtataacacttacaagtagtgtagaaagcatttcctaactaggtatttattgagtgtctgatggtcaccccataaacagcaagagtaggatctttcacatacatagatagacatgcttgtatttttcaaacttttctatattcactgaatgatttattttcttttatgtatattttttatagattgaccaacctcgacttggcctcccttctagagattactatgaatgcactggaatctataaagaggtaaaaagaaaaaaaataatcaaaaccaaactacaaaatgatctggtgtaaacctacaagtaatgaaaaagataaagccaaattaaatttagccctctgatgtttttcattcatgacagggacttaaaatcacacataatagtgagctgtctttgatagaatgaacattctcaatagaatgaatgaaggtattttacaaaactaggaaacttgaaattccttatttgtatcttggtttttagtatttaaaacatatgatcgattttgaaaagttaatttaaaatattttaatccacctgtaaactgcattatttaaaaaatgaaaagatttatcatggtctagggtggtgctggtgaggaccagagggtcagtgagagatacactctgcagcatccttctggaaccatctgatttgactgtcagagaactatgcaggtagtgacattgggctcagacaaacttttgcagctaccttgtgactctaacattggccaggtagccagtgggcatcatatcccatagtggacgtttggatgttctggagtgctttcttattgtctcacaaccttgcctcccttgggctgatgttcacgtgctctttttttttttttttttttattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacatgtgcatgtgtctttatagcagcatgatttatagtcatttgggtatatacccagtaatgggatggctgggtcaaatggtatttctagttctagatccctgaggaatcgccacactgacttccacaatggatgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttaagttcattgtagattctggatattagccctttgtcagatgagtaggttgcgaaaattttctcccattttgtaagttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtcatgcctaggttttcttctagggtttttatggttttaggtctaacgtttaaatctttaatccatcttgaattgatttttgtataaggtgtaaagaagggatccagtttcagcttcctacatatggctagccagttttcccagcaccatttattaaatagggaatcctttccccattgcttgtttttctcaggtttgtcaaagatcagatagttgtaggtatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatgaaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcttctgcaaacagggacaatttgacttcctcttttcctaattggataccctttatttccttctcttgcctaattgccctggccagaacttccaacactatgttgaataggagtggtgagagaggacatccctgtcttgtgccagttttcaaagggaatgcttccagtttttgcccattcagtatgatattggctgtgggtttgtcatagatagctcttattattttgaaatacgtcccatcaatacctaatttcttgagagtttttagcatgaagggttgttgaattttgtcaaaggccttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttggtatcagaatgatgctggcctcataaaatgagttagggaggattccctctttttctattgattggaatagtttcagaaggaatggtaccagttcttccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtcgaggaatttatccatttcttctagattttctagtttatttgcgtagaggtgtttatagtattctctgatggtagtttgtatttctgtaggatcggtggtgatatcccctttatcattttttattgtgtctatttgattcttctctctttttttctttattagtcttactagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagttttttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatgtgtctaatgttgacagtggggtgttaaagtctcccattattaatgcgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcatgtgagatgggtttcctgaatacagcacactgatgggtcttgactgtttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagcacttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatactggcccccactctcttctggcttgtagggtttctgccgagagatccgttgttagtctgatgggcttccctttgagggtaacccgacctttctctctagctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtataccaatcagacgtagatttggtgttttcacatagtcccatatttcttggaggctttgctcatttctttttattcgtttttctctaaacttcccttctcgcttcatttcattcatttcatcttccattgctgataccctttcttccagttgatcgcatcagctcctgaggcttctgcattcttcacgtagttctcaagccttggttttcagctccatcagctcctttaagcacttctctgtattggttattctagttatacattcttctaaatttttttgaaagttttcaacttctttgcctttggtttgaatgtcctcctgtagctcagagtaatttgatcgtctgaagccttcttctctcagctcgtcaaagtcattctccatccagctttgttccgttgctggtgaggaactgcgttcctttggaggaggagagacgctctgcgttttagagtttccagtttttctgttctgttttttccccatctttgtgcttttatctacttttggtctttgatgatgatgatgtacagatgggtttttggtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgccggttctcagatctccagctgtgtgctgggagaaccactgctctcttcaaagctgtcagacagggacatttaagtctgcagaggttactgctgtctttttgtttgtctgtgccctgcccccagaggtggagcctatagtggcaggcaggcctccttgagctgtggtggactccacccagttcgagcttccgggctgctttgtttacctaagcaagcctgggcaatggcaggcgcccctcccccagcctcgctgccgccttgcagtttgatctcagactgctgtgctagcaatcagcgagattccgtgggcgtaggaccctccgagccaggtgtgggatatagtctcgtggtgcgccgtttttaagccggtctgaaaagcgcaatattcgggtgggagtgacccgattttccaggtgcgtccgtcacccctttctttgacttggaaagggaactccctgaccccttgcgcttcccaggtgaggcaatgcctcgccctgcttcggctcacgcacggtgcgtgcacccactggcctgcgcccactgtctgggactccctagtgagatgaacccggtacctcagatggaaatgcggaaatcacccatcttctgcgttgctcacgctgggagctgtagactggagctgttcctattcggccaacttggctcctcctccttttttttttttttttttttttttttttgagacagagtcttgctctgtcctgtcacccaggctagagtgcagtggcgcaatcttgggtcactgcaacctccgcctccctggttcaagcaattctcccagcctcggcctcctgagtacctgggattacaggtgcccgccaccgcgcccagctaatttttgtatttttagtagagacggggtttcaccattttggccagtgtggtctcgaactcctgactttgtggtccacctgcctcggccccctaaagtgctgggattacagatgtgagccaccacacctggcccatgtgcttttcttacagaaagtaaggaacagcaggagacaaaactaataatcttacacgttattagatattggggaaaggtgttggttctacaaaggtttgtcttataattattttgtagctcaaaagtaagttatctttgatgatcctaatggctcacagtgtagtgatgtgactaaaattacattttagttaaaattactagctaaatatgtttatgattggcatttattttgccaaattatgaagttcgaataacatggaatgaattcactgtaaggtatctttttgaatgactacacaacactgaaatgaagaaaaagatatatcatcaaaggccacaattaatagcacagataaatacatgggtatgggatatttgagttcagtacaatctagttgctgtgtggggtacagctactggctttaagagcaatgcagctgctttctgttacagatttgaaagtgattgaggaattttggttcactattgtacatttttatcaccatgaactgggatgcttttcatatttaggattgtgttcttatatcaaatttttcaaatcctatgatacatattttttttacattttaattctgatatcaaggtatacctggcagtcgatgtatatatttaaggcagtaaaagctttttttttttcattgttaagatgttgcatttttgcattttatactcaatgctatcccataatctcaaacaggtcacaaactggcagtctttggcttgaatctgatatagaagcatttttgtttaacctgtagtgtttttttttaaattttgaattagttgtcaatatttttcaaaattgaaagatttcatttgagaatccagatttcttagtaagtcagtagaatttgagcccctagcttgcattcttatatggcagcaattgaccagagtggtgttgtggttgctccttttagaaagggcatttattggctgggcgcagtggctcatgcctgtaatctctgcactttgggaggccaaggcgggtggatcacctgaggtcgggagatcgagaccagcctgaccaccatggagaaaccccatctctactaaaaatacaaaattagccgggcgtggttctgcatgcctgtaatcccagctacttgggaacttgggaggctgaggcaggagaatcgcttgaacccaggagataaaggttgcagtgagccaagatcgtgccattggactccagcctgggcaacaagagcgaaactccatctcaaaaaaaaaaaaaaaaaagaaagggcatttgttctccaggtttgaacagttttgaacagtcctcatcaacatgattcatcgatttatattgacttatcggctcctgtaggcacttgattttgcatattagtctggtcttggctaagccacagcagtaaaaacacaaatacagtagctcaaacaagaaaaagtttacttctgtctgtcatgccagtctggaagtaggcaggccatccagatgaggcaggaagctctgctccatgggaatgtctgggagccggctttctttgattttttgctctaacatcaacctcctctggtgtttttcttagtctatttggtcaaagttggttcaccagtgccctattcacatgtcaggccacaggaagaagaaaagagagaaagtggtagacaaatagttaacctttatgtaaatggcgcagaacttgcatacattccgttgcttaaaacattgtcatgtggccacaactaaatataaaggaggcaggaaaatgtagtcttgagcagtggccatgtctgtgtcttgttaaaacttggttggcagagaggaaggtcgtatcatttaaaagatgaggagtacatataccaatgtcatttagcatactctgccacagtttacatccactgatctagggaatactgtatttgtgatcaaataacacagtggtgatcaaatctagaatcagtaatatgtttatagagtttatgagtgagaaatctgagtctcagaagtttgctgtcaacactcagcagaacagtagtatagtggcaaactttggtccttctctcttcttcattctactacattattacaatttcttaagagttggtacttcatactagtagagttctttgaatgagcaaatgatagaagaaactaacctgcactggcacttacagcccggaagttattctcagcttaaattaggtgctcttcaacgatctgaatcagactagcaaacacgcagcatgcttgctgccttgctcctcttccataactatgtacttttggtgacatccttctttcctgctaacctgagatctcagaattcttcttaaggtagtgcttcaagctgtaagcaatctcctttcagtggaagggagttgcataaaaataaaagttacatgtcatcccagaaatgggtaattatctgaatatttctgcaccctctccctttttttaaatccattcttttgggcatgggggtgagagcgtgtgtagttacagtaagaattccaatgttacccttatttttcccatgatattttctactctctcctaatccctaccacctgcaatccctcagtttcccctgcatttctggcaaaattctagtttttccactactctgctatctttgaaagatgtcaaccaccttaagtatttctgtcttgtgtcttattgcttcatgaacaaaaaatggtgcgaagtgtagaataacaagtttaccttcagtagaggagttataaatctggaaggaatgttaatgtcagtgtatcattggccttcaatgattttctcccttataggcttttatatatgcttttccctttgcctagaacttgccccccacacacaccacctgcctacactctttcctctaatatagttttcctagcacccaggtttctgtatacttcttatttaatgtctttttttttctataaaactgtaaatgaagtggaagcaatgctgtgtctcattgccctttgctctttttctaatacctaccaaagtttctggcccttaaatactacagaatcagcaaatgaatgattgagggggaagatagcagggaagagaggaaacaaaagaaagaagaacccaatcttttggaagccctccttgtttccttcccttgattccgggaaacatgagctctagggcatcaatagctaatagcatacatttctttagcattttacaaactctgtgttctcttttctcttttcaatccccagttacttctttgctaaactcagtttgcctgaggtatatttatacaatcaatgggtatcatacatttgcagtttacattattttattggaaataatcaagagaagttttgagaattggcatagggtcaccaactttttttgtcaaagaaagatggtcttagaccagagaggtctggcttccttgcccgtcgctttagcctataattttaaaactttagtgtggggtctaccttctgcagatatgcctcagaggctgaggatcacagagggtcacattccctcttcagtcaaaagtactctaatcgtaggtctcctttatcagattattaactcagcctgtttccccaggtcttctttgatccttccttccaggatatccaggtcatccagaggtatcatctcccataatcttaaaaccaaacttcttatcgactatgaaaatagcccccacaattactaagaagatcatttcactttatagaagtcattttttttttgctttggataccctcataatggaatttttgtattgtaatatttgattattattataatctagaaagggaaagtgatagagaacagttgcatcatctcagaaaggggcccacattcaccgtgtctgctcttcctaacaaactgttctcaagatgttctcatcaaggagcttcttgtgctatatctttgttaaagagatggagcctgagttctgaggtattctgattatctgaagagattacttaatgacacaatgctatctcaaagaacagaagtagggagattcaagacaattctattccttacagaggtacaaatttctatgctaggaaaacaatacgaaagatacacatggcccataaacataaccattcccattcacaaaatttgtaagtgaaaccaaccagcaacctcatgtgagaatgttcttctatattgattcactgagagaaatgaggaccttaattttcttaagaaatcacccaccttcagaagagtctgaactctgtattgggggtgaattggaattggtctcaaagcttccctttctctaccttcttagcttttcaagagcaattgttatcttactttgttgtccttcataaggaaatctgaagattaggaatccaaaatatttgagcataattacataatagatatgtttatgctctgtactgatgtttgcctgagaaggagcaataagtgaggttagtggtttccaactctaaggactactttgtgtgtgccaattacagggctctgtgcagaaacacctcacatgtacacacacttcaaaagccactatgatttatttttacttgtgcatttatacatccacaaaacatttctttgagtagagcatttcaggtctaaaagaaaagtaagaaaaccactcaggctagagtttgagagcataaggaggcgggaaaggaactggagagtagaagctacagggtatactgctgcagggcatggctagggagaagaagccagagttataaagaagtgtagagccttcacaaaatctgaggttcataaaaatagagacattttagggatgaggatagaggacttggaacatgggcacaatggactgaagccagaaagcgatgacccagagtctgtgctcctagatcagaaaagccaggagaagtctccaaattatatgtacctgggaaagaacacaagctgagattggctatcctgtagatgagcaggtgcaagctggaactgggattaaacaagaggggattttctttgtccacctacccaatgtacaagctgagagaaactgttcaggacttgagctaagaatagaagttccgaggaaataggaagtgagagaaacttaatatatttacaatttaacttcatttttttttaattcaacagatcttcattgagcttatgctatgtgacagatacttttctaggcagtagacattccaaggaaacaaggtccttgttctcatggaactcatgttctaatgggaagagatagacaataaataaccaagtaaataatttaaggaaatgagacaaattgtgagtgttataaagaaaataaatcaaggtgatagaataataagtgactggggtaaggcatgggtgattcaatttggcttgctgaaaccatctctggctgttgtttgtagaatgtgttttaatggaagcagaaagatcagagaaggccacatggtaattcatgtgaaagataacgatggactcagatggcagcaagtcagatagagaaatctgagcagacctaagataatcttgtgtaggtggctctatcattatagggaaacagtttgtgtactttaaactgctcggccaatatgtgcctcagtgatacgtggcggagcttgtctcactgcataacacagctatgacatgataagacaggccctgcaagggaaactgctgacctcactttgtcctttctgggtaccaagtgactaatagtcagaaggtttcactcagttcagtaatctgtgtttaagaaaacaaaagggggcttttaaacatgagatttagtgaatatgacagagaatttttgagatcaactgaactcagtttgtaaaaagagctagattcagccccccaagcatggaataaaccttggaagttatgcaagaagttgtacaaatcttcaggttcttattgataacctgatgaaagccccaaacagtccctatgctggtccaagtttgggtcctcttaggtcccacgttcctcctgctctagcgtcctgctccactgggggctattttttatttccagtgcccagaaatggctgtgtgactatatgtttgcagtctgttggagggaagcaggtctctctgctaacaactgcacactagctgacatgctgcttaaattgagaaatgtttctaagcttttttggtaggaaataatctttcctgcttagtctccctctgtgttcccccagcaaacttcttgtgtagcattattaaatattccccaacatcagtggccaagaatgacacaattctgtgactcctcagtcacttcatgctccacattaagtggagtttcttcctagaatggggaaggcagaacattggtaagagctaggtgtctcagaatctttggaaataaaatccctgatccataggtagttggctcgctaggttacccagatatcaatctgacaggacagttttctgttcctccctgggtcttgattgtcattcattaggaatgaaattaaagtttgaaggacagtagtcaaatggcattcatttgctctcttcctctttggcaaatctaacaaacatcaggctttttccaggcaggaagagcctcatttctaaagagccaatttataaatatcattacctgattctgcaaaatgaagatagtcctaactagagtaactatccatggtgttgggtgttagtaaatatcatctcattggtagtgtgtgattttaaaacccacaaaactgctattatatggattttatctaactgtttaaaaccgatgatcacctttgaaactactgttacgagtactaggacttacaattttttttttaagaaaagctacataaatgttttggtggattcttcttcacgtaaacaatcattgatttgctatctcagagcttcaagaaatctaccttatgactgtcaaaaatgagagctgactctggcctctgttgtaataactaattgctctctcagtcacacacacacaaaattaaatttgggtttaaaaagtatcctggccaatctactttttaagtgttaaaatacatgttgatttgcctgacgtggtggctcatgcttgtattcccagcactttgggactcagaggtggtggatcacctggggtcaggagttcaagaccagcctgaccaacgtagtgaaaccccgtctctactaaatacaaaaaattagccgggcatggtggcacatgcctataatcccagctaaggcaggagaatcacttgaacccaggacgcggaggttgcagtgagccgagattgcaccattgcactccaccctgggcaacaagagcaaaccccgtttaaaaaaaaaaaaaaaaaaaaaaatatatatatatatatatgtataaagtttcttcccaaatcatgacaattatcatcatttcacattttccatatctggaagtatcataataaagaaaattaaaaccttaaggtagaatcacatctcgtacaatggatttagcacggcagtaaccttaagttctgacaccagataaatttggaagtcaggaaagatagtcatgatactaagacatatgttttaatcagttacattggagtagttaccaggtaatggaattcattaaaagaagtggtatattccatgtagctatattaaatactcgagcatcccagaagctagtgatactatatgcttccagttttctgagaaacttgaccagtttagcagactagaagcatcatccaaagttcttgtgcttgctttatatcaaagttctatagtctttaaatacatcggtaaggataaagagactggagcagaatcagtttgctgagtcaacaaagtgcccaagatgattactgttattgttttctcacctcatcaacaaaaagcatcccatatatatatatgtatatatacatatatatggtgtatatatatatgtgtatatatatggtgtgtatatatatatggtatatatatattttccaatatcaattttccaatatcaatctactgagatatatctcagtagattgatattggaaaattcgaactaccattttgtttatagtcagtagtaataccctgctaaaggtcgattgatttatatgctttgggaatacagttaattcaaaacactgcatgcttgtactttggaatagttggtcccatgaggtatgaactcagacatactcgtttacttcaaagtgaaacaaaaattctgattaccttaaatagaaaaaaattgagttgctgagaatatacgtaaaattgtcttttcatttctgttactttagtgattagagttttttaaaaatataatttcaagttttattttagattcagggggtacatgtgtagttttgttacatggatatattgcatggtactgaggtttagaatatgaatgaccccatcactgaggtagtgagcatagtacccaatagttagtgtttcaacccttgctccactctctccctccaccctctattaatcctcagcatctattattgccatctctatgtccttaaatgcccaacatttagctcctacttataaatgagaacatgtggtatttggttttctcttcctgcattaattcacttaggataatgacctccagctgcatccatgttgctgcaaaggacatgatttcattcttttttatggctgcatagtattccagggtgtatatgtaccacattttctttatccagtctaccattgatgattctctaggttgattctacgtttttgctattgtgagtagtgctgtgattaacaaatgagtgcatatgtctttggtagaatgacttattttcttttgggtatatatccaataatgagatttctgggtcaaatggtagttctattttaagttctttgagaaatctccaaactgctttctgtagaggctaaactagtttgcattttcaccacagtgtataagtgttcccttttctctgtagcctcaccagcatctgttcatttttgacttttgataatagccattccaactggtgtgagatggtatttcatcgtggtttagatttatatatctctgatgattagctatgtttaatgttgtctcgtacatttgttgaccacttgtatgttttcttttgagaagtgtctgttcctgtcttttcctactttttaatggggctatttgttttttgcttgttgaattgtttaagtttcttgtagattctggatattagacttttcttggatgcctagtttgggaatgttttctcccattctgtaggttgtctgtttactatgttcatagtttcttttgctgtggcagaagctatttaatttaattaggtcccacttgtcaatatttgtttttgttgcaattccttttgaggacttagtgataaactctttcccaaggctggcatccagaaaggtatttcctattttgttctaggacacttagagtttgaagtcttacatttaaatctttaatccatcttgaggtaatttttgtgtatgatgaaagttaggggtcccattttattcttctgcatatgactagccagttaccctagcaccatttttgaatagggagtcctttccctgttgcttatttttgtcaactttgtcacagatcagatggctgtaggtgtgctgctttacttctgtgttctctatcctgttccattggtctgtgtgtctatttgtgtacccagaccatgctgttttgactactgcagcattatagtataatttgaagtcaggtaatgtgatgcctccagtcttgttcttgttgcttaggattactttggccatttgggctcttttttggttttatatgaattttagaattgttttttctaattctgtgaaaaatgacattggtagtttgataaaaagagtgttgaatctgtatattactttgggcagtatggccatttgatgatactgattcttccagtccataagcatgaaatatttttgtttgtttgcttcctctatgatttctttcagcaatgttttgtagttctccttgtagaaatatttcatctccttagtcagatatactcttagatatttatgtaatgtgtatgtgtgtgtgcctattgcaaatgagattgtgttcttgatttggctctcagcttgaacattattggtaaatagatatgccaccaatttttattcatggattttgtatcctgaaatttttgtgaagttgtttatgagttccaggagccctttggcagagtcttcaggattttctaggtatagaatcatatcattagtgaaaagagagagtttgacttcttttcctatttggatgccttctctttcgttcttttgcctgattgattgatctaggtaggacttccagtactgtgttgaataggagtggggagaatggacgtctttgtcgtgtttctgttctcaaggggaatgcttccacattttgcctatccagtatgatgttggctgtgggtttgttatggatagttcttattattttgaggtatgtttctgcaatgcctagtttactaagggtttttattatgaaaggacattgggttttattgagacttttcccacatctattgagatagcccaatggtatttgtttttaattctgttgatgtggtgaaattgattaggatcttaatgcagattcacagatgaaaaattgttctattgagtagcaaatccatggatagcaatcacagctagatagtcacagcattacagagtatccatgaaaagaactgtttacttagcatttagtaaaagtcatagaataccagtatataaacctctggacttacaaattgataataattttgtacatttttcttaagttcttgcttgatcgaatatttctattttcctattagttttaggtttgattaatggatcactgtaaattcagatgcacctttgcactcacagtgaatatatggatgttccttccacttctaattgttccataaggatgtaaaatattcttaaaactgtgaaaatgttaaagcacattatagcacactttatagcctttctttgtatttaccctgcaaacaagtctttgaagcatagaaatctcacctatccataatcacaattgactgctttactaaattttaaaatgaggtggaatcgtaatgtattttaattgctaataggtaataatggctaataaatagcaattggttcaaacctaacaaaagtgggactccatttcctagtgttcttgccactgtgaacttgaatgaggcatttatatattctgtaaaaggttagtaatacaactattctatagtttacttttgcaaattaagatgtatgtgaagataaaatataaataatttgagttatcagaagaaaactaatatctaaatctatggtatcgtatagtgaaattttacagtaacaggagctatttatggaattaactaaaacctacaggtgtgtgttggtggagctcctgacaacacagcttcataaaaaagaaactgcttgactcaaggagacagataaaaagaagtgtgattatattatatgagtttgtggtcatttttccatgaatagttgagaaaatgactatgaaaaagagatttggtaaagaaatgtattattatggctgagcatggtggctcacgcctgtaatcccagcactttgggaggccaaggcaggcggatcacaatgtcaggagtttcagaccagcctggccaacatagtgaaatcctgtctctactgaaaatacaaaaaattagctgggtgtggtggtgggcgcctgtactcccagctacttgggaggctgaggcatgagaattgcttgaaccatagagatgtaggttgcagtgagctaagacagcaccactgcactccagcccaggcgacagtgtgagactctgtctcaatgaaaagtaaaataaaataaaaaaagaaatgtattattattcagcgaaaaaattagtatatgttattgcttatcaagtgttttgcaactcattctaatcaaggcaaaataactttattgaaaattgaaaattacagtctccataaccaagtggttatacattacttagtactttcaaagtgatacctcattgctctcctttaagctcttattcaaagatatattgactgtctaagaatctgtgcaggtcatttctttaaatacttagaaaaggatttttattttactaaggttatctattaccaaaaattaatattgaaatgaaaataaattttaagtaccatgatgaatatttagagctactccaacagtttagtgctatttttttcttgcaggcttgtacagcatatgtggattttatgatttctgtggccagattgattcgtcaggaagaaagattgcccatcgatgaaaaccagcttgctttggaaatgaataaagttatggaattggaaaaagaaattgccaatgtaaaacacatttttttttctgatacactgaataatgtcaaccgctttttttctttcccctctctatcatactttaagagtaaaaggtacagcactttaaccaagtagtaaaaatgcatggcttggtaatagatcattgacttcaaaaggacctttgaaactaaagaattttatagtaaactgggttcctgacatttaaaagacacactaaattggacaaatattaaactagaaacacttaattgccttttataagtggattccatcagaattctaccatttacagtcaaactgttgttagatgcccttcagactcagagcaaatgcaaagctgttttagttttgatatgtatagaatattactttattttaaagtttaaagtgatcacagagattgtctctatttctttgctaagaagtattaacccctgaacatagccatgtggcaatgtgatactactgagttcaaattgtcaggctgctgagctgacggagggtaagacaataattttgcaacaaagcccaaggagtgtattcctgaatttcttctggctctagatcaacccttggagtctgagttggcactttcttccctgatgattctttgatagggcactgcagtctcaagtgagtgaactctgagtctaagcagcatccaggttattgattaaacccatcgtcagagtcagtctaggacccacagagttctctttgtcattgcaaacgacaacctgcatccctgactccctatctgcttgcccctgccatctaagctcatcagaatcttgaagagttaagatcatggagggcaattttagctttcctggggctacgtgaaaccaaaaatctcctatcagaaccagggtgttcttggagctgccactgaatgaatggcatttgaatgggttacatgtggttctgtgttggaaacagacttgctagaggagaaatgtttcctgctctgggtttttgccacttgcaccttcccagaccatgcgctcctttgaccagcatcagctctgtagtgttgtgtcttacctcagcattatgtgtctatattctcactcttgtattagattcttgtattagattggcatgaggccttagacgtctttgaatcatttatgcatctctaacaaaatccagcatagtattgcacaaaggacatgctcaataaataattgttttcagtaaatgaataggtaagtgacctaaaggggaaactggagccattgtcactgagaaataattccaattttaaacctttaccttttgtctcttctcacttaaaattgcttttactcatttcagccactagttggggagttgttattgcaatttttctttttaattcagtgaaagaaataaaattggatgctgctggtctggcaggataggagaacagtcacaaaggtccatgatgttgccattctcagataacttgcaaccaaattgtgctctgtactaggaagtttctctgttacttgcgataaattcttatagaaactcttgcacctttttttccttgctgaattttaactaggacaccgaatggtaatggtgaagatgggagagagagtatttaagagagaaattggagatgactatatcaaagaaagttaaaatatgaaacattcacagacacaactgaactggccattagccatagctcataaatattgcttatatggcttggcagttgtcaaaatatagacagattttttaaaaattttaaacttgaccccacagccaaatctcaataattcttactacttctactccaaaaatctcttacatttcactttttttgaaatgacaaaacaaattacaaaaacaagtacagaataggacttaaattatgttgtacctatcctatatttttaccctcatatgtagttatatttttctaaagaattcttaattctaaaataatgattaaaaattaaatccataggctacggctaaacctgaagatcgaaatgatccaatgcttctgtataacaagatgacattggcccagatccaaaataacttttcactagagatcaatgggaaggtaagtggtaagttttttgtgctctcttattgtgccgttttctaaattataacattgaaatactctttctaaaattcgtcaagtttttatttattgaagtaaatgggacttcaattccttttttttttttttttttttttttgagacagggtctcactctgttgcccaggctggagtacagtgacacaatcttggctcactgtaacgtccacctcccaggctcaagcgattctcctgcctcagcctcccaagtagctgggactacaggcatgcaccaccacacctggctaattcttgtatttttagtagagatgaggtttggccaatctggtctcgaacccctgagctcgagtgatctgccggccacagcctcccaaagtgttagccacaggtgtgagccaccactcttagctggtaaaattccttttaaggcagctatacaataatactagaaactcccataggaaggggtttgaaaaatactaaaactgaaaatctttctgagaggccattatgtagtcatcagacttggacagtcacacaataaaagcactagatttccttttaactccaaaaaaggataatttattcatagaacttcccatgtgctcatcaaggccatctacagaggtgttcagaacaataattcagaaataggacacaaataaaaagaaaagctctctcatagattccatttataaacagcagttgacttctttttccttacctagtatccaataatctctttttgtggctatgcatttattctcgtgtattagttgatgcacacagccaagagatgaagcaatatccatgggaaaacctacaaactaccacattcagcgatgacattctctttggcactaattctagttaacaaggacttttccaaaggcataaactattgagttagacatcttacatagaattttttaatataataagtgtttaataaatacgttttgaaagaatgacctaaaccaccaaaggaaatgaagaaaattgtatagcatagcaccctatactcagtaagtgatgtgtgcttgtgtctgtgtgtgtaaaatacaacctaagatattgatagtcttaaacattatcaattcccatttagaaagacaagatttcatcttttggcaactccgtacttagcttctgaagtataaacatggcatgcctgtagacccaatatcgataattgaaaagatgctgttttctttgacttcataacatcactgtaccactgctataacagtatattttcatctataataggatttccactgagatgtgttactgtgtttgaatgaattgtttattaatacccacttttaaaagctaaacactttacacacatttccatttttgcataaaccaaaaaagctttatttttaaatttaaatttaaattatatttttattttctgtattggttagacaaagaagatgacattaagcctaatttctaggtatatgttccttaagcttaaaggctttgttttcgctcttaaatggttggcttaattatgctaggtaaataatcatgttgcagaactagtttttatttaaaaactgattgaaacaattgaggaagaatcccaagtgaatatcaaactgatccaaccctctaactataactgaatcttggacccaagaagagaaatccacaatttctgaatgtttcatgcctgcttttttccagccattcagctggttgaatttcacaaatgaaatcatgtcaactgtgaatattagtattacaaatgaggaagatgtggttgtttatgctccagaatatttaaccaaacttaagcccattcttaccaaatattctgccaggtaggtatgtcacagtccccatgtcctcaaagtttgcatttcatatcactcttcagaagctttgcagcctcatcttttctgttgctgggcggtggttttttttatacagagatcttcaaaatttaatgtcctggagattcataatggatcttgtaagcagcctcagccgaacctacaaggagtccagaaatgctttccgcaaggtgaagaaaaaatctctcttttcttaagacttaaagcataaagtgatacatggttatgaaggcttaccatgtacactgctaggacatggtgaactttgcaaagggacaaaatgccaaagttcgttatcttgcacatatttaggacatgttgctgaggaagataaatcttcatgggctttaccatcttatgatggtctatgtggcacgatgattgcattgtcctgtaaggagttacatttggttatttaaccagttcatgaaagaatactgtctggattttttgttgttgttactgtgttaaaagtaatttcggggttatctattttaattaatttgattttcaggtgctcattgcacactggacatatacacagatggacaatattgatgtgggcagtctattgaaagtacccctacctggagttaaataagaccttttcttagcctatacctatattatttaaacaatcactgttttggtactatggtgaggggagtaggcagtagggattgaggaaggagagactccagcaaacatgttagttggagtcttggaaagaaaataacgtggactgattaaaatttctagtttttatccttaaaaagaaaatgtagacatctttttaaaattaaagaatgcaaaaatgtattgtgctaaatctcccttacttaggttatcctgttattcttaaatttatacacatacaggttctgtaagtactcagagttcagctaaaaccttgaaaagcagtaatgtgttttctcatataccatatttcccccattacatttattgaatatgacttcacatttatgtttgtgcagtggttacagtgttgtatgtttttctaacgctttctacaatgatattaagttgtaatagcaaaaagttctactggggcatctactgaaaatatgcctagttttcagatcatatataagtaaacaatccatttggattacatttcatcataggctaggaacatgggccttgtgaggagaagtgatgaatatttcaagaacttagatgagacatttgtgaaatgtgtgctcttaacatgctccagacctttccttctggtcaaatgccatttcctttttcttttccgtaggccctttatggtacaacctcagaaacagcaacttggagacgttgtgcaaactatgtcaatgggaatatggaaaatgctgtggggaggctttatgtggaagcagcatttgctggagagagtaaacatgtggtaatgttttcagaataatacactgtcagttatacaggacactatcagtttgttcacactgatgagcaattacagttctccatcatttggctaaaattttattaatttaggcagagaacctctgaatcataatatgccattgtttcccaataaatcttcccttgccttccccaagagtctagttatgtttctgctcctaatactgtctagtctgaaaccaactcaccattttccagaagcagtgtatttggagtacccagtaacatgttctattgatatagtcatttataaactcttctattatcaaaattgcccccaaattagtattttcttaaaaacatagaaagtaaaacaggatttatttggagtataagaaatgtgctttatttttcattgttaggaaaatgaagacagtggaacttaatggtatggtgaaagaatttattgaaatgctactttatgcttagctaaaccactaatggtaatgacagccctaatattttacattagttcttccagtatgatagtgaaaccattatattctgaaaatgatttttaccttaatgcatatattaagacctatttaatcaagagtgtcgataatagcaatattgcttttaaaatataatggtcccatatatctgttagcttaggtcacagtttgtctataaatttacgtttattaacatattaagtcatacaaagatagcatgtagctctatttttaaaaatctgtgttacaaagaatgaattaatgacctatatttgtcttctgttctgatttgaggtcgaggatttgattgcacagatccgagaagtttttattcagactttagatgacctcacttggatggatgccgagacaaaaaagagagctgaagaaaaggtaaagagcagacagctaactagcaaagaaaaatctttgctagtataggaaaaattaactttaaaaacatttagaaaaaaatataatcaaagattgcataaaaacttgtaagctccttcaatatgtagtgtttccagaaagagtttttgtggataaagatatatttctacaattttaatcttttatctctgcaaccaatactctagcaaggtgaaaatattaagtttctgttcaagcaaatgtaaggtggtgcactattggtgcattataagatctataattaaagagatgttgaagaagcttttttataactattcatgcccacccataatgtgcagcttttattgagacttttactgagtttcataagaataggtctaagatttctcaggaaatcttaggtttaaatttactgtgatcatttgtctttataattatataataactagggggaacatgtcctgtgaaaactgttaacatgctttatgagcaacattcacatgcatcctgactaatctctgtagttaggttggcagaaaaagcagacgatttggattgatagaggagacaataataaatgtattttaataagataatcaaccttggtctagttttcttttagaattaaatcacatggaaggactatcttttttcagctctcaaagagccctgagtgggttaggcctagaacctctgcccccagtattgctatctttccatcactctggccagctcttcagacattcaggttggatttgctcctttcatgtcacagctgtgcatgacatggctctgcttggtaaagccagttggattgttctggatcggcatttccaaagtggtgtcacaaaatactggacatgcaagttattccacaagaggctcatggtcaaaagagtttggtgaacacttcttgtaggaaggcttccctcatctcaccctaggctgggttacatgctcctagggtgtgattttattatcatacgtgggagttaatatttatttcactgcttatcattgctgtttacaataagctctttatggttgggggcaggggggcagaaaatactgcctagcattatatcctcagccctttataacatacctggcccttggtagacccttgaaatatattgagtgagtaaattgataaattaatttcccatcctggacatttataataacttatgattctaaccttataatctaacccatttttaattgtaagaagtcctgcaataaagaaacttgcttaatgtttttgcgacagcatttacccgaagtaattcacaataatttttttgtgtgtttactaccttatactttctgtagaatttgtatcctttagaacactctttaaggaaatgtcttacagtaaataaagtatcattaagtgggggctggattgtcatgactgatggcaaacctacaagaaaatgggtttggcctcagtgacttcagtgatacatatgaggcctgatccactgactggggaaatcctgggctcatgtgacagatttgtaataaaactgcatccatttgatgggaaaccatgtaactcagagatacaggctaaaccccccatgaaaaatttaaattaattaaattatttaagagtgatacgaagtggtaaaatcaaaagtcaagtatcattgagaaaatcaagagagaaataaaataaaaatagaaataacaagtagtaaacaagtgataatgaaataataaaataagtaaaataaaccattttaaaataattaaaaatgaactttagaagtagtgataaataggccaggtgcagtggctcactggtgtaatcccagcactttgggaggccaaggcaggcagattgcttgagcccaggagtttgagactagcctgagcaacgtggtgaaatgctgtctctacaaaaaatacaaaaattatctgggcatggtggtgcatgcctgtagtcccagctatttgggaggctgaaatgggaagatcacttgagcccaggaggtggagattgcagtgagccctgattgtgccactgcacttcagcctgggcaacagagcaagaccttgtctcaaaagaaaaaaaaaaaagatagtagtaaatacataataaatatgagctggaataacaaggaaaaccccgttttccacttaactaattaatgtcatttattgaacttgagaagataggtacactgactttggagaataaaggagaacataaaaactccaggaaccaatatttaggactagtattagcagtaaacctataagcccatatctgttttctcagtcaaatcaatgaggcagaaaggtaattataacctgctggaatggaagctgtaaatattacttcttctaaaaaattgaaaaaaaaagctttgagagaaaaagttcataaaagtacaaaatatgtggaacaatgagttttgtcagtttttatgttggttttcttgagaaagctgcagcctataaggataaggcattagaaactcaatttcagacctgattttcatttattcttgaacctcccaggaaagagccattgcaaagatctctgtttaagtatgtcagacactcattttatgaacagtatggatcaagttattcaattgctagtcatgggcagattataaatttgtatctgaaagttatataatcatcttcacattcaatattataattttcataggccttagcaattaaagaaaggatcggctatcctgatgacattgtttcaaatgataacaaactgaataatgagtacctcgaggtaagtctctataaaatagactctggactactgatacttagggctggtagtagtgtcatttttagctatggggtgcctgaaattatatgaagtagcctgaaaccacaggttgtattatataaagccttcaacgctggtgccagaatgatatttgttttagcctttttgttttcattagccaggactatatttggttattgttcatttggtttccatatattccattttaagaaccgtaagtaaaatctggtgtcctttaaagagtatcaaggaagggatagacatcaaggtggtgaacaacaggcaggcttcttatcacattttacacaggcttcgagtttccctccaccttctaagttttcctctactggaaaaaccaattcatgcctactgtattttaaaaacaaaacaaaacaaaccctgatatttgagaactgaaaactattttgttctgccctggtaatgtaacagttaaaagagcagagagttgcttaaagtcactgcagtgctgatttcagactcaactgaaagtcttgctgctaactctgcagtcaccacaactacatgataccctgatgacagcgaggtgatccttgcccaggtcctgggatgacagtgattcctcattcattgattactagtctagcatggggatttgcaaaccatactgccttcttctctctttccatttgcagaagaaacttgactttttcttttaaatgagctggttatagcttgcaagacccaggggtccttatagcaggagcatagtggctacgaacacagactcaaaaccaagttccttgattccagatcccagttccaccactcatttaaacttggtcgagtgactaaactatatctcagtttccttgactttaaaatggggataggagcccttagttcatcggtattaaatgaacataatattagattctattagtataatagaattaaatgagtataatgtaaaatttaaagtacttagaatagtacttggcacatggtaagtactaaagaagaatgtgctattatccacatgtgttatgtgaagattaatgtcattaatgtgaggtttgtttgacacttggtttcatttgattattataaaataatacactgaatttgtgatttggctggaatactgacctgtgatatactaatagaattaggttaactggaactacatccttttttggtaagttttttaatgctctcttttaactttattgactgatataatttaagaaaatccctatgtttttagcaaaaatttagaagataccggttttaatatttcttcccaaatcttctttataatacagttgaactacaaagaagatgaatacttcgagaacataattcaaaatttgaaattcagccaaagtaaacaactgaagaagctccgagaaaaggtggacaaagatgagtgcgtatattctcatttctaatgtgatcatctagaagcaggtctttccctcctttctttgttggattaagtgaaagagcctcagttagaaaaatattaaaaagtacaaagtcctctttttattgagaacttctaaaagcatctaattatggtatactaaagatatggatcaagactttaaccagattaaaatacctttctcattaaggtatcctcaaatttacatgtctttagtttcgtcttatgtcattgcctatcagctcaatttatttgtgaacaagattctcaaaaaccttagcttaagtaagccaattcatagctcctttaagccttctcttaggccttactctgtgtccagaattttcttctgctgacagccccaccttttttctatcagtcaatcccacaactccatccccttcatagatagttaatgtaagacttttctaaccctgtggtagtcaaataggagatactaggaaccattcttattcacagtcttcttatgctcttaatctctgcttattagtgacattagtatttcctaataactattagtttagattttattttttctattaaatagatataactaacatatttatcagcatatgtgtttatgcaccgaaattcctagaaccacttatgttgactttttctccctaggctcttagcccctagacaacaggggctattccttttgaccataaagtctcagcatctagcatactgaagaatctcagttaaaacaaaattaatgagtgagtgagcaagtgaaaaataaatatactaacttgatttgtgtggtaactaacacagtaacatgccaaagaggtgcttgtttcattcatgcattcatttatcctttcatgcatttattaacattttggaacacgaagtccaggtgtcattgggtactgggagaatcaaaggtgaactttgattacattacaagagcagaaggtagacaagacatggtgtaataaactgcaccaccaagagggaaatgtcgtgccaagcaaagtacaaagtgctgtgggcttatttgatgataagactgttctgttctcagtaaaccaagtacaggttggacaaaactgctaatggaaatgccagtgcattttaatccttactcaacatgttgaactcttgcaacactgacgtgtcctgaaagagagagcaactcttttgctgacttctaagttcatattggaacaaatattgtgttatctgatgctaaaaatgggattgcaaatattatagaatgtttagtgtcccatctgggaaagaaagagagtgaatacacatgcttggcattataatcaagttaccatatcctgtctcttgaaacacacaaaaagttatgcaaaataattatctgggtgaatttatgatctgagaaatttcttataagtctgtatatttgtatttctttaaaaatagacatactaagatttaataattgttagcactataaaatatctatagacaaatactgtcaaatattatttctgaaatggccaaattaaccagtacccataggacatcaggaaatttcttcataattctagaaatagttgttgaattattgcttgatgttttcttttgaggttaacgtagtgccagtttcataatcattttgtcatataatttacactgttcattccctttcatcatatgggctgattttctctgcattcttctctttttaagatagataatcaaaagccaaaagtgtatacaatattttaatgaatgaatggtcaatagcacacatgcttcagtagtactttttggtcctccccatgagcttctgatgatcacaaatgcaatatgaattctaaggtcttctctgctatatggagccagctttcctttctttcctatagtctgcctgtataccagatacaaaggttcaaaactctagctgcacatgataatcacctggggaacattttaaaaaacactgattccccagctcaagcaccctagaatgtgatgtaattgttctgtagctggaacccagatactggtattctttttaagtaccacccaccaagtgagaacccctgagttagtgttatttcccttttgtgtgatatcgttcctgttcatattcaattttatggaatttttcacaagatgatgcctttaatttggcaatttaggtttaaaatttatttttatcttccaaaataatcagaaaccctctgacagtaattgcatcaaatcattaagactgagccctataggatacaacatgatcgaagctcctctcattttattaaggtttcttgcagggaaagttactgacttattttgaacctgcttaatagtaataaagttggctggacatggtggctcaggcctgtaatcgcgccactgcagtccagcctgggcgacagagcaagaatccgtctaaaaaaaaaaatgtaataaagtcattactcttttttcttttctctttttgtggagcaccaagttcaagtccttgctgtgtatgtttagacagataatttctgttgcttctacttgtccacatagcccgtagttacatcttagagaattacattttcagatgctcaagatcctcactcccaaagtcttgaaagagaaatatgtgtgcatacccaaaactgaagggacagagttgagacttttgtagggttgtattgtagggcacttcagagaaatgatgatgcattaaattttcaagacagcaactaatgtaaatgaattcaattagccaaatagtaaacttctagacacttttttcccccaattcacatgctctcactgggcaaactcattttacttctcgacatcttctatcatcatcatgtcagctgaatatttgtatttgactcagatccatttactaagattcaaatccaaatgtctacatgcttatgaaacatctccatgtagatgtcttattgaccctaaaaacacagcatttgtcatttaggcaaaaaataatatctgcccattttctaaaaacctccattttactgctaccaagacagaaaccaaggactcattttaatcatcctagacttatccctttctgttattcctgacatctacagtgatagttaattcaaatctccattttaaaaaaaaagtctgcatccaccagctgctatttaaatattacgtaggaatgggaagaggggatctctagctcaccattcccatggtcacttctgtaattcagacatttctcactgttcattgactcatctcaattattatcctactttttttaccaaccaccttctatatcttcagtttatcctccacactactaccttagagatttttttgaagacacaaattggcattttatttcctgatgaaaacacttcagtgtatccctgttgcctgtctcatgatgtgtgactgttttgaagagaaccaaggctcttcataccccacactagcactccagagttccttcacattcaccctacacctcaccattgtccaaagctccaaccatatgaattacttccaaatcctttctctgtctttcttacatccttgtctcttaccctggaccaccctttatgccctggttcatctaacagaaacctacacatgatttgattaaactttaagtgtcacctccttcctcacagcaccccattgcatatttctcttcaccttgggctgttctacactttgcacattttggtcaaagtaccagtacattttactacgtttagttggactagcccctattgaaagcaaaaaccagatatttgtgtcaccagagcttaaacactaatgaacagaatgtagctctttatgaatgtttatgggaagaataaatgataaaattgccaatttgtaataatgataataaaactaactcagctgctaaaataaaaatggtcacatctggctgggcccagtggctcacgcctataatcctagcactttgggaggtcaaggtgggcggatcacttgaggtcaggagtttgagaccagcctgggcaacatggtgaaacctcgtctctactgaaaatacaaaaattagccaggcatggtgccatgcagctgtaatgccagctactcaggaggctgaggcaagaaaatcacttgaacccaggaggtggaggttgcagtgagccaatattttaccactgcactccagcctgagcgacagagagacactccgtctcaaagaaaaaaaaaaaatggtcacatccaaacatttcactatcatggctggggaagatacacaacatcatctttaacaaattcaagaaattgaggaagtcaggaagtctgcatgtgagacacccaagttaataatttagctaaaagggcctccctctgctcttatgagtggctggcacctgcaaaggacagggatttacttttttttttttttttaagacggagtctcactctgtcacccaggttggagtgcagtgacaccatctcggctcccacctcccaggttcaagcgattctcctgccccagcctcccgagtagctggaattacaggtgtgcaccaccatgcccagctaatttttgtagttttagtagagacggggcttcaccatgttggccaggctggtctcgaactcctgacctcaggtgatccacccaccttggccttctaaagcgatttaaattttaaaagctcttgattcatgtggtttctgatgcctagtatgtgtttccaaaatcatctcaaacattatgtcttttaaggattttgcgccagtttgtaaagaattttaaacatgtcattataacatagaaatagtgctgaatcgggaatataataccctttggttacttaacaatatttctaaaatatttacttctagtaacatgaattttcatttagagttcatagagcaaacatgaatctctaaagaaaaagatgtacaagaacaaaacaaaatgagtctcttgtttttagacttgatgttattttgttagtttctcaggacagaacttcctgtgatataattgtgatgggtgttgctagtgtttgtgaatcataactgttgagccctggagttaactttttataaagtacaaagaggaatctcattggtgcatctctcttgctgttctgcatcaaaatgaaagcatactgacattgacaggagccaagtcaataaacatttattgagcagctagcttgtgcagagcactgtgctaaacaaaatagatgacaaagaggagaacaagatgttgccctttactcgggaggctatgatcttaaggggcagatgattaaaaattaaatctgatgaaaggcggggtttggttgctgctattaccaggaaacaaagtgctagaacagcacttttttcaaaccacaaagctttacttattagtaaaacacaatttttcaaaccacaattaaacctttacttattagtaaaacattctctggaatcaatatgtcagcatttaaattaatattgaggtgagcagaggattcacaaaaaacaaaacaaaaatgattggctcatttctgtctgccccttggttgcttcaagcatggtgttttttttctaatctggtgcaattggatggtggcacacctctgaaataagtggaacccctaaagctggcagctcaacatctgtgactccgtggtgcatatagaaagttcctgaaaggccagcaccaccaaaaatggcagagcagttggcaccctgggaagtgacactgtagttttgccactgcaatgagtgcctaatactcttttagtgttccagttctgccattcacaacctgtggccttttaaaagccctgtggtttccttatttataaaatgagtaggctgtgctagactgtagaatgtgtctgaggttctttctggcactaaaattctgtggaccttactgtgaagttttcataagagccaggaagttttcctccttggcttctccgcatcaaatgacccaagagaaaaaaacacattcttgagtggcagagaagtacctcgcttctttctaaaatatcccttctgatttttccacttcactaatgtttctagaaccaaccttctttctaactaagttctgtatagttcaacttgagtatcaaaggaaaaataattatgcagaaattatatgggtaaatatgatggcccagcagtggaaagttgatagtctctcgagggtgggcaggcggagcaccggacacttgagacaaatgactctccataaatgtagacggagatgatttgtaaaaaggactatttgactcagcaagtattagccagaaagaagagatacactaaacttgaacaaatcagtttaatttcccaaggcagtatctgccatggcatcctcatgttttgcacatgttgtaacagatgaaaattttagatttttacgttttatgcttccattaagccaacagagtctttgcagattttcattgtgttttggggttgttagcaaaatgtgttctattggcaaaaagatttctgctttttagtcagcatttgatgagggattctgttttgtttcgttttgttttgttttccagagggggaaggggaattagaaaaggaagccgaataatttaaaggctgaaattttaggtagttcttttttaaaaacaaaacgaaacaaaaatatcatcttcaaacaacacaattaaaaggtcctaaacttccatttaaactgaaagaactttgcaaaagaattctgatacatttatttcagtgtcatctcttgaaaggacaacattcaacggtgcacagtttctgacagccaccactctctatgacgtgcatagcaatggtgccctctgccctcctagagtcacaggatgaaatgggtcagcactctgggagcttggaggacccaatgctataccaaggcccaaatagccaagtgcctactatgctcccaccactggtcttagccttaggattcaattaagaacaaaacatggaatattcttgccttcatggaattaccttctaatgagctaggtagacaatagtcttatgtcaagttatgtaagtactgagggttatacagtatggaacaggtttcagttctttcctggaagttctcagaattactttaaatcaggagaaaagtcaccaaagaaaattctgacagaaatgatccacccacccaagtgtctccaaaattaggaatctctccgaaataaagcataccaagtgtgtatgcacatatatgtgcatgtacacatatataaggttagcaaagactaaaaagattgtgccttgttgccaaacagaactacacacaaacaactggtaacatctaggaaaacagtagtaattttccattaccttttgttgaaagagaagtggcttctcccagtttagtgtcaaaatcagagtcctagcctcagacagattcaggtaagtcacccagagtacttcagttatgttaacaaccatatgcaacaatagaagttctttggtcctactgtgcttttgcctttgggtaaaaagttacacttatggatcattgggaagagcctgtgctgtggagtcagggggtgaggggagtagacctgagtcagaattcctgctttgcctcctaacctctgaacctagaatttttcctttataatctggtgataatgacttcacttttgtcctgcatggttgtgttctacgttgtataatgcacctagaacataacttaggtgctcattaaatagtaaccagtgtgacacagtagtaagaaatggtcatcttcatttttaaagaggatggcaagaaaatggcattaatccctgtaatgaaattttgtgtatggtgcagatcaacagcttaggagtaggagatttgattggaaggtgagcaggttcctattcttcttagtttaaatataattttcccagttatataacgtagtttgtaggtgtattaggaaagagattaataaccatattgtgcctcagtttctatacctgcaaatatatggatggtttgaaagatgaataaaagtatacagaaaacttcgaagtcttgatgagagaatattgataattgtaaaggattagagtgattattgtgattacaaggtaagaattctttccacccaggcgactggaggaagacacagaaaatctatcgtattgcactgctgatttcaaaggagttgctttgagactactaaatgctgagaaattgaacactggcagtaccggctcactaacaattttgttgttttcagtttttaagttacacaagagtgggtgaaaaaaatttattctaggtgcttttgcaatctagtgggcttataatacccaaaaggctataggatcagtctgttgtcttctgcttttcttcccagctataaaaattatttctgcacactttcatcagcactaagcttcttcagggcaataagagatagaagagaaacacctggttcctctgtcaggtatatttcagttctattccccacccacattgttagctcagctttgagggccatactgcttctagtggcccctctttgttttactgccaaatgcccccaaacgagaataagcttacctgacaaaattacatctcataaattaaaaataaggtttcttccttcctgcttccccactcttcactttataccacatacatgcccacatttgtatgcatacagaccaccagaggaaggatgagaaatggaagaacagtggttcatctctaaagtctgatactgctctgtggaggctgttagtgtttggcctccacactttaaaggtatcttcaggtaacctacactatctattattttaggggcaagaatcaccaccatttcactttctctttgtgaattttctcttctctgtgctgccagtcagcatcaaatttggactgcattccaaccaaaagaacttacagtttttgttacatcactgtttagttggccctgttaatttagtttttatattaacattgagatattttgtgattgatcacaaatattagacattcagtctatagttgttatcatcaccttatttaagatgtaatgatctaatcacagtacttccagaggttctgattattaccagggacaaaatgtcctgtgcttttggtaattcccagactggtttgagggcacatcaagaaagatctcaaagaagaaaaggcaaatactacacactagtgctgtgtaaacccaaccaccataattctaattttatttgaatgtttggtggtcataaatagctacctattttctttaaggtataattcacagtggacattttaatatgcaaaactctccctgctggaaatttgcaaacataaatcaaaatgcagtcttaaagccctcaatgtaatgtaacagaagagcagaaaagcactaaaacaaaaggtatgacatttatttttacaaaagcaatagacacaagatggataatatataaacttcattcgtgtcctacttttgtgatctattgttatctgaaacattaatttcatatatcctgttcctctcctctgtaatcacagtttaaaaacaacttggattggcaccttttctatttcaatattaggatttttgactagtccagagccaaaaaatatgcaactgttatttgtaattacctgtaaaacccatgtagaattcactgtcactaaaccagaaagttcgcaattgagaaactgaaccctaaaaccactgggacctagatacctgttaaattaacttttatagcagttaaaactttaataactataagctgtttacctaaaaaatttgctgccacgtttgctatgaaaatgtcgaggacacatcagaattacctttcagaagtcatgcaaggaacaatgtttccccctaggagtagtaagagcacattttccattttgactttcttgccagacagcttggaatcgtatctgaacctgaattatagtaactgtctgaatatatataaacatagtcataatatatttcctaatcatgatttttgtttattttcttttataatacttcgtagtcacgtcaacgcaatctatttgttctacatcgtttctgatctctcaattttagtctaatatccctgggtttacacatacatgtttttcttgtgagtcaacacaaattatgtgggaagcaaatagagtttaattaaaataaataaaattatattgttgtaatcatcaacctgcaagaaatactaaaatactgatgactcggctgtaatgaaattaaggaggactgatattatcagtccccccccatcctgtttaaaaatgctttctcgatttaaaacaacagcagtaacaaactaaggaagaaacatgttgatcaatcattcttccccatctccaagctttttttcttcctaaagaaaaattaacagaaatgttaactaaatttttttaagtcccaaatcctttatataaaaagtcttgataagttgttgtagacaaaacccattcttagaatttatcagtcagttgttatatattgccctgtgctagttatttttaagagatcaaaataaaattcacttctgacagcccaaaatagttactgacattgtaactaaagcaacattgtaactaaagcctactttgtacagctcacctggcagagcagggtctagaaacagttctgatgtaacctaattgtgctaattactgtacaccccttctgtgagtaggataattgtcatactaacagttgccatgaaagtagaacaactgcagtgaagccattagatgatgatctctgactaccttaaatgtatgcatgtatgctgacatttaagaggttatctgaagtcaagcagtatccatttttccaatgagcaagtaacgatatatgtagtagtctactaagatgagaactttagtcctgttgcgcaaaatttctgaacacatgattattaatatgcagtcttcataacatctgagcagagagacatgggaactttggctcctatcctcatccctcaaattatcatctgggagccatttttttccattttttcattcagcctatagttatttatgcatttttctcatctcctcaactaaactagagtctcctgaagtcaggaactgtattttataaaatctctgggttctatacagagccttagacatggtatagacagacagacagaccgacaaatctacttaagaatgacctgggtttcattttaaagtcatacaaaaatatatctttgctcaattagctggaatgttgtattttttgaaaacacttttaaatggcaataatcagagacatattactctaagacaactacttgagatatcttagttcccaaaaaggttctttgtaaaccaggaattaactatttttaatatacttggatctgaagttttaatgacccacacttcagtattctgtcaactgctccagaatcgttgtcatagttacctagtatcaggaacataaagctaaataaatttcaatacaatcttaacccattgcaatttctgaagtgatacattttaataggttttgcaacatcagaggcctccataaaaatccatgcaaataaaataaaagattacagacttgaatatatgctgatgtttttcaagaaatagaaatgctttcaaatgagctctcacctagtgaactaattttaatttgttgatcatgtttcaaacagaaagttaagattcatctaggaatggtaataatgctttaattgtgtgagtgggttgaatcagataatgcagtatcatttgtaaagagttcttatgttttctacaggtggataagtggagcagctgtagtcaatgcattttactcttcaggaagaaatcagataggtaaggtgtattcttaaataattatttaatatttctctatcgttcccaacctgtagtgcattgtatgaccaattacaatacctctaaacaagcacagctgaggctgagttattgctctattgaatgcatttcttgaaagtaaatgcatccgtgtaccttctttcactatagtgggaaaattcagattggtacaaatcacgttaagtagttttgtttcttttacaatattcttatttatatctaaaatggtttatcttatttctaaatatttttattttatttctaagtaccttttttaaagtcccttgaatatatctatataaagtcatattgactttaagactcattaagcattagcttcttaaagtggtttaaggtttcaagagccaacttttcacagatccagtcctcctggcaattctgtatgctggctctgtgagagatgatcctattctatgtcatcttcattcaggaaggctccaaggggtttagaaagttggaatctcaattatattcgattgaatcgtatgaaattgtatttacctagccacaattgatcaaaaaagaaaaaatttcgtaagttcgcttatagtattattacagacatatatatacattaacacatgaataagttatcatatatgatgaataactgaatgacataatatgacaaaaatattttcttcttcttgggaaggcctggacatctttgaacatacattggctcacatatatcacttatcacatacattggctcattttttttcagggggtttttagcattagaaaggtactcaactgattcagtactgccagaaatattctaaacaaatagtagagcaagcttctgcaggtgcactcagttctccaggtacactcagtcctgcccttcatttctaaacgtggtctagaattaagagagatgataatctcagcattattctaaaccattcttcttatagctcagagtctgttgtaagcctcatttttattgaattctattaccaattagattagaaattataaaaaatcttacaagatatttatcattggctaaaaaaaaactaaccttaaaataaattgtatatttttaggttaaagtttgattatacctttccccgttgctttcaagtctaaaaagagttaggttaagaagttatctacagtttcttctagtatttttatgatttctatttttggagtaaaacctgaatccatctggaatttacgttggtacatgacctgaaactgaattatataaagtaaccagaaaagactgttttgtataacatataaataataagtaagatatgtttacttggcttaaaattacttagctcaaagtctaagctaatgctttctggctagggaaatgattacccaaacccataccagaacgtgcttaataatcaactcctcagaacctttgcagtcagtcctttataatatattatttgaaaccattcaaatcttgttttaaaatgcctttatctctagagagtcttcactttgaagccctctttttaatattcagtagttctgtcagtgtctagttcatttggtactgagacaaacgtaataattaactttcaatggaatcccaagtcaaagcaaggcaacttagactccttagtgctgcattagagcagaataagggatgcagcttcatttcagtccagcccagggaggaccctggatcctatcggagctcatgctggtgcatcctcagtaggaccactctggcatgttcagtccttcagcccttctctagagtaggctcaggcatttatgccaagcaggaccttgtttgattctgaattaccccaagcccctggaggtggctccaaattggcccacttcagggattccccgatcagagaagagctgaaaatattttcattttgagtataatgtcttgaaaccaaagaagcacacagaaaaaggaaaaagaaggtaaaagtggcccaatagtggtctatttcacaaaataaacaataatcctctggtaaatcaagaattagctataataacaattctgaatatataaaaaagaccttttccaagatccttaaaataaggatccaatggaaatataaaataagaaaacttgttaacctcttttcatatgcttgtctggttcttgaacagcagaagaagggaaatccttgaaatgtacactttttttctttcacaatttaaatcttcaaagtggggattgtcttaactaaaaatagttgaagagtcaaatctccatcttttttcttgataggaatgtttatgtgggctgggtgtggtggctcatgtctgtaatctcagcactttgggaggctaaggtgggtggatcacctgaggtcaagagttcgagaccagcctggccaacatggtgaaaccccatctctactaaaaatacaaaaattagcccagtgtggtggtgggtgcctgtaatcccagctactcggaaggctgaggcacgagaatcgcttgaacccaggaggcagaggttgcaatgagctgagatcatgccactgtactccagcctgggtgacaaaacaaaactctgtctcaaaaaaaaaaaaaaaaaaagaaagaaaaagaaatgtgtatgtgtatataaatacacacatacctacctatatacatgtcttctgcaacactgtcttaatggatttgggataatgtccattataaaattagggttggtatagagtaatatgtgccacgtaagtgagcccctccctccatacacacacatagacatacaaatactccaaattagactgcatacactttctcacgggattggtcattttatgttgttatgttaaaaaaagaacttgttttgttatatagagacttactcatatcaataatttctacttcttaattcagttttcaccattttgttagaactcacacatgtaggctacattccaatttgtatgcattcctactcttcatatcaacaaaaaagtcaatttccaagaaagaaggcaaactaaaagtgcttaatccactgttcctcttccttgcatgtttacttcatggagctctagaaggcccctgtgccatgacattaggaaagctgcgcttcaatgttttgtcatatggttctctgtaagttctaggtgctgttcagtcatcttattaaaccttaaaatcgcagtcaaggaaataatttagtgtattctcctttttcattaaaattgcagaaaggatcttttaaatcaatttttttaatttctcaaatgtgtaagttcttcagtgtgttcagtctgtgtcgactataaataccttgagatagttaaattttctaaattgccttatttattcttaggagttttattttcagacttgaaaattaagactgtttccaaacatattgttactccatttaatataaaaagaatgtttagactatgcatggtggctcatgcctgtaatcccagtagtttggaaagctgaggtaggctgattacttgagctcaggagttgataccagcctgggcaacactgtaaaaccccatctctaccaaaaactacaaaaaattaactgggcatggtggtgcatgcctgtggtctcagctacttgagaggctgaggtgggaggatttcctgagcctgaaaggtggaggttgcagtaagctgaggtcacaccactgcacttcagcctgggtgacagagtaagaccctgtttcaaaaaaaaaaaaaaaaagaatgtttaattattttccaccaaaaaaattacttaattgctgccttaggctacatatgaaatattctaaaattgaattgctagcagccttcagaaaataaaccacagaagttgtgctggggaggcaaaaacagggggaagaggagacatggtcttttgcttcatggcccaatgacttatttaattaactaacttgttgacaatcatgaacataaaaaatgcacaactaagcagttggttataaacaacagttgtgatgcctactaggtaacagcaataaggctagtggggaaaatcctccttacagagatttagctgacaaagtaaaaggggaggtcataattagcaaagttgaacttgaagactaatatttaataagaaccataaaagtcttatcacttgcctgaagaatggcatatcagggtatgattaaagcagcaggatctttgtagttaatatttagtcttgatagcacatttcataacagcattttatataatgggtggattttaatcaaagtacatagtgtgggagatagtattcactttaacttaataaagtactgcacataatttttatactttaaggtaaaaataagttcatggctccatttagctcaggctgctacacgtgaggtataactttcataaaaattctctaaagacaaaagtacttttttgttgtcgtgtcatttgaatgttatggcaactttccaaatttttgtagaggtctggggagcaattaaattgctcagatgctttttgaagtcttctctgtaaatatctaatatttatccctgaagcccatgcaaggttatactgtgttcagcccacctgaaagacaaagaaataacatgtgctactctgtgttaactagatcttaaatttcttaaggtcagggcccttgttttattttcttaatgtcctgcatagcaatgacccagggctttgcacttaataggtattgatactgaagggtttttttttaattacagaaagtaacgtttcagttattcagtggatgctagagttttaagccattaaagatagaattactaaactatgaacatttaattaatttaattttaatttctttctaaggtcaaagattagttacctccaaataacatgacccaaaatttgattaaacaggggaaatatattccaagggaagatactctccatcttttattagtatttaagacacattattagtatatttcagaaatagtgaaatatatttcatgagagtatatattataagaggatactggaatggggcagggaaggggagggtatgatggaggtggagaggtgggagaggaccctggggccataggccagaaagatgtgtttagctagagagcaatggtaagccttccaaagatttttagcaggagaatgatgatgcccagagttgtctttaatctggctacaggatagattcagagagtagattagatttagaatagattgtagttgtgtgagacagaaagtgggagactgattaggaaattaagtcattcctgagacaaggaatgagagtatgtgtaaacagtaatactgacaggagaagataaagatgctcctgaaagctacctcacccagcctctgcctaagcagacttgtaaaagactgtaaaagaaaggaggcatctaagataagtagaaacatttacttttgctgatagagacccttcaagggccattagcagaaataatacaaagactgagggcctagaggggaaaatgaatttgatgtttgatgcattaaatataacacatttgtgagacatctgaatggagaaagttagcaagttaatgcagatgtcagagtagacatactgaaaactacaattcatttatttattcactaaactctgtaggacacattagtaagttagggtgatcattcatttatttatcattgattattcattgattcagcacatttcctgagccctgattatgttccaggtactattctagttttaggcattgttcaattttaggcatttagataatgaactagaaaaatgtatgaaattaaaaaataaacaaatatatgtacagacacagaaatctctgctctcaaagggctaatatttgaggagctggggtaggattagggcagacaagaaaaggaaggactgtgatcataaagaaataaatagaatatgaggtagtcataagtgccttgatgaaaataaggtaaggttatgtgattgaggtataccttcaattgagtggcaatacttatttaagatattattgtagatggatacaatttctgcaataacattaaaaataatattggtgttactgagtaactatttcttccaaatatttataaggcagaaaggaccttctgaatgaaggttataacttccctttgcttcaaactccttacagcacaaaacaatcttggattgtaaagtgaatcgtgatgataaatcatagtttatagcaccactccaaggtgaactctgttgtcatccataataaaatgcctgcattggtttctattacagaaggtttttgtatataactaagtgaaactgacatagtgaacagcagcttagcaagcacaaagccaaccccaagcctgccatcactgaataatgccatggtggcatgcgcctgtagtcccagctactcctgaggagggaggactgtctctaagaaaataaaaattttaaaaacttatgccacaaataatctctaactatcttctctccttgtagtcttcccagccggcattctgcagccccccttctttagtgcccagcagtccaactcattgaactatgggggcatcggcatggtcataggacacgaaatcacccatggcttcgatgacaatggtaaagtgcagttgacattttcctttggctgaggtatatgctcataaatttgattaagagttattataatttattactacaaagctacatttattcaaacatgtatcatttctctaattttcaccacactttcaattttccctttaaattgttgcttaaagagatcagaaaattctcatagtgagttaagcaatgtgtgctttacactctggcagaatgaagtaaatattcccattgggaaaatactatggtgtttgtcagcggcagtgataatactaggtcttagtttcctggttgtatatgacgtatcttgtcatactcttaaaggacaggctgcatgtctatgtcttaaaatcagatgtaaaatcagaaaatattgcctctccaagagctcaaaagactcttaagctgcttaagagaccttttttttttcgtcttgtacctactacctagttcaagtctttgcaaacagttaggcacttaaatgccaccctaaatggaaaaatcaatttagagtttcaatcaaagctgaattcctgagaggaataaagacgtgaaatatgtaaagaggtgatagttcaatctatgacaaatttcattcacaaatggaaagtagagaacaatagagagaaaatacttaatccccattttagagagccagagaaagaaaaagagacagaaatgttagaattcttaaaaagacttactaagtgtctattaactcaaactatgcaacagtctttacaggtaggttctaatactgtttctgttttccaagtggaaaaaaataaaaacacatgaaagatttgcccaaaggtaacaaagataggaactggtagaaccagaaggtgaattcaagtaggttggctacatagcccttttcttaatcactacgtcataggcaaatatgaaaaagatggtaatattgtgtcaaaacacatgatacatataaatgcaattggagctcaaaagggagaaagatcgatgtagtttgtggttggcagggaagctgtaggagaaaaagactttttttgtgtgcttgaagtagagggaaactatgagtccacagtgtcctatgaagggtccaggaatataaaaatgccagaataaaaatgttggccattttaaaaatctcaaaatatcaaactaaacagacttgggtcaggtaaaaaccattcaacagaacaaggcataacttcaagaatattttgtctggcggcctcttctgagatatcaagagccaaatgggtgaaatgtctgggtcaatgctgagaagcattagcaaagaaagctctggcagtccaggctttgccaactctgtgatgaggagggatgacagtctctctcatcgtctgcctaatttaatgttctgtcacacagcagtatttcagtccttgcactttgaattaaacatatcttataattcttgttgcaatgagttcccattttacttaaataaatatattataggcagaaactttaacaaagatggagacctcgttgactggtggactcaacagtctgcaagtaactttaaggagcaatcccagtgcatggtgtatcagtatggaaacttttcctgggacctggcaggtggacagcacgtatgtcattagcattctcttgaaaagttttagacatgttcaatcttaagtgtattattggtggtttctttttttaacaatcctaataaagtgtcttttttaacagcttaatggaattaatacactgggagaaaacattgctgataatggaggtcttggtcaagcatacagagtaagtaaaaaagattttctttccattttagtgatttagagtgtttctcatatttaataattcatttaaaaccttttgcaaaaaaagaaactcatataagcagtaaatgatgaatagaaaatggaaaaaaatatgagaagaaagagtggtgaatatgctaaccataagggtcaatacattgatgtgacggagctgaacacttaagtttgcaaagagccaagaagaagagaaaatatggaatattatatcagctgaaatgaggagagagcaggttcacaaaggaggcaacatttttctaagaaataatctctggaataatttttttagaagaaatgtcccataagaaggattatttcagggtctttgaccaatataagaaacaggaccttcagttttgtagcaggtgaagtagcatttgggaacaaaaatcaatgtaaaccacaggcatattaaaccatagttcatatatgatacagtaagggactgacgtgatatggttccagcacatggccttgtagtcaaccacactattatacacagaggactattaacagtggagcatccgttagaatcccatttagccttccattcattcttgcattcaatacatattcattgaggcttaataggtttggcagtattcaaagagctggagataaagcaatgaatgctttatgaaaggtcattatttgaggatctgagcaagggttaaaaaatagtctggtggatgccatgtgcataagaaaaagcagggaatttcataaaagggtggaggaatgatggtctaggaagcaacaaaaaggaatgaagatgattttgagtgtttttctcaactatgaagtagcccatatgtaggagaaagagcagcatctacttgagatgtcacaaggaacaacttgttcctaggctagaactaggcttctctaagacaaggatggatggaatgatcagtggagtgaatgaggatgtagaatcatttgttcattatagaaatgtttggattagagtggaggaggtgaacatcaatggttggatcagggaagaggaagcaccagagaagtggagaaagaggtgactgatggggcctgcagtttgtcagtgaccaaagatgatcagagtgtgaagcttgggagattaagtcagctacaaggtttccaaaagaatgagtccaaccagttccagggacatgggagattgctgctactttgaatgtttagtaatttttttgttcgatgccagacattatgcattttacctcttttttttgagatggagtctcattctgtcgcccaggctggaatgcagtggcacgaactcggctcactgcagcctctacctcctgggttcaagcaattctcctgcctcagcctcccaagaattgggattacaggcatgtgccaccacacctggctaatttttgtatttgtagtagagatgggatttcgccatgttggccaggctggtctcaaactcctgacatcaagcgatccacctgccttggcctcctaaagtgctgggaacacaggtgtgagccactgtgcctgaccgcattttacctctttgggtctggatgttcttttgttcctgtaaatattcttgagctttattctaggatacagttaaattccttgaaaatggtttgatctttttgggtcttccttttgtaacttttattggttgggatggggacagtgttcagtctagggacattattctcaactgctgagataagaatctactctgtgaatcttggggatttccattcttgtcctgtgtaagtaccataaattattatctctaatccttttgagatattgttttcctagcattgggtattttgctcacacacatcttcagatcaagactaagctgaatgcttgaggatgaccatctgtaatctctgaggttctctttttgtgtagctttctcctctttagtaacctgttcttggtgtccctgaactctcagctccttatcctcaactcaaggagtacccccagctctgactggtttgctcctatgatatggcctgaaaactctcaggacaataagctcagcagtcatgggactcactgagagtaaagtttaacatctctcaggggtcattctccttttgcctgatgttcagtgttatgcaaaccattgttttaaatattttgttcatcatttagttgtttccacaagaagttaaatccagtccctatcattccatcttggctgaaagtggaaggcattggcactcaatattcccatggtgattctaatacacagccagattgagaatcactgctataaaatccagccaaagttgggattgatagtactcccatggagaacctcacctagagcaagtacagaattgttaatgatgaagcaaattacaattgtgcaaatattttattacactttgaaaatatgtaaattcttaacgtgtaatgccttgcccccctgctagattgcgagctctctaagagggagcaggtgcaagcctttcccatatccccagcatctttacatagtagaggttcaataagtctatgttgacggtaagtggaagaaatgaaatatattttctgctcatctagttggtcacattcctttgtattaaattggaaatgacacatctcagaacgtttattatgaattcgttttaaaagtttatttagtagaggaaaactcatttttttcagtagcataaatctttaagaattaagaggattttctgacattcaaattacctaaatattttccttcaaatgtacctgaggctcagtccattttgtcctgtcttcaaaagaccagaatagttgcattttattatcctcagactcattggagactaggcctctaagggatctcaagagaatcctttgacttggcaagaatcactcgatcttagtctggtgagtctattttgctaagatagtagtaactaagttaaatgtagcaattgcagacttccttggcaattcatttgtcctgactggtcttattcatcaatttataaaacaacatttagataagtttttcatcacttatttaggtcatccattcattcagttgacatttattgatcacttgacatatgccaggctcttgtcatctactattcagtagcttcttcttttcaaagcatttgtaaataaatttgatttgtctttctaatccataaaatagttgtaggttaccataactaaatgtattatcagggtgattttaacataaaatgttaattacttggtggcatgatcttttacataggtttatatataaccttaggaattaatattattgtttttctattttatcaactgcctaggcctatcagaattatattaaaaagaatggcgaagaaaaattacttcctggacttgacctaaatcacaaacaactatttttcttgaactttgcacaggtattgtgtctttcttgattgatagatatgaaaaccattttgagttataatttcacagtaagttagatgtcacatgctgagttcccttgttttacagagcatttgacttgattcactttcattgtttataatagactgttggatcatattaatgataaataactatgttcctggttgcctttcattgaacattatttgaagagcaaatggttgaggaatgcagaattccaatttaatttttctccttcccctcaacttgctcaaacaaataatccttgattgaacctgagtacatgctttgcttttcctattcctatctctaggtgtggtgtggaacctataggccagagtatgcggttaactccattaaaacagatgtgcacagtccaggcaatttcaggtgcgtggatatgaacagcaatcaaggtgctcttatattgggtccattgcttccacatttggaatttagacttttctaactctgattcttttacatttggaaattcagtgctttttttttttttttgagagtcaaaggtaggatcgagagaacacatcggagcattctacataagcatagccttggccactctctttcttagaatctacaataattataattccttagaatctacgaggctcagggcttgatctattccaacaaagatgtcgcctcagaacagtggctcaatttaaagctagcacaaagatatttctaagaggctgtgaatggtttaggcccagacccaatgagctccaacttgcaaagaaaaatttcaatataaaggaaactttctactaattagaggttcttcaatatggaataacattattcccaaagcttcaggagagagtacattgaagcacagcccatcaaggatgtgagagaaaaatgctctacagagtagaaaactgagctagaagaagttaaagttcttcccaaattagaaaatcaaagagaacaatgattgaagagagtcactccaaccaacatttgaatgttaaatcatagatcctatgtatttgtttaagaactgaattcctaatgctacccctttcccatgtactagaacacttagtcactcatttgctgatcaacaacacctctcaggcaagaaagttaaaaaaaaaaaacctaaaaattttgtagggtagttggaaaatgaaatttgagaacaaaagagaactaatgggctaaatttcaaaagctctacataaaatgaatgtaagcatactgcccagatcatttactcctgggaaaaaacacattcgattatggagaaaaacacatttaattatgaagcaataaagtagttcatttaaaaattaaagaatttattcagcttgctagtatcatcgttgtcatcatcatcatcatcatcatcatcatctagtatttgccctaacatttctttcaatattcattcactcaataactgcttatggtatgcctattatctctgtaatccaagctaaatttagttctgctaagatattcaaattaactgctttataggtaatgagcaacaaaagtgactggattaattcccattgtggtttattcaaaaaacttttagttttaatttttttaaagttgtctttttccttactaaagtgaacttaagctttgaggtaagaaacacttgagttccaaccatggcttcaccatttactagctgttaatgtaacctctgtacctcagtttcttgatatgtaaaataaggattaaattatcatgagagttgctagaggattaacgttaatataaatgaagagcctattttgtgtgtgtgtgtttgaaagtccatactaggattatttgtagacaagaggtatgaacagaataagaattcttatgcattttgtaatagttccctatcagtcaaggcttttttggtgctcatttcttatgttctgcacatttcagaatgttagtaactgatcagcagttaagtaaaacgtacataagtatataactgttttctagctccaattttaaactgaaaacaatattttgctataaattagttaaattatttgtatctttaagtctttattgttgttctggttccaaagatccctcatcgactatttttcattcataacaacagaagcgtgtgtgtgtgtgtgtgtgtgtgtgtgtgtgtgtgtgtgtgtgtgtgtgtgtgtgaagggtaaatggaatgggtaaatggaatgccaaccttttgtcaaggaaattattgttttctctggaggtaaggagattttcttggcaaaaggttgagcttacatttagttttggaaacaggccacttcctggctgtacaaagtaaaacatattttttaaaaaaactttaaaaattaatagatatcgagttgctatttaagaattgtgcttggtggttatatagaaatatttctgaattagagagagatttgtaaccttatgtttaaatagccatagtattaaaacaaaaggcaaaatacacttgatacaaagctgcatcataaaaccatatttgctatgtctaacctattgttgttttattcttcctgactaaagctttatttatgtactttaaaataaactttagaagttaaggtataagaatctaattctaaggatagcagctagcatttataagctcataaaaaccaccatgcaacctaatttgtcaagggtttgccctgcatatctccataaactaaaacataagtcataaaaacctaggtgaatttcagtaatattattgtaatacctagtatatctaccatcctcagagaatgagaggttgcaaattaagttttgataggtaaagtttgtctcttttaagtattaacatttttatcttaaccactggattaaaaattatctattaaaaacacatttctaccttcctgccttaaaacaatatcctgaaaaaaaaagcctaaccttttttaaaattttgatgacacagactactttatgattattagttatggttttactgtttattaatttagtctgtggagctatttattcttataccaattgtgatgctttttgacttattttgggtttttattagggtttttctgtgtgtttgtttctttcctagttttctttcctattattgtattgcctgcctttagttccctaattcctccattttgattagctcagaaaacattttgttaaatttaaatggtatttaatccaaaaacattcttcttttaatagtctagaaattgaatctataatttaaatattgacttcattttggaaatccagtttttggttagccatctatagtcatttcagggaatatttattataatatttatatgtaatctataaatatgtttctaaaattatttagctgtaattttctatataatatgtaagggtctgataattttgtaaagcaagtccaaatagacaaaatgatttaggtgcttagattactcaacattatcttccagtcaggaagaaagggcacttttagaactgacaccactatcaaagcaagaaatgtttctcacagcttaatttctaatattttgaaggaatattttgtctagtgttttatatagacatgttcaactaatatggctattttgttccttcataactctgtaatttagcatgctaataagccctctttgaaattcttctgtttcttccatttcccttcaatattagcattggttcctgatatttatagatatcaatatagattttagtgagttttgcagaatttctgttagcccctccaatctttagctgataactagaaatctattacagcatttatttatttatgactgtatagcagaacatacactcatcaatatgactttgctttgaaagaatcataaaaattagttaatgatgaagattggataccttattcctgaatgaaggcagttaactatgtagccaagtcattcatttacaagaattaacaaaaggttgtctgaggacccattaattgcaaacagtaattcagaagtccaattgtagtaggcaggaatagtcagataggatataaagtccattcttggtcccaatgccaaatctcttagatgtttttaatgcaagtaactgtttgccaagggaataaacatcagcagtacaataagttattttacataataaagtaaaaatttcaagtaaatcaccttaagaaataattaataaaagctttattatcttctgttattagaaacacaagcacacagttttgtaaagcatgaaaatcatgtacatatcttctaataacagaggataattcatgtaatgtgatctcactcttagaaaaaaagtgttttattaataatggattcacttttcaaaatagattatctaggcctggcacagtcactcacacttgttaattccagcactttgggaggccaaggagggaggatcacttgagctcaggagttcaagaccagcttgggtgacatagtgggacctcgtctctattaaaaacaaaaaaattacccaggcatgctggtacatgcctgtagttccagctacttgggaggctgaggcaggaggattgcttgaacccaggaggtcaaggctgcagtgagctgtgatcgtgcctctacactccaacctgagtgacagagcgagaccctgtctcagaaaaaatagatgatctattcaaagatttgatgtcataaacaccaaatgttaactaagaaagtaagtgaagccctagtgtgttgttgatctattcaggatcaaattaggtagagtctttggatggaaagaggatgggcagaatgggcatggagagctgagtgcacaccaggctgagtatttctgcagtgcccactctctgcggtgttatctgaagacgtttctttcttttaggtgttttttgtttgttgttttaacttaattttgagatttataaatataaatcctaaaaatactttttaagaaaaatatagaattaagtcgtgggtttggacattattaccgaagtacttgttcccatatgataaaatctaagaaaaaatcctttggaaaaaattaataaaataaaaacaaaaacatgcagctcttccagtcagtgatgctgatggcttaccctgtcaaccagggagcttgctccctagtgtgaggaatgcccaggatgacaggatgactgtctttagccagtagctaggcatcctgaattgggaagaaggttgcattaatgaatcaaagctcctctctaacataaagaatccttgagtcccgcaacctgaaagactaaagaccaatgcaaattcctaatttctaagctcttttaattcctacataaacagtcacttttgactacattatagaagtgatttttttttggctcatgaacaatggaaatttgtttctcacagttctggagaccggaagtctaagatcagggtgccagcatgatcaggttctggtgagggccatcttctggtttgcagactgcagacttctccttgtactctcacatggtccaaatagtgaatttgtttttcaatatttcagatgtaagaaatggacatttgtttttttcaatcaaattaagccaaactctgagctcttagaccaagctaggagatgagccatttactttcagtggtttttcaacgtactctttcagggttattcaggaatctgatatcatcacacaggcatagaaattagagaatagcctccatcttcagcccaccgtggtcactgctgagatccctacagtccaaatgctccagctggagtcagtggttccatttccttccaatgctcatgagctccagagcctccactcttcatgtccaggttctccaacaaccacacgccatgctatcagagggcctctcggggccttgctcagagcaggaagcatcttcttgtcattcacacaacctgccattactggaacctaccccattcttgggaaggccaatcatctccctgacaagtggactaatatataaattccccagcttctgactccacttcacctcaaccctcccacaccaggagattatttttcgtctttaagactcatctaggaatcctaaaaaacaaacaaccagaaaagattacatcctccatgaaagataggagagttgtggtggagagggatagagaagttagttgatgcgttgatgggtgacatattagaaagtcagacttacaaaaaatccatatggatctctcttttctggaatgaggaaagggaaagaaaatgctttctttctcttccagttggtccataatatcaaacaaacaacagaaacactaagtcgtgtttttcttcctaataccctattgcttctctacaggtaatcactgtgaccaaccaggtcacaggttaattcattcagtatgtactgagtcctgtgctggactttgggggtgcagcagtgagcaagacatacacagtacagcatcttccctcagcatctgtgggggtttggttccaggctccctgcagatatcaaaatttgtggatgctcaactccttgatataaatggtgtagtatttgcatataacctatacaccttctccctcctatactttgtcacctctagattacttataatacctaatacaatgtaaatgctatgtaaatatttgttatactgtattctttagggattaatgataagaaaagtaagtccatacgttcagtagacaaaatatttcccccacatatgttcagccgcatttggttgaatccacagatgtggaactcaaggatacaaaggctgtattttgccctcatagaaattagtctagtgggtgtgtcaggaagtaaaaaaggagaacaaatcattgtaaatgtggtaagtgctttgatagggatagtccctgtaagaggagttagtttagatggcattcaaagaagggggccaaggaaggaatatttaagcaaaggcatgaaggctgaggagttagccatgtactgactggtgagtaactttccagggagtagggtctgcaggtagcaggaagctctgaagagggacagggtttggctggtttgaggaactgaaggtaggtcagcatagtttgagcctaaggaggaacaggaagagaaatgtaccacgaggaggctagagaggagactggagccatcaggaggacattggaagccatggacaggagtttagatttccttcaagtccatggaaggttttaaatctgagattatggaatctgatttaaattttacagatcattctgactgtggtgtggagaatggttggaggagagagaagtcctaagatgtacacacagtagtacacctgccacgtagggagaattccataaatcaaaatggactcacctgtcatttgtgcctagtccttccaaaccagtccacttgtctctgggcccctcctcccaacccaagcaaacgtggtaggctggccttagcaggaggagaagggaaggaggtggttcagggttcagggtgggtgtgaaaacatcacctctgcatcaatgtactgacccatctctcccctcaaacactgctaggtgcagatagtgagttggactgtgttgtttttgcccactggggtcagagataagaggaaaatggcattttgccagccctttccagttattcaagctgaatccagcttctgatatttaaggagcccttttggaaaaaaggaaaataatcctctataaaagcaacaaaaaatatctatttaaagtctattatatttaagtcattatgtgagccctttcaagacatagtgagaaatcatgattatattctttgaccaaactcttattataatacaactccaaatacctgcattttcaaatgtgaattattcatgttttacaaacacatataatgcttataaattattaactctccatgacaaccttaagatgcatgttctattgtgcagaaaccaaggcacaaagaagcttcataagcaggattcaagccatgtagtctgtctcccaaattgcttttaactcctgttctttgttacttctccatttaaaaattctgttaatgagaaggcactgactcattgtaccaggttattttaagtttaactttaaattccaaattcattcacttgacctgcagagggaaatgcttcagggctccagtgtggtatggacgtgagtatcaaatgctgacggtgactttttttgtttgtttcaaaggattattgggactttgcagaactctgcagagttttcagaagcctttcactgccgcaagaattcatacatgaatccagaaaagaagtgccgggtttggtgatcttcaaaagaagcattgcagcccttggctagacttgccaacaccacagaaatggggaattctctaatcgaaagaaaatgggccctaggggtcactgtactgacttgagggtgattaacagagagggcaccatcacaatacagataacattaggttgttctagaaagggtgtggagggaggaagggggtctaaggtctatcaagtcaatcatttctcactgtgtacataatgcttaatttctaaagataatattactgtttatttctgtttctcatatggtctaccagtttgctgatgtccctagaaaacaatgcaaaacctttgaggtagaccaggatttctaatcaaaagggaaaagaagatgttgaagaatacagttaggcaccagaagaacagtaggtgacactatagtttaaaacacattgcctaactactagtttttacttttatttgcaacatttacagtccttcaaaatccttccaaagaattcttatacacattggggccttggagcttacatagttttaaactcatttttgccatacatcagttattcattctgtgatcatttattttaagcactcttaaagcaaaaaatgaatgtctaaaattgttttttgttgtacctgctttgactgatgctgagattcttcaggcttcctgcaattttctaagcaatttcttgctctatctctcaaaacttggtatttttcagagatttatataaatgtaaaaataataatttttatatttaattattaactacatttatgagtaactattattataggtaatcaatgaatattgaagtttcagcttaaaataaacagttgtgaaccaagatctataaagcgatatacagatgaaaatttgagactatttaaacttataaatcatattgatgaaaagatttaagcacaaactttagggtaaaaattgccattggacagttgtctagagatatatatacttgtggttttcaaattggactttcaaaattaaatctgtccctgagagtgtctctgataaaagggcaaatctgcacctatgtagctctgcatctcctgtcttttcaggtttgtcatcagatggaaatattttgataataaattgaaattgtgaactcattgctccctaagactgtgacaactgtctaactttagaagtgcatttctgaatagaaatgggaggcctctgatggaccttctagaattataagtcacaaagagttctggaaaagaactgtttactgcttgataggaattcatcttttgaggcttctgttcctctcttttcctgttgtattgactattttcgttcattacttgattaagattttacaaaagaggagcacttccaaaattcttatttttcctaacaaaagatgaaagcagggaatttctatctaaatgatgagtattagttccctgtctcttgaaaaatgcccatttgcctttaaaaaaaaaagttacagaaatactataacatatgtacataaattgcataaagcataagtatacagttcaataaacttaactttaactgaacaatggccctgtagccagcacctgtaagaaacagagcagtaccagcgctctaaaagcacctccttgtcactttattactcccagaacaacaactatcctgacttctaatatcattcactagctttgcctggttttgtcttttatgtagatagaatcaatcagtatgtattcttttgtgcctggcttctttctctcagccttacatttgtgagattcctctgtattgtgctgattgtggatcttttcattctcattgcagaataatgttctattgtgggacttattacaatttgttcatcctattgttgatgggcacttgagaactttccattttggcgctattacaaatagtgcaactatgaatgtactgcatgttaccatcttacttgagcctttaatggacttatttcttcaaatccttccaaaaattattataagcattgaaattatagtttcaagccaactgtggatacccttaccctttcctcctttatcacaaccaccgttacaagtatacttatatttccctaaaatacatttaaaacttacctaagtgacatttgtagttggagtaataggagcttccagctctaataaaacagctgtctctaacttattttatttccatcatgtcagagcaggtgaagagccagaagtgaagagtgactagtacaaattataaaaagccactagactcttcactgttagctttttaaaacattaggctcccatccctatggaggaacaactctccagtgcctggatcccctctgtctacaaatataagattttctgggcctaaaggatagatcaaagtcaaaaatagcaatgcctccctatccctcacacatccagacatcatgaattttacatggtactcttgttgagttctatagagccttctgatgtctctaaagcactaccgattctttggagttgtcacatcagataagacatatctctaattccatccataaatccagttctactatggctgagttctggtcaaagaaagaaagtttagaagctgagacacaaagggttgggagctgatgaaactcacaaatgatggtaggaagaagctctcgacaatacccgttggcaaggagtctgcctccatgctgcagtgttcgagtggattgtaggtgcaagatggaaaggattgtaggtgcaagctgtccagagaaaagagtccttgttccagccctattctgccactcctgacagggtgaccttgggtatttgcaatattcctttgggcctctgcttctctcacctaaaaaaagagaattagattatattggtggttctcagcaagagaaggagtatgtgtccaatgctgccttcccatgaatctgtctcccagttatgaatcagtgggcaggataaactgaaaactcccatttaagtgtctgaatcgagtgagacaaaattttagtccaaataacaagtaccaaagttttatcaagtttgggtctgtgctgctgttactgttaaccatttaagtggggcaaaaccttgctaattttctcaaaagcatttatcattcttgttgccacagctggagctctcaaactaaaagacatttgttattttggaaagaagaaagactctattctcaaagtttcctaatcagaaatttttatcagtttccagtctcaaaaatacaaaataaaaacaaacgtttttaatactattgcttttatgcctagtcaactctgttccaaactgccaactcctgtgtaaatctctaccccatttatttcttgaaaaatattaagattaaatggagcttttatctctgtagtcttgcatttcccactagcttcaaattgaatttttagaaaatgaatgatataagctttgtatccattatgtccttgttttccccaccctttttcaaagatcaccatgactttctgattggattttttttcaaaagtgaaatggccatcaaatgttatatggagtcactagcataatcagatgacttaggcaaaagccaaaagtaagtgtctttatccacagtctctagtctgaagaagttgaccatttggttggtcaagtggacagaggagtcacatctgactggtggtcaaactggcacatgtttatcgcattctaatcttttatctaacaatggtttcttaatttctgcttctttgtattttgcatttcctctaaaacagtgagaaacactactttcactttcaacctcatagacaaaatgttgtgcttctattttgcttgacaaaacagatcttctcagttgtacaaaggaagtctggcagaaaaataatcattggctcttgccagaaataatgatgagtttccaacttggggaagtatagaaagactggaaagactaatatttatgataaatgtttatactctggattttccttctacccagaaactgacaattttgcgggtattaggcatattagcatcccatttcgctcttataaatacacttgatagaatctccaatctgacatttatgctatatccaggaagacaaatggagccaagtatctgtattatcgttttaccttggtgtaaatccttcttacatgctatgaatgctctatgtcctctgacatactgcatcaaagatgtaatgctaagacgtatggcagctttataacaccaaagaaatagggattcaaacactaactagggctgggtgcagtgcctcacacctgtaatcccagcactttgggagtctgaggcaggaagattgcttgagcccaggagttcaagaccagcatgggtaacacaaggaaaccccatctctacaaaaagtaaaatacaaaattagccaggcatagtggcacatgcctgtgaccccagctactcgagaggctgaggtggaaggatcgcttaagcccaggaggtcaaagctgcaatgagccatgattatgccactgcactctagcctaggcaacagagcaagactgtctcaaaaaaaaaacaaaaaataaacagaaaacctgaccagcagaaaatatttagatgtagtaaatgaaaatagaaaaaggacacaatgttgagtatgcattatcatatcaactatgttaaaatattattccatagaaaaagagttggaagaatatatggcaaaaattaaccagggctatctctgggtggtagtattataagcagttcttattttccttttttggttttctacattttaagtttttctgtgataggaaaatgttactcttaaaaagtcattttaaaaatattatttggaaagaaaaagaaaaggaatatgaaagggaggggagtgagggggaaattgacccaaaaagaaaaatataatttccctaaataaaagggttgttaattctttttaggacctattcaatttgatgtctcaggcaacttagacccaaggaacctggtgaagtagattttggtcaagagcttgctgcctccaggacaggccagatctgtttataaagtaactttgacacacactgtataacacagaatggaggaagttgctggaccttcctctggtacttaaagtgcttctgtgagaacaaagcatgtaatctagaggaggttttgggctttttcctgaaaatgctaaaaggttgactgacccagccacactctcccacctggtcctccgcacctccccaacccgccccaaaccccagcatttgccaaaccctgacccagatg

SEQ ID NO: 15409 - DNA, 107330 bp, Human; identical to SEQ ID NO: 15408

SEQ ID NO: 15410 - DNA, 107330 bp, Human; identical to SEQ ID NO: 15408

SEQ ID NO: 15411 - DNA, 107330 bp, Human; identical to SEQ ID NO: 15408

SEQ ID NO: 15412 - DNA, 107751 bp, Human
actctaagtaggcattttttttttcttttgtcatacattttaagtaaatccttttttttcctttaaaagagtcctcaccgccaggcatgattgctaacacctgtaattccagcactttgggagaccgaggtgtgtagatcacttgaggccaggagtttgagaccagcctggccaatatggagaaaccccgaaagtaaaagtacacacacacacacacacacacacacacacacacgcaagcaaaattagctcggtgtggtggtgcgtgcctgtatttccagttgctcaggaggctgaggcaggagaatcgcttgaacccaggaggcagagatcacaccactgcactccagcctgggcgacagcacgagactctgtaggaaaaaaaaattccagttgagatgctttccagggcgctagtcaagccccgcatgcttatttgtgggagtgaaaacaccaatatttcgggattgttgtgaggactaaatagtgtctgtaagatgcacagagaaagcgtaaatagacgtcaatagcacttgttaggtctacacactccatttttcctctatattaatcgaattatttaaagattggttagctttttggggaaatgtctctccattgtattccacttattaggatgaactaccttttctccttgcttttcagctttctctgctatgaaaaagatggaaaattttttagcacaaggggactcttctcaagcagtaaatcattttgatattaaaaacagataattgcaaacccagttttatttcagtatgaattccgcagtggagtgtgaatatgtgtgtgtatgtgtgtgtgtgtgtgtgtgtgtgtgtgtgtgtaattacctgtgattcaaaagaggaaagggatcagtattaaaggtacttgtacactggaagcaaaaaaaaaaggaagtttagttcctctgagctccttggcaattatagctgctaaaggtagcttttacaaagaaactgcctttgtgcctaaagtatttatttccttgtttgtatttacccctttgaggaggaatcgctgtgtcttgagtgaaaggggtacgctgcttgcttgcattaaactgtgagggtccaggcgcattacggctgatttcagtaggtagagcagacacactttagtttatttttctctttctcactccccaccctcaacctccgatgtacacacgttttaagattccctgaagtcaggaggtgggagcggagagtttcagttcagatcttgacatgagagtacttcgaccaaggaaaagaaagggaagaaagagggaagcggggtggagaaagcaggagcaaggaaggaaagaaggaaacggggagggagagtaagaaaaaagaaaacgaaggagggagggagagaggacatttaaatgaagaaggaaggaagcttggattcagggaggaaagggagcgggaaagagagcgaaagaagagcgtgagaagaggcaagcattatagtctccggtccacaggggagagatggagccccctcaggactagagaatcccgaagagcccgtgtattgttttcttgaaagccccgaagctaagcaattctaaaaatgtttagcaaagcccttttgggaatggtgagatggggggtggggaggatgggacattttcattgccaccgcccgccccccgtctccccggccccctcacatgaagtgactggatttgggagacctagcggaaaccttcaggtcacccagggaactgctcctctctctggtcctgcagcggcgaggcggggtagggggtggggggggtgggccgtgagagcgccgagacgcgcggggcgcggagatgtgcaagtggcgaagcttgaccgagagcaggctggagcagccgcccaactcctggcgcgggatctgctgaggggtcacggtgagtctctgtgggtgcgggtcggagggatgcccaggtgcctcgtcgccccacggcccgggcggaggcgggtccggaacctcccccaagtccggcctcagcctggagcccgcgcgccttgggcggatgcacggactgagaggcgcttggctgggctctcagcccgccactgccacccggccccgtgcgctcattggtcgggatgtgtcggctcagcagcctccaacttctcccgaatcccactggtgagtcccaggagagcgagctgagggagaaaggtccaaagggcgcgagcgcccagggcgctgggagcccgtgggacgggcacggggagggcagagccagccgaggggagcggctgccgggaggtgcgctgagcagggtccgcagctaaggtccagcgcgatccgagcgcccaggaccctgcggccgtggaggaggcgtgccctgggaaggagccgctactgggacctgaagagtgaggggagggagaggggcccagagggtgacctggaggagggctctggaagtcacgtcaggttggctcttcaggttcatttccatagttccctgcggcctctgccttggggagttatgttttgttaccgagatccgcgctaccagattgcaccggggctgatttgggggctgggaatttgccattctgctgtacagacactgatttttttttcttctttttaaaaagcaaggtttgttttcattttggtttctgtcggattttctcatttgtaactcacttttctatttttacttttcttaaccggaagatcttttcattatcccacctcttcatcttgcttttaacctgatttcctattatataattaatgcttaaatctcacaagggttggtcggtgcggggctggtgtgtccttttgtagatgaaagtttaagacctcttaactggtttcagtctatttgtctggtttcaaaataagggtaattgcaaccaaatatccctctttagcttctcgatcaagtcgattcctcccccatatatgattcaaatggcaattttattaaactgaaaactagtacctgacttgcagcgtcagcatttggaaagtgcttgtcggcaaatcgactgtatgaaggcgtgtagcttcatcccctgccatttttgtgggttctagcactttaaaaaattgtctggtaatttcttggacttaaccctgtgtctttggttgtagagcagcactaaccaggggagtaatatggttggcacttcgtgtccagaactccgtatttcaggctgggaaacacctaattaatgtctgggaaacaagaagatgatttatcctgagtacctctgtcctcagcttctgcagacacagtttaaatatggaaactgtttctccttcttcctgtgcctcagtttccatagaacaaactgtaattgcatagcacagcttcaggaacctgcagatataagttaatgttataatgtgcagtgaagatgaaaactgcttagctaagtctaagtctgtaagtcaatgagatttcctttttaacaaatcagttatccaggtttcctgctttgactgtctgatatagtaatgcttatgctcaactggtataagaattgctgctttacattgctttgaaattaagcttacacttaaaatagtaatttattctgttggtaatattgtcgagctgaagtttgcaggttcttgttatcttagacctcctaattctctattctcgtctgtggcagtgtccacttttccgtttaaactttttatttaacacatcttcagttgaagtgaaatattttaagaatacaggtatgtttttgcgtaccctgctttatatgggactataagcctcaacttggtattttttttttttttgtattcttttgtttacttgtcccccttactcttctctatgggattgggtgtggttaagttggatattcaggtatttggggtttagtcatatgttccacagtgagattccagatactgtcccctgatgtcttaaagaaaaattgtgaaccttccagaattaactggaaatgaacgacaaagttaattaggagattaaacttgcatcatttctgcttttgctcaatgcttttgaaaaaaggctactaagagcaaaagacttcctttaagaatttacagggcatttacaagagggggagatggaggaagactttgcaggtgattcaaagattatattgttttgatgcagcttctgtcactgtcttcatttctctgtaactgtttctgcaaacttgggtgctgacccattaagagcccagctgcttcagtacccagtctcaagggtaaggaggagaagccaagggaaagtaacttacagggagaaagaaatgcttatccactagctttactacaccacaaggcatggagtttccacagagcacctgtaatttaaccctgaggctgccctggttcaccccttcgctttactttacagggacactgactgtcatttctaaggaagaactaagaaaaaaaaaagtccttttataccagtaaaacatttctctacattgtcttctgacatatgcggggggaacaatattcaggaaagggaaatactttagcaaatgtgcttaacattcaggtgttctttaggacagtcatgaaacatggggagactgggagaattattattgtttacctctctgtaaagtgtccagagtattattaaatttgttcccctctttcctttgcccaaccaatacactattaaaataggactacaatcaatgcaattccatatcataaccccaggggtggtgagactaagccagcatgccttacataaccattaagtaagacattttaacattcaggtacattacattccacttttatttagcagacacggttttcattgtgtaataaaatatttttatttgatagtctgtccttgcttatagcctcatgtaatcaaggggacagcatgtttaagactttgtatccagaactttaaggtctagctgtggttcgcttattaataattcactgggaaggttaatttctagttttctgctgggtctcccagaccatacttcaaatgtagaatatgtttcttctttctcctatgcctcagtttccacaaaacacacccttagagaattgtgtgtgttcaacaaagatctttaactataagagcatttctgagccgccacttcatcctgggaccaaattctaagagcaatttgtattgagctataaacagctaatctgctagtttaagatgttcttttatacagtcatgcagaaaaatggaaattgtgtgttctaatccttggagactggctgataaagtgtcactaggcccctgatgaaatttaatatttaggcttatatccccttaattttccccctaaatttctacagtacgcttttactgcatgatgatacagctttattttgaacagtgaccaaatgtgttctttacaaagaatattgacgagttgtgtagtcttgaacacgttgcctgacttctctgtgccccagtttcctaattctttattctattctgtggcagtgtccactttttggtttaaagtttttaacacatctccagttgaggtgaaagattttaggaatacaggtatgtttttgcataccctgctttatacaggactacaagtatcaacttggtaactttttgtactattttgtttacttatcccccttactcccctcttaaatgggattgggcgtggttaggttggatattcaggtatcttttggtacagtgagtgaccattttcagaatgttgtctaaccagttaatagatactggtatcagtagtagtagtaattttgaactgtaaaaataaaggttgtttttatgactaaaataaactacttcatgtgttcattcgttttgctgtttatctatattaatatttcaaattattgcttagtcaaaacctcaaggtattagtcactggtttttgagcttataaaggaagccactggagcaagatataaaattaaccattgatgttagtccagagttcaaaagggtgagtttaaaactttcttaatgatggtacagcaattatttgcttataaactgctgaattaatcctacttgagtatttaaccaagtcttactgtctaattttgctgagattttcagtgatataccaaagcaaaacaaaacaaaacaacagcaacaaaaaacaaaaggttgtgactgagacctgtcaaattcatttggctctatatactttgcattcagcaacaaaattttgacttctcaacagcaaaaatgtatttctattttaaaataactgagccttttacttttatccagccacattaagcatttggacattttcttttttatttatttgtttttcattattagtattttcattttttgcagattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatggtgagttactcccacacctgtgcatccataagtgcaaaagagaaggaaatcttcctccatgcttttaccatctatccaacgaatgtgttaaggatagaggcacttaaagactgacaaagagattcatttataaaatgtaacatcaatatgtcaaaataattaactttgaagtacggtgccttttatgtttgagctaagttattaattgcaagtatatttagtgcgctcacgcttacttatgaggaatctaaagtatggttttatttgattaaaatatacacaattttatggccagctttagtaatagtcattagtcaacttttgttgtgtcattgaaattctaaagggcttcacaggaatttaacaaatttaatttgagtcttggaagttttttacaacaaggatgaaaaaagattgattgtttaatggttaaaaaaatgattaccaagcaaaaacaactgattatttcaatttaataggcctggggcttcgttggtagagaagatataataacacatttttcttcataatcaaaattttaaatttagattttacttattttattttcttatattttttctaaccactgacaatgatatataatgttcagtttttagttcttgctttaagaaattgcttatttaattggcagtttttaaaagaacaaaagaaaaatagaaatttaaaaatttgtgttgccaatatttatgtatattctctcctttttctagatggtatttgcaagtcatcagactgcataaaatcaggtaagaaatggtttttacgtgtaatagttatacaactgatgtataatatttaaaattaaatgctaatcttaatttgctttgtttacacttttattcattgtagatcaattatttatgtgtctggctctataatcaatggaaataaaaatatatttaagtagtagattaattaacttgtttactctgaaaaatatattactattttcagccctgggctgtatagcagggcaatagaaaactatatcgctatttgtatggagcttgccatgtagttgaagaaagaaaatgaacacatatgaaatggtaagtttcgtatcattgtgttaaatgtctcagtgcacctcactaggtgggtgagaagaagggagtgagatgtaggcatgtaaatctaggtggagaagttaaaatctgggaagaaatttcattttatttattttttttattttttatattttgagacagagtctcgctctgtcgcccaagctggagtgcagtggcgtgatctcggctgactgcaatctccgcctcccgggttctagcaattctcctgcctcagcctcccaagtagctgggactacaggtacccaccaccacgcctggctaattctgtatttttggtagagacggggtttcaccatattgatcaggctggtttcgaactcctgccctcaggtgatctgcccccctcggcctcacaaagtgctgggattacaggcgtgagccaccgcacccagccttaaatttgggaagaaccttgaagcagggctagaatttagatgtggcggtgcagaagagggaattccaaacacaaaagaaagaaactatgttattgagaagtagtaaaagtgtacgcttgatagaaggacacattatggagaaccttgaaatccatgtttagccttgatattgtaatacaggagaaacagatatttttgaacagaggagtgatcaggccaaaggtgaaagatgattctgcgaatgtgaggttgactggattgagtgaaaaggagggcaggcaggtgggggctgcttctgtactccaagtgtaagctgaagaggttggcctgtggtgagagaagagtactattgagataatggggagggagaattgggtgactcagtagaactgacttgctaaataaaatgaatgaattgagaatgatgccaagttttaaaacccaagggactaaagagaatggaggcagcccacacagaaatagagaggttatgaggtggatgtggatgtgtttggtctaagatgaaaatagacaggaggaaggtagagatgaggtttaagaagctggaatttggatttgagatctgtcagtttaggagtgatagtggaagccttggaagtatttgagttctcaaaagaagagaagaggttcaagggctaaacttaagaagaggttcaagggctaaacaacatcaatgattagaagagaagaaaaataagtcagagcagaaaacagagaagtgtatgaagctatataaatcccatcaattggagtgtggtgaaaatgggagtatttcttctttcttcaagaaaaaggaaggtggtagctgagggcagcacctgggatatgaacacaatatttgtgtcctttaacaagagattctaaacctcctttctaacatctatgtgtcttataagaaataaataaactgttccaaataattttaaccattttctgctggatatttttaattttatttatttatttatttgaggcaggatcttgctctgtcacccaggctggagtgcagtattgtgatcacagcttactgcagccttgatctcctgggctcaaggcatcctcctgcctgagcctcctgagtagctgggactataggcacctgccaccattcctggctaggttgtgggttttttgttttttttgtttttttttgttttttttttttgtagagacagggtctcactatgttgcccaagcttggtcttgaactcctgagatcaagcagtcctcctacttgtcttcccaaagtgctgggattacaggcatgagccactgcacccagtcttggatattctttacttggatttttgttattcactgaactttgcaaaaaaatgacgggaaaatatctggcaattctaggttatagtctaatatcctgaatctgtgccctttggtttttttttttttttgtatcgttttttgatggatttttttgctctgggtcacaagagcaatgactagacaccctgagatgtgatgtggggagcgtgagggagacttgatttagatgttagccatttgctgctcgacatagtaagtttttcccaaaaacgaagtttctttattccccagggaaatggctgcacaggtaccttggctgggggatctccgtggtcatgtgcaaaagtcagcatgtgcccaagttgtcaaagttaacgtttacttcctccccagatcctcctatgcttcctctctctaccagctaccctattatatgctcaggctgtcctgtttcgggaaacttccacttacatattgactactaagggttaattcctctgtctttaatacacttgacatgtctctttggtatcttaatctatagattctctcttctctcactatttttcctttttctcttcttttccttgaattttattttcgaagaaactggattttttgactaggtaggtgtatttctataaacgacaagtgattttgcctcagagatctaggcaggtttttcctcccaaggagcaatgtgacattcagaatctggaatcttaaatgtgacttaatgtttagagataggatttttaaatagtgtttggcaagtctcaactcactaaaatgtatttaacctgtatcctttaattgtagcttagaaatcaaaccaaatgtaaaacaccttgcaggatgtatcttggcagagaaatgtatacaatagaaataacttcagtggtaaacaaggttgctgtatagctgtatatttttcttcattctgctctgttggttcacaagccattagaatacttgttcacattggtagttactattcttcctaggagaataaataagatgacacacaccctcatggatacactctgcatactcataaacacacacactcgtgcgcgcacacacacacacacacacagtcttctgctggttaggaaatcttttctgccacagaaaaatacaactatttcttttagaagttgttgcaaattaggaaaaccctagaggaaatcttggacaaaagcaagtattaaagaagagtggccagagtagagtagatggaaagaaaaagaaatgtgaaaagagaaggctgggcacggtggctcacgcctgtaatcccagcactttgggaggctgaggcgggcagatcacctgaggtcgagagttcaagaccagcctgaccaacatggagaaaacccatctctactaaaaatacaaaattagccgggtgtggtggcgcatgcctgtaattccagctactcaggaggctgaggcaggagaattgcttgaacccaggaggtggaggttgcagtgagctgagattgcgccattgcactacagcctgggcaacaagactgaaactccatctcaaaaaaaaaaaaaaaagaaaagaaagaaatatgaaaagagagatgttgaaaaaatataaaatatcttaccagcaagtctataggtcactttaagagagtgggtgggttcaaacctgagctcagaaattcttgagaatgggaaaagcaagtattgacactcagggtgcttacattatatgaaagatggccccaacttgaacctttcttccagtggaagggaatgtcatagcaaatgtacttatctttgattctttgaagtcaaggaatacagaagtcaagccataccaagacagaagtaaaatattgcagaaggctgtttcaaatctgtttggtgttacatatttaaaatctgagcatctaggatttaaatatttatgatgtacataaaatgatgtttatgtatactttaaattaacttgcctatatgtgtaatgcatcagtatgaaagattacaccagacctaaagtaaaacaaataccacttaagaaataacaacttaaggcagggatcaaaatgcttcaaagtattattcatcgcttatttaccctataaggtcatcaaaaacttagagttataaaacttgtatgtgattttgcagacttttccgtgtaagtctgaatcctgaaactgatttccattgcattgtaacctccctaacttagatttcaaggaatcttgtgctttaaatcagggtttctcaactcaatcactattgatatttttgtgctagataattcttcgttgtggatgctattctgtgtattataggatatttagtagcatccctggcctctaccaactagatgtccagtagcagtcctctcctagttgtgacaaccaaaaaatgtctctagccattactaaatgtcccctgcaggcagcacggtcacttatgactgggtaccactggtttaaacggtctcaagatgttatcaatgcttccctcttaacggtaggcaggataatggcctctcaaagatattcacacccaattcccagagcctctgaatatgttgccttatatggcaacatgcctgtaatcccagcactttgggaggccaaggcgggtggatcacttgaggtcgggagttgaagaccagcctggcctacatggtgaaaccccatctctgctaaaaatacaaaaatccaggcatggtagcacgcgcctataatcccagagggaggagaattgcttgaacccaggaggcagaggttgaagcgagccaagattgcacgactgcactccagcctggaagacagcgcaagactctatctccaaaaaaaagaaaaagacaacagagaattgaggggtctgcagaagcatatgttagaagtgtggtcctaaattatccagaggccagagaagccaagctaagacgtgatcaatacagtttacaagagaaagtgggaccacctccacctgtatagtcatgcaggttgtacactgcatatttgtcgatggcagccttgacagacaggcttgtggaacatcaagacctggatgaaacacctctcagaactgtccactccttttattttaattctgcacataccaagaaaacttttgatgattacttaattattaatacaaggagaggtggcattctgttacttgaaagatattttcatcatggtgagataatgcacagcggtccccttcttatcctctgaggatcccccaagacctcagtggatgtctgacactggactgaaccctatatatgctatattttttctgtatacatacctatgataaagtttaatttataaattagacaaagattaataacaataattaataaaaaataaaacgattataatattattccagcatcactattcttatggtttggggccattattaagtaaaatagggttacttgaacacaaacaccatcatcctgcaacagttgatatgataataatggagaaggctccttcgtgactttcatcatgctactcagaatggtgcgtgatttaagacatatgagttgtctgtttctggaattttctatttaatatattggactgtagttgaccatgggtaacaaaccatggaaagtgaaaccacagatatgggggagactactgtacgcacatactgatttaatcagatttgtgtgctttgagctatgaccctggaactgaaatgaagcttgcaaatgtctgcaagggccagatcatggtgatgccctaggtgatgcatcttggcaacagctagccttctcctggctgtcacaaggcatctctgccttcttgcctgttaacaccttgaaacctccatgaaggaaaacagcacaattaggtaaatacaggaaggactgatggctaactcatgggggctactggccctgtagcagccttttagtgtaggaaatgaggctatttcattatgtagttaagtttggaaaaaatccttcatggaataagaaagcagcagacatcttagtaggaagaccactgaagcacacctttgttaatttaaatgtggcatgtggcaatttgctttgtgtggcttccctggcacaattctcgtgaaaattgtgtagggatattaccttacatttatccagtcaaaattagcatctgtcaatcagatcctttccaagaaagggaatcagttatatcataaatacacaaatatataacatgtgttttttaccctccagggaaactttaagcaagtagtacaccatcattttttaatgaatggtcaagaaattgaaaacatatataagttgagttaagcagttaaagggaaagacaattagcaatgcctggtaagctaagtggtactccaaaggtttattttatagctacagaaattatctacatgtagagggggtggatacaaactagcttagactggggtgagaatcctggtttgacatttaacattttagaataagagatatagaaagattcctctgtagttgaaggatcctgttttgtcctactcataagcaaatccatggggtagcaaggtgctttctggtaagcctttgatatgatatgaagctcaagttgataaaacagattaattgaaggaaattgaaaaatacgcaatttaaaaaaccataaggagaatgttgcacaagcttttgaatcctgtaaattttcattctttaagaccattcagaaaaggagattttgtcgggggccagtggtggcttgttttgatcctatttctgaaccagctgaaaactagaatacgttctttctgttcaaaacatcctagatgggccacatattagtcaggccttctccagagaacagaaccaatggtatatgtatataaagtctcagtatccaaaggcccaagaacctggagttctgatgtctaagaacaggagaaggtggatgtcccagttccagaagaaacagaggatttcccctccctctgcctcttgttttatctaggccctcaacagattggatgatgctcagccacaatggtggtagagtgtggatcttctctactcagtccactgattcaaatgccactcttttccataaacatcctcacggatgcacccagaaataatgctttagaaataatgctttatcagctatctggatatctcttaacctggtcaagctgatacctaaaattaaccaccacaggctacagtgaaaaagatagttccaactgtgagtgaggatgcggagaaactgaaccatcatacattaatggtgggaatgtaaattttagtacatctggatcaacatgttagaaacattttgaaaaacagtttgataatttttacaaaatgttaaatatatactttccatacaacccagcaattctactcctaggtattacttaaaataaatgaaaacacatatcctcacaaggacttcattacagcataatgctgtttttataaataatttataaaagccaaaatatggaaatatcccaaatatgtattaacaggtgaataaacaaaatgccatatagctataaactacgataccacacagcaataaaaaggagcaaactactgttatgtgcaatggtgtagataaacatcaaaaacattatgctgagtgaaataagccagacacaaactgcatattgtaaaattcaatttatatgaaatttctataagaagcaaaactataggggcagaagacaaatattggttgcctgaggctggagatgaagcagggattggctgcaaatgggcataaggggacttcttggggtaatggaagtgttctaaaattggactgtgacaaattctcagctttttggctaaagatcaagtgtaaattggattgtggtgatggttgcacaactgtgtaaatttaccaaaaattaatcgggtgaattttatggtatacaaattaataacccaaagccgttaaaaaaaaaaagcaaacaaaaattcaccttcattctttcccccatctctccaatgtccatttttacatagttatctcatgttttgatcttatgcttgctattgtatgttgagtccattgagctccatttttgcagtttaaatgattatatgtagttttcaatgtagttttcaaatcttcactaaataaactcaagctttttagtttgagtgagcctctattatttaattatattagcaatatattgacgaaaagtctctggaaatagtaaatcaactgggaagttaaaattatttcaggattaggtgttggaagtcctgttttcaccccctggggtttcacttacagaggaagtcaaagacatatgtgtccaggtgtaccagccatctggatcaaagccagaccacttggtctaccacagagcagttagcagttcctgcttctggaaaaatgtgttggtttttcacacaggtgctgcgagatgttttccttttcaccttaactgatagaaagtcaagagccaggacgggcgttttggctcacgtctataatcccagcactttgggaggccgaggcaggtggctcacgaggtcaggagttcaagaccagcctggccaagatggtgaaactctgcctctactaaaaatacaaaaactatctgggcatggtggtggacgcctgtaattccagctactcgggaggctgaggcacaagaattgcttgaacccaggaggtggagtttgcagtgagctgagatcttgccactgcactccagcctgggcgacagagtgagactctgtctaaaaaaaaaaaaaaaagattgaaaaaaagaaaaaagaaaaagtcaagaaccaaatttgaatttaacttgaaattgtaggacttctttgtataaacttgcttcatcagctttattcctattcctcttttctttctcatacaatgtatattagtttattttatgtatccctctaaggccactttgaattattttaggaagaatgtaggttaataatcagatgaatagaatataaattccaacaactgatatgtgcaggagaagggctgttaaattataaactttatttcaaagagatgcaagtgttatgagtaacggaggcacaatttttggaagcttactgcttctttttccactaagccaacttttagcatgggagatctgggatgtaagttttggccacatcctgtgtgattggtatgagatcctaattaagtcagttcagctttctgcatttcattttcattatctacaaaattggaattgaaagtgtctcattttacagggaaacagcaaagactaacgacagcctatttcatgttacacgcccttcagggagatgcaccataggtataatgcacagataggattcatagacatcttatttcatgaaaattgcaaatgcactatttaaaattttttattgagaatcaaataaaaatcaaatcaaaaggcgaacagtgtatttttaaagaggaagttgtagccagaaacagagagaaagaaaaaagagaatgtggtacattttacatattctcaaataaaaatgtgtcatcctttatgaacaacatttgatttgattgctgtgctctgtcttagtatgggggtgacagttcaggctttgaatcaattagaatgagcacaatcagaaatgaacacttgaatctgtgtttcctgtaaagaaaagcctaccatcagggacaccttagtttgtaaacctagctaatctgcactcacccttgccagtaccccttttctcacctctgattaatcccttaaagtaagtaagtcagaggtctgcatcaggagaatgactagatccttggtattcaatgcgtggtccatggaccaacaacagcagcagccactgagaatgtgcaaaaatgcagtctcgggctccgcctcagacctactgaatctgtggctgcactttcagtagcctcttcaggtgatctgcaaaataaggttgagaagcactgaggaatagtgattttcaaatatggctgcttattacaatgatttgggaagcttttgaaatgtacccatactactaaaccttccattcttcctgggcacacaaagtttccatttcttcagtggagtagtttctgttatgtgttaggaggaaaagcaatttaagtaaatgaatagatgttaaggggtataggaattgcctggatatttgcatttttaaaagaaggtacatattgaccaactgattgctttaacaggttcaatttcagactgtgtgctcagtgaagactttaagttagagaggagtgaagactttaagtcagagaggagagacactgagcctgattttctgcttatcgtggacaagctgaacctggaatatcttcctaaatttccccagtgtaatgcaggcatgctatttctgtagagacattagaacaactttttgcctcttccattcattcatttattgatttatctattcattagttaattaattttattttttattttttttagaggcagggtctccttatgttgcccaggttgacctcaacctcttgggctcaagcaatccacacgcctcagcctcccaagcagctagaacaacaggcacatgccaccatacctggcattcatttttttttccacaaaagcattaatcaagcagcttctaaacattgaacactagacattggaaatatgaactaaaataccccctgccgtcaggaaaatgaaaacctggtcagtgtgacagacataaacaacattaccatatggtttgataagtgctatgatggtgataagatttgtgtgctacaggtgccctgagagaggagcacctaaaccagagcgggtctgggagtgggcagctaaagtgatagcaatgaggccgggaaagcagtcgcacttcaccagctaagttctgaaggataattgaattgcccaaccagtgggagcagaggagagcatgtgcatagtctgtatgcaagatggaggcaagagctcaggaagtttaggacctactagtggttcatgatggctgggatgtagaagctagcaagacttgatactagagaagtaaccagggcccaggtcacacagggtcttatatgccatgataaatgggttgcattatctcccgaagtctacagaaaatgaataaaattaaaatgccgcaggggacatctaagggattttaaatagggatgtgtgacattgtcaagattggctgctgtctagctcaagcctggtaaagtggaggcaaagatttacccaaacaaaggaataacattttggtgcccctggtgtgtgagagagcttggcaatattgagaaactgaaagaatatctgtaaggctatcatagagggtgtgtatgaagatatgagagtggaggcaaggagaagtgttcactattggcaaaagaaataagcaggaattggattttgtagtctgtgttaaagtgaatgcacttccttctagtagcggtgggaggtcacagaaggaagggttttaaatgacgcatgactttatcagaattattgagaaagatcactgaatagaaataaagaatggctgtgggcaggaaattgggctactgcacttatttggatgagtattatggttgcctggatttgaatggcaacagtttttattgttgttgctgttgtttgtttgtttgtttgttttgagacagggtctcactctgtcacccaggctggagttcaatggcacaatcacagctcactgtagcctcaacttccccagactcaggcgatcctcccacctcagcctcctgagtagctgggattacaggcatgcaccaccacaccccgttaagttttgtaattttctgtagagatggagtttcaccatgttgcccaggctaagaaatggacagatttgagaaatatttactgggaagtagaattcataaggcacaatgtttctgtaaataggtgaggttgtgaaaaggaagtgaggaaaaggtaactcaagtttctggcttggtaaattgggtgataagtcagctgttcaccaagctagggagcactgaagcagagcttattgggtaataggctgggaccaatgcagtgaagagttcactgtgagatagtttaaatttgagatactggtacatattcgatgtggtagaattcagggaagatggtgttggaaataaagattcgggggtcatcagcatgtggatgatatggttgagatttcttagggaggaaatggagaagagaacccagaattgcatcacataaagcaacatttaaaaatgagaagaggaagaaactccaaaagaaaccgagaagtaatcagagaggtagaaggaaaatcagcgaagtgtaaaatcaccaaagcaaatggaggagcagctgtccaaaattagagagtgatcattggaattaagcacagctgagaggttgagtaggctaaatgttgaaagcagaaaggaagacattgaagattcaggtgaagatcaggtggaaaattgatggattttgtccagaggaagtaaaagaggatgtatatccagagaaaagaatataggatgattccgagataaaggatggcctcctcctcccccttttatttaatactagggagaaagaagccaagatggctgaaatgcaaacatgtttggaagctaggagggacaggaagttgaatgggtcatcatccagttgcctttgtgaagtaacaaacaaaaatctccgcctgggagtgagctggtagagaaagtaagtaaggagagtatgaagactggaaagtgtccatgtgaggagtgggccatgcacacagaactgatggctctgttgaaatggaaggctataacttgaaatggcattaaaccaggcagttgtggggtttctccagcatcaccgataatggcttcaacagatattgtcagcactgttttagatgctaaggatacttagcacctaaacgcagagtgagcaacacaatgtccctgcttacaggagcttacagcagtaaaggagacagtaaataaacacacacacatataaaaaaacattattagatagactagagttggaagggaaaaggaaggcagctggatcaattcagggtaggctcatttgcagggggcaagggaatgaaatactttggtgagatgatggtttcagggatggcaccacaggatgtacactggacagaagatataaaagaaaagtaaagtaaaaaatagagtggctggctgggcgcagtggctcacggctgtaatcccagcactttgggaggccaaggcaggcgaatcaccaggtcaggagatcaagaccatcctggccaacgtggtgaaaccccatctctactaaaaatacaaaaaaattagctgggcgtggtggtgcccgcctgtagtcccagctactcgggaggctgaggcaggagtatcacttgaacccaggaggtggaggttgcaatgagccaagatcgcaccactgcactccggcctgggcggcagagtgagattctgtctcaaaaaaaaaaaagagtggccatggggtgagagttttcagtgaagtcgaggaacaggtgtagagggaataaagaaatgaaacaaacaaacaaacaaaaaacacttctaagaatcagaagattcttattggagaggggggttactcgagatgaagatttcagaggtacaactgttctgggtgatgagaacattaagatgtcgtcatgaaaatgtgtagactaatgtgaagtgaaggtgaaagttaggagagttcagatggtcaagaaattcttaagctagagtgtagcagaggttgtccacagggtctctgatgttacatatcaagatggtagaacttatgtggaagggcagactgcacaaagtgccagagtcttaaacaagcagagatgaatgcctctggagtcagtagaagacagagataaagtaggtgaggcggggatggttgactggcagaagcttaaataagcagagtggacagtaaggatttggctattgcaccaagtgataacagaaaactagttttgcttttccatgttggggcaaggtggagggatatgccacctgatgggattagttcatatggattagtattttcagtacacgtgttgtcatatgtaattatcactcaaaagggtaagcagcaactaataagaagaggtgctggagggccacctgtctggcatatagtgtgggattccatttgatacaattacaaatgaattcatttttactcatttttatcttttcactatcctagataaaaactcaaaatgaatcaatgagttcttatcttaaaacaatatgttctgtttaaacatttctcagcggtataatcttcctttaatcttacatttcttcaatccagaggagtccaactacagtgccttcaccgtgaagctaatgaaaagggagttggtccactgtgtagactagactagatgattgcgaagttaaattgaagtaattgagcaggtacccaatagccagcagcggatttgtttctctgttcttgatgcttaagtaaaaacaagcaagccaagtattaaatggtggagctcctgacaacacagcttcataaaaaagaaactgcttgactcaaggagtgtgtccttgcgatagtttgccgagaatgatggtttccagcttcatccatgtccctacaaaggacatgaactcatcctttttatggctgcatagtattccatggtgtatatgtgccacattttcttaatccagtctatcattgttggacatttgggttggttccaagtctttgctattgtgagtagtgctgcaataaacatacatgtgcatgtgtctttatagcagcatgatttatattcctttgggtatatacccagtaatgggatggctgggtcaaatggtatttctagttcaagaaaaccgaggcaataccattcaggacataggcatgggcaaggacttcatgtctaaaacaccaaaagcaatggccacaaaagccaaaattgacaaatgggatctaattaaactaaagagcttctgcgcagcaaaagaaactaccatcagagtgaacaggcaacctacagaatgggagaaaagttttgcaatttactcatctgacaaagggctagtattcagaatctacaaagaactccaacaaatttacaagaaaaaaacaagcaaccccatcaaaaagtgggcaaaggatatgaacagacacttctcaaaagaagacatttatgcatccgacagacacatgaaaaaatgctcatcatcactggccatcagagaaatgcaaatcaaaaccacaatgagatatcatctcacaccagttagaatggcgatcattaaaaagtcaagaaacaacaggtgctggagaggatgtggagaaataggaacacttttacactgttggtgggagtgtaaactagttcagccattgtggaagacagtgtggtgattcctcagagaaataattttaataatgtttgagtgaatcaaatatacaaatagtattgtgatgcagtgtacccacaatcattaactcaactatgaattactcaaagcactgtagataatagtctagcaaggatctgacaatatgttgagaagaaatgatgcacatgaaaccttgaaagtcaccttaaagaaactcatatcatgcaaatatgaatattttaatagctactataaaatagtagcagctgagtgctgtggcacacacctgtagtccagctactcaggaggctgaggcagcaggatcacttgagcccaggagttggagattagcctgggcaatgtggcaagaccccatcttcaataaataaataaataacttagtagcaattggtgctatgaaactttttgatgtagcttggatatttgtcctcgcccaaatctcatgttgaattaatcctcagtgttggaggtggggcctggtgggaggtatttggatcatgggggcagatccctaatgacttggccctgtctttgcaatagtgagtgagttttcatgagatctggttgcttataagtgtgtggaacccccccacccactctcttcctcccgttcttgccacgtgagatgcctgctcctccttcacgttctctcataagtaaaagctccctgaggcctcccaaaaagcagatgctggtgttatgcttcctgtacagcctgcagagccatgagccaattaaacctcttttctttataaattactcagtctcaggcatttctttatggcattgcaagaacagcctaatacattttgcatggtgcatatcaactatggtaataaagtgaaaacaaagaagtgggaagctttgaaaagttgacaaattggttgagtaccatatggaactccagctgtaggatcagtcccattccaggcccaggcactcactggggccaaggtcagtagctcaaacattccacttccagtcagccctactcttggtgatctgcctctgaccccagctctagtaaatgggtttctgccttctcccatagggatttcactcctggctcattccccacttctggaaaatgagtttctttttttcttttctgtcttctgggactgaaatctagcttagctcttaacctcatgaccttttgccagaccacggagaactgaagtttccttggatcaacacacaccatctgctggttatagctccctcctcacagctgccgtgggtgccctccctgtgtgacttatttctgttgcttgtagctgagaacttcttctgttgatggtcctttatagtttaactaaaccgggattcagtctcactgggctagtcaaaccacttctaccagagcccagtttatgtgaatgatgaatgttttacatggaaaaaaaatgtttcttcatttactgaggaaggagcaccttcactgattttgtatgccaacacagacagcgaaggatcctgcttgtccttcacctatcagccatcacacctattaggaggggggaattggtcttttgttttgtttatttagtaaaaggaaatctaattatatattaaaagttaaaaaaattttagatcctgcctacatgactttaaaatgagcaataaaagtcattttttattcagggatagtaacaggaaaaagaagctagtatcagaatgttttaagattccgatacagtgcatatgcaggttttagtttacaaatagcagatggtgatgatttactataagaaggtgtaattaattgagaatgaaggatccttttggagtgtccattatgggctagtcattgtgctaggcgtaggaattagaatcctttccctgggtgggggtatacttaaaattattgcttttgtattctatggattaccttgaaataccctttgagtcatttctcaaaaattgtgcatatcataccgatctgataactcattgcactgttgatctgaggcttcatcccctcacctaaccacatggtcatccattttgcagtccacaagagcccttcctggattcatggaaagaacttgctctcacttgggcttgagaaagcataagtcaacttggcagggcatgtgttaacaagatgatttagaactttgcgaccagccagaaccataaagacagcttgtaataaaagtaaagctgttctcatgagatgcccatgatgagggcttctagggcaaggctgctgtttcttgctacctcagcaagaatgaggtctctttcccatgatcatttccctccccttcactgggcagggtgacaaagaccaggcctctgctcccaccagtcaacaacaggcagggctcccagcatgccgaaaccttgagagctacctcttcctcctttatcccttcttcagagggtagcctacctgtccacaccggcagagagtcactctgcatgtcagtcctctttcggttgcctcttttgtcaaaaacgtcacctactttcactgcctgggacacagctcagaacctgactcaaatatttgttgaatggccaacggaatgaatgaattgccctctctcctctaccttcaactggtagctcccccttcattcccagagcatcctatacgctttacctataactcatatcccacttgttattagttgttcaatgtctggtttttgtccactaaaatgtaagttttgactgtttctattttattcattattctatttctagcacccagcaatgtgtaagttaccaataaatattgattgaataaatatactctcaggttccttaccttgaagtcacaaaactattgatgcctatgcaaggtgacttgtaagcatacctaatacacaaatatagctgcctcaaggaaacgttttcagtctagctaggtcctgcttatgtcagatttctcagttcagtatttctgtatcaagcctcctaggtttagcccctttctatctgatccatcttctttgctagcaataaagtcaattacgctcttctcagttgtctaattcaccttgctaattctaccctcctaagctagaactaggttaatgaggaaacagtttccggatgtgtttctatttcccactatttttctgtttaagggaaaatttcaactaattttctacttgggtgtaagcatttccagctctctaggagcaaagtctctatcagtctggtttttcttttccaactgtggtttgttctgaattcctcccttctcaataatttatttcttctctcttttaacactctgtgttcttcttctcttgaacaccattatttagctaagtgttgctgttcttcaacaaccaccatcctctaaaactcctctgtccctgctcacttcattcataacacacaaattcaaattcctagccagctcacgcatacatgcataaactcacttatggaaggacattacaagagactccttacctctaggttaggaggagctttacttatcaactgaatacagtaggagctttacttgtcaactgaacactgagtaagtttgagaattgaaaatgagacctgagcatcacaaaacaacctttcatatctagatatagttaccatctaggagttcacgtgcattataaaagaaatggtcttgtttaagatgaaaccctgcaagctctgtgagggcagggattatgtctgtttatcacaccatggtatgttcagttcctaagagtgtcgggtatatagaggccgtcaatatttgttgaaattaaatgaaaagtttcagtcttttcatgcttcacaagaagaaaatcttttggagaaagccaatgatttaacataatcttctggatcttctatgacagaaaatagctatttaatccgtaaaaaatataaacatatggagccaaatactgccttgtgccaatcaaatgtttggtttattaatagttactaaatttattagtgctctctagaaaagagcctttttagaatttgatttcattttaggcagcattcgagaagcactgtcgactcagctttcctctggctgttgtctttttgtaccactccctaaccaaaattgatgcaaaggcaggatgctttgagttactctcagtaatcacatattattgaagtcagctggttattcttgacagacaatatgatccaaaataacacaatgtttaaacagaaggaacatgggtgtggacccccattgctccctcttcagagatgtctgccagggtccagggaacttgggatctacctgaagagtgttactaagggaacaatgtagccttttcatgaccttctatagctttagtttaaaaaaggaacattatcatcatttgctaacattacaatcaacagcagatctgataactcattttaagtgatatattgtatttaaattacagtataatccctaatagctttttgccagcagagtctttcaggattcaaaatgcaaattgcacctgaaaaagaaaaattatttttagacttatggcactttaacttaactgtaacacagttagaatactttttattattattattattaatagaatatgtttcggttgcgaattctggaggaatccctactggaaaataattgccagtcctcccttggctgtgagccattcattgaaatggactatgagataagactgaagaatttcactaatttcgggagtgccaactgaagtttattattgtgaatccattagacatgagatttctgtgattatctcaatgagttctaaaatccaggtccaaatgaggtggaaaaattttatatgactatatacatgttatagagcaattaatattttaattgggtgtcaagaaaagcagtggttgctctataacttaatttgggttcctctgcctctctgtagagtttctgaaaatttttaaatgtcatttggagttaaggcagaatgatactgtggaaaaagcatcagcttaaaattagacctaggctcagctttagttgaattccttaaatttacattggtgacgttgagtttgtaaccaccccatacctagattttcttaaaataggagtaatatgtcctactttataaagcagttctaaggaagaaaaatgattagaacccaaggcagtttcacatagtataagatcccagacgctggccaccaggtttcttgagttcaaacccactgcattatcctttgccaactatgtgaacttgggcacaaatcacttaccgtcaatttctatatttggaaaatggggacacaaatatagttaccatacaaggttaaaagaaaacaaacattaaagaaagcatttaaaaaacagccatcatgaagttggcacttggcgtttgacatatgtcaagtgttggcttctattgttattattattattacatttaagcgtctttggctaaacctaaatgaaaatcctataatttacattgtatatttaaatctgatagtgaatttatctgatagcaaatggattctaggttgattattcatatgcttgtgcctacgtgtgtgtatgcatatttgttgtatgtataagacctatggatttaagataaattagtcacatgtatatatgaaatatagttataaactaattactccccaaactagaacagcaaaaataggtctccttacttaagagtacagctgtacagagtaaattcactatgcttggaaacttctttcatatctatttgtgtaagtctgcagctagtttctgaacagttgtatagtgatggtttcatggtactcaccaattagacaagtataagtcatgaccttggctttcttggaacgtaaccagtggttgacagggagtgtttgagttaaatgataaactagcagtccagtttacactcagcatctggtatcccccactctccatctttcttcaaccaaggcatcacaaaagcaatttgggggcaggcattttcatttaaaaatggagagtggattgtggaagcatcctgagtgtttgtaatgaaagccatttggtttttattagcattagagtctacgtgcttgctagttttcagtcattttctcttcaaaaatggttccccagattccagttttcacattgctgccttttgaattgaatcctttgtgacccgttgtgattacattgcattttccttgtgttcttttaaaaagttctgactttctctgaattgtggttggggggatggtgggaggagggtggcagcaagggaatagggtcacttgtacttttagaatgttgtcaaaagagatttttaaattgtcaaaaattgcctagaagtaatatcaagcttagtgtctgctaataaagcaaggatttacaacagaaggttcggtcagaaatgggtgtcctaaggtctttacaaaagagcatttgctcctgggttccccaacatttctctgacctctgttggacaattctagaacagttataaatcaggctaattataatgatgttaggatactggtgttgtgtgtttggggttaggaagctgagagcttaggcaatttgaagacaacaagctgaaaacagctttgttcatataccattccctaaacattaattcagtgcagattaagaatagtcaatggagggaccgggcgtggtggctcatgcctataatcccagcactttgggagactgaggcgggtggatcacgaggtcaggagtttgagaccagcctggccaacatggtgaaaccccgtctctactaaaatacaaaaattagcctggcgtggcagtgggtgcctgtaatcccagctacttgggaggctgaggcaggagaattgcttgaacctgggaggtggaggttgcagtgagccgagatcgtgccattgcactccagcctaggcaacagaatgagactctgtctcaaaaaaaaaaaaaaaaaaggaatagtcaacggaggaattttgtcatggcactgggggtatatatgtggtatgtatgttgtaaatagatgcctaacctatttaaaacgtggctaatttatagtgaccaagagtttttaaaatagagtagtaattgagaaagaaatggtttgtatctttttcccacttaattttctttcctgttttgtacatttttctagatgcttcaaaaagacccaaagaaaagaggaatataagcacagtcattactcattatttgtggattctctgtttgctaattcacctactccctaaaatgtatttattacccccaaatcactatttgcagctctctcacagtcatttacagacatgcacagactggtgaaaaaactttgagtctttctacacacatgtactcagctgagattgaacaagggaactatagacaaggatcctttttgtagtccatttagtcaacgttttttgcatttttgtgctttttaatgatgatttcactgttaaaatgctccacaaccatagtgtggaagtgctatgtagtgttttgaagcacaagaaggctgtgatatgccttacagagaaaatatgagcaatggataaacatcgttcaggcatcagttatagtgctgttggtgtgagttaaatgttagtgcatcaacaaaatatattaaataaggtgtctttaaacagaaacacacataaaacaaggctatgtattaatcatctgtgtgtccagaagcccacaggaacctaaccttgtatttcccctagggtcaatgattcagtattcactaattcagtgtagtagggactttatatagaacaaaactcatataaataactagaataaaccacacttgttttttaattcctgtgaaataattcatatgggaaaccatcaaagacctgctaagtaatgatgaacattaaaaaaattaaactgggccgggtgtggtggctcttgcctgtaatcccagcactttgggaggccgaggcgggtggattacctgaggtcaggagttcgagatcagcctggccaacatggggaaaccccgtctctactgaaaacacaaaaattagccaagcatggtggcgggtgcctgtaatcccagctacttgggaggctgaggcaggagaatcgcttgaacccgggaggcagaggttgcagtgagcagatatcgcgccattgcactgcagcctgggggacaagagtgagacttcatctcaaaaaaaaaaaaaacaaattaaacccatataatagtactacagcacaaaactttatgctatctattttgttcatttgctgtttgtgactatcatatttatgtcaactttaccctgttttattgacaagtacccaggagcacttgaaaatgtagaaattcctttaaaccctcccccctccaccagaaaacaagcctccagggaatgcacatatataaatattaagatagttgttgtgtatagtgcccaaaatcctattttcagttagcaaactattggtaatgttggaaagcaaggcatccagataagaaaggggagatcttgtggcttggaggccattcaaaggcagacttaaggttgcgtcttcttaagggagacatgtagtgggggtcccgtgtaactggaatttcaccatgtctaatcgtgtctagcagaccaatggaatgctgtgcctcaagtttcttctgagaggcctatgagcctcatgagatatcaacaaaaatgtttcttggccatcagaagagagaagtgattttgaatatagtatagtttttgctattataatcactccaaaaccaggcctgttggtgcttgtggttcttgagagaggaggccatggggggtgaaattcaagagacctgtttacctataggcacaagagccctcctcaagacttgagacaatgaaagatgaggaagggaggtattttccctgcatcatccagcttcagcacccagcgggaactggatcatgggtggtgtctgggtaggaggctgtggaggctaaagtcagtggagcagagtggaagccttggggtcgtgggcttatgcatgagacacatgtgaggttccgtgcaacactttaccagccaattataagggactgaagtcactgcaaaacataggttgccatgatgtaagcccatttgcatttgcagactgaaaaggcaaaaggaaatattcctgattcaagtaagtatgggactatacttttttgatattggatctgttggtcctcatttctatgtttctcgattgtctaatgtggtggttccccctgactgcacattagacccactctagaaaaccttaaaaaaatgtctggaccccctccaaagattctgactgaattgatcaggagtagaattctgggcatccgtgtgtctaaaaggcttctcagatgattcacatgtttagccagggttgacaagtactgtcctaaaacatatttctgagatttttcacactccattttccaatgtgctccaaagatagcttaggcaggaaccctgctacatggccacttcaaaaagatgcacccctgcatgggcctttgagtgcatccacctagcgtggcctccatgccacttccctgtctggttactccactataaaaaattcatctgcggactctccaagtcctcaagctgtacattgtcctgcctttgtcccaacaagaattgttggtgataagtccgacagtggagaggctgtggctgcagagtggcaggaaagagagtaagtaaaggagaagacaggacaaaggaagagtaaaagggtacttgaaaaggactggaaaggagggccctgcaaggtgctgcttctcacgtgctccccaccagccttctgcattcaaagcagggagggaagagtgtgggctcagagccatacatgcttaagtgcaagccttggggccccataatttactagctgcttgatcttggaaaaattacttaatcttgtacagctaaaaagtggtggagctctgggattcagaactggtctgtctgggttaaaagagcccaaacgtttttcccagcgtatactacatctcccaatccatacacacacaatagacttttcagtgaggaatacagtaattaataacttcccagatggtagttgaacttgcttttaaattcctatagtcaaataagttgggagaatgttacaagaagattagttagaaagaaaatggtgtcatttattatcagctcgaaacattcagaattgtcatttgtaagaaataagctcattattaatagaagattacttctcttgtctttgtgtgaccattttcttaaattaaaaataacttttttcccttactgcaaaagtaatgcatgttcatctaatacaaattggaaaataaaggtaagcaaataatacaaaattaaacacactcttaatccctccgcccagatctaactgctgtaaatatgttagtatatatccttctagattttctgtgcttttatacagattttaaaaaatcatagtatatgctctttcactttacaatatctggtcaacaacattccatgtcaatacatttgcctttactacattattttttatatctgcttattaaggtgaacaatttagtctgattttaaaccacatttgtttactcagatgtcagagatccacagataaggaaacatctgaagagcccaggtgtggctatgtggagaggttgagtaattcaaaacaaagtacaaaacataaaaacaattacgaccagtttgacagttgtacgtctgtttcctacggccttctacccacaagtctaccgctgacttcaaagaaaagtcagcacagaggaggtccagaggataaggtgcaaaacgagaatcaaacccacgataagagattaaaggaaggttgatcaaagacccagcataaaagtgctagcccgtgacttgccttggcccatggccccaaaatattcatcagaacagagagcgctctttgaagtgattggatgcatccatgctcagacaagctcggtggtcaaagggaaattttaaagagtggccctggaaggagttagcaaagttgcctcttcctctctctgctctgcacatccctcacaaactgaatgttatttctttggtttgttgtgcagatgcaagtaatttaactgtactttttgccccctgggagatgtgggaagtacagttgcttttacaggatggagaatttgcactcatgatcagagaactgaaacttccagccatcctttttattcagagtgtttaaggaccggtggtatttccaaataggcagtagggcttgttcatgctctgcttgttcattctgcttgttcattaattgttcactacttttctgagtagagttcattgctctgtgatgtcgtgacagaagctttcatttccccagaaagaggaagaaaacagaagtgccccctccaaatggcatagccttcacaacattcagtttaaatgtttttaagtatcttaaaagagaagagttatatattgctaagtgtgttcttagaatgtctgtagttagcacttctttcaggctctagttttctggtttttcactttacataataatcctctatgtatttaggatctttatttttcacctttcccgttaccatatttttatttccttcaaaattcgagggaattgcttttttctctctaccttttttagatcagtttcctagtctttaactgaggtgttaaagttggagtttttactggcaagtcttgactgagcacagtgttaggctctgtgagagagaatatgcattttctattttcacagagccacagtccaggtgaggagataatgaatttgcatgcaaaaaatgaatatgttgtgagctgatacagacttttgtcaggccagtctttcataaagaagtatttggaatgggctttgaaaatgcctgaaattccaaaatgaaataatatgaaataatatttattagtacgtataggggctgggtaacatgctcaaagttacagaggcagaaaaccataaggtgtctcacagaaactgaatatactcatttaactgtgacagatggctcatgcgagaaagtagcaaaggagaagcttcattcgttctattagtgttagaatgtgctatagaatctggattttattatgattgcaaaaggatggtattgaaaactttggagtggaaaatgacattctgaagtattttgagaatatgaatctgcctgtggagtacagaatggacataggtaagaagaggcctggggccacaactttgtcaaaagggcacaaatagagtctgagagaaagagggtttgagacagaatggaaacaatgggaaagatggaatggactctggaggcaatgaactgagaacggatctgacctctgtggcaaggggagaggaggtgagtgatgggctgtaagagaaggtggtaagaagactcatagatgattcagtcacacataaccataattgcacccctgttacctaggtgctaggtgatacaaagagattaatcacatcaacaaaatggttaggtagacagagtaggtatttacaatgaaaaactcaaagtagtctcacattgaagacagagtgaggcaatgagctctcaggagtcaagagaaatattccttgaagtttggagtcacagaagcatcagggaagagatggaacatgagctgaatgttgaatgatgggtagaatttggaaagaatgacaggggcaatcaaagctgtgggatgaggaggttaaagcaaagacacaggactaagaaaacacaaggagtgtttgtgacacattgacgagggccatctggttggaacagagtttgcataaaccaccaaaagaggaaaaggggaaggtagggtgatacgtttattctggtaaaggtttagacaccaagctaaagattttatttttatttctgagatagtctctctctgtcacccaggctggagtgcagtggcgctgtcttggttcactgcaacctccacctcccgagttcaagcgattctcctgctttagcctcctgagtagctgggactacaggtgcctgccaccatgggcagctaatttttgtatttttagtagagttggtgtttcatcatgttggccaggctggtattggactcccaaagtgctggaattacaggcgtgagccactgtgccctgccaagcttttataatttaacctgggaaatgtcaagccactgacatttttcagcaaggttgtggccagtgtcaaagagtctttcgggaagtttggtttgtggaagatgtgtagaatatatcaagatgaagaactgggtgacttctagtcaaaaaggaatgatgatataaaccaggtaccaatcagaatgagaggtatggaagaggggcaaaggaattaccagtaaaccaaggggaaatagaaatacagttttacccaaagtttcaaatccaggaggctatgatagcaactgtgctgtatactaaggcatacaactcatgagatgactggtttggtaacagtcctgagcgttttgttttaaagagctgggtcctgaggttccagacaagcaaacatgccaaaaaagtggttcaatgggggggcttgaggctcagctggaaaccatgtttaccataccaagtttaaaaaatccacacagctcagcaattgtttgaagtttttaattaattaattaattcataaagtgaagtattttcaaaagctcatctgagagcttatattctcttgatacagatgaattctcaattgctcttttgttttcattgcaaaacagttcaacttgtatgagactcaaagtggggagggcaggagcagaattttctctgttccgggtatagacattatgggtattgggccatattctcctcttcgttggtaataattcctattttatacatctttctatcaattgcagctcctaccagagtcaacgtcttgattgtaaatactcagtgttggttgatttgcattttcatcatagtcctgaaagataaaagtggacctaagaaaaactaataagcttacagccagttttataatgacagactctatataaacaaatgcaaattggatgtcaaatttgaattacaaaatttatttgagcaaggtccaggaagtaataacagtgtcttcagatcttttctaaaatgataaaaattcattaacaatcttccatggcttggagtctcagagactttcaaaagtcacagcactttgaagagcagagttggcaactaaagttatcagagtgaagaatggcatgctaacctcaggtgcaggatggccaactcaaagtagacctctattctttgttcttctgagataggaactagccagaaacttagttattcaggggtggggtgggaaggctgtgggacccagggtggaaggacccacacagttcaaaataaaacgaaccaactatagtgaaggaaaagagaactatacacagatagtattcctcatccccctgaattgacttatataaaaaagaaaacggagcatccgacaaattgatgcaatcaaaagggagcaataagcctttttctccttttaagcctcttaagaaataaacccatcattttatctagtgttttctctgctcttgcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaaggttagtagagattgtgtctgtgcatcaaagatttctctcttaatatgttcattttttaaatatacaattgttagccattacaaggaatgtcacagaagattaaaaagttaataatccttccaggatttgtgtaccaccaccaagtcactctgatagtggcagacactgaaattaatgtgttgacatctcttagcattcctgctttcatttgtaggtatgcaaataataaagcggtatcatctctagagatggcaggtttggttttttgtttgtttgtttgttttttgagatggagttttgctcttgtcacccaggctggagtgcaatggtgctatctcggctcactgcaacttctgcctcccagatttaagcaattctcctgcctcagcctcccaagtagctgggattgtaggcacctgccattacacccagctaatttttgtatttttagtagggacggggtttcaccatgttggccaagctggtcttgaactgacctcaggtgatccaccagccttggcctcccaaagtgctgggattacaggtgtgagccactatgcccagccaagatggtagttttatgccattttacagaagaaaaaaaattaaatgattggcacagaaacctacttctgtagtctccctacccaaaccctgtgttaaagttactgtaagatgttactaagatttgccttcccagcacaggtatattctaacctggctaagactgtctccctgagaagttaagaaatctagccaagtccctcctatcctttgttctctgttctcccctcttctagaagttattttgtagaagaacaatttttgctactttttaacattgaaacaagtaggacaattcaattcattcatttggagcatgaacggtacagtcacacaaagataattattttccagccatcaaaaagactattcatactaaattccaaattcctctgtgttattgtttttttttaatctcaatttcaagaaaagtaactgttacctatggcagagccgtatgcatcactgttcataaaaaaaaaaaaagataatctagtcaaaaggactttcatctaaattggctgattaaactgactcccagttctgtgctaggaatgataatctggtaaggggtttggtttttcctataatgttttggaactggggggaggaaatgaatgtacctccagaaaagcaaggtttttttttaactgaacccactttgcaaatgttaattactgcaaatgagcaattatgtttgcatagtgcaaatgagcaattatgttgatgcattttattaaatgtcctatttcagatgtccttcaagaacccaaaactgaagatatagtagcagtgcagaaagcaaaagcattgtacaggtcttgtataaatgaatgtaagtgctcttcatttgatttcattaggagtatatatatatatatattggtgccaaactatgcctagatttctaattgaatttatgtttgttgtttccaaaagctgctattgatagcagaggtggagaacctctactcaaactgttaccagacatatatgggtggccagtagcaacagaaaactgggagcaaaaatatggtaaggcaattttcctactaaaaaagaaatttccatgtaaaatctatgttataatatcattagtgaactaaagcttctaaagatatattttatcttttattgctttaggtgcttcttggacagctgaaaaagctattgcacaactgaattctaaatatgggaaaaaagtccttattaatttgtttgttggcactgatgataagaattctgtgaatcatgtaattcatgtaagtttgtgtgtcaaataactaaagttacctttaaattgtaataaaacttccacatacattgttgttattgatatttagaaataatgctattttcaattgaattgaataagcaaggaggtagtatatccatgctctgtccctaatacctggagttccaattttgaaagtattttcttaatgctgttttcgacattcaccccttgcttctgctacctctgttttagatacctctcccttcacaaaacaaatgataagaagggctccaggcccctcctattcagaaaaagttcctaatttctttgtatagtacttgaaaggagcatgctttcgtttatagaagtaatgcaggtctagaaaccaaaaaataataattgctttcaaaaagaacacagaaaagggattttaaacatcatttttttcctcactaaagagtatctgtacttttttctcaactaaaggtaaataaaatgcctttcttttaaaatggatttattgtatttttacaaatgtaaacaatttgatttaggtgtcacctaagactagattaatgactatgtttggaatgtactgaaaaatataaagagtttttctttcttcctttttttttttgtttttttttttttttggtttcctgtgtaagaaattatacaaaaaattgcaggctactgaatcacctaatcatatctgtgtcactattgcataaatctttatggtcgtttttgttaaaatcatgaaaggaattgaacccaaatctcctgcagtgggctctctctcttctgaaactttctccttgcaggatcaccttgaggaccagggggtggggaaggatcagggcccttcatgtggagatatcttctggctctttccataccagttctttgggttatgttttcttttctattggcctaggctctccacagctgctaggattctctctttaacccagaaatgctctgtttggcctccacactcatgttgccatgcagtgagtaggaaacaatcttgcaaagctgcagtatgcccagatagctcccacttgggtattaaacatggaccagacacgttagcgcaaaactgagtttcctctttcacacccttaactgctatctgggtctactgaggttcttctgagcagagcagctttgaggagaaccaaggagaagtcgcctccattcccttagggtagagaatcttaaaaaacattttctggcacaagttacattagctaaaagattctggagttaccttagaggttttccacttctccccttctccccatccatccaaatcaacttgaagaatattaacccactcccaccaatgaaaggggatcccaactaagggtggaagcagatgagaatgttcccaggggagcacattagaatctcaggaagctgagaaatctgtgaatatgtaatttagaaatttccacgtcctagaatctaacatgtttttgttcacttgcaccttctgctctgcattaaaaatccctcctagtaaatcttttgttcactttcttttgttttccttaaatatctgcagcacagtcctccagattatctaactgcccgttagtataacacttacaagtagtgtagaaagcatttcctaactaggtatttattgagtgtctgatggtcaccccataaacagcaagagtaggatctttcacatacatagatagacatgcttgtatttttcaaacttttctatattcactgaatgatttattttcttttatgtatattttttatagattgaccaacctcgacttggcctcccttctagagattactatgaatgcactggaatctataaagaggtaaaaagaaaaaaaataatcaaaaccaaactacaaaatgatctggtgtaaacctacaagtaatgaaaaagataaagccaaattaaatttagccctctgatgtttttcattcatgacagggacttaaaatcacacataatagtgagctgtctttgatagaatgaacattctcaatagaatgaatgaaggtattttacaaaactaggaaacttgaaattccttatttgtatcttggtttttagtatttaaaacatatgatcgattttgaaaagttaatttaaaatattttaatccacctgtaaactgcattatttaaaaaatgaaaagatttatcatggtctagggtggtgctggtgaggaccagagggtcagtgagagatacactctgcagcatccttctggaaccatctgatttgactgtcagagaactatgcaggtagtgacattgggctcagacaaacttttgcagctaccttgtgactctaacattggccaggtagccagtgggcatcatatcccatagtggacgtttggatgttctggagtgctttcttattgtctcacaaccttgcctcccttgggctgatgttcacgtgctctttttttttttttttttttattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacatgtgcatgtgtctttatagcagcatgatttatagtcatttgggtatatacccagtaatgggatggctgggtcaaatggtatttctagttctagatccctgaggaatcgccacactgacttccacaatggatgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttaagttcattgtagattctggatattagccctttgtcagatgagtaggttgcgaaaattttctcccattttgtaagttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtcatgcctaggttttcttctagggtttttatggttttaggtctaacgtttaaatctttaatccatcttgaattgatttttgtataaggtgtaaagaagggatccagtttcagcttcctacatatggctagccagttttcccagcaccatttattaaatagggaatcctttccccattgcttgtttttctcaggtttgtcaaagatcagatagttgtaggtatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatgaaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcttctgcaaacagggacaatttgacttcctcttttcctaattggataccctttatttccttctcttgcctaattgccctggccagaacttccaacactatgttgaataggagtggtgagagaggacatccctgtcttgtgccagttttcaaagggaatgcttccagtttttgcccattcagtatgatattggctgtgggtttgtcatagatagctcttattattttgaaatacgtcccatcaatacctaatttcttgagagtttttagcatgaagggttgttgaattttgtcaaaggccttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttggtatcagaatgatgctggcctcataaaatgagttagggaggattccctctttttctattgattggaatagtttcagaaggaatggtaccagttcttccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtcgaggaatttatccatttcttctagattttctagtttatttgcgtagaggtgtttatagtattctctgatggtagtttgtatttctgtaggatcggtggtgatatcccctttatcattttttattgtgtctatttgattcttctctctttttttctttattagtcttactagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagttttttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatgtgtctaatgttgacagtggggtgttaaagtctcccattattaatgcgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcatgtgagatgggtttcctgaatacagcacactgatgggtcttgactgtttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagcacttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatactggcccccactctcttctggcttgtagggtttctgccgagagatccgttgttagtctgatgggcttccctttgagggtaacccgacctttctctctagctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtataccaatcagacgtagatttggtgttttcacatagtcccatatttcttggaggctttgctcatttctttttattcgtttttctctaaacttcccttctcgcttcatttcattcatttcatcttccattgctgataccctttcttccagttgatcgcatcagctcctgaggcttctgcattcttcacgtagttctcaagccttggttttcagctccatcagctcctttaagcacttctctgtattggttattctagttatacattcttctaaatttttttgaaagttttcaacttctttgcctttggtttgaatgtcctcctgtagctcagagtaatttgatcgtctgaagccttcttctctcagctcgtcaaagtcattctccatccagctttgttccgttgctggtgaggaactgcgttcctttggaggaggagagacgctctgcgttttagagtttccagtttttctgttctgttttttccccatctttgtgcttttatctacttttggtctttgatgatgatgatgtacagatgggtttttggtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgccggttctcagatctccagctgtgtgctgggagaaccactgctctcttcaaagctgtcagacagggacatttaagtctgcagaggttactgctgtctttttgtttgtctgtgccctgcccccagaggtggagcctatagtggcaggcaggcctccttgagctgtggtggactccacccagttcgagcttccgggctgctttgtttacctaagcaagcctgggcaatggcaggcgcccctcccccagcctcgctgccgccttgcagtttgatctcagactgctgtgctagcaatcagcgagattccgtgggcgtaggaccctccgagccaggtgtgggatatagtctcgtggtgcgccgtttttaagccggtctgaaaagcgcaatattcgggtgggagtgacccgattttccaggtgcgtccgtcacccctttctttgacttggaaagggaactccctgaccccttgcgcttcccaggtgaggcaatgcctcgccctgcttcggctcacgcacggtgcgtgcacccactggcctgcgcccactgtctgggactccctagtgagatgaacccggtacctcagatggaaatgcggaaatcacccatcttctgcgttgctcacgctgggagctgtagactggagctgttcctattcggccaacttggctcctcctccttttttttttttttttttttttttttttgagacagagtcttgctctgtcctgtcacccaggctagagtgcagtggcgcaatcttgggtcactgcaacctccgcctccctggttcaagcaattctcccagcctcggcctcctgagtacctgggattacaggtgcccgccaccgcgcccagctaatttttgtatttttagtagagacggggtttcaccattttggccagtgtggtctcgaactcctgactttgtggtccacctgcctcggccccctaaagtgctgggattacagatgtgagccaccacacctggcccatgtgcttttcttacagaaagtaaggaacagcaggagacaaaactaataatcttacacgttattagatattggggaaaggtgttggttctacaaaggtttgtcttataattattttgtagctcaaaagtaagttatctttgatgatcctaatggctcacagtgtagtgatgtgactaaaattacattttagttaaaattactagctaaatatgtttatgattggcatttattttgccaaattatgaagttcgaataacatggaatgaattcactgtaaggtatctttttgaatgactacacaacactgaaatgaagaaaaagatatatcatcaaaggccacaattaatagcacagataaatacatgggtatgggatatttgagttcagtacaatctagttgctgtgtggggtacagctactggctttaagagcaatgcagctgctttctgttacagatttgaaagtgattgaggaattttggttcactattgtacatttttatcaccatgaactgggatgcttttcatatttaggattgtgttcttatatcaaatttttcaaatcctatgatacatattttttttacattttaattctgatatcaaggtatacctggcagtcgatgtatatatttaaggcagtaaaagctttttttttttcattgttaagatgttgcatttttgcattttatactcaatgctatcccataatctcaaacaggtcacaaactggcagtctttggcttgaatctgatatagaagcatttttgtttaacctgtagtgtttttttttaaattttgaattagttgtcaatatttttcaaaattgaaagatttcatttgagaatccagatttcttagtaagtcagtagaatttgagcccctagcttgcattcttatatggcagcaattgaccagagtggtgttgtggttgctccttttagaaagggcatttattggctgggcgcagtggctcatgcctgtaatctctgcactttgggaggccaaggcgggtggatcacctgaggtcgggagatcgagaccagcctgaccaccatggagaaaccccatctctactaaaaatacaaaattagccgggcgtggttctgcatgcctgtaatcccagctacttgggaacttgggaggctgaggcaggagaatcgcttgaacccaggagataaaggttgcagtgagccaagatcgtgccattggactccagcctgggcaacaagagcgaaactccatctcaaaaaaaaaaaaaaaaaagaaagggcatttgttctccaggtttgaacagttttgaacagtcctcatcaacatgattcatcgatttatattgacttatcggctcctgtaggcacttgattttgcatattagtctggtcttggctaagccacagcagtaaaaacacaaatacagtagctcaaacaagaaaaagtttacttctgtctgtcatgccagtctggaagtaggcaggccatccagatgaggcaggaagctctgctccatgggaatgtctgggagccggctttctttgattttttgctctaacatcaacctcctctggtgtttttcttagtctatttggtcaaagttggttcaccagtgccctattcacatgtcaggccacaggaagaagaaaagagagaaagtggtagacaaatagttaacctttatgtaaatggcgcagaacttgcatacattccgttgcttaaaacattgtcatgtggccacaactaaatataaaggaggcaggaaaatgtagtcttgagcagtggccatgtctgtgtcttgttaaaacttggttggcagagaggaaggtcgtatcatttaaaagatgaggagtacatataccaatgtcatttagcatactctgccacagtttacatccactgatctagggaatactgtatttgtgatcaaataacacagtggtgatcaaatctagaatcagtaatatgtttatagagtttatgagtgagaaatctgagtctcagaagtttgctgtcaacactcagcagaacagtagtatagtggcaaactttggtccttctctcttcttcattctactacattattacaatttcttaagagttggtacttcatactagtagagttctttgaatgagcaaatgatagaagaaactaacctgcactggcacttacagcccggaagttattctcagcttaaattaggtgctcttcaacgatctgaatcagactagcaaacacgcagcatgcttgctgccttgctcctcttccataactatgtacttttggtgacatccttctttcctgctaacctgagatctcagaattcttcttaaggtagtgcttcaagctgtaagcaatctcctttcagtggaagggagttgcataaaaataaaagttacatgtcatcccagaaatgggtaattatctgaatatttctgcaccctctccctttttttaaatccattcttttgggcatgggggtgagagcgtgtgtagttacagtaagaattccaatgttacccttatttttcccatgatattttctactctctcctaatccctaccacctgcaatccctcagtttcccctgcatttctggcaaaattctagtttttccactactctgctatctttgaaagatgtcaaccaccttaagtatttctgtcttgtgtcttattgcttcatgaacaaaaaatggtgcgaagtgtagaataacaagtttaccttcagtagaggagttataaatctggaaggaatgttaatgtcagtgtatcattggccttcaatgattttctcccttataggcttttatatatgcttttccctttgcctagaacttgccccccacacacaccacctgcctacactctttcctctaatatagttttcctagcacccaggtttctgtatacttcttatttaatgtctttttttttctataaaactgtaaatgaagtggaagcaatgctgtgtctcattgccctttgctctttttctaatacctaccaaagtttctggcccttaaatactacagaatcagcaaatgaatgattgagggggaagatagcagggaagagaggaaacaaaagaaagaagaacccaatcttttggaagccctccttgtttccttcccttgattccgggaaacatgagctctagggcatcaatagctaatagcatacatttctttagcattttacaaactctgtgttctcttttctcttttcaatccccagttacttctttgctaaactcagtttgcctgaggtatatttatacaatcaatgggtatcatacatttgcagtttacattattttattggaaataatcaagagaagttttgagaattggcatagggtcaccaactttttttgtcaaagaaagatggtcttagaccagagaggtctggcttccttgcccgtcgctttagcctataattttaaaactttagtgtggggtctaccttctgcagatatgcctcagaggctgaggatcacagagggtcacattccctcttcagtcaaaagtactctaatcgtaggtctcctttatcagattattaactcagcctgtttccccaggtcttctttgatccttccttccaggatatccaggtcatccagaggtatcatctcccataatcttaaaaccaaacttcttatcgactatgaaaatagcccccacaattactaagaagatcatttcactttatagaagtcattttttttttgctttggataccctcataatggaatttttgtattgtaatatttgattattattataatctagaaagggaaagtgatagagaacagttgcatcatctcagaaaggggcccacattcaccgtgtctgctcttcctaacaaactgttctcaagatgttctcatcaaggagcttcttgtgctatatctttgttaaagagatggagcctgagttctgaggtattctgattatctgaagagattacttaatgacacaatgctatctcaaagaacagaagtagggagattcaagacaattctattccttacagaggtacaaatttctatgctaggaaaacaatacgaaagatacacatggcccataaacataaccattcccattcacaaaatttgtaagtgaaaccaaccagcaacctcatgtgagaatgttcttctatattgattcactgagagaaatgaggaccttaattttcttaagaaatcacccaccttcagaagagtctgaactctgtattgggggtgaattggaattggtctcaaagcttccctttctctaccttcttagcttttcaagagcaattgttatcttactttgttgtccttcataaggaaatctgaagattaggaatccaaaatatttgagcataattacataatagatatgtttatgctctgtactgatgtttgcctgagaaggagcaataagtgaggttagtggtttccaactctaaggactactttgtgtgtgccaattacagggctctgtgcagaaacacctcacatgtacacacacttcaaaagccactatgatttatttttacttgtgcatttatacatccacaaaacatttctttgagtagagcatttcaggtctaaaagaaaagtaagaaaaccactcaggctagagtttgagagcataaggaggcgggaaaggaactggagagtagaagctacagggtatactgctgcagggcatggctagggagaagaagccagagttataaagaagtgtagagccttcacaaaatctgaggttcataaaaatagagacattttagggatgaggatagaggacttggaacatgggcacaatggactgaagccagaaagcgatgacccagagtctgtgctcctagatcagaaaagccaggagaagtctccaaattatatgtacctgggaaagaacacaagctgagattggctatcctgtagatgagcaggtgcaagctggaactgggattaaacaagaggggattttctttgtccacctacccaatgtacaagctgagagaaactgttcaggacttgagctaagaatagaagttccgaggaaataggaagtgagagaaacttaatatatttacaatttaacttcatttttttttaattcaacagatcttcattgagcttatgctatgtgacagatacttttctaggcagtagacattccaaggaaacaaggtccttgttctcatggaactcatgttctaatgggaagagatagacaataaataaccaagtaaataatttaaggaaatgagacaaattgtgagtgttataaagaaaataaatcaaggtgatagaataataagtgactggggtaaggcatgggtgattcaatttggcttgctgaaaccatctctggctgttgtttgtagaatgtgttttaatggaagcagaaagatcagagaaggccacatggtaattcatgtgaaagataacgatggactcagatggcagcaagtcagatagagaaatctgagcagacctaagataatcttgtgtaggtggctctatcattatagggaaacagtttgtgtactttaaactgctcggccaatatgtgcctcagtgatacgtggcggagcttgtctcactgcataacacagctatgacatgataagacaggccctgcaagggaaactgctgacctcactttgtcctttctgggtaccaagtgactaatagtcagaaggtttcactcagttcagtaatctgtgtttaagaaaacaaaagggggcttttaaacatgagatttagtgaatatgacagagaatttttgagatcaactgaactcagtttgtaaaaagagctagattcagccccccaagcatggaataaaccttggaagttatgcaagaagttgtacaaatcttcaggttcttattgataacctgatgaaagccccaaacagtccctatgctggtccaagtttgggtcctcttaggtcccacgttcctcctgctctagcgtcctgctccactgggggctattttttatttccagtgcccagaaatggctgtgtgactatatgtttgcagtctgttggagggaagcaggtctctctgctaacaactgcacactagctgacatgctgcttaaattgagaaatgtttctaagcttttttggtaggaaataatctttcctgcttagtctccctctgtgttcccccagcaaacttcttgtgtagcattattaaatattccccaacatcagtggccaagaatgacacaattctgtgactcctcagtcacttcatgctccacattaagtggagtttcttcctagaatggggaaggcagaacattggtaagagctaggtgtctcagaatctttggaaataaaatccctgatccataggtagttggctcgctaggttacccagatatcaatctgacaggacagttttctgttcctccctgggtcttgattgtcattcattaggaatgaaattaaagtttgaaggacagtagtcaaatggcattcatttgctctcttcctctttggcaaatctaacaaacatcaggctttttccaggcaggaagagcctcatttctaaagagccaatttataaatatcattacctgattctgcaaaatgaagatagtcctaactagagtaactatccatggtgttgggtgttagtaaatatcatctcattggtagtgtgtgattttaaaacccacaaaactgctattatatggattttatctaactgtttaaaaccgatgatcacctttgaaactactgttacgagtactaggacttacaattttttttttaagaaaagctacataaatgttttggtggattcttcttcacgtaaacaatcattgatttgctatctcagagcttcaagaaatctaccttatgactgtcaaaaatgagagctgactctggcctctgttgtaataactaattgctctctcagtcacacacacacaaaattaaatttgggtttaaaaagtatcctggccaatctactttttaagtgttaaaatacatgttgatttgcctgacgtggtggctcatgcttgtattcccagcactttgggactcagaggtggtggatcacctggggtcaggagttcaagaccagcctgaccaacgtagtgaaaccccgtctctactaaatacaaaaaattagccgggcatggtggcacatgcctataatcccagctaaggcaggagaatcacttgaacccaggacgcggaggttgcagtgagccgagattgcaccattgcactccaccctgggcaacaagagcaaaccccgtttaaaaaaaaaaaaaaaaaaaaaaatatatatatatatatatgtataaagtttcttcccaaatcatgacaattatcatcatttcacattttccatatctggaagtatcataataaagaaaattaaaaccttaaggtagaatcacatctcgtacaatggatttagcacggcagtaaccttaagttctgacaccagataaatttggaagtcaggaaagatagtcatgatactaagacatatgttttaatcagttacattggagtagttaccaggtaatggaattcattaaaagaagtggtatattccatgtagctatattaaatactcgagcatcccagaagctagtgatactatatgcttccagttttctgagaaacttgaccagtttagcagactagaagcatcatccaaagttcttgtgcttgctttatatcaaagttctatagtctttaaatacatcggtaaggataaagagactggagcagaatcagtttgctgagtcaacaaagtgcccaagatgattactgttattgttttctcacctcatcaacaaaaagcatcccatatatatatatgtatatatacatatatatggtgtatatatatatgtgtatatatatggtgtgtatatatatatggtatatatatattttccaatatcaattttccaatatcaatctactgagatatatctcagtagattgatattggaaaattcgaactaccattttgtttatagtcagtagtaataccctgctaaaggtcgattgatttatatgctttgggaatacagttaattcaaaacactgcatgcttgtactttggaatagttggtcccatgaggtatgaactcagacatactcgtttacttcaaagtgaaacaaaaattctgattaccttaaatagaaaaaaattgagttgctgagaatatacgtaaaattgtcttttcatttctgttactttagtgattagagttttttaaaaatataatttcaagttttattttagattcagggggtacatgtgtagttttgttacatggatatattgcatggtactgaggtttagaatatgaatgaccccatcactgaggtagtgagcatagtacccaatagttagtgtttcaacccttgctccactctctccctccaccctctattaatcctcagcatctattattgccatctctatgtccttaaatgcccaacatttagctcctacttataaatgagaacatgtggtatttggttttctcttcctgcattaattcacttaggataatgacctccagctgcatccatgttgctgcaaaggacatgatttcattcttttttatggctgcatagtattccagggtgtatatgtaccacattttctttatccagtctaccattgatgattctctaggttgattctacgtttttgctattgtgagtagtgctgtgattaacaaatgagtgcatatgtctttggtagaatgacttattttcttttgggtatatatccaataatgagatttctgggtcaaatggtagttctattttaagttctttgagaaatctccaaactgctttctgtagaggctaaactagtttgcattttcaccacagtgtataagtgttcccttttctctgtagcctcaccagcatctgttcatttttgacttttgataatagccattccaactggtgtgagatggtatttcatcgtggtttagatttatatatctctgatgattagctatgtttaatgttgtctcgtacatttgttgaccacttgtatgttttcttttgagaagtgtctgttcctgtcttttcctactttttaatggggctatttgttttttgcttgttgaattgtttaagtttcttgtagattctggatattagacttttcttggatgcctagtttgggaatgttttctcccattctgtaggttgtctgtttactatgttcatagtttcttttgctgtggcagaagctatttaatttaattaggtcccacttgtcaatatttgtttttgttgcaattccttttgaggacttagtgataaactctttcccaaggctggcatccagaaaggtatttcctattttgttctaggacacttagagtttgaagtcttacatttaaatctttaatccatcttgaggtaatttttgtgtatgatgaaagttaggggtcccattttattcttctgcatatgactagccagttaccctagcaccatttttgaatagggagtcctttccctgttgcttatttttgtcaactttgtcacagatcagatggctgtaggtgtgctgctttacttctgtgttctctatcctgttccattggtctgtgtgtctatttgtgtacccagaccatgctgttttgactactgcagcattatagtataatttgaagtcaggtaatgtgatgcctccagtcttgttcttgttgcttaggattactttggccatttgggctcttttttggttttatatgaattttagaattgttttttctaattctgtgaaaaatgacattggtagtttgataaaaagagtgttgaatctgtatattactttgggcagtatggccatttgatgatactgattcttccagtccataagcatgaaatatttttgtttgtttgcttcctctatgatttctttcagcaatgttttgtagttctccttgtagaaatatttcatctccttagtcagatatactcttagatatttatgtaatgtgtatgtgtgtgtgcctattgcaaatgagattgtgttcttgatttggctctcagcttgaacattattggtaaatagatatgccaccaatttttattcatggattttgtatcctgaaatttttgtgaagttgtttatgagttccaggagccctttggcagagtcttcaggattttctaggtatagaatcatatcattagtgaaaagagagagtttgacttcttttcctatttggatgccttctctttcgttcttttgcctgattgattgatctaggtaggacttccagtactgtgttgaataggagtggggagaatggacgtctttgtcgtgtttctgttctcaaggggaatgcttccacattttgcctatccagtatgatgttggctgtgggtttgttatggatagttcttattattttgaggtatgtttctgcaatgcctagtttactaagggtttttattatgaaaggacattgggttttattgagacttttcccacatctattgagatagcccaatggtatttgtttttaattctgttgatgtggtgaaattgattaggatcttaatgcagattcacagatgaaaaattgttctattgagtagcaaatccatggatagcaatcacagctagatagtcacagcattacagagtatccatgaaaagaactgtttacttagcatttagtaaaagtcatagaataccagtatataaacctctggacttacaaattgataataattttgtacatttttcttaagttcttgcttgatcgaatatttctattttcctattagttttaggtttgattaatggatcactgtaaattcagatgcacctttgcactcacagtgaatatatggatgttccttccacttctaattgttccataaggatgtaaaatattcttaaaactgtgaaaatgttaaagcacattatagcacactttatagcctttctttgtatttaccctgcaaacaagtctttgaagcatagaaatctcacctatccataatcacaattgactgctttactaaattttaaaatgaggtggaatcgtaatgtattttaattgctaataggtaataatggctaataaatagcaattggttcaaacctaacaaaagtgggactccatttcctagtgttcttgccactgtgaacttgaatgaggcatttatatattctgtaaaaggttagtaatacaactattctatagtttacttttgcaaattaagatgtatgtgaagataaaatataaataatttgagttatcagaagaaaactaatatctaaatctatggtatcgtatagtgaaattttacagtaacaggagctatttatggaattaactaaaacctacaggtgtgtgttggtggagctcctgacaacacagcttcataaaaaagaaactgcttgactcaaggagacagataaaaagaagtgtgattatattatatgagtttgtggtcatttttccatgaatagttgagaaaatgactatgaaaaagagatttggtaaagaaatgtattattatggctgagcatggtggctcacgcctgtaatcccagcactttgggaggccaaggcaggcggatcacaatgtcaggagtttcagaccagcctggccaacatagtgaaatcctgtctctactgaaaatacaaaaaattagctgggtgtggtggtgggcgcctgtactcccagctacttgggaggctgaggcatgagaattgcttgaaccatagagatgtaggttgcagtgagctaagacagcaccactgcactccagcccaggcgacagtgtgagactctgtctcaatgaaaagtaaaataaaataaaaaaagaaatgtattattattcagcgaaaaaattagtatatgttattgcttatcaagtgttttgcaactcattctaatcaaggcaaaataactttattgaaaattgaaaattacagtctccataaccaagtggttatacattacttagtactttcaaagtgatacctcattgctctcctttaagctcttattcaaagatatattgactgtctaagaatctgtgcaggtcatttctttaaatacttagaaaaggatttttattttactaaggttatctattaccaaaaattaatattgaaatgaaaataaattttaagtaccatgatgaatatttagagctactccaacagtttagtgctatttttttcttgcaggcttgtacagcatatgtggattttatgatttctgtggccagattgattcgtcaggaagaaagattgcccatcgatgaaaaccagcttgctttggaaatgaataaagttatggaattggaaaaagaaattgccaatgtaaaacacatttttttttctgatacactgaataatgtcaaccgctttttttctttcccctctctatcatactttaagagtaaaaggtacagcactttaaccaagtagtaaaaatgcatggcttggtaatagatcattgacttcaaaaggacctttgaaactaaagaattttatagtaaactgggttcctgacatttaaaagacacactaaattggacaaatattaaactagaaacacttaattgccttttataagtggattccatcagaattctaccatttacagtcaaactgttgttagatgcccttcagactcagagcaaatgcaaagctgttttagttttgatatgtatagaatattactttattttaaagtttaaagtgatcacagagattgtctctatttctttgctaagaagtattaacccctgaacatagccatgtggcaatgtgatactactgagttcaaattgtcaggctgctgagctgacggagggtaagacaataattttgcaacaaagcccaaggagtgtattcctgaatttcttctggctctagatcaacccttggagtctgagttggcactttcttccctgatgattctttgatagggcactgcagtctcaagtgagtgaactctgagtctaagcagcatccaggttattgattaaacccatcgtcagagtcagtctaggacccacagagttctctttgtcattgcaaacgacaacctgcatccctgactccctatctgcttgcccctgccatctaagctcatcagaatcttgaagagttaagatcatggagggcaattttagctttcctggggctacgtgaaaccaaaaatctcctatcagaaccagggtgttcttggagctgccactgaatgaatggcatttgaatgggttacatgtggttctgtgttggaaacagacttgctagaggagaaatgtttcctgctctgggtttttgccacttgcaccttcccagaccatgcgctcctttgaccagcatcagctctgtagtgttgtgtcttacctcagcattatgtgtctatattctcactcttgtattagattcttgtattagattggcatgaggccttagacgtctttgaatcatttatgcatctctaacaaaatccagcatagtattgcacaaaggacatgctcaataaataattgttttcagtaaatgaataggtaagtgacctaaaggggaaactggagccattgtcactgagaaataattccaattttaaacctttaccttttgtctcttctcacttaaaattgcttttactcatttcagccactagttggggagttgttattgcaatttttctttttaattcagtgaaagaaataaaattggatgctgctggtctggcaggataggagaacagtcacaaaggtccatgatgttgccattctcagataacttgcaaccaaattgtgctctgtactaggaagtttctctgttacttgcgataaattcttatagaaactcttgcacctttttttccttgctgaattttaactaggacaccgaatggtaatggtgaagatgggagagagagtatttaagagagaaattggagatgactatatcaaagaaagttaaaatatgaaacattcacagacacaactgaactggccattagccatagctcataaatattgcttatatggcttggcagttgtcaaaatatagacagattttttaaaaattttaaacttgaccccacagccaaatctcaataattcttactacttctactccaaaaatctcttacatttcactttttttgaaatgacaaaacaaattacaaaaacaagtacagaataggacttaaattatgttgtacctatcctatatttttaccctcatatgtagttatatttttctaaagaattcttaattctaaaataatgattaaaaattaaatccataggctacggctaaacctgaagatcgaaatgatccaatgcttctgtataacaagatgacattggcccagatccaaaataacttttcactagagatcaatgggaaggtaagtggtaagttttttgtgctctcttattgtgccgttttctaaattataacattgaaatactctttctaaaattcgtcaagtttttatttattgaagtaaatgggacttcaattccttttttttttttttttttttttttgagacagggtctcactctgttgcccaggctggagtacagtgacacaatcttggctcactgtaacgtccacctcccaggctcaagcgattctcctgcctcagcctcccaagtagctgggactacaggcatgcaccaccacacctggctaattcttgtatttttagtagagatgaggtttggccaatctggtctcgaacccctgagctcgagtgatctgccggccacagcctcccaaagtgttagccacaggtgtgagccaccactcttagctggtaaaattccttttaaggcagctatacaataatactagaaactcccataggaaggggtttgaaaaatactaaaactgaaaatctttctgagaggccattatgtagtcatcagacttggacagtcacacaataaaagcactagatttccttttaactccaaaaaaggataatttattcatagaacttcccatgtgctcatcaaggccatctacagaggtgttcagaacaataattcagaaataggacacaaataaaaagaaaagctctctcatagattccatttataaacagcagttgacttctttttccttacctagtatccaataatctctttttgtggctatgcatttattctcgtgtattagttgatgcacacagccaagagatgaagcaatatccatgggaaaacctacaaactaccacattcagcgatgacattctctttggcactaattctagttaacaaggacttttccaaaggcataaactattgagttagacatcttacatagaattttttaatataataagtgtttaataaatacgttttgaaagaatgacctaaaccaccaaaggaaatgaagaaaattgtatagcatagcaccctatactcagtaagtgatgtgtgcttgtgtctgtgtgtgtaaaatacaacctaagatattgatagtcttaaacattatcaattcccatttagaaagacaagatttcatcttttggcaactccgtacttagcttctgaagtataaacatggcatgcctgtagacccaatatcgataattgaaaagatgctgttttctttgacttcataacatcactgtaccactgctataacagtatattttcatctataataggatttccactgagatgtgttactgtgtttgaatgaattgtttattaatacccacttttaaaagctaaacactttacacacatttccatttttgcataaaccaaaaaagctttatttttaaatttaaatttaaattatatttttattttctgtattggttagacaaagaagatgacattaagcctaatttctaggtatatgttccttaagcttaaaggctttgttttcgctcttaaatggttggcttaattatgctaggtaaataatcatgttgcagaactagtttttatttaaaaactgattgaaacaattgaggaagaatcccaagtgaatatcaaactgatccaaccctctaactataactgaatcttggacccaagaagagaaatccacaatttctgaatgtttcatgcctgcttttttccagccattcagctggttgaatttcacaaatgaaatcatgtcaactgtgaatattagtattacaaatgaggaagatgtggttgtttatgctccagaatatttaaccaaacttaagcccattcttaccaaatattctgccaggtaggtatgtcacagtccccatgtcctcaaagtttgcatttcatatcactcttcagaagctttgcagcctcatcttttctgttgctgggcggtggttttttttatacagagatcttcaaaatttaatgtcctggagattcataatggatcttgtaagcagcctcagccgaacctacaaggagtccagaaatgctttccgcaaggtgaagaaaaaatctctcttttcttaagacttaaagcataaagtgatacatggttatgaaggcttaccatgtacactgctaggacatggtgaactttgcaaagggacaaaatgccaaagttcgttatcttgcacatatttaggacatgttgctgaggaagataaatcttcatgggctttaccatcttatgatggtctatgtggcacgatgattgcattgtcctgtaaggagttacatttggttatttaaccagttcatgaaagaatactgtctggattttttgttgttgttactgtgttaaaagtaatttcggggttatctattttaattaatttgattttcaggtgctcattgcacactggacatatacacagatggacaatattgatgtgggcagtctattgaaagtacccctacctggagttaaataagaccttttcttagcctatacctatattatttaaacaatcactgttttggtactatggtgaggggagtaggcagtagggattgaggaaggagagactccagcaaacatgttagttggagtcttggaaagaaaataacgtggactgattaaaatttctagtttttatccttaaaaagaaaatgtagacatctttttaaaattaaagaatgcaaaaatgtattgtgctaaatctcccttacttaggttatcctgttattcttaaatttatacacatacaggttctgtaagtactcagagttcagctaaaaccttgaaaagcagtaatgtgttttctcatataccatatttcccccattacatttattgaatatgacttcacatttatgtttgtgcagtggttacagtgttgtatgtttttctaacgctttctacaatgatattaagttgtaatagcaaaaagttctactggggcatctactgaaaatatgcctagttttcagatcatatataagtaaacaatccatttggattacatttcatcataggctaggaacatgggccttgtgaggagaagtgatgaatatttcaagaacttagatgagacatttgtgaaatgtgtgctcttaacatgctccagacctttccttctggtcaaatgccatttcctttttcttttccgtaggccctttatggtacaacctcagaaacagcaacttggagacgttgtgcaaactatgtcaatgggaatatggaaaatgctgtggggaggctttatgtggaagcagcatttgctggagagagtaaacatgtggtaatgttttcagaataatacactgtcagttatacaggacactatcagtttgttcacactgatgagcaattacagttctccatcatttggctaaaattttattaatttaggcagagaacctctgaatcataatatgccattgtttcccaataaatcttcccttgccttccccaagagtctagttatgtttctgctcctaatactgtctagtctgaaaccaactcaccattttccagaagcagtgtatttggagtacccagtaacatgttctattgatatagtcatttataaactcttctattatcaaaattgcccccaaattagtattttcttaaaaacatagaaagtaaaacaggatttatttggagtataagaaatgtgctttatttttcattgttaggaaaatgaagacagtggaacttaatggtatggtgaaagaatttattgaaatgctactttatgcttagctaaaccactaatggtaatgacagccctaatattttacattagttcttccagtatgatagtgaaaccattatattctgaaaatgatttttaccttaatgcatatattaagacctatttaatcaagagtgtcgataatagcaatattgcttttaaaatataatggtcccatatatctgttagcttaggtcacagtttgtctataaatttacgtttattaacatattaagtcatacaaagatagcatgtagctctatttttaaaaatctgtgttacaaagaatgaattaatgacctatatttgtcttctgttctgatttgaggtcgaggatttgattgcacagatccgagaagtttttattcagactttagatgacctcacttggatggatgccgagacaaaaaagagagctgaagaaaaggtaaagagcagacagctaactagcaaagaaaaatctttgctagtataggaaaaattaactttaaaaacatttagaaaaaaatataatcaaagattgcataaaaacttgtaagctccttcaatatgtagtgtttccagaaagagtttttgtggataaagatatatttctacaattttaatcttttatctctgcaaccaatactctagcaaggtgaaaatattaagtttctgttcaagcaaatgtaaggtggtgcactattggtgcattataagatctataattaaagagatgttgaagaagcttttttataactattcatgcccacccataatgtgcagcttttattgagacttttactgagtttcataagaataggtctaagatttctcaggaaatcttaggtttaaatttactgtgatcatttgtctttataattatataataactagggggaacatgtcctgtgaaaactgttaacatgctttatgagcaacattcacatgcatcctgactaatctctgtagttaggttggcagaaaaagcagacgatttggattgatagaggagacaataataaatgtattttaataagataatcaaccttggtctagttttcttttagaattaaatcacatggaaggactatcttttttcagctctcaaagagccctgagtgggttaggcctagaacctctgcccccagtattgctatctttccatcactctggccagctcttcagacattcaggttggatttgctcctttcatgtcacagctgtgcatgacatggctctgcttggtaaagccagttggattgttctggatcggcatttccaaagtggtgtcacaaaatactggacatgcaagttattccacaagaggctcatggtcaaaagagtttggtgaacacttcttgtaggaaggcttccctcatctcaccctaggctgggttacatgctcctagggtgtgattttattatcatacgtgggagttaatatttatttcactgcttatcattgctgtttacaataagctctttatggttgggggcaggggggcagaaaatactgcctagcattatatcctcagccctttataacatacctggcccttggtagacccttgaaatatattgagtgagtaaattgataaattaatttcccatcctggacatttataataacttatgattctaaccttataatctaacccatttttaattgtaagaagtcctgcaataaagaaacttgcttaatgtttttgcgacagcatttacccgaagtaattcacaataatttttttgtgtgtttactaccttatactttctgtagaatttgtatcctttagaacactctttaaggaaatgtcttacagtaaataaagtatcattaagtgggggctggattgtcatgactgatggcaaacctacaagaaaatgggtttggcctcagtgacttcagtgatacatatgaggcctgatccactgactggggaaatcctgggctcatgtgacagatttgtaataaaactgcatccatttgatgggaaaccatgtaactcagagatacaggctaaaccccccatgaaaaatttaaattaattaaattatttaagagtgatacgaagtggtaaaatcaaaagtcaagtatcattgagaaaatcaagagagaaataaaataaaaatagaaataacaagtagtaaacaagtgataatgaaataataaaataagtaaaataaaccattttaaaataattaaaaatgaactttagaagtagtgataaataggccaggtgcagtggctcactggtgtaatcccagcactttgggaggccaaggcaggcagattgcttgagcccaggagtttgagactagcctgagcaacgtggtgaaatgctgtctctacaaaaaatacaaaaattatctgggcatggtggtgcatgcctgtagtcccagctatttgggaggctgaaatgggaagatcacttgagcccaggaggtggagattgcagtgagccctgattgtgccactgcacttcagcctgggcaacagagcaagaccttgtctcaaaagaaaaaaaaaaaagatagtagtaaatacataataaatatgagctggaataacaaggaaaaccccgttttccacttaactaattaatgtcatttattgaacttgagaagataggtacactgactttggagaataaaggagaacataaaaactccaggaaccaatatttaggactagtattagcagtaaacctataagcccatatctgttttctcagtcaaatcaatgaggcagaaaggtaattataacctgctggaatggaagctgtaaatattacttcttctaaaaaattgaaaaaaaaagctttgagagaaaaagttcataaaagtacaaaatatgtggaacaatgagttttgtcagtttttatgttggttttcttgagaaagctgcagcctataaggataaggcattagaaactcaatttcagacctgattttcatttattcttgaacctcccaggaaagagccattgcaaagatctctgtttaagtatgtcagacactcattttatgaacagtatggatcaagttattcaattgctagtcatgggcagattataaatttgtatctgaaagttatataatcatcttcacattcaatattataattttcataggccttagcaattaaagaaaggatcggctatcctgatgacattgtttcaaatgataacaaactgaataatgagtacctcgaggtaagtctctataaaatagactctggactactgatacttagggctggtagtagtgtcatttttagctatggggtgcctgaaattatatgaagtagcctgaaaccacaggttgtattatataaagccttcaacgctggtgccagaatgatatttgttttagcctttttgttttcattagccaggactatatttggttattgttcatttggtttccatatattccattttaagaaccgtaagtaaaatctggtgtcctttaaagagtatcaaggaagggatagacatcaaggtggtgaacaacaggcaggcttcttatcacattttacacaggcttcgagtttccctccaccttctaagttttcctctactggaaaaaccaattcatgcctactgtattttaaaaacaaaacaaaacaaaccctgatatttgagaactgaaaactattttgttctgccctggtaatgtaacagttaaaagagcagagagttgcttaaagtcactgcagtgctgatttcagactcaactgaaagtcttgctgctaactctgcagtcaccacaactacatgataccctgatgacagcgaggtgatccttgcccaggtcctgggatgacagtgattcctcattcattgattactagtctagcatggggatttgcaaaccatactgccttcttctctctttccatttgcagaagaaacttgactttttcttttaaatgagctggttatagcttgcaagacccaggggtccttatagcaggagcatagtggctacgaacacagactcaaaaccaagttccttgattccagatcccagttccaccactcatttaaacttggtcgagtgactaaactatatctcagtttccttgactttaaaatggggataggagcccttagttcatcggtattaaatgaacataatattagattctattagtataatagaattaaatgagtataatgtaaaatttaaagtacttagaatagtacttggcacatggtaagtactaaagaagaatgtgctattatccacatgtgttatgtgaagattaatgtcattaatgtgaggtttgtttgacacttggtttcatttgattattataaaataatacactgaatttgtgatttggctggaatactgacctgtgatatactaatagaattaggttaactggaactacatccttttttggtaagttttttaatgctctcttttaactttattgactgatataatttaagaaaatccctatgtttttagcaaaaatttagaagataccggttttaatatttcttcccaaatcttctttataatacagttgaactacaaagaagatgaatacttcgagaacataattcaaaatttgaaattcagccaaagtaaacaactgaagaagctccgagaaaaggtggacaaagatgagtgcgtatattctcatttctaatgtgatcatctagaagcaggtctttccctcctttctttgttggattaagtgaaagagcctcagttagaaaaatattaaaaagtacaaagtcctctttttattgagaacttctaaaagcatctaattatggtatactaaagatatggatcaagactttaaccagattaaaatacctttctcattaaggtatcctcaaatttacatgtctttagtttcgtcttatgtcattgcctatcagctcaatttatttgtgaacaagattctcaaaaaccttagcttaagtaagccaattcatagctcctttaagccttctcttaggccttactctgtgtccagaattttcttctgctgacagccccaccttttttctatcagtcaatcccacaactccatccccttcatagatagttaatgtaagacttttctaaccctgtggtagtcaaataggagatactaggaaccattcttattcacagtcttcttatgctcttaatctctgcttattagtgacattagtatttcctaataactattagtttagattttattttttctattaaatagatataactaacatatttatcagcatatgtgtttatgcaccgaaattcctagaaccacttatgttgactttttctccctaggctcttagcccctagacaacaggggctattccttttgaccataaagtctcagcatctagcatactgaagaatctcagttaaaacaaaattaatgagtgagtgagcaagtgaaaaataaatatactaacttgatttgtgtggtaactaacacagtaacatgccaaagaggtgcttgtttcattcatgcattcatttatcctttcatgcatttattaacattttggaacacgaagtccaggtgtcattgggtactgggagaatcaaaggtgaactttgattacattacaagagcagaaggtagacaagacatggtgtaataaactgcaccaccaagagggaaatgtcgtgccaagcaaagtacaaagtgctgtgggcttatttgatgataagactgttctgttctcagtaaaccaagtacaggttggacaaaactgctaatggaaatgccagtgcattttaatccttactcaacatgttgaactcttgcaacactgacgtgtcctgaaagagagagcaactcttttgctgacttctaagttcatattggaacaaatattgtgttatctgatgctaaaaatgggattgcaaatattatagaatgtttagtgtcccatctgggaaagaaagagagtgaatacacatgcttggcattataatcaagttaccatatcctgtctcttgaaacacacaaaaagttatgcaaaataattatctgggtgaatttatgatctgagaaatttcttataagtctgtatatttgtatttctttaaaaatagacatactaagatttaataattgttagcactataaaatatctatagacaaatactgtcaaatattatttctgaaatggccaaattaaccagtacccataggacatcaggaaatttcttcataattctagaaatagttgttgaattattgcttgatgttttcttttgaggttaacgtagtgccagtttcataatcattttgtcatataatttacactgttcattccctttcatcatatgggctgattttctctgcattcttctctttttaagatagataatcaaaagccaaaagtgtatacaatattttaatgaatgaatggtcaatagcacacatgcttcagtagtactttttggtcctccccatgagcttctgatgatcacaaatgcaatatgaattctaaggtcttctctgctatatggagccagctttcctttctttcctatagtctgcctgtataccagatacaaaggttcaaaactctagctgcacatgataatcacctggggaacattttaaaaaacactgattccccagctcaagcaccctagaatgtgatgtaattgttctgtagctggaacccagatactggtattctttttaagtaccacccaccaagtgagaacccctgagttagtgttatttcccttttgtgtgatatcgttcctgttcatattcaattttatggaatttttcacaagatgatgcctttaatttggcaatttaggtttaaaatttatttttatcttccaaaataatcagaaaccctctgacagtaattgcatcaaatcattaagactgagccctataggatacaacatgatcgaagctcctctcattttattaaggtttcttgcagggaaagttactgacttattttgaacctgcttaatagtaataaagttggctggacatggtggctcaggcctgtaatcgcgccactgcagtccagcctgggcgacagagcaagaatccgtctaaaaaaaaaaatgtaataaagtcattactcttttttcttttctctttttgtggagcaccaagttcaagtccttgctgtgtatgtttagacagataatttctgttgcttctacttgtccacatagcccgtagttacatcttagagaattacattttcagatgctcaagatcctcactcccaaagtcttgaaagagaaatatgtgtgcatacccaaaactgaagggacagagttgagacttttgtagggttgtattgtagggcacttcagagaaatgatgatgcattaaattttcaagacagcaactaatgtaaatgaattcaattagccaaatagtaaacttctagacacttttttcccccaattcacatgctctcactgggcaaactcattttacttctcgacatcttctatcatcatcatgtcagctgaatatttgtatttgactcagatccatttactaagattcaaatccaaatgtctacatgcttatgaaacatctccatgtagatgtcttattgaccctaaaaacacagcatttgtcatttaggcaaaaaataatatctgcccattttctaaaaacctccattttactgctaccaagacagaaaccaaggactcattttaatcatcctagacttatccctttctgttattcctgacatctacagtgatagttaattcaaatctccattttaaaaaaaaagtctgcatccaccagctgctatttaaatattacgtaggaatgggaagaggggatctctagctcaccattcccatggtcacttctgtaattcagacatttctcactgttcattgactcatctcaattattatcctactttttttaccaaccaccttctatatcttcagtttatcctccacactactaccttagagatttttttgaagacacaaattggcattttatttcctgatgaaaacacttcagtgtatccctgttgcctgtctcatgatgtgtgactgttttgaagagaaccaaggctcttcataccccacactagcactccagagttccttcacattcaccctacacctcaccattgtccaaagctccaaccatatgaattacttccaaatcctttctctgtctttcttacatccttgtctcttaccctggaccaccctttatgccctggttcatctaacagaaacctacacatgatttgattaaactttaagtgtcacctccttcctcacagcaccccattgcatatttctcttcaccttgggctgttctacactttgcacattttggtcaaagtaccagtacattttactacgtttagttggactagcccctattgaaagcaaaaaccagatatttgtgtcaccagagcttaaacactaatgaacagaatgtagctctttatgaatgtttatgggaagaataaatgataaaattgccaatttgtaataatgataataaaactaactcagctgctaaaataaaaatggtcacatctggctgggcccagtggctcacgcctataatcctagcactttgggaggtcaaggtgggcggatcacttgaggtcaggagtttgagaccagcctgggcaacatggtgaaacctcgtctctactgaaaatacaaaaattagccaggcatggtgccatgcagctgtaatgccagctactcaggaggctgaggcaagaaaatcacttgaacccaggaggtggaggttgcagtgagccaatattttaccactgcactccagcctgagcgacagagagacactccgtctcaaagaaaaaaaaaaaatggtcacatccaaacatttcactatcatggctggggaagatacacaacatcatctttaacaaattcaagaaattgaggaagtcaggaagtctgcatgtgagacacccaagttaataatttagctaaaagggcctccctctgctcttatgagtggctggcacctgcaaaggacagggatttacttttttttttttttttaagacggagtctcactctgtcacccaggttggagtgcagtgacaccatctcggctcccacctcccaggttcaagcgattctcctgccccagcctcccgagtagctggaattacaggtgtgcaccaccatgcccagctaatttttgtagttttagtagagacggggcttcaccatgttggccaggctggtctcgaactcctgacctcaggtgatccacccaccttggccttctaaagcgatttaaattttaaaagctcttgattcatgtggtttctgatgcctagtatgtgtttccaaaatcatctcaaacattatgtcttttaaggattttgcgccagtttgtaaagaattttaaacatgtcattataacatagaaatagtgctgaatcgggaatataataccctttggttacttaacaatatttctaaaatatttacttctagtaacatgaattttcatttagagttcatagagcaaacatgaatctctaaagaaaaagatgtacaagaacaaaacaaaatgagtctcttgtttttagacttgatgttattttgttagtttctcaggacagaacttcctgtgatataattgtgatgggtgttgctagtgtttgtgaatcataactgttgagccctggagttaactttttataaagtacaaagaggaatctcattggtgcatctctcttgctgttctgcatcaaaatgaaagcatactgacattgacaggagccaagtcaataaacatttattgagcagctagcttgtgcagagcactgtgctaaacaaaatagatgacaaagaggagaacaagatgttgccctttactcgggaggctatgatcttaaggggcagatgattaaaaattaaatctgatgaaaggcggggtttggttgctgctattaccaggaaacaaagtgctagaacagcacttttttcaaaccacaaagctttacttattagtaaaacacaatttttcaaaccacaattaaacctttacttattagtaaaacattctctggaatcaatatgtcagcatttaaattaatattgaggtgagcagaggattcacaaaaaacaaaacaaaaatgattggctcatttctgtctgccccttggttgcttcaagcatggtgttttttttctaatctggtgcaattggatggtggcacacctctgaaataagtggaacccctaaagctggcagctcaacatctgtgactccgtggtgcatatagaaagttcctgaaaggccagcaccaccaaaaatggcagagcagttggcaccctgggaagtgacactgtagttttgccactgcaatgagtgcctaatactcttttagtgttccagttctgccattcacaacctgtggccttttaaaagccctgtggtttccttatttataaaatgagtaggctgtgctagactgtagaatgtgtctgaggttctttctggcactaaaattctgtggaccttactgtgaagttttcataagagccaggaagttttcctccttggcttctccgcatcaaatgacccaagagaaaaaaacacattcttgagtggcagagaagtacctcgcttctttctaaaatatcccttctgatttttccacttcactaatgtttctagaaccaaccttctttctaactaagttctgtatagttcaacttgagtatcaaaggaaaaataattatgcagaaattatatgggtaaatatgatggcccagcagtggaaagttgatagtctctcgagggtgggcaggcggagcaccggacacttgagacaaatgactctccataaatgtagacggagatgatttgtaaaaaggactatttgactcagcaagtattagccagaaagaagagatacactaaacttgaacaaatcagtttaatttcccaaggcagtatctgccatggcatcctcatgttttgcacatgttgtaacagatgaaaattttagatttttacgttttatgcttccattaagccaacagagtctttgcagattttcattgtgttttggggttgttagcaaaatgtgttctattggcaaaaagatttctgctttttagtcagcatttgatgagggattctgttttgtttcgttttgttttgttttccagagggggaaggggaattagaaaaggaagccgaataatttaaaggctgaaattttaggtagttcttttttaaaaacaaaacgaaacaaaaatatcatcttcaaacaacacaattaaaaggtcctaaacttccatttaaactgaaagaactttgcaaaagaattctgatacatttatttcagtgtcatctcttgaaaggacaacattcaacggtgcacagtttctgacagccaccactctctatgacgtgcatagcaatggtgccctctgccctcctagagtcacaggatgaaatgggtcagcactctgggagcttggaggacccaatgctataccaaggcccaaatagccaagtgcctactatgctcccaccactggtcttagccttaggattcaattaagaacaaaacatggaatattcttgccttcatggaattaccttctaatgagctaggtagacaatagtcttatgtcaagttatgtaagtactgagggttatacagtatggaacaggtttcagttctttcctggaagttctcagaattactttaaatcaggagaaaagtcaccaaagaaaattctgacagaaatgatccacccacccaagtgtctccaaaattaggaatctctccgaaataaagcataccaagtgtgtatgcacatatatgtgcatgtacacatatataaggttagcaaagactaaaaagattgtgccttgttgccaaacagaactacacacaaacaactggtaacatctaggaaaacagtagtaattttccattaccttttgttgaaagagaagtggcttctcccagtttagtgtcaaaatcagagtcctagcctcagacagattcaggtaagtcacccagagtacttcagttatgttaacaaccatatgcaacaatagaagttctttggtcctactgtgcttttgcctttgggtaaaaagttacacttatggatcattgggaagagcctgtgctgtggagtcagggggtgaggggagtagacctgagtcagaattcctgctttgcctcctaacctctgaacctagaatttttcctttataatctggtgataatgacttcacttttgtcctgcatggttgtgttctacgttgtataatgcacctagaacataacttaggtgctcattaaatagtaaccagtgtgacacagtagtaagaaatggtcatcttcatttttaaagaggatggcaagaaaatggcattaatccctgtaatgaaattttgtgtatggtgcagatcaacagcttaggagtaggagatttgattggaaggtgagcaggttcctattcttcttagtttaaatataattttcccagttatataacgtagtttgtaggtgtattaggaaagagattaataaccatattgtgcctcagtttctatacctgcaaatatatggatggtttgaaagatgaataaaagtatacagaaaacttcgaagtcttgatgagagaatattgataattgtaaaggattagagtgattattgtgattacaaggtaagaattctttccacccaggcgactggaggaagacacagaaaatctatcgtattgcactgctgatttcaaaggagttgctttgagactactaaatgctgagaaattgaacactggcagtaccggctcactaacaattttgttgttttcagtttttaagttacacaagagtgggtgaaaaaaatttattctaggtgcttttgcaatctagtgggcttataatacccaaaaggctataggatcagtctgttgtcttctgcttttcttcccagctataaaaattatttctgcacactttcatcagcactaagcttcttcagggcaataagagatagaagagaaacacctggttcctctgtcaggtatatttcagttctattccccacccacattgttagctcagctttgagggccatactgcttctagtggcccctctttgttttactgccaaatgcccccaaacgagaataagcttacctgacaaaattacatctcataaattaaaaataaggtttcttccttcctgcttccccactcttcactttataccacatacatgcccacatttgtatgcatacagaccaccagaggaaggatgagaaatggaagaacagtggttcatctctaaagtctgatactgctctgtggaggctgttagtgtttggcctccacactttaaaggtatcttcaggtaacctacactatctattattttaggggcaagaatcaccaccatttcactttctctttgtgaattttctcttctctgtgctgccagtcagcatcaaatttggactgcattccaaccaaaagaacttacagtttttgttacatcactgtttagttggccctgttaatttagtttttatattaacattgagatattttgtgattgatcacaaatattagacattcagtctatagttgttatcatcaccttatttaagatgtaatgatctaatcacagtacttccagaggttctgattattaccagggacaaaatgtcctgtgcttttggtaattcccagactggtttgagggcacatcaagaaagatctcaaagaagaaaaggcaaatactacacactagtgctgtgtaaacccaaccaccataattctaattttatttgaatgtttggtggtcataaatagctacctattttctttaaggtataattcacagtggacattttaatatgcaaaactctccctgctggaaatttgcaaacataaatcaaaatgcagtcttaaagccctcaatgtaatgtaacagaagagcagaaaagcactaaaacaaaaggtatgacatttatttttacaaaagcaatagacacaagatggataatatataaacttcattcgtgtcctacttttgtgatctattgttatctgaaacattaatttcatatatcctgttcctctcctctgtaatcacagtttaaaaacaacttggattggcaccttttctatttcaatattaggatttttgactagtccagagccaaaaaatatgcaactgttatttgtaattacctgtaaaacccatgtagaattcactgtcactaaaccagaaagttcgcaattgagaaactgaaccctaaaaccactgggacctagatacctgttaaattaacttttatagcagttaaaactttaataactataagctgtttacctaaaaaatttgctgccacgtttgctatgaaaatgtcgaggacacatcagaattacctttcagaagtcatgcaaggaacaatgtttccccctaggagtagtaagagcacattttccattttgactttcttgccagacagcttggaatcgtatctgaacctgaattatagtaactgtctgaatatatataaacatagtcataatatatttcctaatcatgatttttgtttattttcttttataatacttcgtagtcacgtcaacgcaatctatttgttctacatcgtttctgatctctcaattttagtctaatatccctgggtttacacatacatgtttttcttgtgagtcaacacaaattatgtgggaagcaaatagagtttaattaaaataaataaaattatattgttgtaatcatcaacctgcaagaaatactaaaatactgatgactcggctgtaatgaaattaaggaggactgatattatcagtccccccccatcctgtttaaaaatgctttctcgatttaaaacaacagcagtaacaaactaaggaagaaacatgttgatcaatcattcttccccatctccaagctttttttcttcctaaagaaaaattaacagaaatgttaactaaatttttttaagtcccaaatcctttatataaaaagtcttgataagttgttgtagacaaaacccattcttagaatttatcagtcagttgttatatattgccctgtgctagttatttttaagagatcaaaataaaattcacttctgacagcccaaaatagttactgacattgtaactaaagcaacattgtaactaaagcctactttgtacagctcacctggcagagcagggtctagaaacagttctgatgtaacctaattgtgctaattactgtacaccccttctgtgagtaggataattgtcatactaacagttgccatgaaagtagaacaactgcagtgaagccattagatgatgatctctgactaccttaaatgtatgcatgtatgctgacatttaagaggttatctgaagtcaagcagtatccatttttccaatgagcaagtaacgatatatgtagtagtctactaagatgagaactttagtcctgttgcgcaaaatttctgaacacatgattattaatatgcagtcttcataacatctgagcagagagacatgggaactttggctcctatcctcatccctcaaattatcatctgggagccatttttttccattttttcattcagcctatagttatttatgcatttttctcatctcctcaactaaactagagtctcctgaagtcaggaactgtattttataaaatctctgggttctatacagagccttagacatggtatagacagacagacagaccgacaaatctacttaagaatgacctgggtttcattttaaagtcatacaaaaatatatctttgctcaattagctggaatgttgtattttttgaaaacacttttaaatggcaataatcagagacatattactctaagacaactacttgagatatcttagttcccaaaaaggttctttgtaaaccaggaattaactatttttaatatacttggatctgaagttttaatgacccacacttcagtattctgtcaactgctccagaatcgttgtcatagttacctagtatcaggaacataaagctaaataaatttcaatacaatcttaacccattgcaatttctgaagtgatacattttaataggttttgcaacatcagaggcctccataaaaatccatgcaaataaaataaaagattacagacttgaatatatgctgatgtttttcaagaaatagaaatgctttcaaatgagctctcacctagtgaactaattttaatttgttgatcatgtttcaaacagaaagttaagattcatctaggaatggtaataatgctttaattgtgtgagtgggttgaatcagataatgcagtatcatttgtaaagagttcttatgttttctacaggtggataagtggagcagctgtagtcaatgcattttactcttcaggaagaaatcagataggtaaggtgtattcttaaataattatttaatatttctctatcgttcccaacctgtagtgcattgtatgaccaattacaatacctctaaacaagcacagctgaggctgagttattgctctattgaatgcatttcttgaaagtaaatgcatccgtgtaccttctttcactatagtgggaaaattcagattggtacaaatcacgttaagtagttttgtttcttttacaatattcttatttatatctaaaatggtttatcttatttctaaatatttttattttatttctaagtaccttttttaaagtcccttgaatatatctatataaagtcatattgactttaagactcattaagcattagcttcttaaagtggtttaaggtttcaagagccaacttttcacagatccagtcctcctggcaattctgtatgctggctctgtgagagatgatcctattctatgtcatcttcattcaggaaggctccaaggggtttagaaagttggaatctcaattatattcgattgaatcgtatgaaattgtatttacctagccacaattgatcaaaaaagaaaaaatttcgtaagttcgcttatagtattattacagacatatatatacattaacacatgaataagttatcatatatgatgaataactgaatgacataatatgacaaaaatattttcttcttcttgggaaggcctggacatctttgaacatacattggctcacatatatcacttatcacatacattggctcattttttttcagggggtttttagcattagaaaggtactcaactgattcagtactgccagaaatattctaaacaaatagtagagcaagcttctgcaggtgcactcagttctccaggtacactcagtcctgcccttcatttctaaacgtggtctagaattaagagagatgataatctcagcattattctaaaccattcttcttatagctcagagtctgttgtaagcctcatttttattgaattctattaccaattagattagaaattataaaaaatcttacaagatatttatcattggctaaaaaaaaactaaccttaaaataaattgtatatttttaggttaaagtttgattatacctttccccgttgctttcaagtctaaaaagagttaggttaagaagttatctacagtttcttctagtatttttatgatttctatttttggagtaaaacctgaatccatctggaatttacgttggtacatgacctgaaactgaattatataaagtaaccagaaaagactgttttgtataacatataaataataagtaagatatgtttacttggcttaaaattacttagctcaaagtctaagctaatgctttctggctagggaaatgattacccaaacccataccagaacgtgcttaataatcaactcctcagaacctttgcagtcagtcctttataatatattatttgaaaccattcaaatcttgttttaaaatgcctttatctctagagagtcttcactttgaagccctctttttaatattcagtagttctgtcagtgtctagttcatttggtactgagacaaacgtaataattaactttcaatggaatcccaagtcaaagcaaggcaacttagactccttagtgctgcattagagcagaataagggatgcagcttcatttcagtccagcccagggaggaccctggatcctatcggagctcatgctggtgcatcctcagtaggaccactctggcatgttcagtccttcagcccttctctagagtaggctcaggcatttatgccaagcaggaccttgtttgattctgaattaccccaagcccctggaggtggctccaaattggcccacttcagggattccccgatcagagaagagctgaaaatattttcattttgagtataatgtcttgaaaccaaagaagcacacagaaaaaggaaaaagaaggtaaaagtggcccaatagtggtctatttcacaaaataaacaataatcctctggtaaatcaagaattagctataataacaattctgaatatataaaaaagaccttttccaagatccttaaaataaggatccaatggaaatataaaataagaaaacttgttaacctcttttcatatgcttgtctggttcttgaacagcagaagaagggaaatccttgaaatgtacactttttttctttcacaatttaaatcttcaaagtggggattgtcttaactaaaaatagttgaagagtcaaatctccatcttttttcttgataggaatgtttatgtgggctgggtgtggtggctcatgtctgtaatctcagcactttgggaggctaaggtgggtggatcacctgaggtcaagagttcgagaccagcctggccaacatggtgaaaccccatctctactaaaaatacaaaaattagcccagtgtggtggtgggtgcctgtaatcccagctactcggaaggctgaggcacgagaatcgcttgaacccaggaggcagaggttgcaatgagctgagatcatgccactgtactccagcctgggtgacaaaacaaaactctgtctcaaaaaaaaaaaaaaaaaaagaaagaaaaagaaatgtgtatgtgtatataaatacacacatacctacctatatacatgtcttctgcaacactgtcttaatggatttgggataatgtccattataaaattagggttggtatagagtaatatgtgccacgtaagtgagcccctccctccatacacacacatagacatacaaatactccaaattagactgcatacactttctcacgggattggtcattttatgttgttatgttaaaaaaagaacttgttttgttatatagagacttactcatatcaataatttctacttcttaattcagttttcaccattttgttagaactcacacatgtaggctacattccaatttgtatgcattcctactcttcatatcaacaaaaaagtcaatttccaagaaagaaggcaaactaaaagtgcttaatccactgttcctcttccttgcatgtttacttcatggagctctagaaggcccctgtgccatgacattaggaaagctgcgcttcaatgttttgtcatatggttctctgtaagttctaggtgctgttcagtcatcttattaaaccttaaaatcgcagtcaaggaaataatttagtgtattctcctttttcattaaaattgcagaaaggatcttttaaatcaatttttttaatttctcaaatgtgtaagttcttcagtgtgttcagtctgtgtcgactataaataccttgagatagttaaattttctaaattgccttatttattcttaggagttttattttcagacttgaaaattaagactgtttccaaacatattgttactccatttaatataaaaagaatgtttagactatgcatggtggctcatgcctgtaatcccagtagtttggaaagctgaggtaggctgattacttgagctcaggagttgataccagcctgggcaacactgtaaaaccccatctctaccaaaaactacaaaaaattaactgggcatggtggtgcatgcctgtggtctcagctacttgagaggctgaggtgggaggatttcctgagcctgaaaggtggaggttgcagtaagctgaggtcacaccactgcacttcagcctgggtgacagagtaagaccctgtttcaaaaaaaaaaaaaaaaagaatgtttaattattttccaccaaaaaaattacttaattgctgccttaggctacatatgaaatattctaaaattgaattgctagcagccttcagaaaataaaccacagaagttgtgctggggaggcaaaaacagggggaagaggagacatggtcttttgcttcatggcccaatgacttatttaattaactaacttgttgacaatcatgaacataaaaaatgcacaactaagcagttggttataaacaacagttgtgatgcctactaggtaacagcaataaggctagtggggaaaatcctccttacagagatttagctgacaaagtaaaaggggaggtcataattagcaaagttgaacttgaagactaatatttaataagaaccataaaagtcttatcacttgcctgaagaatggcatatcagggtatgattaaagcagcaggatctttgtagttaatatttagtcttgatagcacatttcataacagcattttatataatgggtggattttaatcaaagtacatagtgtgggagatagtattcactttaacttaataaagtactgcacataatttttatactttaaggtaaaaataagttcatggctccatttagctcaggctgctacacgtgaggtataactttcataaaaattctctaaagacaaaagtacttttttgttgtcgtgtcatttgaatgttatggcaactttccaaatttttgtagaggtctggggagcaattaaattgctcagatgctttttgaagtcttctctgtaaatatctaatatttatccctgaagcccatgcaaggttatactgtgttcagcccacctgaaagacaaagaaataacatgtgctactctgtgttaactagatcttaaatttcttaaggtcagggcccttgttttattttcttaatgtcctgcatagcaatgacccagggctttgcacttaataggtattgatactgaagggtttttttttaattacagaaagtaacgtttcagttattcagtggatgctagagttttaagccattaaagatagaattactaaactatgaacatttaattaatttaattttaatttctttctaaggtcaaagattagttacctccaaataacatgacccaaaatttgattaaacaggggaaatatattccaagggaagatactctccatcttttattagtatttaagacacattattagtatatttcagaaatagtgaaatatatttcatgagagtatatattataagaggatactggaatggggcagggaaggggagggtatgatggaggtggagaggtgggagaggaccctggggccataggccagaaagatgtgtttagctagagagcaatggtaagccttccaaagatttttagcaggagaatgatgatgcccagagttgtctttaatctggctacaggatagattcagagagtagattagatttagaatagattgtagttgtgtgagacagaaagtgggagactgattaggaaattaagtcattcctgagacaaggaatgagagtatgtgtaaacagtaatactgacaggagaagataaagatgctcctgaaagctacctcacccagcctctgcctaagcagacttgtaaaagactgtaaaagaaaggaggcatctaagataagtagaaacatttacttttgctgatagagacccttcaagggccattagcagaaataatacaaagactgagggcctagaggggaaaatgaatttgatgtttgatgcattaaatataacacatttgtgagacatctgaatggagaaagttagcaagttaatgcagatgtcagagtagacatactgaaaactacaattcatttatttattcactaaactctgtaggacacattagtaagttagggtgatcattcatttatttatcattgattattcattgattcagcacatttcctgagccctgattatgttccaggtactattctagttttaggcattgttcaattttaggcatttagataatgaactagaaaaatgtatgaaattaaaaaataaacaaatatatgtacagacacagaaatctctgctctcaaagggctaatatttgaggagctggggtaggattagggcagacaagaaaaggaaggactgtgatcataaagaaataaatagaatatgaggtagtcataagtgccttgatgaaaataaggtaaggttatgtgattgaggtataccttcaattgagtggcaatacttatttaagatattattgtagatggatacaatttctgcaataacattaaaaataatattggtgttactgagtaactatttcttccaaatatttataaggcagaaaggaccttctgaatgaaggttataacttccctttgcttcaaactccttacagcacaaaacaatcttggattgtaaagtgaatcgtgatgataaatcatagtttatagcaccactccaaggtgaactctgttgtcatccataataaaatgcctgcattggtttctattacagaaggtttttgtatataactaagtgaaactgacatagtgaacagcagcttagcaagcacaaagccaaccccaagcctgccatcactgaataatgccatggtggcatgcgcctgtagtcccagctactcctgaggagggaggactgtctctaagaaaataaaaattttaaaaacttatgccacaaataatctctaactatcttctctccttgtagtcttcccagccggcattctgcagccccccttctttagtgcccagcagtccaactcattgaactatgggggcatcggcatggtcataggacacgaaatcacccatggcttcgatgacaatggtaaagtgcagttgacattttcctttggctgaggtatatgctcataaatttgattaagagttattataatttattactacaaagctacatttattcaaacatgtatcatttctctaattttcaccacactttcaattttccctttaaattgttgcttaaagagatcagaaaattctcatagtgagttaagcaatgtgtgctttacactctggcagaatgaagtaaatattcccattgggaaaatactatggtgtttgtcagcggcagtgataatactaggtcttagtttcctggttgtatatgacgtatcttgtcatactcttaaaggacaggctgcatgtctatgtcttaaaatcagatgtaaaatcagaaaatattgcctctccaagagctcaaaagactcttaagctgcttaagagaccttttttttttcgtcttgtacctactacctagttcaagtctttgcaaacagttaggcacttaaatgccaccctaaatggaaaaatcaatttagagtttcaatcaaagctgaattcctgagaggaataaagacgtgaaatatgtaaagaggtgatagttcaatctatgacaaatttcattcacaaatggaaagtagagaacaatagagagaaaatacttaatccccattttagagagccagagaaagaaaaagagacagaaatgttagaattcttaaaaagacttactaagtgtctattaactcaaactatgcaacagtctttacaggtaggttctaatactgtttctgttttccaagtggaaaaaaataaaaacacatgaaagatttgcccaaaggtaacaaagataggaactggtagaaccagaaggtgaattcaagtaggttggctacatagcccttttcttaatcactacgtcataggcaaatatgaaaaagatggtaatattgtgtcaaaacacatgatacatataaatgcaattggagctcaaaagggagaaagatcgatgtagtttgtggttggcagggaagctgtaggagaaaaagactttttttgtgtgcttgaagtagagggaaactatgagtccacagtgtcctatgaagggtccaggaatataaaaatgccagaataaaaatgttggccattttaaaaatctcaaaatatcaaactaaacagacttgggtcaggtaaaaaccattcaacagaacaaggcataacttcaagaatattttgtctggcggcctcttctgagatatcaagagccaaatgggtgaaatgtctgggtcaatgctgagaagcattagcaaagaaagctctggcagtccaggctttgccaactctgtgatgaggagggatgacagtctctctcatcgtctgcctaatttaatgttctgtcacacagcagtatttcagtccttgcactttgaattaaacatatcttataattcttgttgcaatgagttcccattttacttaaataaatatattataggcagaaactttaacaaagatggagacctcgttgactggtggactcaacagtctgcaagtaactttaaggagcaatcccagtgcatggtgtatcagtatggaaacttttcctgggacctggcaggtggacagcacgtatgtcattagcattctcttgaaaagttttagacatgttcaatcttaagtgtattattggtggtttctttttttaacaatcctaataaagtgtcttttttaacagcttaatggaattaatacactgggagaaaacattgctgataatggaggtcttggtcaagcatacagagtaagtaaaaaagattttctttccattttagtgatttagagtgtttctcatatttaataattcatttaaaaccttttgcaaaaaaagaaactcatataagcagtaaatgatgaatagaaaatggaaaaaaatatgagaagaaagagtggtgaatatgctaaccataagggtcaatacattgatgtgacggagctgaacacttaagtttgcaaagagccaagaagaagagaaaatatggaatattatatcagctgaaatgaggagagagcaggttcacaaaggaggcaacatttttctaagaaataatctctggaataatttttttagaagaaatgtcccataagaaggattatttcagggtctttgaccaatataagaaacaggaccttcagttttgtagcaggtgaagtagcatttgggaacaaaaatcaatgtaaaccacaggcatattaaaccatagttcatatatgatacagtaagggactgacgtgatatggttccagcacatggccttgtagtcaaccacactattatacacagaggactattaacagtggagcatccgttagaatcccatttagccttccattcattcttgcattcaatacatattcattgaggcttaataggtttggcagtattcaaagagctggagataaagcaatgaatgctttatgaaaggtcattatttgaggatctgagcaagggttaaaaaatagtctggtggatgccatgtgcataagaaaaagcagggaatttcataaaagggtggaggaatgatggtctaggaagcaacaaaaaggaatgaagatgattttgagtgtttttctcaactatgaagtagcccatatgtaggagaaagagcagcatctacttgagatgtcacaaggaacaacttgttcctaggctagaactaggcttctctaagacaaggatggatggaatgatcagtggagtgaatgaggatgtagaatcatttgttcattatagaaatgtttggattagagtggaggaggtgaacatcaatggttggatcagggaagaggaagcaccagagaagtggagaaagaggtgactgatggggcctgcagtttgtcagtgaccaaagatgatcagagtgtgaagcttgggagattaagtcagctacaaggtttccaaaagaatgagtccaaccagttccagggacatgggagattgctgctactttgaatgtttagtaatttttttgttcgatgccagacattatgcattttacctcttttttttgagatggagtctcattctgtcgcccaggctggaatgcagtggcacgaactcggctcactgcagcctctacctcctgggttcaagcaattctcctgcctcagcctcccaagaattgggattacaggcatgtgccaccacacctggctaatttttgtatttgtagtagagatgggatttcgccatgttggccaggctggtctcaaactcctgacatcaagcgatccacctgccttggcctcctaaagtgctgggaacacaggtgtgagccactgtgcctgaccgcattttacctctttgggtctggatgttcttttgttcctgtaaatattcttgagctttattctaggatacagttaaattccttgaaaatggtttgatctttttgggtcttccttttgtaacttttattggttgggatggggacagtgttcagtctagggacattattctcaactgctgagataagaatctactctgtgaatcttggggatttccattcttgtcctgtgtaagtaccataaattattatctctaatccttttgagatattgttttcctagcattgggtattttgctcacacacatcttcagatcaagactaagctgaatgcttgaggatgaccatctgtaatctctgaggttctctttttgtgtagctttctcctctttagtaacctgttcttggtgtccctgaactctcagctccttatcctcaactcaaggagtacccccagctctgactggtttgctcctatgatatggcctgaaaactctcaggacaataagctcagcagtcatgggactcactgagagtaaagtttaacatctctcaggggtcattctccttttgcctgatgttcagtgttatgcaaaccattgttttaaatattttgttcatcatttagttgtttccacaagaagttaaatccagtccctatcattccatcttggctgaaagtggaaggcattggcactcaatattcccatggtgattctaatacacagccagattgagaatcactgctataaaatccagccaaagttgggattgatagtactcccatggagaacctcacctagagcaagtacagaattgttaatgatgaagcaaattacaattgtgcaaatattttattacactttgaaaatatgtaaattcttaacgtgtaatgccttgcccccctgctagattgcgagctctctaagagggagcaggtgcaagcctttcccatatccccagcatctttacatagtagaggttcaataagtctatgttgacggtaagtggaagaaatgaaatatattttctgctcatctagttggtcacattcctttgtattaaattggaaatgacacatctcagaacgtttattatgaattcgttttaaaagtttatttagtagaggaaaactcatttttttcagtagcataaatctttaagaattaagaggattttctgacattcaaattacctaaatattttccttcaaatgtacctgaggctcagtccattttgtcctgtcttcaaaagaccagaatagttgcattttattatcctcagactcattggagactaggcctctaagggatctcaagagaatcctttgacttggcaagaatcactcgatcttagtctggtgagtctattttgctaagatagtagtaactaagttaaatgtagcaattgcagacttccttggcaattcatttgtcctgactggtcttattcatcaatttataaaacaacatttagataagtttttcatcacttatttaggtcatccattcattcagttgacatttattgatcacttgacatatgccaggctcttgtcatctactattcagtagcttcttcttttcaaagcatttgtaaataaatttgatttgtctttctaatccataaaatagttgtaggttaccataactaaatgtattatcagggtgattttaacataaaatgttaattacttggtggcatgatcttttacataggtttatatataaccttaggaattaatattattgtttttctattttatcaactgcctaggcctatcagaattatattaaaaagaatggcgaagaaaaattacttcctggacttgacctaaatcacaaacaactatttttcttgaactttgcacaggtattgtgtctttcttgattgatagatatgaaaaccattttgagttataatttcacagtaagttagatgtcacatgctgagttcccttgttttacagagcatttgacttgattcactttcattgtttataatagactgttggatcatattaatgataaataactatgttcctggttgcctttcattgaacattatttgaagagcaaatggttgaggaatgcagaattccaatttaatttttctccttcccctcaacttgctcaaacaaataatccttgattgaacctgagtacatgctttgcttttcctattcctatctctaggtgtggtgtggaacctataggccagagtatgcggttaactccattaaaacagatgtgcacagtccaggcaatttcaggtgcgtggatatgaacagcaatcaaggtgctcttatattgggtccattgcttccacatttggaatttagacttttctaactctgattcttttacatttggaaattcagtgctttttttttttttttgagagtcaaaggtaggatcgagagaacacatcggagcattctacataagcatagccttggccactctctttcttagaatctacaataattataattccttagaatctacgaggctcagggcttgatctattccaacaaagatgtcgcctcagaacagtggctcaatttaaagctagcacaaagatatttctaagaggctgtgaatggtttaggcccagacccaatgagctccaacttgcaaagaaaaatttcaatataaaggaaactttctactaattagaggttcttcaatatggaataacattattcccaaagcttcaggagagagtacattgaagcacagcccatcaaggatgtgagagaaaaatgctctacagagtagaaaactgagctagaagaagttaaagttcttcccaaattagaaaatcaaagagaacaatgattgaagagagtcactccaaccaacatttgaatgttaaatcatagatcctatgtatttgtttaagaactgaattcctaatgctacccctttcccatgtactagaacacttagtcactcatttgctgatcaacaacacctctcaggcaagaaagttaaaaaaaaaaaacctaaaaattttgtagggtagttggaaaatgaaatttgagaacaaaagagaactaatgggctaaatttcaaaagctctacataaaatgaatgtaagcatactgcccagatcatttactcctgggaaaaaacacattcgattatggagaaaaacacatttaattatgaagcaataaagtagttcatttaaaaattaaagaatttattcagcttgctagtatcatcgttgtcatcatcatcatcatcatcatcatcatctagtatttgccctaacatttctttcaatattcattcactcaataactgcttatggtatgcctattatctctgtaatccaagctaaatttagttctgctaagatattcaaattaactgctttataggtaatgagcaacaaaagtgactggattaattcccattgtggtttattcaaaaaacttttagttttaatttttttaaagttgtctttttccttactaaagtgaacttaagctttgaggtaagaaacacttgagttccaaccatggcttcaccatttactagctgttaatgtaacctctgtacctcagtttcttgatatgtaaaataaggattaaattatcatgagagttgctagaggattaacgttaatataaatgaagagcctattttgtgtgtgtgtgtttgaaagtccatactaggattatttgtagacaagaggtatgaacagaataagaattcttatgcattttgtaatagttccctatcagtcaaggcttttttggtgctcatttcttatgttctgcacatttcagaatgttagtaactgatcagcagttaagtaaaacgtacataagtatataactgttttctagctccaattttaaactgaaaacaatattttgctataaattagttaaattatttgtatctttaagtctttattgttgttctggttccaaagatccctcatcgactatttttcattcataacaacagaagcgtgtgtgtgtgtgtgtgtgtgtgtgtgtgtgtgtgtgtgtgtgtgtgtgtgtgtgaagggtaaatggaatgggtaaatggaatgccaaccttttgtcaaggaaattattgttttctctggaggtaaggagattttcttggcaaaaggttgagcttacatttagttttggaaacaggccacttcctggctgtacaaagtaaaacatattttttaaaaaaactttaaaaattaatagatatcgagttgctatttaagaattgtgcttggtggttatatagaaatatttctgaattagagagagatttgtaaccttatgtttaaatagccatagtattaaaacaaaaggcaaaatacacttgatacaaagctgcatcataaaaccatatttgctatgtctaacctattgttgttttattcttcctgactaaagctttatttatgtactttaaaataaactttagaagttaaggtataagaatctaattctaaggatagcagctagcatttataagctcataaaaaccaccatgcaacctaatttgtcaagggtttgccctgcatatctccataaactaaaacataagtcataaaaacctaggtgaatttcagtaatattattgtaatacctagtatatctaccatcctcagagaatgagaggttgcaaattaagttttgataggtaaagtttgtctcttttaagtattaacatttttatcttaaccactggattaaaaattatctattaaaaacacatttctaccttcctgccttaaaacaatatcctgaaaaaaaaagcctaaccttttttaaaattttgatgacacagactactttatgattattagttatggttttactgtttattaatttagtctgtggagctatttattcttataccaattgtgatgctttttgacttattttgggtttttattagggtttttctgtgtgtttgtttctttcctagttttctttcctattattgtattgcctgcctttagttccctaattcctccattttgattagctcagaaaacattttgttaaatttaaatggtatttaatccaaaaacattcttcttttaatagtctagaaattgaatctataatttaaatattgacttcattttggaaatccagtttttggttagccatctatagtcatttcagggaatatttattataatatttatatgtaatctataaatatgtttctaaaattatttagctgtaattttctatataatatgtaagggtctgataattttgtaaagcaagtccaaatagacaaaatgatttaggtgcttagattactcaacattatcttccagtcaggaagaaagggcacttttagaactgacaccactatcaaagcaagaaatgtttctcacagcttaatttctaatattttgaaggaatattttgtctagtgttttatatagacatgttcaactaatatggctattttgttccttcataactctgtaatttagcatgctaataagccctctttgaaattcttctgtttcttccatttcccttcaatattagcattggttcctgatatttatagatatcaatatagattttagtgagttttgcagaatttctgttagcccctccaatctttagctgataactagaaatctattacagcatttatttatttatgactgtatagcagaacatacactcatcaatatgactttgctttgaaagaatcataaaaattagttaatgatgaagattggataccttattcctgaatgaaggcagttaactatgtagccaagtcattcatttacaagaattaacaaaaggttgtctgaggacccattaattgcaaacagtaattcagaagtccaattgtagtaggcaggaatagtcagataggatataaagtccattcttggtcccaatgccaaatctcttagatgtttttaatgcaagtaactgtttgccaagggaataaacatcagcagtacaataagttattttacataataaagtaaaaatttcaagtaaatcaccttaagaaataattaataaaagctttattatcttctgttattagaaacacaagcacacagttttgtaaagcatgaaaatcatgtacatatcttctaataacagaggataattcatgtaatgtgatctcactcttagaaaaaaagtgttttattaataatggattcacttttcaaaatagattatctaggcctggcacagtcactcacacttgttaattccagcactttgggaggccaaggagggaggatcacttgagctcaggagttcaagaccagcttgggtgacatagtgggacctcgtctctattaaaaacaaaaaaattacccaggcatgctggtacatgcctgtagttccagctacttgggaggctgaggcaggaggattgcttgaacccaggaggtcaaggctgcagtgagctgtgatcgtgcctctacactccaacctgagtgacagagcgagaccctgtctcagaaaaaatagatgatctattcaaagatttgatgtcataaacaccaaatgttaactaagaaagtaagtgaagccctagtgtgttgttgatctattcaggatcaaattaggtagagtctttggatggaaagaggatgggcagaatgggcatggagagctgagtgcacaccaggctgagtatttctgcagtgcccactctctgcggtgttatctgaagacgtttctttcttttaggtgttttttgtttgttgttttaacttaattttgagatttataaatataaatcctaaaaatactttttaagaaaaatatagaattaagtcgtgggtttggacattattaccgaagtacttgttcccatatgataaaatctaagaaaaaatcctttggaaaaaattaataaaataaaaacaaaaacatgcagctcttccagtcagtgatgctgatggcttaccctgtcaaccagggagcttgctccctagtgtgaggaatgcccaggatgacaggatgactgtctttagccagtagctaggcatcctgaattgggaagaaggttgcattaatgaatcaaagctcctctctaacataaagaatccttgagtcccgcaacctgaaagactaaagaccaatgcaaattcctaatttctaagctcttttaattcctacataaacagtcacttttgactacattatagaagtgatttttttttggctcatgaacaatggaaatttgtttctcacagttctggagaccggaagtctaagatcagggtgccagcatgatcaggttctggtgagggccatcttctggtttgcagactgcagacttctccttgtactctcacatggtccaaatagtgaatttgtttttcaatatttcagatgtaagaaatggacatttgtttttttcaatcaaattaagccaaactctgagctcttagaccaagctaggagatgagccatttactttcagtggtttttcaacgtactctttcagggttattcaggaatctgatatcatcacacaggcatagaaattagagaatagcctccatcttcagcccaccgtggtcactgctgagatccctacagtccaaatgctccagctggagtcagtggttccatttccttccaatgctcatgagctccagagcctccactcttcatgtccaggttctccaacaaccacacgccatgctatcagagggcctctcggggccttgctcagagcaggaagcatcttcttgtcattcacacaacctgccattactggaacctaccccattcttgggaaggccaatcatctccctgacaagtggactaatatataaattccccagcttctgactccacttcacctcaaccctcccacaccaggagattatttttcgtctttaagactcatctaggaatcctaaaaaacaaacaaccagaaaagattacatcctccatgaaagataggagagttgtggtggagagggatagagaagttagttgatgcgttgatgggtgacatattagaaagtcagacttacaaaaaatccatatggatctctcttttctggaatgaggaaagggaaagaaaatgctttctttctcttccagttggtccataatatcaaacaaacaacagaaacactaagtcgtgtttttcttcctaataccctattgcttctctacaggtaatcactgtgaccaaccaggtcacaggttaattcattcagtatgtactgagtcctgtgctggactttgggggtgcagcagtgagcaagacatacacagtacagcatcttccctcagcatctgtgggggtttggttccaggctccctgcagatatcaaaatttgtggatgctcaactccttgatataaatggtgtagtatttgcatataacctatacaccttctccctcctatactttgtcacctctagattacttataatacctaatacaatgtaaatgctatgtaaatatttgttatactgtattctttagggattaatgataagaaaagtaagtccatacgttcagtagacaaaatatttcccccacatatgttcagccgcatttggttgaatccacagatgtggaactcaaggatacaaaggctgtattttgccctcatagaaattagtctagtgggtgtgtcaggaagtaaaaaaggagaacaaatcattgtaaatgtggtaagtgctttgatagggatagtccctgtaagaggagttagtttagatggcattcaaagaagggggccaaggaaggaatatttaagcaaaggcatgaaggctgaggagttagccatgtactgactggtgagtaactttccagggagtagggtctgcaggtagcaggaagctctgaagagggacagggtttggctggtttgaggaactgaaggtaggtcagcatagtttgagcctaaggaggaacaggaagagaaatgtaccacgaggaggctagagaggagactggagccatcaggaggacattggaagccatggacaggagtttagatttccttcaagtccatggaaggttttaaatctgagattatggaatctgatttaaattttacagatcattctgactgtggtgtggagaatggttggaggagagagaagtcctaagatgtacacacagtagtacacctgccacgtagggagaattccataaatcaaaatggactcacctgtcatttgtgcctagtccttccaaaccagtccacttgtctctgggcccctcctcccaacccaagcaaacgtggtaggctggccttagcaggaggagaagggaaggaggtggttcagggttcagggtgggtgtgaaaacatcacctctgcatcaatgtactgacccatctctcccctcaaacactgctaggtgcagatagtgagttggactgtgttgtttttgcccactggggtcagagataagaggaaaatggcattttgccagccctttccagttattcaagctgaatccagcttctgatatttaaggagcccttttggaaaaaaggaaaataatcctctataaaagcaacaaaaaatatctatttaaagtctattatatttaagtcattatgtgagccctttcaagacatagtgagaaatcatgattatattctttgaccaaactcttattataatacaactccaaatacctgcattttcaaatgtgaattattcatgttttacaaacacatataatgcttataaattattaactctccatgacaaccttaagatgcatgttctattgtgcagaaaccaaggcacaaagaagcttcataagcaggattcaagccatgtagtctgtctcccaaattgcttttaactcctgttctttgttacttctccatttaaaaattctgttaatgagaaggcactgactcattgtaccaggttattttaagtttaactttaaattccaaattcattcacttgacctgcagagggaaatgcttcagggctccagtgtggtatggacgtgagtatcaaatgctgacggtgactttttttgtttgtttcaaaggattattgggactttgcagaactctgcagagttttcagaagcctttcactgccgcaagaattcatacatgaatccagaaaagaagtgccgggtttggtgatcttcaaaagaagcattgcagcccttggctagacttgccaacaccacagaaatggggaattctctaatcgaaagaaaatgggccctaggggtcactgtactgacttgagggtgattaacagagagggcaccatcacaatacagataacattaggttgttctagaaagggtgtggagggaggaagggggtctaaggtctatcaagtcaatcatttctcactgtgtacataatgcttaatttctaaagataatattactgtttatttctgtttctcatatggtctaccagtttgctgatgtccctagaaaacaatgcaaaacctttgaggtagaccaggatttctaatcaaaagggaaaagaagatgttgaagaatacagttaggcaccagaagaacagtaggtgacactatagtttaaaacacattgcctaactactagtttttacttttatttgcaacatttacagtccttcaaaatccttccaaagaattcttatacacattggggccttggagcttacatagttttaaactcatttttgccatacatcagttattcattctgtgatcatttattttaagcactcttaaagcaaaaaatgaatgtctaaaattgttttttgttgtacctgctttgactgatgctgagattcttcaggcttcctgcaattttctaagcaatttcttgctctatctctcaaaacttggtatttttcagagatttatataaatgtaaaaataataatttttatatttaattattaactacatttatgagtaactattattataggtaatcaatgaatattgaagtttcagcttaaaataaacagttgtgaaccaagatctataaagcgatatacagatgaaaatttgagactatttaaacttataaatcatattgatgaaaagatttaagcacaaactttagggtaaaaattgccattggacagttgtctagagatatatatacttgtggttttcaaattggactttcaaaattaaatctgtccctgagagtgtctctgataaaagggcaaatctgcacctatgtagctctgcatctcctgtcttttcaggtttgtcatcagatggaaatattttgataataaattgaaattgtgaactcattgctccctaagactgtgacaactgtctaactttagaagtgcatttctgaatagaaatgggaggcctctgatggaccttctagaattataagtcacaaagagttctggaaaagaactgtttactgcttgataggaattcatcttttgaggcttctgttcctctcttttcctgttgtattgactattttcgttcattacttgattaagattttacaaaagaggagcacttccaaaattcttatttttcctaacaaaagatgaaagcagggaatttctatctaaatgatgagtattagttccctgtctcttgaaaaatgcccatttgcctttaaaaaaaaaagttacagaaatactataacatatgtacataaattgcataaagcataagtatacagttcaataaacttaactttaactgaacaatggccctgtagccagcacctgtaagaaacagagcagtaccagcgctctaaaagcacctccttgtcactttattactcccagaacaacaactatcctgacttctaatatcattcactagctttgcctggttttgtcttttatgtagatagaatcaatcagtatgtattcttttgtgcctggcttctttctctcagccttacatttgtgagattcctctgtattgtgctgattgtggatcttttcattctcattgcagaataatgttctattgtgggacttattacaatttgttcatcctattgttgatgggcacttgagaactttccattttggcgctattacaaatagtgcaactatgaatgtactgcatgttaccatcttacttgagcctttaatggacttatttcttcaaatccttccaaaaattattataagcattgaaattatagtttcaagccaactgtggatacccttaccctttcctcctttatcacaaccaccgttacaagtatacttatatttccctaaaatacatttaaaacttacctaagtgacatttgtagttggagtaataggagcttccagctctaataaaacagctgtctctaacttattttatttccatcatgtcagagcaggtgaagagccagaagtgaagagtgactagtacaaattataaaaagccactagactcttcactgttagctttttaaaacattaggctcccatccctatggaggaacaactctccagtgcctggatcccctctgtctacaaatataagattttctgggcctaaaggatagatcaaagtcaaaaatagcaatgcctccctatccctcacacatccagacatcatgaattttacatggtactcttgttgagttctatagagccttctgatgtctctaaagcactaccgattctttggagttgtcacatcagataagacatatctctaattccatccataaatccagttctactatggctgagttctggtcaaagaaagaaagtttagaagctgagacacaaagggttgggagctgatgaaactcacaaatgatggtaggaagaagctctcgacaatacccgttggcaaggagtctgcctccatgctgcagtgttcgagtggattgtaggtgcaagatggaaaggattgtaggtgcaagctgtccagagaaaagagtccttgttccagccctattctgccactcctgacagggtgaccttgggtatttgcaatattcctttgggcctctgcttctctcacctaaaaaaagagaattagattatattggtggttctcagcaagagaaggagtatgtgtccaatgctgccttcccatgaatctgtctcccagttatgaatcagtgggcaggataaactgaaaactcccatttaagtgtctgaatcgagtgagacaaaattttagtccaaataacaagtaccaaagttttatcaagtttgggtctgtgctgctgttactgttaaccatttaagtggggcaaaaccttgctaattttctcaaaagcatttatcattcttgttgccacagctggagctctcaaactaaaagacatttgttattttggaaagaagaaagactctattctcaaagtttcctaatcagaaatttttatcagtttccagtctcaaaaatacaaaataaaaacaaacgtttttaatactattgcttttatgcctagtcaactctgttccaaactgccaactcctgtgtaaatctctaccccatttatttcttgaaaaatattaagattaaatggagcttttatctctgtagtcttgcatttcccactagcttcaaattgaatttttagaaaatgaatgatataagctttgtatccattatgtccttgttttccccaccctttttcaaagatcaccatgactttctgattggattttttttcaaaagtgaaatggccatcaaatgttatatggagtcactagcataatcagatgacttaggcaaaagccaaaagtaagtgtctttatccacagtctctagtctgaagaagttgaccatttggttggtcaagtggacagaggagtcacatctgactggtggtcaaactggcacatgtttatcgcattctaatcttttatctaacaatggtttcttaatttctgcttctttgtattttgcatttcctctaaaacagtgagaaacactactttcactttcaacctcatagacaaaatgttgtgcttctattttgcttgacaaaacagatcttctcagttgtacaaaggaagtctggcagaaaaataatcattggctcttgccagaaataatgatgagtttccaacttggggaagtatagaaagactggaaagactaatatttatgataaatgtttatactctggattttccttctacccagaaactgacaattttgcgggtattaggcatattagcatcccatttcgctcttataaatacacttgatagaatctccaatctgacatttatgctatatccaggaagacaaatggagccaagtatctgtattatcgttttaccttggtgtaaatccttcttacatgctatgaatgctctatgtcctctgacatactgcatcaaagatgtaatgctaagacgtatggcagctttataacaccaaagaaatagggattcaaacactaactagggctgggtgcagtgcctcacacctgtaatcccagcactttgggagtctgaggcaggaagattgcttgagcccaggagttcaagaccagcatgggtaacacaaggaaaccccatctctacaaaaagtaaaatacaaaattagccaggcatagtggcacatgcctgtgaccccagctactcgagaggctgaggtggaaggatcgcttaagcccaggaggtcaaagctgcaatgagccatgattatgccactgcactctagcctaggcaacagagcaagactgtctcaaaaaaaaaacaaaaaataaacagaaaacctgaccagcagaaaatatttagatgtagtaaatgaaaatagaaaaaggacacaatgttgagtatgcattatcatatcaactatgttaaaatattattccatagaaaaagagttggaagaatatatggcaaaaattaaccagggctatctctgggtggtagtattataagcagttcttattttccttttttggttttctacattttaagtttttctgtgataggaaaatgttactcttaaaaagtcattttaaaaatattatttggaaagaaaaagaaaaggaatatgaaagggaggggagtgagggggaaattgacccaaaaagaaaaatataatttccctaaataaaagggttgttaattctttttaggacctattcaatttgatgtctcaggcaacttagacccaaggaacctggtgaagtagattttggtcaagagcttgctgcctccaggacaggccagatctgtttataaagtaactttgacacacactgtataacacagaatggaggaagttgctggaccttcctctggtacttaaagtgcttctgtgagaacaaagcatgtaatctagaggaggttttgggctttttcctgaaaatgctaaaaggttgactgacccagccacactctcccacctggtcctccgcacctccccaacccgccccaaaccccagcatttgccaaaccctgacccagatg

SEQ ID NO: 15413 - DNA, 107751 bp, Human; identical to SEQ ID NO: 15412

SEQ ID NO: 15414 - DNA, 107751 bp, Human; identical to SEQ ID NO: 15412

SEQ ID NO: 15415 - DNA, 107751 bp, Human; identical to SEQ ID NO: 15412

SEQ ID NO: 15416 - DNA, 5631 bp, Human
ttctgtgtttttagtggagacggggtttcgccatgttggccgggctggtcttgaactcctgacctcaagtaatccacccgccttggcctcccaaagtgctaggcttacaggcatgagccacagcgcccagcctgtgcaaagtttttattggccacgtccatacctactttgatgttgagttcccttacattcatttttctagaggataaggggacaaaggaacttctcagataaatgtttttgtgaggagctcttgggtctttgatgcaattgaagacacagcagttactctcaaggtactcacagcctcattttctaaacaatgcctctccaggaagtccttggtgtaagcatatgttcctggagtctgcattgtgagacagatggcagaaaaatgactcctcttttattcccattgattttggttcttgagaaacatgtggttacccctgttgctatgaggtagtattattgtaataataaatgtgctgatagaattatggtccattatttaacctgtgtgaagatggggataaaactgctaaatgggcaggattaggaacaagttaggtatagataagccatattaaataaatgtagaaacaatataaagcagtgaaagcaaaaacccttgtttaataactagactacaaggcatcaaaagtcaggtcaacgtatgaaagaaaaatcttgcaactcaaaggaaaaaagctggcagctcacaggacgagtctgggtcacattatgttttgtttgaacagcaccatgttttaaatatcaggagatgttacatacaaaagaattcaacttctggcttctcttgaaaaatttgtcattgtttactaatattcctaactgatttacttttctctcccatcctccctcccttcctccctccctccctgcctcccttccttccttccttgctttcttgctttcatcttgctttgttgcccagggtggagtttagtggcatgatcccagcctactgcaacctccacctcccgcgttcaagtgattctcctgcctcagcctcccgagtagctgggattacaggtgcttgccaccacacctggataatttttgtatttttaggagagatggggtttcaccatattggtcaggctggtcttgaactcctgacctcaagtgatctgcccacctcagcctcccaaagtgctgggattacaggcatgagccactgtgcccagcctactcttgtttctttgagaggtagcatgaatctccagttctccacataacatgtaggtggattaaaaactttaatatgaaaagtaaaactttatagtttatggaagaaaatacaggatgctgtctgaggacagtctaattacacaagactcgaagtagtagatactataaattaaaaatttattttcatcaaaattaagaattcttatttaacaaagttcatcatagacaaacaacctacagggaaacagattggaaaagctattttcaatgtataaaaccaacaaactatttagaatattcagggaattctagcatacaattctaacttgcagcaagaaaaagtcagaaaacacagaatattaataagtagttaacagaaagggaaacttatgtaagcattatatctcttaagtgaatgtaatacgaaaaatgaatttagaataaattaactcaattttctcagaatccggttgacaaaaatgaagtcaggtaatgtcaaatactggccaaagatgtgaggacatgagaatcctcatctatggctggtggaagtataaatagtcattacagtgagccattttagcagtgcaaagttaaattaagaatacatagtgttcagcctgcttccggacgggcgaggagacttgtggtctggttctgggacttccctaatagcatggcgcctaaacgccagtctccactccagcctcaaaagaagaaaccaagaccacctcctgctctgtgaccggaggagacatcggcctctgcaggcttgctgaagaagggagaaaaagaacagcaagaagcgattgaacacattgatgaagtacaaaatgaaacagacagacttaatgaacaagccagtgaggagattttgaaagtagaacagaaatataacaaactccgccaaccattttttcagaagaggtcagaattgatcgccaaaatcccaaatttttgggtaacaacatttgtcaaccatccacaagtgtctgcactgcttggggaggaagacgaagaggcactgcattatttgaccagagttgaagtgacagaatttgaagatattaaatcaggttacagaatagatttttattttgatgaaaatccttactttgaaaataaagttctctccaaagaatttcttctgaatgagagtggtgatccatcttcgaagtccaccgaaatcaaatggaaatctggaaaggatttgacgaaacgttcaagtcaaacacagaataaagccagcaggaagaggcagcatgaggaaccagagagcttctttacctggtttactgaccattctgatgcaggtgctgatgagttaggagaggtcatcaaagatgatatctggccaaacccattacagtactacttggttcccgatatggatgatgaagaaggagaaggagaagaagatgatgatgatgatgaagaggaggaaggattagaagatattgatgaataaggggatgaggatgaaggtgaagaagatgaagataatgatgaaggggaggaaggagaggaggatgaaggagaagatgactaaatagaacactgatggattccaaccttcctttttttaaattttctccagttcctgggagcaagttgcagtcttttttttttttttttttttttccctcttgtgctctgtcaccctgttcttgaggtctcttttctctgctccatggttctcaacttatttggggggaaataccttgagcagaatacaatgggaaaagagtctctacccctttctgttcgaagttcatttttatcccttcctgtctgaacaaaaactgtatggaatcaacaccaccgagctctgtgggaaaaaagaaaaacctgctcccttcgctctgctagaagctggagggtgctaggcccctgtgtagtagtgcatagaattctagctttcttcctcctttctctgtatattgggctcagagagtacactgtgtctctatgtgaatatggacagttagcatttaccaatatgtatctgtctactttctcttgtttaaaaaaagaaaaaaaaaacttaaaaaaatggggttatagaaggtcagcaaagggttggtttgagatgtttgggtgggttaagtgggcattttgacaacatggcttctcctttggcatgtttaattgtgatatttgacagacatccttgcagtttaagatgacacttttaaaataaattgtctcctaatgatgacttgagccctgccactcaatgggagaatcagcagaacctgtaggatcttatttggaattgacattctctattgtaattttgttcctgtttatttttaaattttctttttgtttcactggaaaggaaagatgatgctcagttttaaacattaaaagtgtacaagttgctttgttacaataaaactaaatgtgtacacacacacaaaaaaaagaatacataaataccatgcctagaaattctatgcctggagaaatgtcaacatctggagaatcactcgcatagagttttacaaaaagatgtcctcaaacagacacatgataatgttcatagcagtatgacttgaactagcaaagatctgaaattacacaggtgtccatctctagagaaatgtacaaataaaacatggtacatatatttaaaggaatattatgcagcagacagatgctccatataaataaggtttatatattgcaatgtaaatatatgcatcaaaataaatatgcatgaaagatggtttgaaaatcaaagtttaaatatagtagagtgggtgtctatacctggaaagagattgggattggaaggaggaataaagaaaattaacataaaacaaattgaaatagaatacaatagccttgcaggggccaccaatgatcgcatactgtgaattcaggaatattatacattcagttctgtaaacctaaagttataaaagacttcaactaaaaaaaaaaaaaaaaaagagctactacactagtctcctgttacctgcaggggatatgttccaagtctcccagcagatgtctgaaaccttggatagtactaaaccctgtatatacagtcataccttgctttacaatggggatacattcagagaaatgcatcattaagcaattgcatcattgcatgaacataacagagtgtacttacacaatcctagatgtcagagcccactacacacctaggctatatggtatagcccatagctcctagattacaaaactgtatagcatgttactgtactgaatactgtaggcaattttagcacaatggtaagtatttgtgtatctaaacatttctaaacatagaaaagatccagtaaaaaatatggtatatattcttatgggaccagcatagtatgtttggtctgtcattgactgaaacatctttatggggtgcataactgtactatgctttttcctatacatacatacttatgataaactttaatttataaattaggcacagaaagagattaacatcagtaactaataataaaatggaacaattataacaatatattgtaataaaagttatgtgaatgtggtctgtctctcaaaataccttgtaatgtacttatccttcttctttttttttttttttagacagagtcttgctctgtcaccagtacagtgacacaatctgggctcactacaacctctgcctcctgggttcaagcgattctcctctgtcagcctccccagtagctgggattacaggcacaagccaccatgcctggctaatttttgtatttttagtagagacagggttttgccaggttggccaggctggcctcaaactccgggcctcaagcgatccacctgccttatcctcccaaggtgttgggattacaggcatgagccaccatgcctggccttatccttcttattgtgatgaagagggaacagagtggaatgacatgagattttatcatggtactcagaacggtatacaatttaaaactgtgaattgtttatttcttgagtttttcatttaatattttcagactgtggctcaccacaggtaactaaaactaaagaaagcaaaatcataggtaagtcagggattactatatttctttacattttggccaaagacaactcctctagttatttttttcaaacttgtgaagatggaataaatcccattgttaggcctgatctgagctctccaatgccaaacactaatctagtagttgcagtttcctgttacccagggacatatttgtggtcttcctattttgttgttttcagtgtgttaatcatctccactcaaaatcctcctgaatgaaactgttggatgacctacaccacctttgcctaaaaagtgtgtttctggaaagccagagggaaaactcctgcaaatgagccaccctagtgctgctggatttgaagaggcagatggtggttggattttacaag

SEQ ID NO: 15417 - DNA, 27284 bp, Human
  misc_feature (1)...(27284): n = A,T,C or G
cttcacatggtgataggtttttgtgaaatttgcaagatattttgataatttgtagttgtttattttctttcaactctgacttgttttctgttaggtggtgctggaatagctgtgggcattttgaaatcaggctaagacaaagatgagctggggatgtgcttagtatgggtttagtggtatatatgtgatttgcaattatttctgtgtatagttaagtacttgttagccatcccagtataacttaagatttttagtatcttatttgttattctggttcttgaaggagtccttcaaattgtaaaacttggatctgtccctggtaactgacatagcagaatggaggaattcacaaccttggggtggggtgggaaggaagccaataaaaagcaagctgatttgtgctgtagacttctggggaggctcaggaatttgaagcattgggttctttttgggacattggtctctgggttagcctaaaacagggattagttaaaaatctgagaagcagatccttttccttagcacaggagcaaactgtgctctccttccccatcagaacactgtggatgtattctctagaggggctaaacgagaggttctgggcttgagcctactaataccaggcatagttgagggtggaggtaagactctacattaagaacaggattaagtaaaattctctatgctgaatggtgattccctcttcctaccacttcctctgtttaactgccagaatgccaataggcaggagagtagatatgtcttctctgggtagttgaccaggtacaggaaagacctacaaattcactggcttttccacaatgaaatagccagctgccttgtcatcttacggtgaaggcctccagtagctaagttttattagcaaatagagatcttagtttttagtttcttgtcattaaataaaaagccaaggattgttaaatgtatgttcataaatattagttttacaagacactagggtgtgattccaacagctttgactccgtttaggagccggtgcttttgacttctttggggctaagcttcttgctgtggcttctgcttgttgctctggtgaagcactgaagagagggaaaacaatcagcataaattttttttttttttttgagacagagtcttgttctgttgcccagggcagaatgcagtggcacaacctcggctcactgcaacctctgcctcccaggtttaagcaattctcttgcctcagcctctgagtagctgggattgcagacatgtgccactacgccccgctaatttttgtgtttttagtagagatgtggttttgccattttggccaggctggtctcacactgctgacctcaagtgatccacccaacttggcctcccaaagtgctggtattacaggtgtgagccaccgcgccggccctaatcagcataatttgtgatgtcatggccctagatctaaatgccaggagattctcacagaaacaaaatttaatgagtgcctgtatctgaattctgttactcaggatttattgatagttctttttcttttcttattttttttttggggatggagtctctctctgtcacccaggctggagtgcagtggcacaatctctgctcactgcaagctccgcctcccgggttcacaccattctcctgcctcggcttcccaagtagctgggactacaggcacccgtcaccacacccagctaattttttgtatttttagtagtgatgggatttcaccatgttagccaggatggtcttgatctcctgacctcgtgatccacctgtctcggcctcccaaagtgctgggattataggcatgagccaccgggcccggccaataattcttgaatattgatagtttattgaaatttgtaggcagatttaggggagatcaaaggactgctcttcagactgggaaagaaatagcttttctttctgtattttgacttgttatttttgattaaaaaacatgttataccaatttaaaacgcttctcccctttcctccagtgataaatgctgctcattctttctacaatggaacaacaaccctaccaatatcagatgaagatagaaccccacggaaaagaattagcaaaacgttaaatatgaccacaagtcctgaagagaaaagaaaaatcattggggatacttttgttaaggtacctttgtttttaatatcctcaacatgtactatttttgatgtgaatcttagtatttgtttttccttgtcactatatcaaataaccaaattagctaattttaatcctttttcttatgtggctgagagttttattgtatattgtcattatattgaccagtagaaactgttttatgtttttttgttgttgtttggttttttttttgtttttttgagacagagtcttgctgtgtcaccaggctgggctggagtgcagttgcacgatctcggctcgctgcaacctctgccttctgggttcaagtgattctcctgcctcagcctcctaagtagctgggactacaggggtgcaccatcatgcccagctaatttttgtacttttagtagagacgggggtttcaccatgttggccaggttggtccggatctcctgacctcatgatccgcccgcctcagcctcccgaacttctgggattacaggtgtgagccactatgcccagccaactgttttatgttttaataaacatgtttgcctacattgccaggctattattttaagaatagatgtctttaagagtagatgtattcagcttatcatagactttaattcattgattatctcaatggctaatttcaagctcttgaatggaatgttcacatacctttgtttttgttttttttttttttttggaggcggagttttgttcttgtcactcaggctggagtacaatggagcgatcttggctcacggcaactttcacctgctgggttcaagcgattctcctgcctcagcctcccgagtagctgggattacaggcatgcaccaccatgcccagctaatttttttctttttttgagatggagtctcactctgccgcccaggctggagtgtagtggtgcaatcttggctcactgcaaactttgcctccagggttcaagcgattctcctgcctcaacttcctgagtagctgggattacaggcgtgtgccaccatgcccggctagtttttgtatttttagtagagacggggtttcaccatgttagtcaggctggtctcaaactcctgaccttgtgatctgcctgccttgcctcccaaagtgctgggattacaggcgtgagccaccacacctggccactaattttgtatatttagtagagatggtgtttcatcatgttggccaggctggtctcgaactcctggcctcaagtgatccaccccactcagcctcccaaagtgctgggattacaggcgtgagccactgtgtttggcctcatgtacctttttgaatcgtgttagaggacatgttcattaaggagtttattttggagattggtggattttattttctgatcagtatttctaaaggactctaagagatttagctgaaagtataaacttttgcttttaaaaaaagttatctcttacaaggctgttttactcctgttgattatagattgccaatgaagtaattggagaaatgaacttgaaaccagaggaggttttccttgcccaaggtactttacggcctgatctaattgaaagtgcatcccttgttgcaagtggcaaagctgaactcatcaaaacccatcacaatgacacagagctcatcagaaagttgagagaggaggtaaaagtttatgaaaactttttcataaagtagatacatggaaagtcttccattcttccctcctcttccctctaatattcacagaattgcataaccatcaccacatctaattttagaacattttccttaccctaaaaaggaaccttatacccattagcagtcactcctcgttctacctgttgttgtcattgtcatcctgcccccaccccccagctcctcctttcctcctttcttgccagccctaggcaattaccaaccactaatttattttctgtctctatagatttgcttattttgggcattttatataaatggaatggtacaatatgtggtcttttatgactggcttcttttacttaccgtaatgttttcaaggttcatccatgttgctgcatgtatcagaactttattcctatttattgccagataatattccatcttatgggtataatgcattgtatttatcctttgatcagctgatgggcttttgggttatttccactttttggctgttataagtaatgccgccatgaatactggtcataagtttttgtggatatgtgtttttatttcttttggtatatgcctgggagtagaattgctaggtcttaaggtttaacattttgatgaattgccaaactattatttaaaatgatgatacaattttacattcgcactagcaatctatgagattcaaatttttccacatcctcaccaagacttgttgttatctcttttcttattgtaaaaaacacataacataaagcttaccatcttaactctgatttttttttttttttgagacagagtctcactctattgcccaagctggagagcagtcatgcgacctcggctcactgcaacctctgcctcccggttcaagagattctgctgcctcagcctctcaagtagctgggattacaggcatgcgccacgaggcccggctaattttgtatttttagtagagatggggtttcactatgttggccaggctggtcttcaactcctgacctcaggtgatccgcctgcctctgcctcccaaagtgctgggattacaggtgtgagccactgcatccagcctcatcttaactatttttaagtatatagttcagtagtgttaggtgtattcacattgttgtaaaacagatcttcagaacttttcatcttgcaaaacaaactctatacccgttaaaaaacaactctcccttttttctggcccccaccctctggtaaccaccattctgctttctgtttctatgtttcactactttaaatacctcatataggtggaatcatacagtattgcctttttgtgacttgcttatttcacttagcataatgtccttaaggttcattcatgttgtagcatgtgacagaatttccttcttttttaagactgaaaaatgggccaggcacagtggctcatgcctagcgctttgggaggctgaggcgggtggatcacctggggtcgggagtttgagaccagcctggtcaacatgatgaaaccccgtctttactaagaatacaaaaattagccaggcgtgatggcgggcatctataatgccagctccttgggaggctgaggcaggagaatggcttgaaccctggaggcggaggttgcaatgagccaagactgccattgcactctagcctgggcaacaagagtgaaactctgtctcaaaaaaacaaacaaacaaacaaaacagactgagtaatgtactactatatgtatataacacattttgcctatccatttttgtttatcttttggatatatgcccagaattgggattgctggatcatatggtagttctctttttaatttttttgaggaacttattgtccatagcaattgcaccattttacaatctaaccaaaagtacataatgactccaatttttccaaatgcttacaatttgttattttctatttttttatggttgtgttatctgacttttaaaaattttagtcatctggctcagcacagtggctcatgcctataatcccagcactttgggaggctgaggcaggtggatcacttgaagccaggaatttgagaccagcctggccaacatggtgaaaccctgtatctactaaaaatacaaaaaaattagccaggtttggtggtgcatgcctgtagtcccagctactctggaggctgaggcaggagaattgcttgaacctgggaggcagaggttgcagtgagccaagattatgccactgcactcccgcctgagcgacagagcgagactctgtcttaaaaaaaagtaaataaaaatgttagtcatcctagtgtatatgaagtggtatatctcattttgatttgcatttccctaatagctaatgatgttgagcattttttcatgttcttgcttattggccatttgtgtatcttggagaaatgtctattcgtatcctttgctcctttttttaaaaaataattttaagttcgaggatataagtgtaggtttgttacataggtaaacttgtgtcataggggtttgttatacagattatttcatcacccaggtattaggcctagtacccattagctttgcttattttttaattgacttatttatttttttattattgagttgtaaatgttctttatatattctggttacaagtcttttatcagatatacgacttgcaaatgtcttctctagttctgtgagttgtcttcattttctcaatgataacatttggagaattataattttggaacactagtatattttctaattgctttgtattctaatgagaattagatcagagatgatggattggtttaccctgatttatttatatttaaaaagcttatgtttaaaatgtgcttcaaagagaaataatacccataagatattcgtctaattccttataggcacttaggaacaaatactttaaaagatgcatttttagtaataatctgttagtctaagaaaagtggtaacaggaaaagccaataatttattacgctttgttttccatgtcatcttggttactagtttatattggttggcttctttcctccctgtagggaaaagtaatagaacctctgaaagattttcataaagatgaagtgagaattttgggcagagaacttggacttccagaagagttagtttccaggcatccatttccaggtaaaaattagaactgaattttgtttgattcatctttagaccttcatgttgaagaaaaatcaattcagacaattctgaaataatctgtcatctcagggaatatgtaacatgagagaaaggaaaggatggttagggaataattgaaatcttttgagtatctactgtatttacttcattttattaaatactcattttccattgtatctgcatttaagtgttacattatccttgggagtctggcatctgatgttgccatcagatgagaaaaccaagacataaagatattttaataatattgccacacagtcctagtagtagagctaggatttgttatattatttgtaccataccgcagtgcgttccatggaagatgtgaggatttaaatttagctctttaaaatccttgtcctatgtctgacttgtttgaatggatgaaccacttattctgtgcagagaattcttggcacaatgtaactaattcctgaacaaataatacttcatttgctgtcatatagaaaaaaattagaggtgatacttgtttaaagttaggactgcaagtcttaacctgtttttgttactagttcttgagaggttgggcaagtctgtacatcaggttctagctcactgtaatagtgattaggggatgatttgggagaatgacctaattgaattgaaaagcataataatagccaacatttcttaagtactttctatgtgctaggcactctgctaaatacattttattgtcttatttaatcttcacagtggaaactactattatcctgttttacagatgaagaaacttagggacagcgactaatttgccaaaagttatgcagattgaaaggagtggagccagaatgatatccccaataatttttatctcagagtttatactcttaatgatcatattggctccataaacagctttacacatgtataacctatgtggtgattagcacttgttctcaaatcaagtaatcagattgagatctttagtccctaacctgcatgccggcgaagaatggtctgtggaccggtgtggtggctcatgcctgtaaccctgagtctactaaaaatagaaaaattagccaggtgtggtggcatgtgcctgtaattctagctactcgggaggctgaggcaggagaatcgcttgaacccgggaggcagaggttgcagtgagacaagattacaccacagcactccaacctgggcaacagagcatgactccatcttaaaaaaaaaaaaaaaagaaaaaaaaaaaagaaaagaatgatctgtgaatgtaatggagggaagccaagtgttctatgtccttggtcattatttcatctagactcacttgatgttttaaaaatctattttgtatgttgagttttctattatgtaagacttcattggcaaaaatggttttactgctttaaaaactatcttaagtatgctgtttattctaaaggtaaagaatggactagggaattaattggacatagctgaggttttgcctataactaggcatctcaagtgatgccttttctgttgtagtaaagcagcaggatccagttttccatagatctatgcacaccttgtgtttttatcaacttttaagtatttggtaaaatagaggttgggtacagtggctcatgcctgtaattccagcactttgggaggcctaggcaggcagatcacttgaggtcaggagttccagaccagcctggccaacgcggtgaaacccgatctctactaaaaatacaaaaaattagctgggcatggtggtgcatgcctgtactaggtacactggtggctgctaggggagggtaaggcaggagaatctcttgaacctgggaggtggaagttgcagtgagctgagatcgtgccactgccctccagcctgggtgacagaatgagagtctgtcaaaataaaatagaaataccagttcacattttttggtattaaaaactcacattatttattagattatgtgtatattttaacagtataataccattcctaaaattagattgatagttgaagctggatgataagtaaggtagttaattatactgtcctctttatgtatatgttggaaaattcccttattaaaaactttggatgagcacatatgttataaactaaaaatatttactggataattttgtgatacttaatacatggactgtaaaaataggataggccaagtgcagtcagtggctcatgcctgtaatttcagcatttccagaagccgagcttctggagttcaagaccagcctgaacagcatagtgaaacccctatctttactgaaaaaattagccaggcatggctgccggtgcttgtaatccaagctatttaggaggctgaggtgggaagactgcttgagctcaggaatttgaggctgcagtgagcaataattgcaccactgcactctagccttggtgacagagcaagactctatctcttaaaaaaagggagataggaatgatagggagagaattaaacatactgtcttatttgagcctcacaatggaaactatgatagtattaccctgttttatagatgaagaaacttagggacagagattaatatgccaaaaagttatgcagactaaaacgtatgcataatttaaatgttgcagcattctaaatgttacaacatttttagaatgttgaagcattctaaaaaatgctgagttgaatgggaaactaatagctacatttggatacttatgatgggcagatggattttaattttggaaaggttttatgttttgaaactagtggcatttttatattagatttttatattagaaatataacattaatgttaaatactattattactcctacctttaggtcctggcctggcaatcagagtaatatgtgctgaagaaccttatatttgtaaggactttcctgaaaccaacaatattttgaaaatagtagctgatttttctgcaagtgttaaaaaggtaatatttgatacagctaatcattacaagaaattgaacggattcttattatataccagcatttataatgaattttttagggttttattatttgaaaatttggtgtaatataacctttgaaatgactgtggagaaaatattccacagatattcttatatgcatatttttctttccagccaaacaagactggatatcctgagtctctaaaaatgtcagataaagtattttaaagcactcttttatgtgtatttcaagatagtaagggaaatcctttgagtcaggaatttattgggagcatcatttcaagaaaccaaagctgtctgctcctctgaggacagctactaatcctttgtggtctaggatttgggtttttacaatttcattcatgtacaggtgtctgagtatgagactgggtccaagaagggccagagattggatcagatatcttcacactatgcaaccctttagctccaaattgaagatgaatggaaaaattccccagtctactttattctacagatttggggttttaatttatgtaatgtgtgtggtctgaaaattgcaacgaaataattttaaagtggatctgggttggtagtgcttatgggagttaggcaaggaaaaatgcagattctctttagaatatcttcacctaggtcccaaaggattctcatagatagatttccaacaaatatgaggttataataaaaaatacaaatcacatatagaagtatggcaccatgaatgagaaaggaaaaaactgtcagaacaagaccctcaagactttactggaattaacaagcaatatgtaaagtaaatagaaataagctattcataataagaataatgtataagagactactaaaaataactgggcagatttgaaaataatctaagttctgggaatgaaaataataactgaaaaacagctgaaagagagaattaatgaactaaaagaaagttgtttagagattatccagaaattaggacaaatcatcataaagaaaatatgggtagaaaaggttaagatggaaggataaggcaagtgctaacatatgtccagaaggaaataatagaaaaaaatgtattaattcctccacactggtaaaagacatgatggctcagattcaggaaatgtaacacatctcaagcagaataaagggaaagaatttgacacctagtaagcacatcttagagaaattaaagactgccaaagacagagcagctgcggagaacagatcaattacctacccaggaaattatactgaaacagtaaaggcaagacttcaaaataccaagagaaaataattaactgtagtgaacagctaaactgtcttttaaaaacaagggcaaaataaagttatttcgagattaaatagaatttactaccaacagtcccttactgaagaaactaaaggcaatgattttcaaccctggctgtatgttagaatcatctggggaagcttttgaagtatactattcttgacatatagccctagaatttaattggtctgagatgggacctgggcattccaagtaatttgtgcagttaaggttgagaaccattgtttttttttttgtttgtttgttttttgagatggagttttgctcttgttgcccaggctggagtgcaatggcacgatcttggctcactgcaacctccgcctcccaggtttaagcgattctcctgcctcagcctcccgagtagctgggattacaggcatgtgccatcacgcttggctaattttgtatttttagttgagacggggtttctccatgttggtcaggctagtctcaaactcccgacctcaggtgatcacccgcctcggcctcccaaagtgctgggattacaggcgtgagccactgggcccggctgagaaccattgttttaaagaactgacttgaggagaagcagcaggatgccaggagaaagtcatgagatacaagaaggaatgctaagcaaggaaaatggtaaatgactaaaactgaaacaaacatggactgtataaaatgataaaaatgattataaaatcgagagtagaggtaaaaatgatatctacttgttcttgtttattagaaaatgtgtaacaatgtttagctgaagtaacatgtaagccacaaagggattgatttgagctaaggaattcaaagatgtctgtgttatttgccagaaggacagaagattgattatcttttaagtatccttgttaacacttaaggacaactactgcaagaatagaaatagaggatttaacttcaaaaccggtaaagaggaaataaatgagctgggagaaatcaccagttcaaaagacagcaagaaaggagtaagagtaaaaaatgggttaaatagataattacagaaaaagattgtagaatgaaattcaactatattgataacctataattaattaaaaggactataacattcctagttaagacatagacagtcaaactagattgaaaactaaaatctgcttagtatagaatagtagacatgaaaagtatagtctattcacaacaggcattactaatacctagggatagtaggagtgaaaattaaagaatggaaaaacatataccaggtaaataaaaaaaaagaaatggctaaagctatattaatttcagacaaaactgactttatggcaaaaagcattaagataatatttgactcagataaggtgcatcacttgctggtgacagggtactaaagcctgaatgtatgtaaatataatctgcatttcttatcctaagacttcttcatagtcctagccctcaggtgtgaatttctggcatagtgcatagcacacacaactcaaggagataccaaatacaatccactgctaaaaaccagtaaaatacataagatagtagtagataataaaagagtgaataccttatttcttaaaactgaaaaaatgcctctttggtttttctcagccacataccctattacagagagtcaaagcctgcacaacagaagaggatcaggagaagctgatgcaaattaccagtctgcattcactgaatgccttcttgctgccaattaaaactgtaggtgtgcaggtgagttgtgtgaattcattcaccagtgatatacttttttttttttttcttttcttgagacggagtctcactgtgttgcccaggctggagcgcagtggcgtgatctcagctcattgcaacctccgcctcctgggttcaagcactctttctactaatcttgaaataaggattacttaggaaaatgaaatatgtgagtatatataccaagtttagagaaataaggtaattttttatagaatgtttagggagtgaatagttaatggaactaaatagtcaggctgagattttgtagttttggaacatctatgaactctaaccaaaggtaaatattgaaagcaaccctttcctatagggttggcatgcttacttctgccttgtagggcagggatcaagaggtcatttatcctaggtgtgaaatatactgtggttttagaagtctttaactgcaggaaggcctccagatgagtaagttacaccatttaggtgttgttctcagcttgtgtattccctgtactagggaacacattctactgatgttgtgtttattctgcctttctagttgtaaaagaacatgagaataatatagttctcaattataaaatgctacttgcaaaatgactaataactaataagatagtatgttaatttctcctcttttttctggagacagggtcttgccctgtcgcccaggctggagtgcagtgatgtgatcatggcgtactgtagccctgaattcctgggttcaagcgaccctactacctcagcttcccaagtagctgggactacaggcaagcaccatcatgcctggctaatttttaaatttttttgtagagatagggtctccctgtgttgctcaggctggctttgaaattctggcctcaagtgatccttcactttggcctcccaaagtgttaggattggaagcatgagacactgtacccggccttctttatatgatcctcaaatgagtttttggggagcaaaagtgtgggagggtagggaagagaaaggttattttcttctatttcaagtttgtggttaaatggagacactagaagaggtgtcagtagttcaactcgaaaatggtataagtgccagttattgggttaatgtgtttataatgtcctcttacagtaaaattatgtgtagaatatacatatgtaactaacctgcacattgtgcacatgtaccctaaaacttaaagtataataataaaaaaataaaaaataaaaaaaaagaaattctgtttcagagattattcttctaaaacctaataagcattttttctaaatatatgaatctgtcagtttaaattcccctttgctctgaattcatgcagttctgcctgtaaataaaacaagataaaaattgattgttgccaggcgcagtggttcatgcctgtaatcccagcactttgggaggctgaggcaggcggatcacctgaggttggaagttcaagaccagcctgaccaacatgcagaaaccccatctctactaattagccgggtgtggtggtgcatgcctgtaatcccagctagtcgggaggctgaggcaggagaattgcttgaacccaggaggcggaggttgcggtgggccaagattgcgccattgcactccagcctgggcaacaagagtgaaactccttcttaaaaaaaaaaaaaaattgattgttatttttaaagtaaactaaaatattttatttcatgaaagtgatagagccagctattgggttaaggaactcttgccttctttttaaaggccaaatgttgtaagctgcttatgttgttttaaaatcactattgaaataaccttacttggagttactgatactttctttcagtggtttatggattatctcattcatacataaatttattttgaaatttgcaatgatacttacaggcagtattaccctaatatataaaaatagaattgtggacaggttatttaattcttaaaagtttctgagttttaagtagatttgttatagagaacttcaacgtctgtgtgctaactgctgctgcaaagggagttgaaatagttccccactcttctttttagagaagtgttacaaaaaatagatacttgagataatctgatgaatgagtgatttctttcttgaaaatgaaacttattcaggctctactacttttcccaccaaaataaaattttcttttgttattggataactgactttagtctcttaccctttgaagcttagacccttgcaagcccagataaaaatgatggttcatagttagtataacaatgcattttattttctaaataccaaagtaaaccgtatttgtaaaaaatgaaaatacattaaaaaaaattctttgtatttctactctccagttaagttttgtatgtgtctttccagaaacactttaaaaagaaaataaaagaggggatttggggtacacattgtcaacttttttcttttaactgaacatcatgaacttacctttctgtgcctttccaagtagatggttcttaactgttccctcatattctatgcataccatcatttatttaactattcttctaaccaatgggcatttaaactgttctgttttttattattataggcatcccatcagttatccatgtatttatgtaggatcattttatgtgcatgtgcattttacactttttttttttttttttttttttttgagatggagtcttgctctgtcacccaggctggagcacagtggcttgatctcagctcatggcaacctccacctaccaggttcaaacgattctcctgttgcagcctcctgtgtagctggggttacaggcacacgccgccatacctggataattttttgtattttagtagagacggggtttcaccacgttgcccaggttggtctcgaactcctgagctcaggcaatccacccgcctcggcctcccaaaagtgctaggattacaggcatgagctaccacgcccagcccattttacacttttatagatgctatcacattagcattcacatatgttgaattttcacattcttagtacctgccactttgggcattaggtacttctctaatctgttactttttaaaattgcttttcataaaaaaagcaaattacttggattaaacaggacacaggaaaagagaataaattatcagttttatttacttattttaaaattaactttttttttttattatactttaagttttagggtacatgtgcacattgtgcaggttagttacatatgtatacatgtgccatgctggtgcgccgcacccactaactcgtcatttagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccttacaaaggacatgaactcatcattttttatggctgcatagtattccatggtgtatatgtgccacattttcttaatccagtctgtcattgttggacatttgggttggttccaagtctttgctattgtgaataatgccgcaataaacatatgtgtgcatgtgtctttatagcagcatgatttatagtcgtttgggtatatacccagtaatgggatggctgggtcaaatggtatttctagctctagatccctgaggaatcgccacactgatttccacaatggttgaactagtttacagtcccaccaacagtgtaaaagtgttcctatttctccacatcctctccagcacctgttgtttcctgactttttaatgattgccattctaactggtgtgagatggtatctcatagtggttttgatttgcatttctctgatggccagtgatgatgagcattttttcatgtgttttttggctgcataaatgtcttcttttgagaagtattgatgggacatatctcaaaataataagagctatctatgacaaacccacagccaatatcatattgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaagttgtccctgtttgcagacaacatgattgtatatctagaaaaccccactgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcagtgccatccccatcaagctaccaatgactttcttcacagaattggaaaaaactaaagttcatatggaaccaaaaaagagcccgcatcgccaagtcaatcctaagccaaaagaacaaagctggaggcatcacactacctgacttcaaactatactacaacgctacagtaaccaaaacagcatggtactggtaccaaaacagagatatagatcaatggaacagaacagagccctcagaaataacgccacatacctacaactatctgatctttgacaaacctgagaaaaacaagcaatggggaaaggattccctatttaataaacggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaaaatggaagaaaattttcgcaacctacttatctgacaaagggctaatatccagaatctacagtgaactcaagcaaatttacaagaacaaaacaaacaaccccataaaattaacttttaagctgatacttaaacacgttgataagtaaatgtttatgaattgtttttgtctcccacttaagaattctttatccactcaaaaaacacgggcagatcttgtctgccaaattataatttttcataattttattttatttttttgagatggggtcttactctgttgcccaggctagagtacagtggcatgatcactgctcacgatagcctcgacctcgttgggctcaggtgatcctcctatctcagcttcctgagtagcagggactacaggtgcatgccaccacactgcccagctaatttttgtatattttgtagagacagggtgttgccatgttgtccaggctggtctcaaacttctgggctcaactgacccacccacctcggcctcccaaagtgctaggattataggtgtgagcttctgtacctggccttgtctgccaaattaaatatgctggttatccacagttgtgcaggtaatgggaatgttgaatactttttttttttttgagacagagtttcactctgtcacccaggctggagtgcagtgatacgatctctcagctcactgcaacctccacctcccaggatcaagcagttctcctgcctcagcctcccgagtagctgggactacaggttcatgccaccatgcctggctaatttttgtatttttagtagagatggggtttcatcatgttggccaggctggtcttgaactcatgacctcaggtgatctgcccacctcggcctcccaaagtgctgggattacaggcatgaaccactgtgcccagcctaaattcttgatattaccatgatactttatgtatgtcttagctgattcaggtaggatttaatatgggattttaatttggaatttatttataccattaaagaagcatttagtatatactttcattcaaaatttccaaaaatccattaataatgtcaccatgcataagatatttttcaatgcatcttttcttttttttttaaaaaaaaaaaaaagctttgtcaagttaaactggtgtatcttttgactattaaaaattattgattatctttttattttcagggtgactgtcgttcctacagttacgtgtgtggaatctccagtaaagatgaacctgactgggaatcacttatttttctggctaggcttatacctcgcatgtgtcacaacgttaacaggtgtgtttcacaggagctagggtgggggcttgtgtaatggaaggatgtatttcttaagggctttcaattaatggaagaccaaaaggctcaaatgtagatataggtaggtcatgtagataagagtaaatggctgtgtttgtaattcaaatatgcacataggttgcagttaagtagatatttaatattatcttgtgttttgactcttcatcacaatgtagtcatctgttaaaaattatttaaaggagaaagatttttattttagtgtaaaatattaaaggcagctgtaaaacatcttctaaattagtggtttatattagctgttggttttatggtaacatgttttattccagaaggattgaaaaaagtatgtccaggttacagaattacaaataaagtaacacacacacacacacacacacacacacacacacacacccctacaaaacaaacaacccccactccaaacaaaaatggagacttggttaatttagtagtaaccccaagggaaaaaaatcaaagaaaagaaataggcatgtgccagatagcattaaaatagttacatttaaatatataatttacatttagattaatttccctttaatttgcatattaacttcttacattggatatatcaacagctgatttataatctatttctaatcctcaatttcatcgtaccatatatagttcaaaaattcacttattttgtactagattgctaattaaatgttcttacttcacagttattctctctgttcagttttcttcatgggtgttaggcagttaacaaccaaaaagaattacttgaggtttcattttactcaaattgctgcagaaatcagaagcttaccttttaatgttaagctagcagagtctgtatagttcgagataaggagttacagggaagccatgtttttaccgatgggaacatgctcattcaaaggcttactcaaatgaactgaaaaccgtcaaatacagaagcatctttaaaatgctgaaaaatagaattattactatcttcaataatgggggccaggcatggtggctcacgcctgtaatcccaccactttgagaggccaaggcgagtggatcacttgagcccaggagtttgagaccagcctgggcaacatggtgaaactccatctctacaaaaaatacaaaaattagccaggcatggtggtgtgtgcctgtagtcccagctactcgggaggctgaggcagaagaatggtgtgaacccgggagacagagcttgcagtgagctgagattgcaccactgcactcaagcctgggcgacagagcgagacttcatctcaaaaaaaggaaaaagaaaaaaaaaagaatcttggtgaactttagatttatttgctggggtctttttgatgaattggagtttaaaaatattcttccctgtttgccggtttttttcctaatttggataagggaatctttgtacagggagggactgttccagttttactgtcatatatagtgtggataaatacctgtcccagtacactctagtgattacttttgtttgtaagaaatgagaaggtgaaaagagcaggttcatggcattctcttaactttctcctgtaaagatcttttatgaactttaggaactgtattgtttagaaaaattataacttactgtctatacgtgggacaaaaaccttgcttctgttgtagtatgtttggaaggagacaataaagtagttggtgataccggtggttttgtgctaatatggttttctattgtgtattttacctaagtacatattaagaaaagaagaaaaaacattaaactttaccatgatagtttccggggagatttattttctttgctaaaaacaggactaacgaaaagtgaatagggagaactagctaagtggcactcatatctctaccctgattccctcttgttttctgggtgaagattgtgaaacagatcccttcaaaccagtggccagctacacttcaagttgttaaaattgtctgattctaatttcctcaagttatgttccaaactgtactctcattaactcaagatatttgtggtgtatcttcatgtctttcaaacagacatttatataaaacactaatgaatcatttttttggaaggaagtagtaggatactaagtcctatttcaatggcctttttaatgaagtgcaaatgagaatctctctagaatgattgtttctcaagtagagaaaaaaagatgagtttactaattttgggaaattcactgtagtttcctcttggagatttccagtgcatgttagcatagtatattaatagtttctgaagtcttgtcataaagacacctatttttaaattttaattgtgtatttgtttcctaggactacccataacaaatcaccacaaactaggaggcttaaaacaacagacatttattctctcacagtttaggaggccagaagtctgaattcagtgttggcagggtcatattctctctgaagactctaggggaggatccttccttgcttcttcctactatcgagtggtggcagcatagtccagtctgtctttgtgttcacatgaccctcattcccctgtgggtatctgtgtatccaaatttcccagcacttggaaggataccagtcattggattagagcccatcctaatccagtattacttcattttaacttgattacatttgcaaagaccctttttctccccagagattctgggtgggcatgaagttttggggatactcttcgacccagtacattaagtgaaaagagagttgtaataatcacttatatctttgcacattctgagatacagaatattccagagaacacactttgaggaaaacacgtagaacacagaccttcctataatcttatatcttgtcctatccatctggggagttgaagtgggcaggagaagggcctgaaactaagtgggaaatggaaagaatgttactgttctaagtgccttgcttctcatactaaaatgtaatttctacatttgaaatgtaattgctgtattatttttacctctttgtttccagagttgtttatatatttggcccaccagttaaagaacctcctacagatgttactcccactttcttgacaacaggggtgctcagtactttacgccaagctgattttgaggcccataacattctcagggagtctggtaagttgctcatgtttttgattactaccctctgaaactagtttttggaagcttgatattaagagtaggaggatgtggcttttgctttttagatgcttttgtttttattatttaaatctttgaatgttctatgatgttgcttttttttcttgagacggagtctgtcttgctctgtcgcccaggctggagtgcagtggcacaatcttggttcacttcagcctctgcctcctgttacaagtgattctcctgcctcagcctcccgagtagctgggattacaggcacccgccaccacacctggctagttttttgtatttttagtagagatagggttttgccattttggccagctgatctcgaactcctaacctcatgtgatcaggtcaggagtcaggtcaggccagccttggcctcccagagtgttgggattacaggcgtgagccactgcacctggcctataatgttgcttctaaataaaatatattcccctttgtggccatttgtggacatgcacagagcagcagaaaatttgaatttccagacttagatgttcccagctgagtttgaacaaggtgacgctatgccttcttgttttcagctctcataatgtgaacaagtctttttcatggtctccttgatgctatatcttttgcatttttatgtcttttgttggtgattttgctgtttaaaatggatctcaactatagtgttgaagtgctgtctgggttcctaagcacaggaatgctgtgatgtaccttacagagaaaatctgtgtgttagataaacttcattcaggcatgagttaaagagctactgattgtcagttcagtgttaatgaatctataataaatattaaatacagtgtcttaaatcagaaacacataaaacaaggttatatattaatcagttgatgaaaatattacaaccagaggcttgcaggaacctaaccctccatttcccctgggagaaatggttcagtattcgctaattcgttgtttgcagtgtagaatataactatactgcaaattataatagagaataatgagactggactgtttctgtttacagcacatcagtgaaacatcactgatgtgatcaaattctgttttttgcatttgtgattaagtccatttaaaatgctctgcgagtagctgaaatcaatgcatgatgacagtcttaactacgctgtgtgtgtatatgtgatttcagatattgcctgggaggatttaattgaactgagttagagtgcttttctatggtgtggtgattggttctacatatacctttctctagggtatgctgggaaaatcagccagatgccggtgattttgacaccattacattttgatcgggacccacttcaaaagcagccttcatgccagagatctgtggttattcgaacctttattactagtgacttcatgactggtatacctgcaacacctggcaatgagatccctgtagaggtaatttatatatttttttctaatgcacgttctcagtacctcttacattttataatatggtgaatggaataggctatgccagtgctgtatttcttatgttggttttctgttcataagataggctttttttttaaaattttcacatatttgattaatacactggggcagaaaaaggctttaaattatatatgctctccaattgtgtgattactgtataaaaagtaattgattataattttatctaatcctgccaatttctactttacaaacagtattccccaaataaaaaagaaaactctaggagtgaagaagagtttgttagaaataaggatgcaatttgatagctttatggccagacacccaagaattgcctaaatgttctccctactaccaattccaactcaatttttgatccttctttgtcttcaccagaacattccaaaggagctacttgcataatagcaagtgaaaatcaaagtgagactctattagttgggccactgcctccagtgcactaacacgaggctgtcgtgatagctaggtagatgggttggttcggaacgtggcttagagtcatttttctcttaggctcaaatttgtcaaatttgacaagtgagcaggctatcctctcctgtatacttgataatgattattacagtgtactctgtgccaccttggtggcccttagagttgtatgtttaagctgcagataatttgcagagcattggctgaaacacataaaatcacatgcttggatgccacagcaatgtcaaatcgctatatgttcttaagcacttgtggctcagtcacaaacacaacttgcagactagcacctgtttgtggatcacactttgagtagtactgagtttaagtcactaatattttaaaccttaataacttacacctatccctgcagaggggaataggttcattatataagattaatcagaaaccatcccatatacatggaggacaatagtgaaaatagtcaaattttaatttcaaattacaaatgtaagccctctaggactgctggacatgcagtggatgctgacttttctctataattttttttaataggtggtattaaagatggtcactgagattaagaagattcctggtatttctcgaattatgtatgacttaacatcaaagcccccaggaactactgagtgggagtaataaacttcttgttctattaaagtaccgtgtgcagtttaaattgattagaaatcattcccattattgacatgcagtactgtgaaaagagttactggagcagctacatcacatctgagttctccacagcaaaaatctacggcttaagagctgagttggggataaccaaaagggactgaagagtttgtacgggtaaataatcaaagcaccattgcctacactcagacagattgatactgcttttgcctttgcctcacttattctttatgtataaattcactgttgatgtctctgtgaatatgtatgaaggtgggtgaatttgggggtaattatgggcttctgtctccttaccagtttctaagaactgttagaaacgcccattatttaccagtgttacttactacttatatatactttttggagaatcagttttcttataagtaatcttatttctccaaagggtgaaaaagagatgaacatatcagataaaggtataggtgggctattccagccacttttgaaggacactgagggtataaaatgtaagctaccataagatggaaaagcaccaggaatttgttgatgtacttttgaattttatttcacagccttgggaggaagaaactatgagtggtctcagatgtctatgaatggtcttaaaatgttttcaaaccatgttccacatagatgccatgttattcaatgtcagcttgtttattagtaaggagctttatcctcctagccttatattaccagccccccacagccttgcatagaaagtttctgttatctccttagaagaaactggctcaatgacgtttctggtgtagtgcagatagaggtcaagaggagcattttcatctcttcttttgctggtcagagaaacggttctgagatcacagaagctatgatgcatacctacagcttacaaaagggagaggaaaaatgtttatatcatctagtaaacagtagtaaaaggagcttttaaatctaatctatagcacatattattcattgctcagacacctgagaacagtcttgatacatgcaagaggtttgccaaactttgtaatcctttctactacctataagagaggatctaagatctggggtaggactggttgccatcaccaccggggggtaacagaccttttataacattcgcagcacatactggagacaggggagaccaaacctgtccgatacctctgggttgttagctcagaaagaaaaaagattggctttaaacaaagcactttcaaaatgcggcgtgttgcatagcttaaaacacgggagctttggcgtaagaacacaagtttacttggagctcgggggggggcaaccacgggggcgagggtgaaagaagccccctttagcttggggggggcgcgggaccccnnnnnnnnnnnnnnnnnnnnatcatgcaggattgtttgccaaacctttgtaatcctttctactagctataagagaggatttaagaactggtgtaggacttgttggcatccccaccagtttctaacagatcttttataacattcacataagtactgtagacagtagtagacttaaactctccgtttctctcagtattttagctaagaatgttaccatatttttctcttaacaattccatctcaggttgctgctgcttgtctagtttaaaaggtcagatctattaatcaggaatgaaattttatttgggattcagtgttagacaaacaacaaaatgatgcgtggcagaagtcatctttttattctggctggtccagggaacaagaaaactgctgctggaccagcaagggaagagtttctgtctgtcttaacagaaatctgtccccaagacaaaggggtacttgactcctacaaaacttaaagggtacattctctatctgatgaggaggtactcattatggccttctggaaagaggctatgttagtgatctggtctttacagatttagagtcatgttatttgaaagctagaatagacaacctataaaat

SEQ ID NO: 15418 - DNA, 22368 bp, Human
gctctgcctataagtagctgaatgtcttgaggcaacttcaacgtttccctggaccttagattccttgcctgtaaaacagcatggggccagatgatctctaagggtccttctggctctgaaggcaatgatctggggcatggaacctgtagttagagagctgggaaatgggcagatgtgggctccagggcacccagaattgcaggcttaggagctaacagcaaccaggattctgtagtctagcaatcttgctttacaggtgaggaaactgggcctagaaaggcgaagtgatttttttgcctctctcagctttattcctcttttcctctgaactgtagagtctaaagattcagcacaaagcagttttgtgtagtggatacataagcttttttgttgttatttttctgaattattttgttgactttcaaagttttttttacataaacagtaaatgctcgttataaaaatttccattaatacaggaagtgaaaaaagtaaaaaactgcaaattgctgttatcctcccacccttaccccctaggtccccagaggtgtctctgttaacagttcagcgtgtatccatcctgactcctccaataaatgcagaaacttgtatgtctctccccgacaactggattatcatatacattattcaagcataggctttagactcagacatatctacatctaatcccagcttatagctaattatttgagtgaccttggccaagttgttcatccagttttagtctcaatctccccatgtgtaaaatgaaaataataatagtatctacctggcctggcgtggcggcttatgcctataatcccagccctttggaagaccgaggctagtggatcccttgagctcaggagttcaagaccaacctgggcaatttagcaagacctcatctctactgaaaaacaaaaaacaaaaaaactcccccaaaattagccaagtgtgctggtgtgcacctgtagtcccagctactcggaaggctgaggtgggagaatcgcttgagccaggaaagacgaggctgcagtgagctgtgattgcaccactgcactgcaacctgagcaacagagcgataccttgtttctgttaaaacaaacaaacaaacaaaatagtatctaccttataggatcatggtgaagatttaatgagattttatatgaatagcacttaacagttcctggtactgatagtagtaagcactacacacacacacaccacacacacacacacacagagcacagaatgagttagaggtaaagtgaaaactaaaccccaagttttctgaccctcagtctcctcgactttctaccacatctctctgcttctctcctaggtgcctaggcatgggttcagtgctcactacttgttgaatgaatgactgaggttgtgtgtaagggggtagatctagggatctgaggtctgtggagttcctgggatgcctgctctggaaaatggaggctttcatcctgtgagttgggagggtgtggggcagtgtgggttggctggaccagctgttgcttcagagctccatgcctggagagttgggcctctaggcagagctgagggcccagagtggctctcagcttaaaggatcttggcttagaaggaatgtgcagtgggctgcctctgctcgggaggggctaaaaaaagcctcaccctcccctgggctttgtgtgaggcttatcaactgctcaagtcagctcatctctctggctgctccggcatatttgagaaggtctgtttccctggtccttctgggtttccaccaattggcaagaagggatcagcctgtcctagaggtgaagagagagctgtggcatgaaggggagggggctggtggccccaaacctggtgacaatacacagttgtcagctgtaccctgctggcgtttcttccttttatagtcagcagcagttgctcttgctttcacccagcccctctgtgggggctcctgcccaggataaaagggaagggaggcagcccaggctcctatctcatctcccagacgccacgtctctcggtttcttcttagatcactcctctgccaaagatcccaacaagacaacatggctcccaagaagcctgagcctaagaaggaggcagccaagccagctccagctccagctccagcccctgcaccagcccctgccccagctcctgaggctcccaaggaacctgcctttgaccccaagagtgtaaaggtaagtgaggctcagccattgggatagaggtggggatgacattgagagtccttttgctctggagcttagcgatctactttatgtgggctggactgggatgaggactagggtgtccatgccccagatcgcagtcccatggggcagtggagtgggtgttggggctgatgagggggagattgagtcataaaccttttccgtcaagaatgaggtgctgctttgagggagccctgtcctgctaccctagatttgtgcagctaagttgggaatggggggaggtacaaccaaccatccatccacccttttataaggcattatgaggaccaccatagcaaagtaaaacagactagccttttcctaggaggtagtgggatatctttatggagaacagacagatcatggcagctgccagtgtaacttggagtaagtgatataaacagtcagggaatatcctccctgtgcatggcagtttgggaaaggcttcactcacaaacactcttacggcaggtgagggcagggtgggaaggaggttgtggttaaggtaagaggagcccggattcctctctctctttccttacccagacgggcctttccttctgtggccttagcctgggttcctatctgtagcatgcagaggactggcccaccctgggctgagaccctctctccaaccgggtcaggaagctgggcctggttcctttgccccaccctgctctcctcacacaaaacattcctctccctggagctggtgtgggccctgcatgctgactcagtcattttagacctcccagctctctggcccagctgctgaaggaatggaactggtgggagaggggtgggctgaagagggagggggccagagacctctgaagaggagcagttttaagccttggcaccagagtggaaaaggtcaagtggctactggtatgaagagctattaataacaggttgggagtgctgagcccccagggatctcagccttaggacagggctgggggtggtgagggatcaggtcaaaataagagcacaggacaaggttctgtgacaagcaggcagggaaattaaaacccagagctctaattgtatgacctccctgccctctgagaattcctctcatacccacagccgggataaccctacaagtattatgccaaagacccagtccccgcaagggacaggagttaaggtggaactgcttagccaagagatggaggcaattgtcccttttctgagcttggttatggctcactctggggaaactgaggctactgtaggaccctgaaaacacctgcaggttttctaggtcatacatcactccatttacaagctgagcctggcaggaaaagctgactatttcacccttcaggatccctcctcgcctttatttctgatttgttcccataaagcactgtgcctttgggtgggttgccaggccttgtccctggtgtctgggcaacagctgcctagtggcatcaaactggtgtccttcccttggcctgtcacttctttcattcactctcctctctcaatttctcacccgtgagaaattgcacccctggttgcaatcctcttttccatatctgcatcttcatgggggttgttgaagttgctttgaagtagaaaaaaaataggtatcttttatgagagacattttccctattattgtgttatacttacccagttcctttgattagaaggttctttactccaagacagaagagaagccagatgaggtgattcatgtttataatcccagccctttgggaggctgaggcgggagggtaatttgaggccaggcatttgagtccagcctgggcaacatggcaagatccttgtctctacaaataaataaataaattataaaaaagattcgaagatataacagaagcaaacttaagcccagtgtgtgtagttatgaccacgtctattgagattttaagtttttacattaattgctcttacatgtttattcctggttcttaaagcattgtaaagtaaggcaaactgtgccttttcctcagagagtgaatgcagagcatccttcaccccatctagggggttcctttaactttctgaccaccccctacttttggcagtctattcctagccacaactagttttctttccaacccagttaactccccactgccccaacctatccccagctcatggctgccatatctgggtcctcatgaatggaggtcagttctcggagatgagacaggatgggcacagcacaagcagcagcagaattaggactaggaatgacggcacttgaagaagaggctccaggattggaaccaccaccagtggagaggggatgggatgggatggggtggggtggggtgcataaggaccacgaggtaacatacaagatcttaaatcaaaatgatgacttgggctgggtgtggtggctcacgcctgtaatctcagcactttgggaggtcgaggcaggtggatcacctgaggtcaggagttcgaggccagcctagccaacatggtgaaaccctgtctctactaaaaatacaaaaattagctgggcgttatggcgggtgcctgtaatctcagctactgaggcagaagaatcgcttgaacttgggaggcgaaggtcgcagtgagccaagatcacaccattgcactccagcctgggtgacaagtgcgaaactccatctcaaaaaataagaataaaaaataaaataaaatgatgacttatgcttggccattgtcattcactctcctcttctgtactcagcattaaattactatgcattatatgggggaaatctaaaatgtattacttcattcaacaaatgtttttcagtgcctactatgtactgagcatttcagtgaacaataacaagaatccttgcctgagggagcagtggcttcaaggagacagagtgcacgtaaaggcatgactggaaacaattaggaagcgtggagggcccatgccaattgctcttgctgtcccagagtgcctaagagtgtgtcagaagacaaaattagaaggcattttagtttaaagatctgaattggcttttatgtttgagtctagaatctggcaacaatgagccgagcagaggaggtggtattatagacaaagaaaggctgaggtaagcagaaatgagagcaaaatgcaaattgttcattgcaaagttacttttcttgtaaaggttaaagcagatggcactttcttatcaagctggctgaaactgtcatgtttggggatttggctattatctcttattttcctgatttcttggaaaatcagatgaacaacttagtttcagcttggtgacatggaacttcagcatgagtgaatctattttggtttggtctgttggtcctagtgtaggagctcagtacaaaccaacggcctcttataaattgtacttaacgagggatatgtgctgaaggaggggttggagtgggatgcggtgtgggaagccttcattgaagggagtggatttaaaatcagaatcaaatagaaagagcagtccgagtgtggggagtggtggtgcccaaagagggcagaagtgcagcttgtcagaggactatggactaggaagagattgaaggggcaacagtgagggcagtttgtgggtggctaggatgaagaatttacctcagacccggaggcattacaataggcagtccgtgtacgttctagaattatccagggaatttttctttccctttcgctcttacctggagccatcacttaataagcggtattgagagagctttggagtctgcattacagttgtccctcgttatctgtaggggattagttccaggacccccacggataccaaaatctgaggatgctcaagtctcctatataaagtttgcatatttgcatataatctacacacaacctcctgtataatttaaatcatctctaggttacttataatacctagtacaatgtgaatactatgtgatagttgttatgtattttttgtattatattttattttcgtgtggttatttattgttttctgaatattttcaatccagagttggttgaacctggggaggagggccgacggtattttatagcctgtcagttgtggctcattcatcaggagacttgtgttttacccttagcacaagtcaccttccctgcttatcagtggcctgctggaggtggccatactgcattggaagccacttctgcttctacttccctttgggggcctttacaactgcttttagcaatccaagccctcactactatttccctccctacagatagacttcactgccgaccagattgaaggtgagtatggacaaccccacctctccgtctctattgcactttcctggaggaggaggaggaggaggaagaagaggaggagtagttgtcctcatggtaatagtaatcactgtcatcatcatagcaaacctatattgagcatctaccatgtgtcaggcatagtcctaggcactttatatggattaactcctttaattctcataacaacaccatgaggtagaaattgttacctcccccattttacaagtgataaactgagacacatagagattgggtgacttgcccagtctcacatggcagtcagcagtagagctaagattcaaactcaggcaatctgattccagatctgtttcctcaactactctgccagactgcttggagcatagtagatgcttaacaaaagttagtgcctttttttcttggccccaaagatctatctaagatatttggaagccctcatttctgttcccattattggaaagccctccttagtttaccagcttcccctcttcccaccatgaagtctgccaatatgctaacccactaatggtggcagggccaatgaaatgttttatcatgtgatgctctgtgtccccagctgtaaagcaggactcaatgtcattgcagcgtatccctctgtttcctccaccaaacgcctctaggacataaaattataggaattggaagggaccttgaaaaatcacctaatccaaccccctcattttaagcacatactctcttttaaaacttaaatgaatatttgcacatggtaaaacaaaaaagcaaaaaagcacacacatattacttaaaagtaaataataaaaaataaaaatcctttttttccatgctgattcctctcccaaagacaaccactgtgaacaggtgtttatgtatcctttcagaaaaatatataatgatacacaagtttgtgtgtatgtatgagtgtatacagtttatacaaatcaagccgtgtgatacacactgtccaccttttattaaatatatacttggatttaataatatacagtatttggatatcttttcaaaattaacacaaacagttctacctcattcttttaaacaattatatagactctcacacacagatgtacccttttaatttaatcaagactatattgataggctttcagattgtttccggtgggaggatatcagctttctttcgcctgtggccttcctagcagggtttaaaggatggtgcattttaaattataatggttattgccaggttgctctccaaaaaagtgacaccagtttacccacaaatggagcatgagagctggcatatgcattttgaaactagtgaattgagcctgactctgttttcataatactcagtggatactcacttgcagcattaatttcaatgcattttagttaaatatatacttacgtggatatagaaacacaatgacactagtgaggactggaaaatcaactaatgatttaaaattttaatttcccaaatggccaactggaacagatggttatctcttctctcctgaagactttcagggctgatggggaggggacaactcattctgatcttttatccctctgactttgaagacatttttccttctgttgaatcagaattgtttttcctttaattttaccccagcgatcttttcatttgttttttggtgaagattataatggttttctcattgtcatcttggttatggtggaaagaacataatttggaattaggagactttcgtattagccctaattcttccattattggccatgagacttcggacaagtcacttctttaaatcttaattttcttatccacaaagtgagggtatttgggtttcaattcagaaattctagtccattcagcatcctctagatatcctccatctatttggagatagttttcaaatccctcctaagatttatattctctaggtgatatgcctcaatttattttattttattttatcattttattttatcttgagacaaggtcttgctctctcacctaggctggagtgcaatggtgctatcatagctcacgataaccttgaattcctggttttaagcaatcctttcacctcagtctcctgagtagcttgtactacaggcatgtaccattgtttttatgttttgtagagatgggggtctcgctattttgcccagactggactccaactcctggcctcaagcaatcctcccaccttggcctcccacagtgctgggattataggcattaagtcactgtgcctggcctcccaatttcttttgtgctttttttttttttccccctcataggaattagcttctaacccttggcttgcttctcatccctctccagacttctgtattcttttagagaggggttactaccactggactcattgctctagtaagcaggtgaccacactactgcagattattgaggaaaggtctcttctggacccttgaacatcacctctaatacctgaagttcacactggctttttttttttttttctagttgtagtcctaaacttcagtgtttgatttttttatgtgcataccaggcttcccagcaggccaggtgattggttggagcattagcagttataacaagcaggtctccttctcttcctccttcctccccatcatttccttggtttgcttaatagttgatcataagtcatatctacattggcttttacatgaggataataatacctatagcatatattttttcataaagattaataaagtgttctatgcaaaattatttgctcagatcctggttcatggtaagtgctcaaattataggtcattgttcttattaccttcctcttcaggtttcaccctcttattaagcatcatgacatcttttttttctttttcttttttttttttttttgagacagagttttgcgcttgttgcccaggctggagtgcaatggtgtgatctctgctcaccgcaacctccgcctcccgggttcaagcaattctcctgcctcagcctcctgagtagctgggattgcaggcatgcatcaccacgctcagataattttgtattttttatatagatggggtttctccatgttggtcaggctggtctcaaactcccaacctcaggtgatctgcccgccttggcctcccaaagtactgggattacaggcgtgagccactgtgcctggcacatcattacatcttcttttgaggagacttcctcttttgttaaacttgacctcactcttctgaatgaactaggagatcaaaaagtctgacttcagattcaactaacaaatatgtatttatcaagcactgaatttgtgccagacaccatgctaattgttttaaaggtaaaaaagattaaatcctgcctgggtgcggtggctcatacctgtaatctcagcactttgggaggctgaggcaggtggatcacttgaggtcatgagttggagaccagcctggccaacgtggtgaaaccccacctctaccaagagtataaaaaattagctgggggtggtggcacgcacctgtaatcccagctactcgagaggctgaggcaggagaattgcttgaacctgggaggtggaggttgcagtgagctgagattgtgccactgtactccagcccaggtgacagagcaagactttgtctccaaaaaaaaaaaagattacatccttataacaaggctatgaggtaggtgttatttcctttttacaaagcaggaaaccaaagttcagcaaagttaaatgatttggccaagatcacatggttaagtgatccaaattaggattaaactcaataagataatactagcagcattgtttatgcatttactatgtgctggtcattgtgttaaaaatttttacatacattattgtatttatatacctagtatatttacatacattattatattaatttgaatgtaatttaagaaacctatgatagctgggtggagtgactcacacctgtaatcccagcactttgggaggccgacgtgggctgatcacctgaggttgggagttcgagaccagcctgaccaacatggagaaaccccgtctctactaaaaatacataattagcctggcgtggtggcgcatgcctgtaatgcctgtaatcctagctactcaggaggctgaggcaggagaatcgcttgaaccgggaggcggaggttgcagtgagccgaaatcgcgacattgcactccagcctgggcaacaagagtgaaactccatctcaaaaaaaaaaaaaaaacaaaaaactaactaaaaagaaacctatgatgtaggtaccatttatagaagaggtttttagaggttaaatatttatttgtccaaagtcaagcaatgggaatgaaatttgaactcgattattcagtaatgtgaaagaaatgtggttttatgtcttttaaattcatataaagccgaagaaagagttggaagtaaaggtctggggaatcttctgtgatatgtggaatgatttgtaaataatccatacgcagcctcgaaggaaagaagtacttggaaaggatgaaaactggctttttttcctaagtagttcatgaattcttttttggcttatactgttcatctgcttagtaaagcacttctttgtgggtagcataaggtaacttaaatgcccctcccaggccaaattacctccactaatgaattggttgaatcccaatcaatgaagaattgggcccgggtatgatggctcacacctgtcatcccagcactagggaggccaaggcagatggatcacttgaggccaggaatttgagaccagcctggccaacatggtgaaaccctgtctctgctaaaatacaaaaattagccaggtgtcgtggtggtgggcgcctgtagtcccagctactcggaggctgaggcacaggaattgcttgaatctgggaggcggaggttgcagtgaactgagatcacaccactgtactccagcctgggtgacagagcgagactctgtctcaaacaaaaacaaaaacaaaaccaaaacaaatcaatgaagagttaaggttctttgaaaaagggaccaggagtgccttcctttggtcttgctgcagggatacttgccctgctgccttcaaggagtccagtccctgtggttctgagctggtaagtaggaaagagaactaggaaacagctgtaaccacaatttgtcgattcccttaccatatgctgaacattgcttggcgtgctttgtgatcccacctgcaacccactcaagtgatcattgtatctccacttagagctaggaaaatgagggcccacaggggttaatagtttgcccaaggctgtatgcgagtccatggcagagctggggtggtctgaccattgccttatctggcctgggggccgcctttcagcctggaacaggcagtactgataacagctgactttccagcggtcttatcactttgtaaagtgcttccacacactgcgacctccctttgctctcacagtgacaggcccagggagtggggtgtagttgtcactccctttgtgtgcacatgaagctgagacccagcccagcttatcctgcactctgaggcagagccaagatgagaatttaggaatcctcacttctgggccagtgctgttttcacttgtctgtcatttcaggagtcaggaacctcacctacaccagagcgggatgtgtgggtgggaggggtggaggccagggagacatctgaattttttttttgtttcaagatggagtttcactctgtcacccaggctggagtgcagtggtgcgatcttggctgactgcaacctctgcctcccgagctcaagcgattctcgggccgcagcctcccaacattggaattttataacaacgaagcaatagaagagatcccagtcccagccctggaatgggtcgtggaggcaccaggctgcttctttggttgacagaagatgggatgaggacgggttcgagggacggcctgggataatggacaaagcgaaatattgggatattttaacaaccacactcacctgctattcagcttgggtggaggctgattggccaccagccaccaccttcactggggattggaaggtatagctgggtcttctctccacagagttcaaagaggccttttcattgtttgaccggaccccgactggagagatgaagatcacctacggccagtgcggggatgtactgcgggccctgggccagaaccctaccaatgccgaggtgctgcgtgtgctgggcaagcccaagcctgaaggtcagtgcggctgcatggcagacctctcccagggtcaggcttgcagccccttggcttcctccttgtccagatcttctctgccatctgcactctctcttctcctgctttagcccctcaggaccagcctcacctacccagcttaccctagtcccattttgagaatttatctagacgtccccgtacttaagtgacccttgaggaatgtagcctgggcttgtttccctcacgaggttgggagctcctgtggggcatgagccacattctgttgcctcagtgtctgaggaaggctgagtgggaatctggaaatctgataactgatggttcccactccccagcccaggagctctcaggaggggcatctgtcacagcaccgaggtatcctgtggtggccatcgcgagctgtattacaaacaatttgtttctaataatggttagagtactgacgtttgcaaattgtttggtataaattagagcagcttcaagattcttagctctacgtgctgcctctttcattcatttgcatttcaataggttttggtgagtgagtgtttagaatggtgagtaagtgtttagaaagtggtgcaaacgattcttttgtggctcctaagtgtgatcattgagtgttcatactcatgtgagctgtgcctctgtcaatcattacggcagatgagaagaggtgtgagggagtgtgtcctgtttgtgaatgttgtctgtcatgtgtgccagtcaagttaacagctgctctaaaacacacacacatgcttctcctcagtggtgttggcacggggtttggggtggggtgagcctctcagcaagggtggtctgtctctggaggcttcctgggccccatagtggtttcctccccatcccttggttctggcccgtcccccttctcctctggctgaaggtaaccgcgggggtgaaggatgtgggcaggaaaggaccagagggctaggggcttgcatctcagaagtcagaagcaagtcctgtgtgcttataaaagaaagaaatgcccacatttgtgatatttaaaaatagtttgcctctattaaattaaagccttttaaatacactaccatgtgggagaagtatgctattcacaagagaactgtgaatttataagaattattgattcagagtagcttcaagctgtgtggtctagtgatgggaccccatgcagagtgatgcaaacgttgcttttttcaatcctgttggtttgcccctgtgattataggtctgtcacgtcaagggtctaaactgagtgtgaggcccgggccgcgtggcacttcagacccctcacatcctgctgctgccaccctcagctcctccgcttggctggccacctggtgcttagaggtctgggtggagggctcctttttccttccatcctactgctttcactgagaaaagagggcccctgagaccatctccccagctcccagtcccctaccttgcttggatgggaagctctgtgtcctctaggagcactaatgggtgtaccacccagaattggctgcagcccaagccctgggtgctgtcagacttggggtgaggccccctcttgaccctctgctcccttgagcacctgctcacattgatttctctttctttaccctgcctgcctgaagagatgaatgtcaagatgctggactttgagacgttcttgcccatcctgcagcacatttcccgcaacaaggagcagggcacctatgaggacttcgtggagggcctgcgtgtctttgacaaggagagcaatggcacggtcatgggtgctgagcttcggcacgtccttgccaccctgggtatgccagctgggcagagatgaagaccaagtgggaggaatggaggggtgggaggtgccaaggtgacatatgctggttgggtggggggtggtatacaagggtctttgcatcctgaggataatgacctgatccaggccctgtctccctgggctctgcaagaacaaccattcccagttgggtttgctcagcaggtaccagggtttgggagaggaggggagagcaggttggcagagcagggcttactactgaggcctgagaggtgggactcagggcttctgtccttgtctttgcctgaaacactgaggctctggaagctgtaaggcagagggggaggcttcggagactaggcaagacctttagacccttggccgcacccttcagaacctctgggagaggcttggtttgaaccacctcccagatccaggcagtcttggaccttcacacttaagggggtacttgggtattgccagttcctcctttgccatctgtaattaagagcgcaccacctcccaaacccaccgcaggagagaagatgactgaggctgaagtggagcagctgttagctgggcaagaggatgccaatggctgcatcaattatgaaggtattaagccgcgccttgcatcccagggcagccagggatggtaggatgggaacagcttgggtggggtgggcccaggagctggagggtatgtgtctgaggtgggtttttgtagaccccccattggatgttgttctgttccatcttgtgagtgaacctcctagtgtaatggcgggagcatggattttggagatagctctgtgatatattagctggtgggcttgattaagtcactgattttctctgagcctcagttttctcatctgagggatgggggtgatgctggcacctttctcaaggctgtggggattcatagagataatgtagttcattccatttgtgttgagaatcagcatagagagtgggcacagagcagagtctaggtatctgccctccatccaccttctccccaccaacccccaaataagagcaggaactacacagtctggagaaaggggagcaggagggttagaagtcaggcagtgtagagaagggacaagtggtttatgggcctagaggcgctgagccacatggtggctgattttcacttttttcctagcctttgtcaagcacatcatgtcagggtgaagcagagtcttccaggtgagtgcagcctctccctcctggtcccttccggggtcacatagggccttaagaataacaccatgtgccctagaaggcatctgtcccagccctgaccccttaagaggaaacctcttgggatcaggaagtgaggacagccctgctcactcaccatctcctgtctcctgcctgcccttgcctgttcaccctgtcttgaccctatcagtcacatcctcttgcctctcccaggatctctcaaggcaatgcccttccctcaggcctggggcctcctgtacaggctcctgggagtgagaaagccgatcccaagtggaagagaaggtccctggcctgtgctcttgaccccgttcttcctcacttctttccctaggttttccctgggatccccctgggtgtggtaaggggctgggtctaggagggtgaaatgccctttcctcctagcactttctttcaggtgcctggcccttggctttagccataccagggtgagttaaagagaggccccggctgggtgagctgagatggagtcctcgacttatcaccacaccactgccccaaggaccttacaggccctccctgttaataaacagctctaacacggccaggctgggctctgggattctgaccagtctctgttttgtttgtttttttaaaactaattaacgaattgcattggtttgcgttgtgtgtgtgtgtgtgagagagagagagataaagtcacctgaggcctcatgtgtgctcagagaaatgagtagtatctgggagctaggagacaaggacaaaagcctgtggatctagagatattggggtcagacccaggagagcaagctctggaaggccagcagcttgaggagttgtcacctggaggagttttattccctttgggctcaccctctacctaatcacacctccagatggcaggcagagaggggccaggctgaggcagggactcctcctttggtccttgctcttgctgcttttaaacaaaaattgttgtaaaatacacataacatgaaatttaccatcttaaccatttttaagcatacaagtcagtagagtgaggtatattcacattgttgtgtaactgtattagtctcttttcatgctactgataaagacatacctgaaactgggaagaaaaagaggtttaatggatttacagttccacatggctggggaggcctcacaatcatggcggaaggcaaggaggagcaaaggcacatcttacatggatggcggcaggcaaagagagcttgtgcagggaaattccccttttaaaaaccatcagatcttgtgagacttattcactatcatgagaacagcatgggaaagttacctcctactgggtccctcccacaacacatgggaattcaagatgagatttgagtggggacacagccaaaccatatcagtaatgaatctccagaaccttttcatttccaccagcagaaacactgtactcaataaataactccccattccctccttcccccagcccctggcaatcagcattctactttccatttctatgaatttgaccaccctggataagtgaaatcagacagtgtttgtcttttgtgaccggcttatttcacttagcacaatgtcctcgtgttccttttttaaggcggaatcatgtcccattgtataggtcaaccacggtttggtttggtcctcgcttttttaggtgcctcttcctctgagtgcaaagctcctggtacctggttcagtcctgcctgttctggacatctcattgactccagacccaggattccagctcagtgccctggaaagagtcagggtcagaggtcaggaacctcaggctgagagaggaggagagtggggagaggcacgtggaaaagagacgcctgaaaaccagcaattgggaagaaggagcaagatgatgtgaggaagttaaacacacatgtatatgagtagaaatatttatatgggagcacaggggtccagtcatcccagaaagggagtccttacatccctgaggactccccaaggtgaaataaatccttcccatggcctttctgttgcctaactatcaatcatccagccacagaactctgtgaaacatctaagaattcagccaaggctgcctgcctgtcatgggaagctgagaaccatgagcccaagtttgcttttcttagaatttacagtctggctggggagacaaggccaaggtctatatacatgccctttgtttcccagattttctttgaggaagggtttcagctttgtgagtgactggttgaaacacaaaaccagggatctttatacggttgagcaggggttcattgaatccagtggttctcaaactttggtttagacccatagccttttgttcgaactaaattttatggggaagtcagtgcatgaaactgaagagaacagagtttctctggctgaggaggagagggctgggttcaggcttcttggagcctctaactaggctccttggagcagagccagttcaccgattagtcagacttcctaagagtcaaaatcaggaaaacagatccttaaatgggaagtgacttaatcaaggtcacagctaatgttgacaaggtcccctgaattctacattgtttcaattttcaacacaccattttcaacctgcctttgaaatgttttccaagcttggctcttaggactcttttccttgtccctacctcgcagactgctctttttggcctcactttctgctccttttctttaaatcacacccccagtttgaaatgccaacattctccttagcactggggcctcgtcaggttttcctccttcccttcttttttttttttttttttttggttttttaacatttattttaggttcaggggcacatgtgcaggtttgttacataggtaaattgcatgtctcaggggtttggtgtacagattatttcaccacccaggtaatatacatagtacctgataggtagttttttgatcctcaccctcctccctctcttctttctttcttcagcaagtatttattgctcactgtattcacttgtgaggaactggagttaaggttcccagtgatttgaaaactgaaagtgttttccttgcccaaagtagcttactgtccacttaagcaagcacataagtatccagggataaatagagaatgatccccaaatagcatagggataactccatctatgtaacatacagtgtaagttttaaggaaccaatacaaggaggaaccagaaagaagtgaggcattacaaatattttctctgggagaagggctttcagtgagaccttaaaggaaaaggtgccccaaggttggtgcttagccccagggagaagaagagcatgaacagaggtcatagctcacttactaattcaacagatgcccattgggtacctgctgtgcacatggcactggcatgagccttggggatatactgaaccacacagacatggcccctgtcctcaaggagctttcagtctagtgggaagacagacattagttataatcatgtgacaacatcagccaacatttattgaacacagtattaattaagattatatttggctgtgcgtatggacaccaaaacacagtggcttaagagacatggaagtgcgtttcttcctcccattacaatccagagattggcagtccctggctggcacagccggcatgctccacagtcctcagggacccaagttcttttatcgtatggtgtctcagtgtgtgacctctacacatggtctaagatgctgctccggctcagccatcacttccactgagagaatagttcaggaagcattttattttcttttctctctcttttttttgaaatggagtctcactctgtgatccaggctggagtgcagtggcacgatctcagctcactgcaacctccacctcccaggttcaagcgattctcctgcctcagcctcccgagtagctgagattacaggtgcgcgccaccacacccagctaattttttgtatttttagtagagatggggtttcaccatgttggccaggctggtctcaaactcctgacctcaggtgatccacctgccttggcctcccaaagtgctgggattacaggtgtgagccaccgcgcccagccgggaagcattttctacttcacaaacctccttgggaaccagtgcaacttatttgctgcctccatggtgttgggcttgtttatctgaagacagaagagactcttgtcctcctagtcatcccttccccaaccctgtactttgcccggcccataactaaggtttggcacttgcccctcctgggaagaggtatgcataaaaagtgactaaataaagttcacgattttcttcaactagactgacttccactatttcgaacccagatccagaccatgtacagttgacccttgaacaacataggcttgaactgtgtggatccatttatatacagacacttttcaataaaatttacactgaatgtgcctgtccctcctgcctctcctttcacctccacctcctcttccacctctgccaccctaggaccgcaagaccaacccttcctcctcctcagcctactcaacctgaagacaaggaagatgaaggccttgaagattatccacttccacttactagtaaatatattttcttttccttatgattttcttaatttttttctccaacttactttattataagaatacagtctataatatatagatacaaaatatgttaaatttttatgcttttcgtaaggcttccagtcaacagtaggccattagtagttaagtttttggggaatcaaaagttatatgcacattttgattgcacgtgggttggtgcctccaacctctacgttgttcatgggtcaaccataatttatggaaataggactgagcccactgggggcccttccaccaccctgaggggttcctgactgagggcctgagaaggtggcatctcaggcaggatgagtgtgagtaagtgggccagaaggaggaggggaaaggtgtcccagctcgggggaagatttaaggggggctctggcctggagccagcaatggcaccatcctgaagggatgatgacacatgaggggacacagggaagctgcttctgtggaaagagagtatgactgtgtgttccccaaaggccaggctttctgctccctgtggacagatgctggggagaaagttgcccagaaagttatcagaggatgggtatcttcatggaaacttcccactgtcagaggaacgaacagccagtgaccttcaggagggaggtgggaaaggagcagagggggagagggtattcaggggccttctgtaagtctcctccctgtccactgccacaggcccctgacagaggccagagcctctactaccccgcggagagaaaatgagcaaagcggtcactagagctaagatgatgatcatatgaggtcccctgatgtcaaaggtgaatttcagagagatgataataaagagcatcatcaacttactgagcacctactatgtgctggcactgtgctaagcacttctatcattctgtcatagcagtttaggagtttatgtatttattaattaaaaacatttattaatttaattattaatttaaaaatacataggaagaataataacaacaaactcgactcataatttttctagtttcccctctccagttaaagatggtagcatgggctgggcacagtggctcatgcctgtaatcccagcactttgggaggctgatgtggacagatcacctgaggtcaggagttcaagaccagcttggccaacatggtgaaacgctgtttctactaaaaatacaaaaattagctgggcgtggtgttggatgcctgtaatcccagctactcgggaggctgaggcaggagaatcacttgaacccgggaggtggaggttgcagtgagccaagatcgcaccactgtactccagcctggacaacagagtgagactccatcttaaaaaaaaaaaaaaaagaagtccgggcgcggtggcttacacttgtaattccagcattttgggaggccgaggcaggcggatcacaaggtcaggagttcgagaccagcctggcaaacatggtgagattagccaggcgcggtggcagatgcctgtaatcccagctacctgggaggctgaggcaggagaattgcttaaacctgggaggcggaggttgcagtgagctgagatcgcgccactgcactccagcctgtgtgacagagcaagactccgtctagggggtggggctggtcgtggggggtggggggtggtgagaaaaagacaaaagaaaaaagatggtagcatggcatatttatattcctgaaacactgttttaatcaaatttcttccctaattaggacttaaaagagctcctatcccctactgggtcatttccaaacctttctatttaacttctaaggccttcctttatttgccccaaatctgctagaggcatcactggctgaagccagctgatctttctttctgttagctccccagtgctgcttccctctccccttctctcctcaccccaggacctcttgattcatcttgtttctctctcctgatacgtgccccattctgttcatccaccttattcccacccttcaatacgcaagtcaggctcacctcttccctagagattttcccatctgtattaatta

SEQ ID NO: 15419 - DNA, 212449 bp, Human
  misc_feature (1)...(212449): n = A,T,C or G
gaggaaaaaaatatggtataaaagctctactctagaatattgttaatgtaaggagaactggaagaacaggacaagcaggcttttgagaaaaatcacagctgaagatagggcttaatagtttagagcactaaaagataaacaattttaaaaatcagtgtgtgagtgtgtgtgtgtgtgtgtgtctgtgtgttgcgagtctccaatctcgctggtaactcgcagttttctgatgaaagtgcagtatgtaacgattactagttggcatcctctgctggagaccagtctcacaaaagggtgaccctgtgatgcacgaaaggctatttaatgccccagcgaagtgcttcagggaccaagattttattattctttggtgatgagagttgtgatcctgcatccctgatttagagccacttagggctccgacagctccaccccggtgttctagaggaaaatcttccttcatgctctctgcctgatttgaaagcaacacagcttcccgatgttcctcctgggaggtggttcaatctttagaaattgcctaagaagcctgtccatctgctggagtgcctggctttcgggaacggaccaagacggacttggcttttaatctgaaataatttgaggattttctgtctataacttaaaatcaccgcttaactcaaagtaaaaaagtgacacgctctctagagggcttttgtagacattgggaaaatccgtatgacgaagtacggtttagaaattccggatttaatttcccccgggaaaagcaaatatcttctgttggtaccgggcagtcgactcacgtagtcttcctttaaaaccaagtctatgccagccgggtgtgaggggagtggtgggggtgagcagggggaggagagagattcgaaaagtacaggaggaatcagtccagtacaggggttgcccctgccaacaagtagctattcctgttaactcccaagaagcaagtttccacctttgccacttcctcctgccctttcctttccttttcccttcactcccgctcttggacccaaggttcgctccccaccgccaccgccctgccccactattctctttacaggacagaaggctgcagcagcacggcggagaaaaatctctgaggaatgagtcagtgggatgggcgtatgggtggagggagagggcagtcgatttttaaacctcagcgagggtgggtgggcagttggaagccagaggccttatcactggggcgctgcaacatcacagaaagtgttagtcccagggctctccctggcgcgcgcggctcctgtgcttgcttcttattggcggacctggccctgggggcggagccgcggtgaagcaccgctcatccgggctccaggaccggggcacgcggttctccctgatcccggagctgggctcagggctcggactcagtcctgcagcgcctctaggctgcggatccgcgcttcaaccacctgctttgcgctgcgtccggggaagtggggaggagacgggagggagggaggaggcggggagaggaggaaagaggcagcttacacacgccttccagtccctctactcagagcagcccggagaccgctgccgccgctgccgctgctaccaccgctgccacctgaggagacccgccgcccccccgtcgccgcctcctgcgagtccttcttagcacctggcgtttcatgcacattgccactgccattattattatcattccaatacaaggaaaataaaagaagataccagcgaaaagaaccgcttacacctttccgaattactcaagtgtctcctggaaacagagggtcgttgtccccggaggagcagccgaagggcccgtgggctggtgttgaccgggagggaggaggagttgggggcattgcgtggtggaaagttgcgtgcggcagagaaccgaaggtgcagcgccacagcccaggggacggtgtgtctgggagaagacgctgcccctgcgtcgggacccgccagcgcgcgggcaccgcggggcccgggacgacgccccctcctgcggcgtggactccgtcagtggcccaccaagaaggaggaggaatatggaatccaagggggccagttcctgccgtctgctcttctgcctcttgatctccgccaccgtcttcaggccaggtgagcaagggcctgggagcagccccagacagacgtgggcctggagcagtttcctaggtccccgtcccagcctcgcacccccgaggcagtgcgcccaggcgcgtggtggaggtaaggggaccgctgtcctggcacagagctgtccccgggctcggtcacctgtgccgcacgtttgggcttggctggttagctcaagtttgggcatcaagctggggaaactgggtgaatctccaggaacttggtgctccggggtgggcaggattcgcctgacgctctccccttgtccctgcggctcccagctaggcggcggactcttgccctctgacagttcctcctgtctctgggtatccaagtccacgtcactgcgccccgagcagtttttctttcgcttagttctcggatgaaataactgccggcactttttcgtgataaatcccctagtaacttccccttggtgagccgaggaagggatgggaggggtagagaaggagaggactttaatcacctccccccgccccccttgcgaaacctgctaaagcttaaaatcgtggtttcaacgttaccccctgcggtccccgtccattgtctgggcgggtggtgagtgaaagggtgaccgcaggcagataacacagccagaacaggaattagtaggtaggcctgggagacacctcagtgagaggtttgtgaatttccaggacctgctcatagagcctcagttctcagttctgtactgagtcttggaagagagagagagagagagagagagagagagagagagagagagagagagagagagagaaaaggcaaaattcccaacaactaaaatatctctcgggaaatccctttccacaccctcggggacgtcccctggccctggtatcctcaggcccgcctggcggctgacacaagttgttctaacagggtattccgtgcgctcacagttgcctgacagagcagcaggttcctttgctcccctaaactgaaaatttaggggatttttttttctttgaagttttttttttctatccctgcgtagacagttgccagttaaactcctacttcctggtattttggcctgtttgttcttagctttttctttagcttttatcaaagaaaaatctcacttccttttatccgtgcacatcccttcagctgtcggcaagctcaggtcacagaagaggtttgaaagcctctgaatctctcccaggaactggcggggagaggggtttgggggccagagcctgaggaagagattacaagtgtttgcgagctgctgctgctgctgccgttgctgtgtgtgtgggcgggaggagtgccctctccagatctctttattaaagttacatttctgggtgaggtaatgagctcacctgatgtttctgaggctgagggaaaaaaaaggcgtctgcgttctctgacaaatctcgggctctggggcggggactgtgaaaccatagttcaaccggatttaaagcaggtgtcctagtgtaacaacgctggggaggtaggtggaaaggcgagacccccttgggcctggcacagtgtggatttcactttttcgagattccactgtccgatggaggaaaggacactttggagccagggaatgagccaagaagggaggacaagggtgatgtcggtttgtaacatgcaaacgtccacacgcccacagttggttttccgattaaccccctcgagacttggagaatgtaatctcaccctcgtccacacccctgacacaggcacataaccagtttccttttcggtgccgtcacaggcgggccacgtcgcaggataggtttttctacacatttaactgctaaaagggggaaagttccgctttcagacctccttcacggtggttcttttggcgccacaggctcgtgtgtccagggggcaccgagctgcgcgctttcggcgagcggctagccccggctcaccgcaaccagccaccgtgaatctgaggatccgatatcggccctggaccctcagatccgtggtttcggtgaattaccgagctggcattgccgaaattctcattgcagtatcagtgtgttttgaaaggaaaggttacagcactaaaggcgccgtgtctacactgaggaagcaagtcttggacagtaagtgcgccttcttcggagccctctgcatagcagagcccggtgggggcgcggtgccaaaggccggcttcatttgagcggggtaactgccttccctgccggccactcttcatttccggagcagttttaatagtgtatgtccagttgtagaggtcaaaaactcgagtttgtgaaactgcttccccgggtctttcggcttgtagtcgctacaaagtcattgatatattttaggcgtgccacgttacctgttttgaaaggaggagaaaaatatatgaaccacgaaaactgaattcagagatgaaggcaatgaagtgtgtgttcaacatccgagatagcaatattctcgttattcttgtagaaagagcgtcagcctgtggtgacattttgtattgcttaaaaaaagaatgcttttctggattatttacaaggagatggggcgctgcagttaactctttcttcacttgggtcatctgtatgaacccctctatgggatttttcataactactcactgatctcactgatataagattcattctaagacataagcacacataaagctttcttcagtgggatattatgtttgaaacatatcaattgatctcaacaggacttgggaaagcatcaactcaaataatgtcctttcaaagactattgatgtaggactattgaaattgattaatttaaaaactaaaaactgtttaacagccaatatatatatattttttccttaaggatttatttaatccaatagcaatttacaatttaatggagcattatttgcagtaaattgcttttctaggctttcttcaggacatctaccttcaggcacttgagcaagtcatttaacctttttgagcttcagttttctcatacaaaataaaaagacagactagaggcctactctctgaaatgtctcccagctcaaaaactctttgtttctgaagtcttaaggtaaaaaaccaatttaggcaggcagagtcatttttcaacactatttttctaaggatctcagtctagacaaaattcatataaattgtattattagaaaagtatcagtagaccccaatttctaatttcctttttttttctacctttaaaaattcatgataacatctatgcttactctttccagccttagtagggaaaaaaaaaagcgtgaaggagagaaattagccttccactctcctgggaaaagaggacccaaaagtaagaaaggatagtaggcctcagaaagccctgctagtgtaactcatctctcctgcaaacctgttcctatataaactgcatacatagtacctagaatgagatgtaaattatggtttatgcttaaatattcatatgacaaagcctcatattgtacatcctaaagttgctcaaaaagttgatttgcaacatggttgtaaatgcaagacagaaggaaatagaaaatactaatatttttctattgttttaaaacttgtagaaatccaaaatatcttgtcttaccagattccaaaccttttctgactttgtaaaaaattcaaactagcttatcttttttaatagacattcagatgaaaatgcatgtctaccattgacttatcaaaaagaagaaaattaattaaatagtcttgtgttattagaaaaattgtatattgtagtcagtattcatgtgttcagtttctaactatgtcatgtaagaatgttgtgaccttgggaaaattatttttctgctcttttttatttcccatctgtgaatttctttctgtgcaatgtgtggttctgattgtgttgagattagtaattcccttgctcagcatttcaaattttttaagtaaaacgtgctatattaattaaggcttttattatattgttaatagaataacattctttaatttattccacttaattatcacttttatcattttattaaaataatagaaagatgtttcttttttttttctctcttttttctttttctccgtcaaattttcatgccactaaccgtgggcctttgtaaaacttagtaccacctaagttgtcaatattacttggtgtaagatggcagcagtttgtcagatagtattttaaatgctttataatcaccatgttttacaattccaaacacacttctttctgttctggccatttatttagcataaaacaccatcaaagagttctagctccctgaaggtattcactcaagtagacacatgcaatttatagcccagatatgcagaagatccacttaggtatagctatgatagaagaatatgtctctgtctcaatgtatacatagaaacttaaatgcaatttctcacaatgtgttaattttattcttcattgttaagtattcacagaggctaatctcatttcttacacattatgtgtgtgacacatgtatgtgacatatgaagaatgaactaacttactggaatactaaagaatggtttcttgggtgtggtgggtgataacatttatttggttattacttttggatttcaactcagtttattttcaataagaaatggaaaaaaatccatttatacttttgattactttttttattagggtagaattttcctttccttgtggagagtaaattcaagactaaaatagatattctatattcaggaagagaatattgcaggctgtttggtaaggttaaatctaaatcctacaattattatagtgtccctatagtacgtaagtcattaccatatttttggagttactgatattttcatgcagctaatttctctgcttaaataataaattttacattctcttttctcccttattattgaatagaataccttatatatttcagataggcctagttccaaatgtggtatggtattcagtaattgttttatgctaacctattatcatagcccattactgtagtctatgttccaagaatgaaattagcttttaatgcttcctctcttatttatccagtcagttctcaattatccattccattgaaggggaaatcagagttgcgcacaatccaaaacatcttctaaccaaaggattacttaatttgactttgagttgaggtacttcaatgaacatgtctatacttgtctggtctaagaattcatagtacttcaacacaatgaaactaaactgctggggaataggttaatcagaaattagacagctgtccagcttctctgatttgcttctctattactgttattattgttttagctcttttctgtatcacttaaggaactgatgcaaaatcttggcccaagtaagactaaaaacatctatgagatgaaactaaacctttgcaatcttctcaaatcctataaatattatagacccttgatgttcattcacaggaaaacatactatgaccatggcaattgctgtagtcttctggcctttgctcaatgacacttccactatgaataatttgtttagctctgcaaaatcacatttcaagttttagaaaaattttaccctcacctggccctttttcttaagcaagttttttattacatcatatgagtttccatgaataaatgaataataaagcaatacccttttcatgttatgagttgggttagcagccaggtaggttgactctccagtaggattttcacacacctgcttttagaaaaaaaaattactacttataatggattatggggttacagtaaacagtgaaaaccagtaatatcaaatccataaatgttaggaagattggaacttgtaattaaaaaagactttatttttgattattttaacttattatgatgatttcactagagaagttaactgaatttgtagattaagatatcaaccagcactccaacacaatgttttcttgagggagataaatctcaaagatactttcaccttagaaattgatataagtagatttttatcctctccatctgtatagttttagagagagtctagattaccttatttgaactgtgaatgaagaaaaaaaaactttcctgtacttacttgcctttggtgcaaaatcaacattggaatgttgataatgactaaagtgagtcttaacttttcccttttccttttccctgtacttgtctttgctgtagtttttaccacattgtattatgatattggtgacttttttcagttgaacataaattttttgaataccaaatatcatctttgtctatgtatcctcaagtctagttaagagcttgacacctagaagctgcttcacattttttctttgcattaaatacagtagaagcaatgcatatgtggagaattaaactccatatggcagcacctgacattcatgcattactaagaaattttctcaaggagtttgggagttgaggatataatattcctcactgagaattgaactggaaaataaaaccatcatgaaagaacagagtgggacaggctatcaagacctgatggcactttagtagtattaatgaaaaacaaaaagaaaagaacatgtatattcgtaaaggacctgtgattaaggatgaaaaagactttggtcattggagaaacacagaaaaagtagaggagttgggccaaatgtggttattgaagctattatacttaatgaatccaaacactttcttttatggtgaaagtaagtggcccctctaactggcagacatgacttgcccagtctccttagcaggtatagctttttgttgagatagataaaactcattataagaacctaattctggggccaggctcagtggctcatacctataatcctagcactttgggaggccgaggcgggcggatcacctgaggccaagagttcgagaccagcctggccaatattgtgtaactctgtctctattttctttttttcttaaaaaagaacgtaatgctctgaatattcaagtcatatagtaaactttcccatggtggaatttcatggtcactaagaaatcttctaattataatgtgatgcttgttttttgtttttgtttttgtttttgagacggtgtctcgctcttgttacccaggctggagtgcaatggtgcgatctctgctcactgcaacctctgcctcccgagttcaagcgattctcctgcctcagccttccaagtagctggaattacaggtgcccaccagctcgcccagctaattttgtgtatttttagtagagactgggtttcaccatgttggccaggctggtctggaactcctggcctcaggtgatctacatgccgcggcctcccaaagtgctgggattacaggcatgagccactgcaccgagcccaatgtgacttcttatatagccagtttacagtcagaggatgcactagctggaagagaagcattgtattcccttggcaataattgctcttatgtataccaataagctggtttatgagtttggttagtgagaattcatctttaaaagatgggaaaatgtttggtaagcagccaaaagaagcttctaagttttcagggttgaaacctacacattgaacccttccaaattcagcttgtttgtggtacaatcagctaaccattccccaggtgacacctatggtgtcatttgttgtcaacttgtgtgttacctattatagacatttattttctttcttgtatatcttttggtgctatcttgcttaatatgcatattattagtaggttgaccattcattcatcttggtatacctaagactgtcctggtttatgcctcatgagctggtacaattattaatggcatcctttttcattttcagaagtgcattttgcataacatatcatacaggctccacaataatttgtaacttgtctttatgtcttggagtacttcactgtgataaatgcactcttcatcctaaccaagtgcatatttttaacccatttaaatttaattatcagctacagtgaaatatcattaatgggttatatgcccctttcatgtcaggtataagaaagaaagatgtgaggttgtagcctctagaattccagaatgttgtggatatgaaacattgaggatcctatggtttggaatggaaactaaattgacctcagatgccaagggaataattttgtttgaaattcacctgggagctacacttagctacggggttatttagggaagaactatttcagtatgagcatgaattccttttgcagcaaattgtacaactcccattctgttcttctatgagatttctcagtaatcacactaccaatttttttcttaaaaaaaccagggatgttgaaggaagccccagcattcttctgtacatgcaaactaagttgtatcagtcagaaaaggcgacctgatgtggccaccaacagtatggctaggatacggttgtagtcaagggtgtgacaacagcaaagacgcttatcgcggaaactttgaccctgtattaacaattttcaccttctagatccttgggcaaaacatacggccttttgagaggctcaagcagtgttgaataagaatactttcacttagagcgaaaaccttaactctctccagagttaaattatggaaagttcagtgtgtgtgagtttgtgtgtgttgggggctggagaggagagagaaagacagagacagagagagagagagaatgaattctgaaggattagaggcatggaatttattgtcacaagttaaaatatggtaaaagaagggttgttggaaaaatgagaatgttcttttgatgttctttttgtttagccccccatttgagagctgaaataaatgaaaccacaggtttaagagattacctaaaatccagtagcaaattaaccacaattcctagtgacatgttttcagtttcatttgcgcctaaactcatagattaaaggttttgacctgtaaagaacctaaaaattaattaactacttgactaaggtcacattgttggccaatccagaactaaaactcatgtcaattgatcattcagcatatataacagctttcaacaaatattaatggagtgctcagtatgtactacacattgtgcttgaggatatggaaataaactaattactatacattcaagatcctatcactcaaagatgttatgttctctcagggaaacagatatcaattaattaactatataactatttgctagaaattttggtaaatgtcacaagaacaatgaacagcattttacaacaaaggggccagatctagtctgggatttaagagaaactcagaaaacgtctagcaggaagtgatatctgagctacgtgctgaggaataatctagcaaaggatgtaggctgaggaaataacatgactgaggatgctaaggtggtaagaaacatggtttctaactcctggaggtgaaaatgtgcctatcccttttcatgaaaactaaagaagttttgaaggttgaggcaaaaaccaaggattccttgaagttgttcaaatactttcctgcaatctccctaattgacttgccagttgtgggatctacaaaaggatgtctttgtcttattgaaatattcacatattagtaaatatttgtatgtatacctccctacttaaaaaataaagtggaaacataccatatacatcattttgtacctttcctttttcatttaacagtacattttggagattaaaaaattgtctcatagcagcacctatagctctacctcatttttaaaaagtgtgcattggattttactgtactatcatcattaatgtaaccatttcacaagttcctggaagtttaggttgtttccaatctttcgttattacaaactagagcagtgaacatcctaatcatgttattgtccatataagcaattggtggcagttgttggtaaaatgtcttggaagtgaagttactgagtcaacgatgtgtttttcatttagaaagaaattgtaaaattactgctcaaagagtacacatctttaaaaaaatcccaacaaaagtaagataatgcctttcttaaactctcttcataaatctgtactattacattcctctttttaaccagtatcataagttggttttcatttatttaaagcttattggaaaagttagaattataggagtagtaggcatatacactcacatacaaggcaaaacctatattggtgcctaactttattatacatgagattgggccagaaatgggaaaagacaggtatttaccatgaatttttattattgttctttctacataagattgctaacttttagaacataaactgtataattataagccataacctcttccattttgtaaaattaatactctgtacaatcaggattaagagacagccacatttgagccataagtgaatttaatactgcttttcaacacaaagaaatggtttccaaatatttgtattagttcgttgtaggtacagtatacattttatgggtggtctgactaatgccactttgtaaaccctgtataatagtcattactaaacaaacttcagttatttttaagtaaatcatatttcgaacaattattccaacaagtttaagccttaagtaaatcatcttttgaacaattcttccaacaaagcttgtcagaattttgtataaactgataaaaagtacaatattttacaaatttttttaaaaatcagtgccactaaatatttttcacctgtaattttttaacccattaaggaaagtaggaataaaatctattttagtcacttttacatagaaaatagcaggatatatatatatagttttgaaaaattatatgccgaaagtaatatttttaaacaaatgataaatattcataatggaggtaatgtttgtatgcacatactgtaatttaatgagtaaagcagtttctgcctggtatttagtttagatgttcaaatctggggcacttatactttattctgcaagcattttccctacctggtgataggtacaacactttctaagaagaatgtttatggtgattttaaggtataggttttatatttttgcagagatggtcatggatctaagtatgaataacagttttgatatcagatctaagagtaaaatgtaatttatatttggatttactccattacataaatcccctgttccacccagcctcaatggatactggctagttctcaaatagttttttttttttttttgagaaatgcttgtttagtataagattaaatagcttctctgatcatactagaatggcaaatacgtatctgtttattaaaacaaaacctttatccactcagctgttttcctctttgctgttagaaaatgccacctttctaaaagagattataaaatagtaaaaaaggagtagggtttcagggtatggtttggaggttatcattttctagaatccatccaaagtgtttggttagaaatgatttgaactgcttgagtagtgatttgatggtaggcagtatggccgtatctccacggtataagaagactattctccaggcttgatcttcatgaactgtctatgctcagagactccagactgaaatctgcatagcatagatttctttatataacagctcaagagcttgggctatggatcagagcatgagtttgctttctagcttttgtctgttttttcatttgttaattgaggatagcagccaagttcatttggtaggaatattcaagaaggtaatgaatttatattatgtttgtcagtgcctagcacattgtagacactcaaccaaataataatcattatgaatcacatttttcagtaacctaataatatcagttattcacatcagaaaaacttgtgaaatacttcattttactgattgagaaatatttcagttccatctgaatacattttgggcttccataactaaactgaaaagtatattttattagaatgtttcataatctcaatgaatgtcaagtaacctttcagttttatcatctcaggaaaaacaaaagaacataattgaaaattatagctttaaaatgtaattttccacaaaaaaaagagaaaaaaacacgtgttaaaattataaagacatatgtaatgcactatattattctcagaaattgacattattatatgtgtttctgtaatttgaaaatattagaacttagaaagaaaaatttccgattgttacaatgctgtcattttgataataaaattatgattttaaatacattatttctcaagtgtaattcaatagagggagctccactgcttcccttttatgagcactgtaggatgcttccatttattatgattttccaatgacctctaatttaatagtgaacattattaaaaacctataattttaatattaaggatattttggaaagtgaatagtatcctctttctattcatataattcaaaaaatgcttccacaaataatatgtgttttaaagccccagttcttagttctttgtaccttttgcataataactcactagacatgattaaagtaggtatactcttgagaaacatactttaatacaccaaggcatcaaaagagaaaaaagttcatttctagtgataaaataatgcatgttttcatattaattttgtggtagctattaagttaaaactgttatatatttgaatagtagacaaaatcttttaaaattactctgcctagatttttaaccaaatggttacagatttccacatggaaatggtcttcttccttttttattttctcatatattcccttgatttaggtaatcccaaattgtattttcaagctaaattgatattcatcatcttatctattattactttaccttttaattttgttatgatgaaagaagttgttgggttgattttgttcaaaaatttataattttgtcaaaaatccactaacatggttaaaaaatttaaatggtttcaattttataagacatctcctaagatgtttctacataagggagttatccactctgtgtgtgaccctgacaattcatttaccttttatgaggttcatttttctcatggaagtattgtaccatgtgatttcttcacagctcaaaaattctaagattcaaaactatattttgatttagaagaagaatatgcacgcgcacttgtatgtttgagtcagtgttgagcaataattttacctgaagtctaattaaggaaaaaaaattcaatgatgggcctcatttttaaatttgaaatggaaatgattttattacattctatagaaaattgtataatatcacacattagacctcctaatttattactaaaattatatcagtaaatgaaatcgtccaattctctggtatatttaagaattgtcaacacagaaacagatttaaaaatctcatattgaaattagattatctgtcacgacggccatactgggaaaggagctttgtgataaaggcctgtgggttcttcatcacagttttaacaaatcacaatttaaaataccttttaaagtaagtgcccattttattgtgcttactttccattatagatcagagtttgagaatatggtgtctgtagccaaattgtttagttttgaaacctgtgtctcctttctccagtttcccagttgggtggcattggggaagttgcttaaaccctcttctgtcctaatctatgcaatgggaataatagcacctatcttgtaggatagctgtgaaagttaaatgaattaatacacataaagttcattaaacagtgtggttgtcagtagtaagctcttaagaggtgttagtattattcaagtatttaaataaattaaatctcagttaatctttcccacttccccaaaatacgattatacacccaactgattcacatagatattatacataaagaagagaggccacaggttcagaattataaaattgccagctgtagctcctctccactctacctttctttccactcaaaaaagagaatctgaatgagagtgatgtcatgtttttatggggcgtaaccttgaatctactcactctgtaaaacaaataaaccattcacaaactccaagactttatccattaattgttagtatcatattcattatgtcatagttcccatctgttaatgaaacatcattgcattgcaatcttgaggttgaaatataaatttaaaagtgaatttgaagctaaaaatgagatgctttgcagcctatagtttacagtgtctaaaagcaattgttttaggtcattagtgtaagtaggccataggtaacttaggagtatacaagtgactgtgctcgaaagacatttatgtagactctgtagattcagagtctacacaataataaaatagggcccagtgatcatattttaagaaaccaaaagaagtaaacattttctaacatatttctcaaactttagtcccttctaatcttttctcccctctgccatcagagtgatgtaagatctgaatcaactcttttttttattgtcatattttattttactttatttttttatttattttttcttttttattattattattatactttaagttttagggtacatgtgcacaatgtgcaggttagttacatatgcatacatgtgccatgctggtgtgctgcacccattaactcgtcatttagcattaggtatgtctcctaatgctatccctcccccctcccccaaccccacaacagtccccagagtgtgatcttccccttcctgtgtccatgtgttctcattgttcaattcccatctatgagtgagaacatgcagtgtttggttttttgtccttgccatagtttactgagaatgatgatttccaatttcatccatgtccctacaaaggacatgaattcatcattttttatggctgcgtagtattccatggtgtatatgtgccacattttcttaatccagtctatcattgttggacatttgggttctttccaagtctttgctcttgtgaatagtgccacaataaacatacatgtgcatgtgtctttatagcagcatgatttatagtcctttgggtatatacccagtaatgggatggctgggtcaaatggtatttctagttctagatacctgaggactccccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtctcttgcctgcataaatgtcttcttttgagaactgtctgttcatatcctttgcccactttttgatggggttgtttgtttttttcttgtaaatttgttggaattcattgtagattctggatattagccctttgtcagatgaatcaactcttataactgctctgcttcaaatacttcggacacttcccaatatagtcagggtaaaatagtaacttcttaatatagcatttaaagtttttcttacatttctcagaacaatttttcttggaattccatgtgctagccatatttctaaatgtgccatgcccttcctgcttcctgagtgggttgttattcacgtctctgtcttattcaagaacaccctttgcttcacaccctctcaatcaccctttctttgcctgaataacgtgtatccctatccttcagaacacagtttatatgccatcacctccagaaattcttccctgatctctctaaggtgcctgtcctctgtagttccagagttcatttcatgtattgcctatttattcttctctctctcccttagtgaatttttatattcctggaggcaggagctgtgtctacttaatcttttttctacccagcgtctactgatacatggtacattttcggtacacacccatgatgattgaataaatgcattagtcaaaattagatttcttagtctactgatacatagaactttctcagtacatacatgacaattgaataaaggcattagtcaaaattacatttcataattatcaatgaagcctattttaaacaacaacatataatgttgtatgaataagaaatatctacattgagaaaattgttcaatttcttttaaaaattgagggaatgacaactctcctaaaatatggtcctaaaaagaatttgccttattctacccatgctatgcaaattgagtgctaaaacaaatggaataaagttagatttcttccgagtgccaatccaagttaacataagtactcttcttgagtttccatattgaacatagtctgttcattaaatgtgagatcatcctgagaattatagaaatttatttaaactaatttattttaaaaactgtaggtttgtgaagatactaaaactactttttctcccacaggataattgtagacgtacattcaaaatagaagtaaattaatggtaatattagttcttctatttttaattaatagattaaacctttggatcacggcatttctcataatctagcagaaataatatagaaaagacttcataagcagattgatcagtcacgcaggcagtatttaacatatttgtaccactgaaaatacatctgtactgtggaccatgtcttggatgcttttgagagtaaaatattagagaaaatttggagaaaatctggttttatttttacaaaactattgactattgaaagagaactttaaaattcagtcactaacttaacaaaattatataaatttgaatgatgtttcatttttactgaaaaataaaccttgtgctcttgaaaccaacatatcattttgagaaataagtctttactgataaaaacagtgcagaattggatttatcacagatctcattattcaatggtacttaatagctgagaacttaatagttttaagtctggtgtcacttctctggacaaaataatcttaaattcttataatctttcaacttaagtcctttttttataagctttgttttatttccttactttacttttgatccttcccagtccttcagaattttaacttctatatcatggttttactctgccaattcccatattaccttcccaatttaccttgttagtaaatttttacttctttggtctctgaggcaagctgtcttctgaattcttgcccagaaattctaagacttttctaatatattattaaaaatacttgtccagataaaccaatataaatacaacacattaccactgataactctcgtttattaaatacctgctgtactccatgtaaaatagtactttacgaaagaatggctaatatatttgtataaccaattttaagtttaaaaactgtgactcttttttaattttttaaattataaattgtaatctcactttcagccttttaaatataggactttgaatgcagtatagtttatgtatcaagaagtagccagagcaaagacattatcaaataaagccaagtaaacaagactttctctttgttgaaatatataaacctaattgggccatatcagtgatcagttaagattctggattaatcaaagaggctacatgacaattttttaaaaaatcttttctattacttgaaaaaatgtcacccatttctaagacaaatactgtctagttcctggattcttggcatgtaatctaggcttcacgttcttgatgttgtcacccaacaaaataatctttccacaaacatataaaaatatatggagttctcaattttccatggaaatagaatctagggttaatgtggtgaaataattttcattattaacaagccttattttagtatatgtaaataggattagattgaaaagccaagttttatagtaaaagatgtgatttctgtaaaagagagtattctgtaaaagctggaggacaagtgaagcttaaaggagcagcttgtactgatgagaaaggggagaggaatgagtggacctctcttcagagaggaaagaaagataagatgaaaagccagcatgaaaaggaacttgctgtttaaaattacaacaaactgtttatgtggaccagtagcatcatgatgtaaaataaattttctttactgctttgccatgacgcttaattgataatacattctagtaagcccaaatttgaatctcttctcgataactaacattcagttaatttcttatttcgaagtgggaagagcaatggctggaaagaaacttcctacagagaaattctgatgcaaatatgtcttgaaatccagagcattttggtccaaatttaacaatgtgtgtcaaattttacaacagcagatgtgaatttatggttctttattaagttttaggaattctgaattgtatttgtctgcttaattctatagtgaaactaaagctcagttaaatagtctaaagaatgttacttaatagtaaaattacataaatatgccatgcacatgttggctttcaacagagtgcatttgaatatattcagatctgtggtgggtgctgaagacttgtctatataggttcagttccataactgaaccagtgagaatctagaaaaccagtgttttcaaaactactccctcatgggtgaatggagcacatactattgaatgatctgctctaaacttaggcattggtgggcctgaaataagacttgggcagtgagcatctgcttctcttcacccaaagagttgaccttccaagactatagaggaagttaaaattaagaaatgagtataagagagacacaagtaggtgacttctcaaattctgaaaagggaagtttgggtaaacaaatctgaaggaagaagaaattaatattagaaaagcagagttaggaagacagaagtgaatcagtaaaatgtcttttgttagaacaggtgcttctacatctgttttgaatcaactgcacaatggtttatgcatgggccaactgaatagaaatactcaaggctggcataaatggatttggttccagttacagatttctttgttttgttttgttttcaaaaatagagcccaattaaatccatcctcattggttgtagacattaccctaaatgtctagtgtgtgcaaatgtttctctataccctaccttcctatccctattccccatgggtccctagcattagaccctgcttcctgacagtctagacttgggcttgtcattataccaccataaattagaccctgcttcctgacagtctagacttgggcttgtcattataccaccataaatatatatatatatatctgtaattgtttccttagtgaattgaaggttttttcatttaaaattaaatttgtgtggaaagtatattctttcccatcaagttaggaatatttaaaagaagtatacatgttagatgcaaagcgctaattcaggaatgaccagataactagtatcattatattctttttccaagtatattccccaatgtttggaatgctgttcttttgatcttaactctttcatctgaaagcacccatcaaaggttacatgagcaaattacccaataaatgttatttttccaatagtttcagcctcaccctacttaaaattatattgaatgttcgtgacagttcaaattgacaaattttcagtttgcctcttctttttaccccacgttattctccaaatagaaatcttgagattttttccacaagataaatctttagaataactgaggactaattatatgttccacagcagtctgtagtagtctcacaggctgagcgtccaaatgaggttgctgctatagggaagggcaggcggaaatagaaataaaataaataatccttcccaccctcacacacacacacacacactcacacacacaatcaagaaaccatcaaacaaagctcagaaacatttcaaacataagatcatcttttactttacttttttgttgcatgtttactttgccttctggaaatattgcacaatctattagctttttctctttagatgtttgaaggatacagaaggtactactaacttaaaaaaaaaaacattgattctcacagcagaacctgtgtgtacttgttcactacatacctacattgttaaatatagttgcttcacaaacaatacaataagaaagaatttaagaaaacagattctatgtaaatagtctgcgtcactaactctattatttagtgattaaacggaaaaatatttagtattgagtgttggttcatcattgttgaatcagtaacggttaccaggatcattgtcaagttaataattgagaccaggaacttccttcttgctgagggcttttagtagtgatcagtggcagagggatatgaaaggctggagaagaaaacaggagacccagtcctgcctttaccagcagccctgagattttggttaatcacttcatatttctgttctgcttctttgcttatacaatgacattaggctacagctgagtgggctcccttccgtgtggttgtgagactttattctactgccaaataaaaataatatttgcattatctctttttttaatatttgcacttttttgttctcatcagtatccataatgaagcactaagcatgtaacattttgcagattgagatttcccagtcaccatgcaccataaataaaataattgagacataggaataaaaatgcattacagtataaacaagcagtaacagagtgtggaaaataaaaagacaaggaagtacaacctctcctctgtttaacactgaacaaaatttttgggagagtataatgttatatttataaatagagcaattagatttggttcagagaaaagaaaatgattaaacctatagaatacagttgttgtaaagaagggaaaagacctggagaaggaagaagtaaaaggtgaattaatagctgtgatgagaacactgatccatgattcttcatctccacagacgactgtcccacaacaaaaacaaaacagcatgcaattgctgaaggaaaaagctagttcctcaaatttgaaatgctacttttgaggaagactcagggacttctacctcttagagtattacaaaatgttatacatataccatactccaagcagagatgttctgctgtctctttaaacttagtttagtataaaaggatggtaaatttggtgataaatttagtaataaatgcaacatttttcttatctgtaacttaataggaataaactaatttaagattccttctgtttcaaattctttatgattttttattttggggatgttggacttgaagcttcactaaatattcggttatagaaatacttttctaggaaaacttattagggttaagaaaccagatatttttcttttaaaaaatatgtaattcatatattttgaacttaataattagattccaaatggtcctaatcacaccctgtggatctttagctcttgaggattcaaaactatgagattttacaatcacgttttagatagtaaagattgaatgagtatgttaaggctttcatgaaagaaaaatggaagaaagaataattgaaacaagtaacttaagtggtgggcaagtaaaatctgtaagccaatttctttgtctgtaaaatgaggagaataatagtatttatatgaattctttgttgaatgaacaaagtgagataatttttggaaaatgatgagcaaagtgaatggcaagtagaacagacttcagaaatgttagctatttattatttacacaagaaaagtggaaggtatggtgtactaaatatgacaaatatgacacattcaaacagaaaagaggaaaaaatttctgttatgtagaaaattatcccactacaattttctttatccttatttattaaaaatacgggatgaaagtaagaaagaaagatacgcaaaacagtgtgtggtatgtttgcttaaaacggaatgtgttttgaaacacacaaaaccatatacctacttgtatgctcatatatacatagtttttttttttttttttttttttttttttaaaaaccacacagaaccctnnnnnnnnnnnnnnnnnnnntggtcctaatcaccccctgtggatctttagcttttgaggattccaaactatgagatttttccatcccgttttagatagtaaagattgaatgagtatgttaaggctttcctgaaagaaaaatggaagaaagaataatttgaaccagttactttagtggtgggcaagtaaaatttgtaagcccatttttttgtttgttaaatgaggagaataataggatttatatgaattttttgttgaaagaacaaagttagataatttttggaaaattattagccaagtgaatggccagtagaacagacttcaaaaatgttagctatttttttttttccccaaaaaaatgggaaggtatggtgtacttaatatggccaatattgcccctttcaaccaaaaaaagggaaaaatttttgttttgtaaaaaattatccccccaccaatttttttatccctttttttttaaaaaaccgggttgaagttaaaaaaaaaaattcccccaaacagtgtgtgggatgttttctttaaacggaatgtgttttttaaccccccaaacccaaaacccccttggaaggttaaaaaaaaaaaggttttttttttttttttttttttttttctaaaaaacacacaggaaccttaataatgggcttctctgaaagggaggcctgcgaatatgagataggagggaagccttcttattttttaagtatatgctttatctgatttgaatatttataatgtgtacattattttaaaataaactactagtgcaaaattagtattattttttattttttacatttaattttattttaagttccaggatacatgtgcaggatgtgcagatttgttaaataggtaaatgtgtggcatggtgatttgctgcacctatcaacacatcatctaggtattaagtcttgcatgcattagctgtttatcctgattctgtccctcccccctaccccctcaacaggtcccattgtgtgttgtccccctccctgtgtccatgtgttcttattgttcagctcccacttttaagtaagaacatgtgatgtttggctttctgttcctgcattactttcctaaggataatggcttcccacttcatccatgtccctgcaaaagacattatctcattcctttttatggctgcatagtattccattgtatgtatgtaccacattttctttatccagcctatcattgataggcatttaggttgattccatgtctttgctactgtgaatagtgctgcaatgatcatacctgtgcatgtatctttataaacagaatgatgtctattcccgtgggtgtatacccagtaatgggatggctgggtcaaatggtatttatggttctaggtctgagaggaatcaccacactgtcttccacaatgattgaactaatttacattaccaccaacagtgtaaaagcattcctatttctccatagccttgccagcatctgcagcatctgttgtttcttgattttttaataatcgccattctgactgggatgaaatggtatctcattgtggttttgatttgcatttctctaatgattagtgactttgagctttgtttatatatgtttgttggctgcataaatgtcttcttttgagaactatctcttcatatcctttgcccactttttaatggggttgttgggtttttttcttgtaaatttctttaagttccttgcagaccctggatattagacatttgtcagatggatagattgcaaaaattttctcccattctgtaggttgcctgttcactctgataatagtttctttgctgtgcagaagctgttcagtttacttagatcccatttgtcaatttttgcctttgttgccactgcttttgatgttttgtcatgaaatctttgcccatgcctatgtcctgaatggtattgcctagattttcttctagggtttttgtagttttgtgttttacatttaatgctttatcatcttgagttaattttgtctgatgtataaggaaggggtccagttttaattttctgcgtatggctagccagttttcccagcaccatttattaaataaggaatcctttcctcattgtttgtttttgtcaggtttgtcgaagagcagatggttgtagatgtgtggtgttatttctgaggcttctgttctgttccattggtctatgtatctattttggtacctgtaccatgctgttttgcttactgtagccttgtagtgtagtttgaagtcaagcagcatgatgcctccagctttgttctttttgcttaggattatcttggctatatgggcacttttttggttccatatgaagtttaaagtagtttttttctaattctgtgaagaaagtcagtggtagcttgatggtaatagcattgaatctacaaattactttgggcggtatggccattttcactatactgattcttcctatccatgagcatggaatgtttttccatttgtttgcgtcctttcttatttccttgagaagtggtttgtagttgtccttgaagaggtccttcacatcccttgtgtgttgtattcctaggtattttactctctttgtagaaattgtgaatgggagttcattcatgatttggttctctgcttgtctattgttggtgtataggaatgctgcttatttttgtacattgattttgtatcctgagactttgctgaggttgcttatcagctttggggctaagatgatggagttttctagatataggatcatgtcatctgcaaagagagacagttttacttcctctcttcctatttgaatatcttttatttctttctcttgcctgatttccctggccagaacttccagtactatgttgaataggagtggtgagagagggcatccttatattgtgtcggttttcaaggggaatgcttccagcttttgcccattcagtgggatattggctatgggtttgtgataaatggctcttattattttgaagtatgttccttcaatacctgatttattgaagggatgctgaattttatcaaaggctttctctgcatctattgagataattattgtggtttttttcctttagttctgtttatgtgatgaattacattgattgttttatgtatgttgaaccagccttgcatctggggatgaagccaacttgattgtggtggataagctttttgatgtgctgctggatcagtatgccagtgttttattgatgatttttacatcagtgttcttcagggatattggcctgaagttttcctcttttgtatttctgccaggttttggtatcacgataatgctggtctcacaaaatgagttaggaagaagtccctgtctttcagtttttggaatagtttcagaagaaatggtatcagctcctctttgtaccttcggtagaattcagctgtaaatccttctggtcctggtctttttttttgtttggtaggctatttattgctgcctcaatttcagaacttactattggtctattcagggattccacttcttcctggtttagtcttggggtggtgtatgtatccaagaatttttccttttcttctagattttctagtttatttgcataacggtgtttattgtattctctgatcgttgtttgtatttctgtgggttcagtggtgatatctcctttatcattttttattatgtctgtttgattgttctctctttttttctttattagtctagctagcaggctattttattattataattattatttaaaaaaaatagctcgtagattcattgatttttttgaagggtttttttatgcctctatctcctttaattctgctctgatcttgtttatttcttgccttctgctagtttctgggtttgtttgctttgggttctccaattctttcagttgtgatgttaggtttatgatttgagatctttctaactttttgatttgggcatttagtgctataaatttacctcttaacactgctttagctgtgtcccagagattctggtacactgtctctttgttctcattggtttcaaagatcatcttgatttgtgccttaatttcattatttacccaggagtcattcaggagcaggttgttcaatttccatgtagttgtgtgattttgagtgagtttcttgatcttgagttctagtttgattgtagtgcaaaattattgtaacaacagtattactaccaaaattgtagacaagatacatcttctcacatagtaatttatttattatgaattgagaaattaggaattttggttatagttcctatgaaactttaggataacagttgtgctcatttttatgtgttgcttgtttcttttccccgttaggcttgcgaatttttttcttatttgttacaataaacctacaaacatattgaaattaaaatgatctttcatttttattgccattcttatattagtctatgtttaagttaaatcacatttaagatgaagttgcatagtttgcttcttgattgatgttttgaagtgatttgcaaatgtaacaatgtaagcctagaggatatctactaaaaaaaaaatcacccaaacatacagttaacagaagtgcaaatattcttcagtagaaataaatttatacatgttatggcgagcaagtatgagaagaaaacataccataagaggaatttaaattttgtatcaataattttttgacactcaagattgttgaaccacacttaatacaatggattattttaaaagctgtggcatagtatttctggagaagtatttcctaaattcttgtgatccagataattagaccacaaccaaattaattttataatggcatatacttatactcactcttagaattcacaatagaaatgagctttgctaactcctggtataaagaaattgtttacattgtttaaccttatgtctgacttgagacatttggaaaaccagcatttggaaagcagtgttttgaagtaaaatatactacatgaatgaaatacagtgtctagatttaggactatttgatgtctggtaccttctataaccataattcttcattataagtcaaaatacaacagaagaacaaaacaaataaatacaaaaagccctattatttatttccatgaagatacatgtaagttttccacatgatttggaatttatattatctaaatttttattttaagctcactcaaatatagataattgcaaatttggaaaagcagtcagtaatatcaaaatactgttattttgtgcctgtgtatttttacaaaatatttcgagtccattctttcaagaggttcacatcagtattcaagtactatggtactttcactagtagccaagtactatagtactttgactaagtatggtaacagcctgtaagcctcctaaagctgaaaagattaaaattttattcttagacaattgaatccactaatacaaaataatttaaagtaatcggttaattttgtttacttcgcattttactttgctatgtgtttccctgacatatgactcactacctatgtatgtctgtgtctgagaaggacatacatagctacgcggaagggacatgcgagggatgagggaagcataggcatgttgaggtacttatctcctgcagagcaaacacgtcatgatctggaaatgactgcatttcctcccacgtgcctaggcttttctgaatccctggttctcttttcaacaggcccatagaaatgtctctgcttctttgttgttatttacatttaccaaaactgcagggatttccttagatgccttccagctagtctggctttataaatcagacctatgtcccaaaggaattttaacaagttttcactatttttgggaaaacacaggacatgtaatatattccataaactactcctgaaaatatttttttaatttcagagttaaattgtgtttagtactacacaactccaattttctcctgcaatctatagatttattgacatctgcaaaattgtttaggcagaaaggtggtttctttttccattttaatattaactgcagccataaaacaagcatggcaaaccaatgactatattttgggaaattttttagataattcagtagcttacacaaattgcctttgttttttctgagcctattatagcagacctgtaaggtttggttgtatatattcattttttctactaatgtggaaagtagttgtagttttataattggtgaaataaaatgcaagcaaggtaataatgactgtatttcacggagtaatttctaactttataactgtaagcacagtaaataaagcatgtacctcatgccataaacttattctcaaagtttatcttaagttaatcaacatgtatgatttgacttttcatcaaatgaccgccctgccaacttattaacaaaggatttctggtattaaaattttttggcagttattttgggcctttcaagatctttccattaaaatatatatttagtgaccacaatggaatatgtttttactcttcaggttgtacaatcttcaatgcaactttttcaggaggatgtttcatacagtgtcactgtaatcctataaagtataatatgaagattcaagagttttttgtccttggagagtacacagaaatagagaaattcacagcaacaaatgagctcttatttcttatatccagagatgttttcttactaaattgttatgtatgtatactcatgtgacatattttttctatttgatgtcaagtgattcttttacatcagctctccattttagattattcccatgaaaatatgcttttcttttactattaagttaaaagcaattaattcaatatgacttatgacaccatgttatttaggatatcttattgcaatgacaggaatcaacaggatctagcttaagcaaatatgggggatatataacgagggaacaagaagtctctgtaacagagctatagtaagatatgcatctctataatgaagctaggacttagatctcaagaacgaatttaaattaagggcatgaaggctatcagttctgtctgtctcaattcctcagctcttctttcttttcatttgccttctctctttctgaagactatcccattttgattctaaggccatatggcagcccatgtctcctggattgagttctcctccatttaataaacatagtttgcctagttctgaattcacagggcaaggtttctgattggcttagcttgggtcaggtgtccatttaggaccagtcaactaacattggaggaggggaatttgataggtttctgtgcaatttcaagaagccttgggatgtgctaataaagtagactgggcaagcacaataataactgcctactatagcattttttgcttaattaaattaatatttattagacactcatcataagcaagttataaccgtggtgctgaataaatgagtaaaatactgtatctatattcaacaattcaaggatgtggctgctgtgcaaatcattggagtacagtgaagacagagaatggagcttagtgatgatcataaggagagaaataggaggtttaggagctaggaggtatgatcttcctgagaatctttgaaatagaagagacctgaatatctgtgggagccaaaaggaaagaaggatcagactcaaagggcaaaactgaacttggaaaagcacagggattgattgggcaatgtctcaaatctggagaaagagacaaaactgagaaacgggacaagattactagaaacttactggacttcttcctaaaaggtagaaacaaaggatgaacaaaagcattagtacaaattgagtttttaagtagaattaatttctagtagatttaatgaagttttggacattcttcagcaatatctactatctaacagtaaaaatattgtggaaccatagcttccctactgcccagtcctctgtctgtccttgatgttcatggtgtcagcgattattgggatggttaactctgcaagtagtatttaggaaaaagtgattgccctcttaaaggttaccatacctttccaaagaccatagcctctggattcatttcttagcagttttatagttcctttgttaaatgttagcatgtgagatagtaatttttcataaaaagcatatgtatacttttaggtggcatgaaagtgttaactatctgtggacttttatccaatttcagcttatggtgacaggtttcctattgtagatgaattgaattaatttttcaaaataacctttttttgcgaggctatatcaattggtgtgctacagttaaaatgtattactttgcctatttcccattttctactaaagtttataattcacacaaagaaatacaataaagtgtgtctcctgaaattgtgctttgtgaaatgatgaggccattactctgccttttgagattaataaatttttctcttggcatttgttcccttatctaactggcaatgtgagtttaagctttacagataaatattatactattgttttaagttttgatttttgtttattccttataaacattacttttgaaaaataaagtgtatcttctgcaagttgtacacatgtatatatgaagtaaacctagtcaaagtgcttgagttgctttgtaattcaaaattatgtaagtacattatgttatgttgaataacaaaaagtgataactctaagtttaaatgggtgactaaatttaaaaaataatttataccaagtatagagataatagatttaaacatatcaatttaaacttatagctatcacttcttgttatttaacataacataatatattcatgaataggtagtagattccatttttcatgatcaagctttcctcaaataaccctccctccaattttcaataacaacgaaacacaacaaattaaccactcatccagaaattctaaactatttacgtataatgattgtcacatacctttttaaagaacactttgttttccaaatataatttgactaaatgcaaataagaactgaaccaataaaatgaagcttttaaaaaaattgaacttctgtttgataaatggaattatttatttgacaacactaaaaatatgtaaaataatgctttagaatatcattttaaatccactttttaataaaagctttcttaactaattaattcaacaaatatttgttgagtgactaccatgggttagctactgtgttaagttggatgctagggatgcagtgataaagaaaacatggtcctatgaagcttttgttttggtggaatggtggttcttaaacttgcacgtgcctctcaatcacctggagagtttgttaaaacataggttgttgggcttgacatctacagtttcagattcagtatttctgaagtggggttccaaatttgcatttctaacaaggtcccatatgttgctgatgttgccagtcctgggaccacactttgagaacagctgtcctagaggaggcagtgctgtctatataccaaaacttcaattagcctatgctgtgctgacccatgcatgcccactgcagctccccctctttcattttttttcagaagaaaaaatgctttctgtaaatacaatctggtatgtggatagtgcacaaattatatagttgcttcttaaattactgagaaatttacgaggtcaagtaaatataattttcagagataatgctaccttatttagcctagtgaaaatgtatcatcagtattatggcctgattttcaatttaatcatcactttattttaacataaagcttttctttctgatcttttggtagccatccagttttccatagtcttttaaatgtgatggccagtggttcatttattgcaataattaagatggatagcagcatgccagctggaatgactacacttgtgtttattgtataaattatttccttagtataaaagcctcttttatggcttttgctttggtcatatcttttgtaccctaaaccattaaccatagcatgtttaggagagccatttataaagaagctggtaatatttaccaatttctaatcaccattaattcatgtctacatttttcttagcactggagattgcttgttgctttgttccttctgccaagagcaagaaaaaaaaagtgttctaacccttctaggactcataagcttttttttttccttttcttccttttctttgatttttttttactacattcacacttcttttattttgttctactctcatctcttttccttgtgaatcttaagttactttggttagtttactcaaaatacatagaaatgcagcccctaatgtgaatttcttataaggcatatttgaaattcctttaaaacacagactgcaactgatttttgtcatttttttaaaatgctacttgagtttggtggtcttttgcatttcaaaaataattgcatttcagttttaacagaaattattcagatatagttcagacactgatcatttctgtatgcatcatcgtacccagcaaatttcagtaaatatttgctgacctattttttttctttacactttagtttcaaggaaattgcatgcctgttacctttctaaaagctagtgcagtgattgttggtatatttacaatactcatctttccttttaaactttgtaagtttgaaagtataaatcaaaatgtcatattacatcagaatataaattttattattacccatatatcaaataactagttaaagcaattcagagtagttaagagggaatatttagtggcaataaatgtatattgttgcatataaatacacatattaggcctagatttattgtctacaattcttttaatttcttatcagatttcagtatgaaaaaaagtgaatgaaataagcaaaagactatatccagttactgtaactaatgctaatttcataatctcttaatggtttaatgttatatcctgatggttttatgttttttgaccaatctttcaggctatccttttctgaccactcaaaccatgaaaacctgccctccctggaaaatccaagagccagtcagttcccacaaagacaacaagagccactctgtttggaaaactttggctctttttcagcagtcaccattggccttagaatacagagcattcttacccactggctaagattaacttggttagcagacagcctacatcccttcgtataaaaactgttcttaaaaagtagcaaacattgtcctaaatttccttaccccatccctgactatcatcacctactttctgtcactgacttgttaatacctttattgttatatacagattttataagttgtccctacctgtttttaaataattgaggttataagcataatagttggaagggttaactacgttgtcctgttaaggctgataaaagggcatagatgcttttaaacatacacaggaagaatgagaaaagcagatagcccttgtttgggtcattaagaagatgataaagtatttttcttatagcatgtttgtgggtaaagtatttgaaagcttctaatctgccattgataaaacagatactttactattaggttttgaaaaatgccttaaaaaaatctgctgcaaacatcatttaatatgtcatttaacttataaataataagcagaaacctaatatcttcatttttgcaggtatgaaatattgtaaaagaaatgtaaaataaattttaattttattcattgatactgtgaaggagaactttaatagactgagcataatgtatcatttgcatttatataatgattttaccactgtcattttagaatactataaatttagaagagtaatacagtaataataagaatttttaacattttttagtctcaggttcagagatgagtaaaagaccctcaggacatacgtaaagagaagaactctttctagacagaagtgaagaaatactaaacactcaagtgtaagattccctgaagatggaatgatggtagttgtgttggaagtggtggtgggatttgttggttgagggaagagaagagaaactaatctattgttcagagatggggttaagtagaccagggattagatttctactcagttaccagctagtcatttgccgttgagaaagttacatcagtctttggatactttaattcccatctgtaaaatggggaaggtaatacctgttttataaagttagtggcataattaaattttaaaaatgtgtattaaagcattttgtacacaaagtaggcactcaagaatcgaactattactaaagactcttactattaaagaaaagcaaaactgtattataaaggaaaagcaaacaaactctggacaatcagaattataccagaagtgtattttccatggaagttgaacctagattagtgcataacaaggaactgctacaggcattgatcgtttcttagaaattggctactgattccacaaggaacacccacaccttagtagctgatgatccccttttgtgtggaatagaaataaatgtaagtagacaataaataaaaactgaaattatgtactgtctctgtaatttacgtctagtatttgaaagatcaccactgaatcttacgaattttgctgactcctatacacaactacttgggaagtttccttaggggctgagacacaggagcagcacagtagaggagcagtacaaaatgttcaggagaagataatagtcagatagcattgtcacaagaaatacgctgtattttccactaagctcatggttgctctcagtgcggttgtttattcattcattcatccagtaaatttttatcaagtgtttatatgttatcagcatggaactaccaacacctgaaaatacaataatcactaagatagatagagtccttgcctttgtagaacttgtagtatgtctaaaatttgttttaaatcattctgactcttttagaaagacttcttcatattaagttgaagaagttgagtaaagttgccacccccatagtatagcccttttaatgaccccgtctttctcattattaaggaatgtccatgtgacttaggtgttctgaagcaaagtaaactcctctagactagtggttttcaaccctgactgcacttaggatcatcttggaagttttgaaaatatgaataattgagtctaaccacagacaatgaaataagaatttctagacttggggctcaggcattagtattgtttaaaagctttagaagtgattctaatgtgtagccatgattgcaaacgactgcttgaaaaaaacagagaagaaaaatagcaacttggggtagtgaatgatgacaaacaggaagcaaagtgagtgatagaaataacaatcatgaagctttaccaaacatccccatcatagatgtcaagataaggcttatacagaaagtaaataaaacagcttactcttagataatatagtgatttcatttatactcaatggaaatattccatcaagaaatgtgccaaatctagatactttgtcatattattagaaatgtcgatattgcaactagaagatgttggataggaggcaggactagcttgtggctcccactcagacagacagagcagtgtgtggagattcattgtgaaccattgctccaagaactacagcaggaacataccaggaaagcagagagaatccacagaccctttgaaggaactgtatcactgctgcaggctccatgagatgctgaaaaactgtgagtcagcttgctttctcaatggggagtctcgtggtttggggcaaattctcagccctggtcacctgctgcatagaaatagactcggtgctgttggtggggcatggtgggagtgagaccggcctttaggtgtgcaggctgcatgggagcggggtgtggcccgtgactgctggctttctcccacttccttggagacctgtatgactcagcagaggcagccataatcccccttggaatgtaactccattggagttataactgcacccccatcccccatggcagccacagcaagctctgcccaggagaggctgagttcagacacgtctatccctgcccctacctagtggtcatcctctgcctgcccaggtagccaaagacaaagatcataatctcctgggagccctatagccctgcccaccgtctgagaaacctgaatacttaaccaggtgtccctagggcaagtttgcatcttctctataggattgcagctgatgcgcttctttttttttttttttttttcttaaacagagttttgctcttgttgcccaggctggagtgcaattgtgcaatctcagctcattgcaacctcttcttcctgggttcaagtgatactcctgcctcagcctcccaagtagctgggattgcagatgcccgccaccacgcccagccaatttttgtattttcagtagagacggggtttccccatgttggccaggctggtctcgaattcctgaccttaggtgatccacccacctcagcctcccacagtgccgggattacaggtgtgaaccgccacacccagctctgatgtgctcttgaaagcatcaccttctggctggaggccaacaaacacaaaatcagtgcactaaataaaaacacaaccagggacccttatggtgtccacttcactcccctgataccttcaccggagcaggctgcgagacctgaaaacggatcacatcacaagactcattgcagacactccccagtaccagcctaagctggtagctccactgggttgccagacctagaagagcaaaaacaatcatgacggtttggctctcaggaagccccactcctaggagaagggggagaacaccacatcaagggagcaccctgtgggacaaaagaatctgaacaacagcccttgaatcccagatctgccgtctgacatagtctacaccaacgaaaaggaatcagaaaaacaattctggtaatacgacaaaagaggtttcttcaacaccccaaaaagatcatatcagctcaccagcaatggatccaaaccaagacaaaattctctgaattgccagaaaaagaatttagaaggttgattattaagctaatccaggagccaccagagaaaagtgaagtccaacttaatgaaataaaaaacatgatacaggatatgaaaggaaaattcttcagtgaaatagatagcataaataaaaaacaatcacaacttctagaaatcaaggacacacttagagaaatgcaaaatgtactagaaagtatcagcaatagaattgaacaagcagaagacggaacttcagagctcaaagacaagtcttttgaattaacccaatctgtcaaaaacaaagaaaaagaatggaaaaaaaatgaacaaagcctcgaagaagtttgggactatgttcaacatccaaacctaagaataattggtgatcctgaggaagaagagaaatctaaaagtattgaaaacatatttgagggaataattaaggaaaacttccctggaattgctagagatctagacatccaaagatgagaagctcaaagaacacctgggaaattcgttgcaaaaagatcattgactaggcatgtagtcatcgttatctagtcaagacaaaagaaagaatcttaagagctgtgaggcaaaagcatcaggtaacctacaaaggaaaacctatcagattaacagcacatttctcagcagaaaccctacaaggtagaagggattggggtcctatttttagcctcctaaacaaaacaattatcagccaagaattttgtatccagtgaaactaagcttcataaatgaaggaaagatacagttgtttccagacaaacaaatgctaagagaatttgccactaccaagccagcactacaaaaactgctaaaaggagctctaaatcctgaaacaaatcctcaatatacacaaaatagaacctccctaaagcataaatctcacaggacctatataacaataacacaatgaaaaaaaaaaacaaggtatttaggaaaaaaaatagcacgatgaatagaatggtacctcatatctcaatactaacattgaatgtaaatgacctaaatgctccacttaaaagatgcagaatgacagaatggataagaagtcaccaaccaagtttctgctatcttcaggagactcacctaacacataatgattcacataaacttatgataaaggtgtggaaaaagatattccgcaaatggacgctaaaagcaagcaggattagctgttcttatgtcagacgaaacaaactttaaagcaacagcagttaaaaaagacaaagagggggcccagtggggtggctcatacctgtaatcccaacactttgggagaccgaggcaggcagaccacttgaggtcgggaattcgagaccagcctgaccaacatggagaaaccttgtctctactaaaaatacaaaattagctgggcgtggtggcacatgcctgtaatcccagctacttggcaggctaaggcaggagaatcgcttgaacctgggaggtggaggttgcagtgaaccaagatcatactattgcactccagcctggacaacaagagcaaaacttcgtctcaaaaaaaaaaaaaaaaaaaaaaaaaaagacaaagagggacattatataatgataaaaggactagaccaacaggaaaataccccaattctaaatacatatgcacctaagagttctcaaatttataaaacaattactaccagacctaagaaatgagatcgatgacaacacaataatagtgacggactttaatactccactgacagcaccagacaggtcatcaagacagaacgtcaacaaagacacaatggacttaaactatactttataacaaatggacttaacagatatttacagaacattctacccaacaactgcagaatatacattctattcatcagcacatggaacattctccaagacagatgatataataggccacaaaacaagtctcagtaaatttaagaaaaccaaaattatatcatgtactctctcagaccacagtggagtaaaattggaaatcaattccaaagggaaccctcaaagccatgcaaatacatggaaattaaataacttgctcctccatgatcattgcatcaacaataaaatcaagatggaaatttaaaaattcatttaattgaatgataatagtgacactgttcccggaccaaactgagggttgggctgttatttctcacagccccataatgagatgcagataaactggggaggaagagagtttttatttctgtaaccggttacagggagaagacctggaaattatcactagaccaattcaaaattataaagttttccagagcttatatactttctaggctatatgtctatgtgtaagtgtgcattcgcctaaagacacagtgatcaacttcttttaatctgtaactaaggtctgagtcctgaagaccttgctctggagcctcagtaaatgtcttacttaatctacatgggtccagatactggggtaattacccttatcttgtctcctgctaaatcatggaggtttgaggagttcttcagacccccaataaacttgtttgtggaggtctgggaagtttctttagacccacaataaaactttagtcctaaatgggtcctattaagaattccttcgttattttgtcatgctttaaggcccaggaaaggcctaggcaaaactcctgatgggctttttgttacatcccagccattgtataagggcactggcttttaatatttaacttaaccactcagtcagtactgaaacagctgttagtgagagctgacctaccacaacacaacctatcaaaacctccgggaaacagcaaaagtggtgctaagaggaaagttcatagcattaaatgcctacattggaaagtttgaaaaagcacaaatagacaatctaaagtcacaccttatggaactggaggaacaaaaacaatccaaattcaaactcagccgaagaaaagaaataactaagatcagaacacaactaaatgaaatttaaacgacaacaacaacaaaaaacaataaaaagataaatgaaaaaaaaaaactggttctttgaaaaggtaaataaaactgatagatcattagcaagattaaccaagaaaaggagacagaaaatccaaataagctcaattacaaatgaaacgggagatattgcaactgacaccacagaaatacaaaaggtcattcaagacgactatgaacacctttacgcacataaactagaaaatgtagaggagacgaataaattcctggaaacatacaaccctcctatattaaaccaggaagatacagaatctctgaacagaccaataacaagcaacaagactgaaatggtaataaaaagaaaatgccaacaaaaaaaagtccaggaccagatggattcacagctgaattctattagacattcaaagaattggcaccaatcctaatgacactattccaaaagatagagaaagagggaatcctccctaaatccttctgtgaagtcactatcaccctaataccaaaaccagagaaggacataacaacaacagcaacaacaacaaaaaaaaaacaacagatcagtatccctaatgaacatagatgcaaaaatcctaaacaaaatgctagcaaaccaattccaacagcatatcaaaaagatagtccaccaagattaagtgggtttcataccagggatgcagggattgtttaacatacataagtcaatagatgcgatacaccacataaacagaattaacaacaaaaatcacatgatcatctcaatagatgcagaaaaggcatttgacaaaattcagtatccctttattattaaagccctcagcaaaattggcagagaagggatataccttaaggtaatgaaagccatctatgacaaacccacagccaacatcatactgaatgggaaaagttgaaagcattcccccagataactggaacaagataaggatgcccactttcaccacttcttttcaacacaatactggaagtcctattcagagcaatcagataagagaaagaaataaagggcatccgaagaggaagtcaaactgtcactgtgtgctgatgatatggttatatatctagaaaatcctaaagacttattaagatcctagaactggtaaatgaattcagcaaagtttcaggacacaaaattaatgtacacaaatcagtagctctgctatatactaacagtgactaggctgagaatcaaatcaagaactcaacctgatttacaatagctgcaaaaaataaaataaaatgcttaagaatatacctaactaaggacgtgaaagaccttacaaagaaaactacaaaacactgctgaaagaaataatacatgacacaaacaaatgaaaacacaccccatgctcatggttgggtagaaacaatatggtgaaaatgaccatactgccaaaagcaatttacaaattcaatgcaattcccatcaaaaataccaccattattcttcacagaactagaaaaaaaaaacttaaaagtcatatgaaacaaaaaaagagcccacatagccaaagcaaaaagaacaaatctggaggcatcacattaccctacttcaaactgtactataaggccatagtcaccaaaacagcatgatacgggtataaaaataggcacatagaacaatggaacagaatagaaaacccagaaataaacccaaatatttacatccaactgatctttgacagagcaaacaaaaacataaggtggggaaaggacaccctattcaacaaatggtgctgggataattggcaagccacatgtagaagaatgaaactggattctcatcttaccttatacaaaaatcaactcaagatggatcaaagacttaaatctaagacctgaatctatacagattctacaaggtaacataagaaaaacctctctagacattgagttaggcaaagacatcaagaccaagaatccaaaagcaaatgcaacaaaaacaaaggtaaatagttggtacttaattaaactaaaaagcttttgcacagcaaaaggaacagtcagcagagtaaacagacaacccactgagtaggagaaactcttcacaatctgtacatctgacaaaggactaatatccagaatctacaaagaattcaaataaatcagcaagaaaaaaaacaattccatcaaaaagcgggctaaggagatgaatagataattctcaaaagaagatgtacaattgaccaatgagcataaggaaaaaagctcaacatcactaattatcagggaaatgcaaatcaaaaccacagtgcagtaccacctcactcctgaagaatgaccataatcaaaaaattaaaaaataattgatgttggaatggatgcagtgaaaagggaacagttttatgctgttggagggaatgtaaactagtacaaccactatggaaaaacaatgtggagattccttaaaaactaaaagtagatctactatttgatccagcaatcccgccactaggtatctacccagaggaaaagaagtcatatgaaaaagatacttgcacatgcatgtttatagcagcacaatttacaattgcaaaaatatgggaccagttcaaatgtccatcagtcaatgagtggataaagaaaatgtgacatatatatatacacacacaccatggaatgctactcagccataaaaaggaaggaaataatgatattcacagcaacctgtatagaattggagactatcattcgaagttaagtaactcaagaatggaaaaccaagcatcatatattttcactcatatgtgggagctaagctataagggtgcaaaggcataagaatgacgcattggactttggtgactcaggagaaaggctggggaatggcaagggataaaggatgacacattaggtacagtgtacactgctcaggtgatgggcacagcaaactctcagaaatcaccactgaacaacttactcatgtaaccaaacaccacctgttccccaaaacctatagaaattaaaaaaaaattaaaaagaaaagaaatttcctgtcctaacaatcaatgaattattttatcatatattgccaataggagctaaacaacgagtttgggccagattgatctgtattttctaatatactttattttttagagatgttttatattcacaccaaaattcaacaaaaggtacaaaaatttcctatatatccccttttgcaacatgtgcatagccttctccattatcaacatgctccatgagagaggtactttgttacaactgatgaccccagcgttgacacattattatcacccatgatccatagcttacattagggttcacgcttgctgttgtacattctgtgagtttgggaaaatgtatcatgacatttattcctatctttaaaaataggagtaccaaccggaacttgaatttggcccttgtatctttacagtgctggttttattttactctcatagtcatcttttgatgctgtaacggaaccacctgactacccatactatttgcaggttgtctccaagattgccaatatgggtcacccagaattagcacaatgggaaaggcaggttggctaggccaccttaataaccacaaagacaaattgtcttaaattagaggaaaaaaggtagtgtctaccaagacatctaccgtaaaatctatctgaaaattagaattggtttaaggtgaagtaagtcagaagagttaatgtccatttcttgttcatgtacgtgtgtatgcttgagtctttatgtagtaccactcttgatgtttatgtagttatgtggtactacataaatactcaaacatatacacatacatgaaccaccatgtaataccaccgtattgtctgtatctccggggatataggctttgctaacttgttttatgatccactgttgatacatttgtaaatctaaatgctaactcatttattctgtttacctttccgaggcaggcaggttcaattgacttaacagcaggctagcaactcagagactgtgaaatctaatcacattttgacccattcttaaattgcttcatctgtgaaaaaatgtttgatgaatgcagtactctcttgtgagggtttgtatgaagaataaatattagaaatgattgtggggcactttgaaaatttgttatgaaatgataattatattcaaaacaccctttgacatcaacttacagaggaaaaagtgtaatttttcccattgtagacctttttaaggaattccatatttggtttatccctagaattttctatacttgtgtataccatacttctcctaacccattaatggagttgttaaacatcatataatattgaaagatatttctattagatgagctttcaattattaatggtaatggaaaaacattaatgcagctcttacaacatgacagactgtcagaaagatctcaggaatagtgaagggccagagatcctagagtccctgatctgtataaatttgctgcagtatctttataaagtggataataattgtgttagagatcatttgatcagggagaacccagctcaactgtgcaattcagaagagctgggagttaggaggaggttatcctcaatatattaaggcattccagttcacttctggatgtcccacttggtaaaagaaagtacatttttcattgcatagtagcagcatccacagcagcagaagtagcagtagaaatagcagtagcagtgatagtagcagtggaagtggtagtagtagcagcagcagcagctgggataataggaatagtaacaatggcatcaggagcattagctaacattttattaactgttactatgtggcaggcactgttctaacctctttacacgtttccattcatttaattttcataacgctctttgtaacacgggtaattcccatcttagggaatactgtctatgagaatattattcatcaaaaatgagcaaagggacaaagggagaatagatatgcagtgctcaaagtttagagatgctgtgtagtcatttgaagagagctgaacaggacttcttccagcctaaaagacaacagaaatcctcaggtgactaggcacctgctgccatagatagcttctgatgttggagagaacacagagaaagctctacagtcctctgtgtttaggatcccataacctagaaaagaagtataacctaaaattaaggaggagaatatttttattctaaagatgaaaagtataagaaatgatttaatcacatataaaaaatttatgttgtaaacaggagcaaaggcgaaaaaaatctcatactgataagggcatttttatgaactgaaacaggttgctgaaggaggaaatagaatcttttcccctagaggcatttaatgtcaggactaatagcatcaggataaaatgctataagtaaaaccctgagaaagaagggataaacctctagagtcattttcaggtctatggttttataaagtaattcttaaatgtttaatatattagaatgggaggaatagatctatgtgtccaaataattaggacattggtttccttcaggattctgtcttaataaccttgaagactgtggtgaaacaaagaacatcaaggtcaaaaagaattagaaacaaatgtgctttattctcattgtgaactgatatgatagataatacttgagctatataattataattaatttgaaatgcagtacttgaaatttaagcagatgtattcctctcactgtaacactgttagaggtaaaataaaggagaataattttatactcaaatctagtaaaattagcgatccatatggacttcattttatgcaaattattaatcttgtatttgcacttttgcgtttgggaagtagaagaattgtaattcagaatcggaatgttgaaagtgtcatattgtttcttttacacgtgagatgatttacagttttaagtgttatgctcttcagaagaaaaacaacttacattgagccccagaagtcaacatgaggagaaagcaaatgacgttttgtttaacttaagaaaaagttttcctagccacctaattttggaaaatacttggaatatgtgtgaataaaaatacaaaatacataatgttcatccaaagggcttaacattttatattagatacaaaataagaactgatgggtgtgttaataggaatattaaatagaatttctctcaaggaaagattttaaaggaaatgatcataaacattgtgccgataaatcactcatcatataataaacaaaacatgattaaatatttatctaaatttaacagttttagatgcttaagttttgcttgggttctattaatttgtgcatgtagttaagaaatatatcttgccattcaagtagacccagttctaaacaaaagttctaccaccaactagcatagtgacacgtgaccttgtacaggttagtaacatctctaagttctccatttcttcgactgcaaaatgtgaataatgatattatttatctcagtgcccttgtgaggattaaattaattagtgaattaagtgcttcatacagtgactgatgtttgataggtgtcagtggagataacattttgtaattattatatatgatttaaaatgcatgtgataacaccatatagtttaggttatatgtgtatatttgtacagtatttcttctgatgttaaatttctgtatacattttcttgtaaataagaatagaaaatagtgtctccatcttctctctacacatttgcacatctttccaatcttacagacctgggtgattgtgctgtaggctagaatatgcgcagactctagtcaaacatacttgatatctacttcctcctctggtgcatagtagatggatgtgggataagtcacctagcccatttctgaacttcagttgtaatctgtaaaatgagatcattgatagctaactaataggttgcttggaagtacagatgtaacaatgtcaagaatctccatagttgacatagaacagacttaatactgaataagtaaagtgtccacagctgctgttattgcaatgtgtgtttgtccattagaggcctccttttaattacactttctttcaattaaataatgcaaaataaggtaattagaaaatagtatgtttaatgtttttgactaaagttttgcactcactaaatggaagaataaataattagttaggcctaatatggtcatgtgccatgatgttatttatcaaacattatttagttccatttagcaaatttaatgcctactatatgcaaaacatcatgttcaatgctggcaaagggggatgatgaatgttaataaattagatatagttctgctacttagtgacttaaaatccagtgattgacagaaacacagaggttaatttacggttgtcagtaaaagtatatgaagaaatgcataaatggtcgagtgcagtggctcatacctgtattcccagcactttgggaggctgaggctggcggatatcctgagcccaggagtttgccaccagtctgggcaaaaccgatggaatgatgaaattccatcttacaaaaaaaaaaaaaatgcagaaattagccaggtgtggtgctgcgcacctatggtcctaggaactcaggaggctgaggtgggaggattgtatgagcccggaagatggaggttcagtgagccaagatcatgccactgcacttcagcctgggtaacagagcaagaccctgcctcaaaaacaaacaaacaaaaataaagtactgtgagatagaataggaaactgtgagatagaataggaatacaggattgtctgaatggagtgaattggaacgcctccttatgcaagtgacctagaaaggaagaggaggcttctatgaagtttaaacgctctctagaaaacagcatgaacaaagaaagacttggatttgagaaagctcagagcatgttcagggtactgaaatgtagggtgctggtgtgcttatatgtatgtgcagttatgtttatttgtgaaaaatgagctaagggtcagaatatagggggacataaattttaaaagcataacttataattatattgaagaaggacttgaattctaggccaaggtgtgtgatcttattttgtatatattgggaatacatcaaaggcttttgaccaaggaaatgaaaaaacccaatttttatttgagaaagataaccctgatgccattgtttaagatatgtctgcagagagtgagtttaaagctgggagagcatttaggaagctaatgtgaagataaggggaaaaagcagatatcgtctgacctagagcctcagctgtgaaaatagagctgactcaagagatctatgtcagcctggatagtttggcctcctctgttaaacagtgtttcgaatgacttgtaagtctagcagcctgaacatgcagcgtagtcctttttagagcacatgttggaagagttgatagatgtccattttcccgtgcttatttactgaaagactccaggaaaggtacctcaatttgctttctctgtaaacagaattacttgctttcatccctttggtctcagagagttttaaggattaattagttgagacgaagtgcctcaaaaagaacaagtatggaacatatggttttcctgatacaaataaatcttatagatgcgtccatgctgtctttggaagcccagcaaataaaagacatgcaaaaattgtgtaaagtagaagataagctgagatcaacaaataataaatccccagcattagcttttgcataggaaataaacatttctgtccactgacaacagctttcttttaaaggaaaacaacctgatgataagccccaaggccacattaatatcagccaaagaaacatttattggttctcttctggaaaccataacaatgagcatgttgcatcaaattggtcacacataaattagtttttttgaatcgataaccttttatttattgctgttaaagtgatatatttttcctaaaatatttgttttctttctgtgccctctttcttttcaagttacctccacagatttatgtcaaaatattatgttcattatacttttgccagtggcttgctttgatgcaaccataaatgaatatcattacactttacaaagataatttattttctaggctttgctgtcatgctatatgtagcttgtatagttaaaacatatagaaactaaaatattttggggcctaaagaaagtttattattttgtttttggcttttcaaattgacattctccattgtatctctataatttaaggcaaccaggtatgacatgcgcaatttatttgctaagacaaaccagatatgctggataaagctctttggggcagtcttgcaactctctccttgtccccaaattcagcccatttttattagcttctatctggctcctgattctttgctgcatctgtcattctcaacttgactttgttctttctcttaaggataaggataagtcttaaggataagactctccttatcactgtttacattgaaggatacttagtcattaggatgtctctgtaagactttatacccttaagggaagactttaatgtgcctgaagctgtgtttttccaaatgtaacatttaatatctccttaacactcttttaatacaccctatatagttggcattgctacattccagctatgtgatattggtcaatttactaaacttttcagttcttaatttttctacttataaaattgtgataataagaataattgcttcagagcattgttgtgagaaaattatatataaaatcacaccataaataatacatataatatacttagctcagtttatggatcacagtaatagttcagcaattgcatattattattattgataatagtaaccgttattatgcaattgctccgtattgctcctcatcctgtgttcccattcttgataaatgttaccaccattcgaccaatttttagaccaatgtcctgaattatcattgacacatcttcactcatcttatttctatgcattgccgtattcttaagttcaagccaccatcatttcttccttgaattactgataacttcttccttgaattactgataaatgttaataaattagatataattcattttcataattccttgaattactgcaatagctaactcatctccctacatttcccttgcatactgtgcaattcatactcataatagagctggagagaattttggaatatttaagtctgatcatgttacctcttacttaaaatgtctcagtagcctctcataacttctaatatgaagtctaaaatccttgatatgagctataataaaagcccagcatgacatgtcctttgcctaattcccctgtgccattcatctcctctttatcacctttgtactcaagctttggcttttctgaactttccttattttcaaaaatgtctcccagccccacttccacccgagacattcacacaccccatttcctcttccaggaaggctcttatgtcgcctgggtaaacttactcttcaagtctagtgacttttttccagaagctttcctgatatctttccatttcaccccactgctgacttattaaaatttctagaattttatacttttacactacattctctgtgttgtattctcttattcagggtctgctatttaatttttaagttccttgaaaatagagacaatttcattgttttcatcagtttggtccaagtatatataacatagatgaaaaatagatattttgtattatatatattatataaataattgttgaatgagatgaataaactatagtgagaagatgctaggctttgttaaccattcaaacctaagctcaaatcccagcgcggccacttgctacctctggtactttgaacaaattctttagccttgtttctttgattttgttttgtttcagtcaggaaattgtaagataattatagtctcctcattattcttgtaagagtaaaataaggaaacatgggtaaagcacttaacatagaatatattttctataaattttacttcctcttttttttcatttataaagttgttcttccagagtagtagtattaacattgaatagtgtaaagcattcatgccattttattgtatcttctcttaggacatacagaagataatttggtccctcttgtcaatattcttggagtgattgatgacaaaccattttagtgtccctagaaatggaggacttactgcccctttttttcaaaaatgaatattctttttttttggctataatctgaggaggagatgcagtgatctaaaggtaaaagtatcagaaaaaagaattgtccttttgctgattgatttgagggatgtgattatgtagtacattgatgctgactcaccctgagtaaaaaattcgttacattctcatttcctcctactaatatatggctgtggtctttcttacaaaggcctttaaattcaccaagtataagctctaatgaaaatcttgtgtatttttaaaatgtctcttacttgatatgtaaaggaaaacagaacaaaggcattgaagaggtaactcttttggttttaggaatattaaaatgcaatcttcaccagctgtccatttttaaattagatttcagtttttcacatggggtactgtgtgtgttggttagcattggagtaagaatttaaattcttaaaagctttgaagttaattctgtattaagaaacaactgagaggttgagtatggcactatttcttcctgaatctgagatcaagcagatgtgcctctttcaatcagtttttactaccatgagatttaaagcaaagaaaaaaaaaacagttaatgacagttcaaattcacttagtagagtaacgtgttctaaaatggaggattgtaatggttgaagaattgggttatgtttttctcttggtgtgtgtcattttgtattgttttgtcttgccactaagttaatttgatgcatttccctcagaaattggggtagtggggtgtttacatcagaagactatgaccaaagtaaaatgaggggtgaaatatgcttttaaaaatatagagcaaaagcagtgattgatactatagatcttcaattttatcttcaggttctagagttttccagatattcactgtagaaaaaaaaagacttctggtcacaaattctgttactttcacaccaaaccccaaaacatttcaccgaatttcttatcttcctactctttcatttctactattttctttctttcttacaaataaaccttccttatcaaatcccattttctgtgctttatttgagcaattgatacatcctactttctttagatatcattttcctttgcctccagatacaactgcatctatggggtctctgatttttatagcttgttagaagaagatgctgtattatataggataaaaattattatataatacctatgtatacaaaataataaattcccccataatttaaaaataatgtagtattatagtttaaagttaggttctcttcatctacttcctgaaactctacagtgaggccaaaggaattgaatttaaagaataattctggaatgtctataagttaaatagacgacttgatttctgagtcacgttcagattgacgccacttcttttcattgctgcatttgagaaaatagtgtagaaacaggtacattctgactatataagacataactaataaaagtgaaaacaaagaacaaaagtcagggaaacactaatggttctagagcactaatgggaaaatgaggaagtacatcaagaaagggctaaactgcattcaccttgacagctggtagaggtgatacgccaaactgcattgcagagaacatagcaactgcacgatgtttcaacagtcattttgacagggaaagtccagggacaaagaaggaaaatgaatataaagagcaaaattttgttaagccttgaaacagaaaaatttcccatagggaattttttaaaaatatggcagactagaaagtattagttgtcccaaaggagtcttatttttccaattgaagtagctgctgcttatctgaaacttaacagtttgttgtggccaaaataagcaggtggttataagaaattaaatttccctggagaatgaataatagtgacatacaagtaattataatatcacatgattcacattctgaagaaggtcaaataataaacatataattcatttccatctgccaacatgaatatttgttgagtgcctactgtgtgcctggcacagctagcttcacggttctatctggatatatagatggaagacgggtgagtcagagaaagagataaagactttttatatatacaagcacaaataaaaaaaccgttttggaatttttgcagaattgcaaatgttacttcatattttaaagtcaaaaaaatagcaaatataaaacacttaaaatttttttctaaaaggtagtatttcaattttaccatagagagatggttgccttatctaacatctcgaaaagagccaccctttgatgttcctcttcctctctctcttcctttctctctttatccctgtcttctacacctttattaaaaaaatggtcttctcagtatttttaatatagaattctgcaaatgaaataaagaacattacttatgtaggcactgaacacatttcaatgtttttctttttaaagaaaatgacaggttctgcacactggtatctactaaaaatgaacccaactttgcctctgagaatgttactgtgaagaaatgctgcatctaaacttcagccaaaatatgctaattagaaaatgaagctgaatgaattgctttgctagatgagattatttggaattatattactgaattttggaaattatgtgtcctatcaaagaataacttttgtcataatgtcttccttagctcacaggacatttattaatgccactcctggtccagtcagttcagccaccatttagagaaagtctaccatgttccaggcagctaccagcttctaaagatctagagacaaataagaaccaacttttctttgtttcacagagtagcacagatgacaggcatatttacacctaattataatgcacagagattgagggttataatggagatattgctatgggaacaaaaatgagtgaacaacatatcttggtggaggtgcagaaggtatatttactgaagagaggaaagtaaaaagagggagatttgtaatctctgaggaagagtattcaagggcttagacacagtttggttgtattttaagcaaggaaatcaatgatggattggtaaaaagttaactccggggcaactttttttaagcattggtaacctgtgagaaaatgatctatagtaaatatttctttttattcctcaggcagtacttaaagcactgtttttaggagttagatgttttccttatactacttttttaatagtagtaataaccctctcaggtaagagttgttaatttttttgtagagatgaacaaataggttcagagagaatgagcaagtggttccatttacacagttaataatcaccaccaattgtctgtctgattgaattaaatataagagggaaacatatagaaatgaggagataaattgcagccttgatagaaaaggagaattgtgtttgtgctatggttcttttgtggtccatagcaatttaattctttgtgatgaacgtaacactgataataccaaatttcaatgaccacatattcaattcataataaacatttattataaatgccaacaaaattggtaatttaaagaattctctatttttaaaaaaagaagacaaatagattacttttaattatatctagtcttttcctcagcctgttctattctgataaaggcttaagaaggaaatggttctgatagaaaagaactaccctgaaatgtggattaagacttgtcacccatagaaatcctaggttccacagctgtgaccaatccatggcattcaaagtggatctctcaagaagaagcactgtagttaagaaaatttctaaaagaattttgttcattcttgagtcaaaactttgatgagattaaaacattttgttccacttctggggtctcagtgttgaacaattttagcctctttaagatgaaaatacttttcttgaggtttttaattttttttttaacttcaatatcttttggggtacaagttttcttttttttacatgggtgagttacataggtgaattctgagattttagtgaaccagtcagccaagtagtgtttattgtacccaatatgtagttttttatcccacaacccactcccaattttcccacttggagtcttcagggtccattatatcactctgtatgcttttgcatactcacagcttagctcccacttataagtgagaacatacagtatttgagtttccattcctgagtgacttcatttagaataatggcctctggcttcttccaagttgctagtaaaaacatttttacgttgctttctgtgggtgagtaatattccatggtatatatataccacatttcctttatccattcatgggtcgataggcacttagggtggttccatatccttgtaattgtgaattgtgctgctataaacatacctgtgcacatgtctttttcatataatgactggataaaagtactttaaaacaactaatgattccaacattatttccagtggtactggtaatgcattcaggcagaaatttttttttactcctggatttttatctgaactaatgcactttttgtatgccaattgccaattaaagtttctgattttttgcattgcccctgagatattttatagccttgggcaaaaaagtgtactcttccagaccacaaagataaatggagaaaatagtgcctttccttaatttatggcgctgttgtaatcatttaatgtgtgcaacatgctaaatgttgtcattatggtacagtattggatttctttgttgtattacggagcagaacattcaataataataagatagaacagctttttctaacaacttgtgttcaagccactgataataatgaaattatgccagatgaacttattctccaacctcttcctgaagagtcagtgggatacaaaatgtttgagtgaggaaaagcattaatggacagaaggaaagtgtagtcattactctggggaatgacatagttgaacaactgaacatgcttttcagaaatgattacactcataactatcagttgtactagttcggccttgaaaatacagtagctatcccattttacaacataatgtatagttatgtcatataattttactggaatcttctaatgtaagttcccattgttagcagtgaaagaaacagctggtcacaagtacattgtttgaaagagcaagatgaaatagaaattttttataagagatgcattcctgtaatgtagatggtgaatcaaagtctttagagtaagagttttattgcaataatttattataaacattatattataatgtctttagttcactactataatatccttggttctttgagaaatcctctccctcccactattcaataaaaatatctgatgcactttttcagggcttatgaaaacaataaatattgtgacaaatgactgttatcatgtctatggcgtctcatttgagtacagattcttttggcgcagaacaaacagggccaatgacttaacattaggcttaatcagttatcctagaaatttaatattgaataattctttaactttgggtaatagttaatcatagctactaggcatttttttttaacatctgttctttcagggaaaaaaaaaaaaaagaaaacatcatataatcaggtcttcctgaaattctgttcaatgtgtttctgcctaattctcctccaggactctgtttgtttctttaatgaccaagatttcttttagatgagtattaaattctttgagtttgtaacgcaacacttgcaaatatttcgctagaaatttatacacacatatctgtcattttattctacaaattgatgttttctcattctataacataaggaactcagtatttaaagttcaaagcaatcaccactttaacaaactcttgagcttgtagttgaaagttcacacacattttacagaagagaaacacagctagagaaaagagcctaatcatatagtcagtaacttagattcatgatgactattctgtcttgaattaaataagctacccttatttgaatagtttgggggacatctaactagtatgtttttaatgtatattttcattaacatttcagattactcattcattcactaacatttttggtacatgtgccatgtacactattctagatatgtggggttttttagtggttaaaattgtcaggttagaagccagatattatttattaggaatttacttcagctctccattttgtaatttccttgtgtctgagaaattgtatctactttgtagggtttttgtgggtatcaaatacataaaaacatatgtaaagaataaaatgaagcctgagccatgttatggtatcaaatcctagatactattaattactgtattctcatttaatcctcacaataagcctgttgggtaattattattattctcattttgcaaggagccatgctatcctaaattatacgtctaagaaattccagaattcagatgaactcttagaatagtccgaatttcaaaatcatgttctttccattacattgatgacaggacatttcaggcaaaataaatattgtgagcataagcatattggtgttgaaatcagaatgtttcatggtggtctactgagaatttacccctcttgattttagagttgtgggtaggtaatgttgaatagttggatggccagtttaaagacaatctgaaaagacaggcattataataggaatttgctgaggttgacatttgaagacattgattatatttaggtatgtcttaagatggcaggaaaagataaatctgtttggaaggggacaagattagcaagacaagtgaggatgattttgtaggaatctaggtgtgaggtcacacagccagactaaaatggtgtcggttaataaaaccatgtccagaaaaccatagatatttataagaaacaaatgatacgttgatagactataataggtgaataaggggaaagagtaccttactttctgacttgagagattggcctccttcacctagtaaataaatcaaaatggaatacatgctatgtgtctgcccttgtgtttagcaccatgcagtaagtggtagaactagaacttgaactctggggtgttttgcatgaaggtccttactctcaatttcactatactgcctccaacctatgagtgccatttagctattttgattctcattctacagatgaggagaatagggctcaaagatgcctcaggttgtcttaacaacagagttatcagttgtaaaattcagaaccttcgaaatcttgttttgtacttcattattattgaattcttttatagttcttttagcataagtgtgagtctctatgaaaaattattttatttacttgaggttatgctgtgcctcatatgtttgatgacacattggttctatttgctctgtgtgtgcgcctgtgtgtatgttatatacctaggcttgagcagggcaggggaggcaaaatttcctcattgtccagagtggaacctctcagtctttcaaaggagactcctgcattgggcattggagatgtcttatgctttttgcctttgctacacacttctgatcccggagaaacgattttcattctccagcaatgatttaaaaaataatttatcacaaaaattaaatagattgcactgtaaaaatcatataattactcctgtaaaactacagatgaaagcatgcacagaaaattatagtggaaagtttttaattagcttctgattaactgtaagcttatgttttaaatgtaccatgcagaaccttataacaagtaggcataaattaaatagccactaatatgtatgtagcaaaaatattaatacggctgctactagggattttcactggcatatttttaatttttttttttttttactttaaagtggagtagattctgtagagttggggtatcaatcacatgatcattaaaagggcaaaatattttttcaaaacttgtgcaataatctttacctaactggctatgtggttggtgatttgttcctctcttaaagagcgaacaggcgctctttcaaatggagatgcttacatgatttcatgtatattcttagttttcatgggagacctatcccttcagtagaaggaaatgctagctttaggtcacagcaaaactaagctttatttttcccattttgtctagtctatgtttcacatgttaaagttgtgaattggacacttaatttgagtgagagtcagggtatttttcaaactatatttagtgactttaacttgctgagtgacctaggacaagtcatctaagctctctgggccttagtgttctaactggtaaaattagaaggttaaattaaatgatctttttacctagtgtcaaatcaaaagaatcacatttctatattaattgtatttttaaggttgttggtacctaggttcttttaataatatcttggaaataaaacattattatattctttaaaatgtacatataacaattgtacatatttatggtatgtaccatatttatggcaaaatgtgatgttttgataaatgtataaattttgtaatgatcaaatcagggtaattaacatagccatgactttaacatttatagtttctttatgatgagaatattaaaaaagtctcttctagctattttaaaatatggaatacattattgtattatatatcatagtagtcatcctgctgtgcaatagactaccagaccttatccctcctatcttactgtagatttgtactcgttgacaaatatctctacaagtgtttttcacaaagaagcccctcagtattctgacatgaggaaaagcaacgaacttgctttccatttatgcaaattagattgttaacttcctatgcaactaggaatacttaacagtacttaacaatatttatattgttcctttggacataagtatggctatgattgcccccacctcccaaaaaaacaacaaaaaggaatcataggaaacaatttttaaacttattttcaattttttttattattgattaaataaaagcacaacttaacaaaatataggcagtcttgtactttatatacaatgatccttctggggagacatggaaattcatctgtcttcctcaagccaagtgggactgttctgtcctaggagaagggatttttaaggagtggggaaggaaggggaaaaaaaggaaatcttttccttattgtcaccactgcttacccttttcaaagaagtatcttcggttcttagaaatcccatgcccagggtgaaaatggagagaaagaaaacacaggaagaagagagtatatatagagagggaggccagggaactaggagaacagaatgagaggcaaggtaatctctctcacccttttaggaaaggactctcattgcctgtgctccttctttacctgacaagctgcagttgcccctacctctactgttgcttttgttcctctgtaataaagaggtagagaagaagggaagaagaacagctgaaaagcagagaaaggaaagaagagttggcagtgaaaggcaaactcatagattgccttaaaacttccatggctgccacttctggccccctgtccccactgcttcatcaccatgggctgaagctagcatttaaagggggaggaaaagagagaggaatctgaagacaggaagctctagtctctttcagtatccactgtgttcttcatctacccaccccctcccctcatctgacaccttgcctaggacaagggctcttaacccctgagcttccaatagtccctaaataagctgtacaatgttttttactctgtgaaattgtaggtagagtttgggtgtctttggggcggggagggttcatagagtttctccgatttttagatacacccagcataacctaactcacctgtgctttttaatattcttctttggcttccataggctcttctgaaaacctaaccactatatgcacaaagttcttaccattggaaaacacctttaaatgatacacagagaaagtttccagaaaaatcatttcaaggttggagaaaacctattatacttttttaaataaaataggaaataataagctggattgaggtaatatatatttggctcctactcacacaaaaattttgaaaaagaaaaaaaatgtttaatttattttttaattcttcatttgtaatcacgaaatatctgaactaaatatttgaatctctgcaaaggctgggagttgctatgtgttgttgggaccacactactctcatatcctgtgtaaataccccatgactgagtaaatattatcatgcaattttagaattagaagtttagatgttttgacctaaatgttttccagggttaaaatatccttcttacagaacagtgatcctcataagtttaaacagactggaaacaataaagcctaaaaagaaaatcatgcacatcaacaattttctttctatctttcaactttaattttcacccttatagccctaaaccactaatttgaaaagatttttctaaaagttcatctttctaatatatcataatatttctttttttctggccctggaagagattgagtactccgtattttttaaatatataatggatatattataaatactagaaatgagtacaatactattatttaattttgtgccaatttcatgaatgaggaaactagatattgagcaaagtgcaaagatagacattacagtcctgacctctggtaagtatttcagaattgtcactttcaaaaggtaattcaagaacactgtatttatgtatctctcaataagttcactatttgcctctcctatagaaacatggtagttgttgtgtgaaccattatccaaagcaaagttagatcaatactactgaagtaaataaattgaaaactatattaaaactgaaaaatgtggttgtgaggacatgcaagaaaaacaatgtggtgctactagcctggaattggtatgaataagccctttaaaaaagaaaaaatgaatccttaatctttatgccttagtatcttacaattctccattaacctttgataaaaccatcatattgggcacaaaagaaacacagtcaatgaatttttcttgatattcttttttacaggaaaaaaatcaaacaatgtgattcattataaaacctatggtcagaatcaataatctatgccttcatatcatgcctgtttagataataattattaagccaccatttaaaattttttaaactcaaattccatctgcaaaaaatctattttgcttttaaaacttaatattaggtttcaactttactttctgtcatccttcttttggttgccacatcagtagactcagaataaaagcatctgcccaaagcaaatacactggagttcactgtcaaacagagattcccaagaaaccaaacagaaaaggaataaaaatgagaagcatgttttattaaatgtcttctacacctgcttcctttatcttttagacctgcttaccaaagcccattggatattttgattttttaagtcacaggcatatgaactagcttgaacatttatagtatcaaattattaaaggtaatgacctggtatttaaaaaatgatgttccacatctaggggatctccatgaaagcttttcagctgaataaaggttataattgttaaacaaattggttatttattaagctagcactataaacaaaaagagtatttaaacagctggtatccctgtgaccctacctttaatcttctccagagaaaatgtgacaagaagtgatatttaacaataattttagaaaatgtaatgaacaccaattgattatgtaacttgcattttattttcaaaattacattaaaatagtatgcaactattcatttaaatgcattttagaattaaaatgaattattttcacctacaaaacttatgtttaaaaatgagatagtactgttttattattgatctacattaaattagcaatatgttaaaattcatttctatattgtaatgcttggaaaattataaatttttgaactttttaaagctatgcttgaaagttcaagagagccttactcagtaatgaaagttaaacaaacaaattaataatacataaacaaaaaggttgtttataaccagtcctgcacaattttaaatctatgcagtagagcaatgtatgataattttaataaacacacaatatatcaacacattttcatggacactatatttttaaatagaaatttaattttggaatatttttaaatgtatagaaaagttgtaaaactagtacagagtttccttatactttatacccactttcttctatattaatatcatatttatagtacatttatcacaattgagataatattgatatattattatcaactaaaattcatactttattcagttttcttttttagtttttacctaatgtcctttttctgtgacatttacataccactttatgtttagtcatcgtgtctctaagttcttggctgtcacagttgttgaaactttacatttttaaaaataattttgacagttttgaggggtattggtcaggtatttactagaatgtctttttatttgaaattgtctgacatttttcttatgataatattgggataacagtcattgggttttgggaggaaaacaacagaggcaaaatggcattctcatcacattaaatcaagggtacttactgttaacatgatttactactgtccttgatcccctggctaagttggtgttgccgtatttctccactatgaagttacgcttcttcccttttttcattttgtggtctttagaaggaagtcactatgcaaagctcacacctcatgttccagaagctgcttttccaaggagtgaatatttatcctccacccttttgagtgtggagcatttacttaaattgtttggatttatgctctgcatgagagacttatctattatcttccattttaaaatgtatttaatcatcctatcagtatggactcatgaatatggatattattttatactatgaattatagtccattactactctattttgttgctcaaatagtttcagacattatcttttgaactacttatggttggaagttcctagcacaatgccagaaacatagtagacgttaatggtaatttagtgtgaacctaaacttaaaaatatgctcatgggccattttttaatttaaaaatagaaagtatattctattaagaggtactcgatccctaattgcaaatccccacttatatccttcgaaacaaaaaaaaaaaaaagaggagacatggtatataatttagatattgccacagtaatgtggcattgtatacaaccatgaaactcagcagcagacaacaatgaaaatgtatttagctcatgaatctatcagggtaagctgatctgggttaagtttggctgacttgggcagggctcactcatatgtgtatatggcagaggtggagtggtcacagggggagtcatctggagctagtaatgcctcagatgacataagtggagcaactcagctctggtccatggttgcctctcatcatgaagcaggacagcctgagcttgttctcatagcgatgagcaaaggcaagtaagcaaaatgtgtaagtgctttctgcttgtatcccatttgctatccttacagtggccaaaggacagcataaggtgagcccaagttcaagaagtggggaaatagactgtaactccgtggtgccagaaactgcaaagtcacatggcaaatatagtgtctacaggaaagggtaaagaatagagaccattaaaccaatcaatctaccatgcattaactatacaaaggaacgagtctaagctctcatgggtgtgtgtttattatttttgaaatcagttttcaccctgtttttgttatgaattatgacagtgagtggaagtgcagcattatcattaactatgtcatatttcagaagccgttcttcccaaactgaggaccaaatcatttaaaagtatgatagtaatttacttttcaattctgcactcattttagattataatgaaatcttactgaacaaatgctttttaacagagtatgtttccaatatgaatgaagatttcatgcagcaaaacttgagctgtaataatgaacaggtctgaaaaaacgaaagaataagctaagcctataaatctcttccatatacatttatgacagaattagacatatgaatactctattcttagagaatattcagtaaagcataaactcttacttataatgaggtctccatggaaatgctctttcaaatagagttattgacaattgcaaaatatacaacttgcaaatttttcgttttagggtttgtttaaattaagctttaagaattcatgcatatcaaatcctatttttttctgtagaaaaattcaaataaaatcatctgaaataagtcccctttttcttaaaacatttgaaaataatgtatgaaatgtaattaaacataaacttcaatgttcatatctcaagttctaaatacaatcctggaagaagcagtttctattacacttcccatagaaaactgcttatgtttgaggtagcattttgttttgaaaaagatgtgagcttcagatcctccaggaagctctaggtagatattccgattttctcttttgtaaaattggtttaaaaggtttttgtttttttaatctctctgatcctcggtttcctcatctgtaaaaaggaagtaatctgcctgcctcatatgggttttaatgagaattaagtgttacataaaatgtcaaacttagcacagcgcttcacacataacaaactccttactaactccttactcctgccttccaagatgtacacttttacatttacttacttagtactccactccaatagttttcttttgcataatagaatgcaaaatgcatactagaaaggaaattgtcctgcagagtttcagcaaaacaaatgactggcacaaaccagtatgttattacaaggatttatatacactcttgttctaatcatattctgtgaaacgtaacaggagcatgtattaaccagcttcatataaccaattttccaaactaatatcaacactaaaaagattttcaggtatattaagctggagaactttgttcagaagactttaagaagtggccatataggaaagcaatcaggattgcaaacattaaactttagcataaataccacttgttcctcctttcagagacaatgaaaactcttgcttatggctataataatcaggctacaaggatttctaagaactgttcttagtttaatttttctgctattgccagatgcttttcaccattttaggtgcccaaatcctgaagccaaatttaataaaggagaaacaggcctaattgataaatggatgttcagtatgcgttttccagtcagaacttgccttggcttagtggaacattctggtagttcaggcaaaaagtgtttcactacaagatcctgaacactatattgcatagaatatttgaaaaccagtgatgtccaagtcactaaattcttcctttacttctttcggatgggactaaagagaaggagtagcttgaccttgcttctatcaccttaagaaatatatgcacactctcaaacaagctgatacactgaacactggattatagacagtgcatttaaattttgtaatggatatctgatgaactagtcagagggattgaatctaccaattaaagtctgtcccactgcaaaaatagtcctcctgggtctgttgccaggaagaagactgagtaattaagatcaatgcagtttttttttgtattctgatgtccatcccccaaaacatcacttatttcattgtcccaccaagggggatataggaaagggctttctatcaccttaagaaatatatgcacactctcagacaagctgatatactgaacactggattatagacagtgcatttaaattttgtaatggatatctgatgaactagtcagagggattgaatctaccaattaaagtctatcccactgcaaaaacagtcctcctgggtctgttgccaggaagaaaactgagtaattaagatcaatgcagttgtttttttgtattctgatgtccatcccccaaaacatcacttatttcattgtcccactaagggggatataggaaagggcttaattataagactggtcagaaaatataagacaaaggtatccttgacattaagaatttcatgattcataacaactttaaaatattgtctattctccatatgaagtgactttcccttttaaattatttggtatttatggaactaataatgtgttgtgctaacacagagcttttcatccaagaacttcaaagcactctttatttgtcacattctgtgatcatttagtttgactataaaatattttatgattaatattggagcgagaaaacatgcaggaaaacaaagtataatattgggggaaatttcaaatacataagatttcatcctgactaattatctcagttttctgtagcccatggtaaattaggatgaaatatgcttgcacttaaaacttagctttgctaacatctgtttcttttaaattagattttaatttaaaatggcttgtccttacttcaaaaatatgagattatttttcctccgattttgagtttttcactaaaaatcttatatattaatatacataaatgtattctacattggcctttttatcctcttgggcaattactaaagtaattcatagacctgttcttactggtaagtagggataaattaaattgtcaggacactaaagtaacattagataaattatgtttcactgacttaaagacagttaattctctagaaatgaagcagtttatttcttaactcatgggtaagtttatattggaattttgaaggtgctcgtgaaatcattgtttaaatgaggtcttatttagttgagcacctaatgaaatttcttgccatttctcccagtgattatacatgtatatgtaaactgtcaaccagtttcttcatgtgaaacgcatcctaaacttaatattttaaaatccttatatatgtgatttaagagcaagcctctggagagaaactgttgtatgaaaataagtaaaatcattgtttggcttgctatattatagtctttgcctatgctactaatcaatgatatggcatcaggcaattccttaactttcttcaactgtaaaacaagggcatacaggttaatgactcctcaggtcattttaggcttctatatgatttaatacatgatcactttctaaaatatgtatttttttatctgtttctaaaccatgcttatggttgtttactactgacaaaaatataagattaattataactgatgtcatacctatagtcagcagtgctgaagcaaccagtgacaagtcatacaacaaaaaacgtgtctcctagagctgttaacagtaaaataaaatccactcttactgcttctgaatttaaatccgagtactttcctgagtaaataaaaggaggacacaaaccctgctggacgtttctgagagcacattatgactgtcactattttctttccattgctatcatatgactcaatgtcagcacagtgctattcatttttactctttatagggccataagtaattgataaaatggtattggaagattcatttgttataattcttttagtagcaagtaataagatgctatctcaaactagattacataaaaatgaaatttattgggtcacataaaacttagaaataatggggtaggactggctgcaggcctagaatccagagcctatatgatgccaaaatgcacatcttaccattgcttcacttgtgtattagtccatttttatgctgttgataaagacatacccaaacctgggaagaaaaagaggtttttttttgtttgtttgtttgtttttttttgagacggagtctcgctctgtcgcccaggctggagtgcagtggcgcgatctcggctcactgcaagctccgcctcccgggttcacgccattctcctgcctcagcctcccgaaaaagaggtttaatggacttaacagttctacatagctgggcaagtctcacaatcatggtggaaggcaagaaggagcaagtcacatcttacatggatggcggcaggcaaagagagagcttgtgctgagaaactcccgtttttaaaaccatcagatctcatgagacccattcactgtcacaagaaccagcacaggaaagacctgcccccatgattcaatcatctcccaccaggtccttcccacaacacatgggaattatggaagctacaagatgagatttggatggggacacagagccaaaccatattagtttggttttcccttgtcttgacttcatttggacaacttgttgccagtgtattttaggatggcagggattaaaatccatccattcaacaacttcagtgtaaacagtttattttattttatttatttatttatttttgagacggagtctcactgtgtcgcccaggctggagtgcagtggtgcgatcttggctcaccacaagctctgccattctcctgcctcagcctcccgagtagctgggactataggtgcctgccaccacacccggctaattttttgtatttttagtagagatggggtttcaccatattagccaggatggtcttgatctcctgacctcgtgatctacccgcctcagcctcccaaagtgctgggattacaggcatgagcctgtatttaatttttttaaattaatagttctagcaaaagttcttcaactgagtcttcttagtttagtgtagctcacatgtccatctaaatcaatcttatgattcaataagatggactctttcttctggccaaattaagcatgtgcacatctcttgagctggtcagggttggagtggggaatgaagtcaactttcctgaactgcataaactgagtactggggaggagtgatgatgcaatgacagtcagggtgctattcccagaagggtgaatgactgctaggttatcacaagcaatagatatccactacaaacaaaagtcaaagaggaagaaaaagagagtcagaaagggaaggaccattctttcaacaactgtatttgaagtgttaccatgtgtcctgtacactgagaatacagatgtgaacaaaacagacaaaaaattcttgtgtccttatgtaactcttaatctggtgggagagacagtgtatatgttgacctctggcaaaaatattggtgtaaaacacttcatcatgtgggaattatttggattcaaatattaggtctaagactggatttgcttggttaatttctcactttcatcctctgtaattttgaggagctcaaagttgctaaagtttttttattttacttacaactgattgttgcctataacagaaatatctaaaaatgtaattatatatttttaaaccgatatcatctattataagtaattatttgctttgattatttttcctataccttttggagaaatctttagctgtttttttataagcctttcccaatttctgaaatactatatgtttctatgacaataataggacttcatggcaaaaatgagactaaaacattaggacatttcatccacaataattaataaggaagacaagctgaatgcataaagatattctgattaattcaactatattacatgaaccctttggtacatagatggtagggaaatccaattagctataatatttaagagactgctgtcctaatacatatatcatctttctaggataatagcttcttcctctgattgtacattttttttcctccaaaggaagaaaaagaaaataatctaacgtggaaaatttttcttttgaaatctaccccaaaatttattacaatagtgtaaaactccttttaaaattttaaatgtattcaaaataccatacttaaactattctatacaaattagaagcaatttattttatagctataaataagaagagattcctaaactctcatattttatagtaggaaaatgtatatttttatcaatcttaaatttaggccacatttatattttaaaggaaatggtgtagcctaaactcaaagtttatttgtaaataaataagtctctaaacaatcactcctatgatgtaaaataaacttgaaagcaagaattttccctctgctgcccactaatagcctttgctttctaaacctttagtcatatctgtcatgtcctttaaaaagaatgtgatcttccttaaagtatgagcttgatagtccaattattgatcttctgctactgggtatgatggagaatccttaatttttcacagactatatactgatctagtatatagtctacactatatgtttgtactatattatacaactttatactatacttaacatgtttgctttttacataattcccccatattgctgacataatctattattcataattcggactccttggcattttacttacttatctttatacataagggacacacataattttatttttaaaatgttagttaagcttttaaaaagtctcagaaaaacatgaaaaatctctataattcaataatgtatttattcagtatctactagggaggatttaatcgataaatgttaaaagaaaatgtttcaccatagaatagataccaaaattatatgataatgaattatctaattattatgcaaacattttattaggtatataggttttattattttcttgtaattctcaatacttgaattttacaagtgtcactggcaaatgttgactaatgacaaaaatgtcaaatacttgtctctgtgatgaagcaatcatgttgctacagatattgtatagagacacagcccagatgtggtggctcacacctgtaatccctgcactttgggaagctgaggatctcttgagcccaggagtttgagactgcagtgagttaggattgtgcactgcactctaccctgggccacagagtgagatcttgtttaaaataaataaatgaaggaaggaaggaaggaggaagcaaggagggagagagggaaggaagaaagaagggaggaaggaagaagcagaaataatgttataatactacagacgaaggtatatgaaatcaggatggtaatgacagttgcaaaataggtgaaagcatttgctcttcctgccagagcaagatggctggggggccttagacagtgagtaatcaaaattggaagcagaaactatggcttcctagttgctagtagctagggtaatgagttagagagttaggattaatgatacaggatttgtatttctcactagtcaggatccaaagaactttagaatcattaattgagagtgggaagtgtaaccaggtctcagaagaaattctatttaattgtttaagttatagacctatactgagtgcaaagttccatagtagtgatgacacagagtggactagaatcccagagcagtcattatttgaatggtttgtgcaattgacatatgcctcagtttttgtttttgttttttaaccaataagcatggaaaaaaaaaacctcctatgttggtttcttatttttcatatatagaaagtcatatggaatactcctgctatatggtaagtactccacaaattacagttactaggctacagataaagaaatggtctaattttgaaataagcttatgatcttttggaaagtaagtaccttatattatgggaattgggtatgtgaataatcggggctcaatatgaaattttgaagttctaccattctgaattggaaaattgaagcaagtgttgatctgaaatctaaaatgtcatgtgcactgagatcaggatacacgtattcagagagcagaatgaattcaatctcaaggcagagggagttaacttctgtggcctatttatatttctgaaggagtcttccaggctgaaggtcagggcaaaaagtatagtcatttcttggagtgcaaaatccctgtgatgcagacactgttctatttgttgttgtcattgttgttactgttgttgatatttggctataacataagaggaaaagtgtgcttatagagatattttcttttctattctgtgaatatcataaaaagtaaggttagtaaatgttataaatgaattctgtcagaaaacactttataaaaggaaaaatctcacacgccatccattcaacaatatttaaagcccacttagtatttacaaggaactctactaatcaatgaaaattaacgtgatcaggctaaagcttttgaggggaccaggaaaaaaccaagtcataactagagaaagcaccttggggaagtttggctatagaaatacaaaggcatagcatctaagtcaaatgaggcgaaaggaagtcaagagaacatgaaccaggaagggaactctcctcctaggaggtggcacttgagaagagataacaaagaaagcattggttgcacaattctaatgtcaataagcaaaatattcattgattatctactgcccgtcttagaatagcacaaagggccttttcaggcttgtcttattttgcttaaattttgaggttgtgatgaagttgaagaagggaggatggacttggagaaaaacctccaagttataacttctcaaaggcagtaattagagagtatctcctctttgtctctgattcaggactcagctaaggcccagcaaatgggaaacttcctttttaaaaaaagccagtgtagtgctggcagtcattaaagatttgctgaattactgacctcttatcgcccacatgccctggggaatctgttagcagtccaccacctcttgtcactaatcaagatgcctttatgttaacacctcccttttaaaagcaagtcagtcaggaaacttaagtagattaacacttaatcattaattacctcatgggataaccaaacaaatttcttttctgtttaggctatctctgatcttctgccccaggatatatttttcaggcattgaaggactgatgtgagttactctggtagtcctggcacttagggtcttggtgaatctgcttggggaaaggaatgaaggcatggaaacaggacagaaaggtgaagctagagcagagaaaaagcactgaaaagaaacttcaactgatttttagtttcacctagggtatttctaggagttagaacctccatccaagaatgcctgagctaatgtaaattaagatctgactttatgtcttggttctacccatcaatcataatcactcggttattaacagagtatttgccaaaggccaatggcacttcgtgaccaaacaagaagaaaaggaaatatgaaagttcttaatatataacttttcttgtgggtttacattttctttttttttttagttctgaatcaggtaattgattcagtttttcatgtttgcacagtttatttaactatgttaactaaatggtctgaacagaatagttgctaccatggcttaagttactggttcagtgtctatggcaatgcattaaatcaagtttctgctcccagttttataaaaaggaaaattgactagatgagaacattgccaccttattcattatgtatagctcattagttcccttgtcaactttcctttgcttttaatcaattgaaagaaaaagtcttcatggatttttagtaggaaacatatggagctgtaaatcatcagtaatgtatgaacttatatttacaggtgcaactgaccttgactgtgcatccttcccaacttacttcttataaatcctgtaatcaataagtgaaatagtattccatacccttcataattcaccttccaatgtctgtttttccacacatcatctaagcttctataaaacattcttttcctctgtaatggactccaatcctgtttataagttttataaataagagcttaacatttcttctcaatacttagaaatgacgataaaagaattagttgacaagattggtatcttaagaatttcaactccacttaaatatctaagtggatgctgcattttttcaaagagttaccctgagtggcaatatattcattccaagagtgttgcctttgcacatagatcattgcagctatccctttcaaatagcatttagaatctattttcagatttaaaaaatagtctaacattagttttaaaaaataaccaaaggtatttaatgcacaccactacatattatttctttctatatacatttgtgaatttattgggaagagtaaacagttggagatgtgtcaatgctgggtttgaggttggatgagattttatattattaagtggagattattacattagaatgagactagaaccaatctatcttgggcctttatacttcttttttctccctcaggtttgaggtatcaggacacatttagggccctgttaccttttaaacataatatgggctcaagtaaaatgaactattattttcaaaatatattaacgcattacaggatgttagccaagtaaatttttatacatatttattttactttaagtgaatatttaaaatacattttcagtttgtttcttaggataagtgagaaaaatatcaaatatttgagagaaaaaaagatttttaaaaagagcgagagttactcataaaaaatgagtaaattcggccaggcgcggtggctcacgcctgtaatcccagcactgtgggaggctgaggcgggtggatcacgaggtcaggagatcgataccatcctggctaacatggtgaaaccccatctctactaaaaacacaaaaaattagccgggcgtggtggcgggcacctgtagtcccagctactcgggaggctgaggcaggagaatgatgtgaacccgggaggcggagcttgcagtgagccgagatcgcaccactgcactccagtttgggtgacagagcgagattccgtctcaaaaaaaaaaagaaagaaagaaattacatttaataaaactgattccttcaactttaaatacatatactttttaagataaggtctccttctgttgcgcatggtgaagtatagtgagtatagctcactgcagccttgaactcctgggctaaagggatcctcccacttgagccccctgagtagcttggactacaggtcaccatgcctggctaatttaattttttgtgtatagagatggggatcttgctatattgtccaggctagtctcaaactgctaccctcaaatgatccacctatcttggcctcccaaagcctggggattacagccatgagctacctcgcccagccaagattttgtttctattttgggtgcaccctttataagagatcaagtacaccattaacatgttatgtgtattacttggaaaatgaaatggaaacattatccattcaatcactaattctctcaagaagacatgcctatattcccaggggctaaattatatattttttctaactgcattcctaactccccagctttctccagatcctgatatgtctcctccctgttctattcatttccattgtgttgaaaaccatactctgcaaggcgcagtgtgtctgactgaagtatattatgcacgcgagctttccaaaagctgaaaaaaatattgagaaccaatgaataaaaccataggtatctaaaagacattgaataataataagagatatacaatagaatttaagaattcattaataaaaagtataactggagtttttctaaaataatggactcttaaaccagtaaaatatatatctaatttaaaatggtttcttttaaattataataaaacatatacatgtaggcacatcttattaaacaatggacaaatgtagaagtaaatttcatttccacttaaaaaggcacaggcaggtttcaaatggttctgcatataaacttgctgacatgaataattttaaatcaggccagttatagctttcattctttgaactgaattcaaaactctcttacttttacattattagagagatgaatcaaatgtttctataatgcctactttcattcaatccacacccaattttagaggactgctgtcacaatgccaaaaaaacatagactgaagttttaataatgtttcttatatgataaagaaattctagggtaattttatagcacagtataagtgctgaacttgtgttatacctttcaaataacagtaaccacctctaatttcttaaagggctctttaaaaaaatgcatggtatgtccatcatagagcaagaaatgcctctttttataatatattcaaaatggaggtggttatgtttccttttacactggtattgcaattcattttctgttagtaagcaagaatattgaccaactgtattacactctgttctcacactgctataaagaaatacccaagactgggtaatttatcaagggaagagatttaatggactcacagttccacatggctggggaggcctcaggaaacttacaaccatggtggaaagggaagacgcacatcttacatggtggcaggagagagataacaagcaagagcaaggaaaactgccttataaaaccaccagatgtcatgacaactctctcattatcacaagaacagcatgggagaaaccacccccatgatacaatcaccgcccacttggtccctccctctacacatggggattatggggattacaatttgcaatgagatttggttggggacacagagccaaaccatatcaccaacataatataaaatcactttgaaaggacctcaaaatacatcctaaaatttgtttcaaagatgaaaaatataacttaaaataccatgacttctgaatcagggtagtttgcaaggtgattatcttcacaattagaaccaaaatgcttaataatactattttagtttgtgtaaaactttaaagagtattcatgctcttcatctccctatttctatcttttttaaagaaaagcagtcaattagttaaataatcactaatgcagttttatatgataataaataatgacaccaacttggattgtcttaacaaatctgaacagtgacttttcttttgagaattgaaagcatccctagaaacaaatttgcctgtatgtttaatgactcatacattccaaatacatccaggagacaatcaacagtttatctgacgtatgatatataaaacaaattatttaagtgaacttcatttatcttagtctatacgatataatcataatgctatttataatgagctcaaatagcaacaagaaaatattggagaagttaatattgaagaaataaaattaatcaagctgtcctactattcaatttctgaatattcagatacagtaaatgttagttaatacatgaacaagtaattatcaagaaaataatccgatttacaataactaacaaaaaaatcttatggatgagtttaaccaaggaggtgaaagattactacactgagagatcaatacactaaaacactgaaaaacattgataaaaaaactgaagaagacacaaataaatggaaagatattttgtgctcatgaattagaacccttaatattgttaaaatgtccatactattcaaaacaatctacagattccattcaatccctatcaaaatatcaatgaaattcttcacagaaatagaaaaaaatactctaaaattcatatggaaccacaaaacaccccaaatagcaaagcaatcttgagcaaaaagaacagatctggaggcatcacaccacctgatttcaaaatacactacaaagctaatagtaactaaaacagcatggtactggcattaaaacagacacacaggccaacagaacagaatagagaagatataaataaattcatgcacttatagccaacttattttcaacaaaggtgccaagtatacacgtgaagaaaggacagtctttcaataattggtgctgggaaaactagatagtcacctgcagaagaatgaagctagacctctatctctcaccatgtacaaaatcaattcaaaattgattaaaggctgaaatgtaagatctgaaatgataaaactactggaaggaaacctaggagaaatgcttcatgacattggtctgggcaaggatttttttggataagaccacaaaagcacaagcaagaagagcaaaaatagcaaaatggaattacatctaatgtaaatgctcctgtacaccaaaggaaacactctaaagagtgaaaatagaacttacagaatgggagaaaatatttgaaaactatgcatctgacaagaggtaatatacagaatatatcaggaactcaactcaatagcaaaaacccaattaatccaatttaaaaatatgcaaaacacctgagtagatatttctcaaaagaagataaacaaatggcaatgggtatatgaaaaaatgctcattatcactaataatcagggaaaagcaaatcaaaaccacaatgagatatcacctcactctgattagaatgactgttatcacaaagacaaaaaataacaaatgctggcagatgtggggaaagggaattcttatacactggtggaaatgtaattagtattagctattatggaaaacagtatgtaggttcctcaaaaaattaaaaatggaacaaccataaaatccagcagttgcactatggagtataaatccaaagaaaattaggttggtatgttgaagagatagctgcactctcatgtttattgaagctctattcataatagccatgatatggattcaacctaagtatctaccaatggatgaatggataaaggaaatttggtgtacacacacacacacacacacacacacacacacacataatggagtactactgagccctaaaaaagcatgaaatcatgtcatttgtggcaacatggatgacacttgaggacattatgataggtgaaataagcaagacaaagaaagacaaaggccttccttattatctcacttacctgtagaatctacaggagttgatctcatagaactaaagagcagaatagtggctcccagatctggaacgtgtacaagaggaaggatggggagaaactgagtcagcaggtacaaagtcacagttagataggaagaataggttctggtgttctattgcacagtagaatgacaatggttaacagtattgtatattttaaatagctggaaaagaggattttgaatgttctcgccacaaaaaaaaatgataaatgtgcgaagttatggatatgctaaatgccctgatctgattttcgcacaatgtatacatgtatcacaacatcacactatataccccataaatatatttattattatgtgtctcttaaaaacaaaatttcaaaaatggtaatcttgttatactaaggtttctgaaaatgcaaagagaaatgtgatatatatatgttactcctttaaacttaaagagtaaaaaattaaaatcaatgtatcctaaatactaaaaaaaaattagaatgttgagctaagacgacaagatgaaaaagagtagtacttttagtgcaggagtaaatttcagaattttagagattgtatttttaaaggtaaatcactacctgtcctgttaagaggaagctaagacagatactgtggttctcacctgtaatctcagcactttgagaggccaaggcaagtggatggcttgagcccaggagcttgagaccagcctaggcaacatagggacatgccatctctaccaagaaatacaaattaaaaatttagccaggcctggtggcatgcatctggggtgctaccacccagctactccggagactgaggcaggaggattgcttaagccagggagatcgagctgcagtgagccataatcatgccactgcgctccagcctgggtgacagagcaagaaactgtctcaaattaaaaaggtgcgggaagataagtttgtgtttatacctttgtaaatataattctgaaactgtagcgtatttttgacaagtgctttgcttttgttatcaaataatgctggcagtggaatgaggctcacgacattattatcaataaacacataaagaaaataaaaggctatacctatttttctttctaatgttctcaagagtaggccaaaaatataaaaagcaagatactagaggtttagttaatctgattgtattgttttcatatagatctctagatttctgcaattggatgtgtttaacatgaaaccttgatatatgatttcactaccaacaacaacaaaaaatcagttgggattatgatttctaatggtgtggaaaccctgttttataaaaataagacacattagctacttaaagttcatctgaacctgaactgtaattatttcagagaagtcctgaaatcattttggtcctgatttagaggtcttctttgtcttttcaatttaaagcaattttcatgtatagatttttaccacatttccaccttttataaaaccctaaagaatatcagtcactaaacctactgtagtaactgatctgatattcatttaagctaaaactttaagctaaaagaaaataattaaatttgtttgacctaaaaagaatgtccttgcattttgtagtctccattaaaaaaaaaaaacactccagtaatctttcgaatcttttttcagccaacagctctgtaacatcttgcctctatacatgatactgcctttttagccaattccaacctagagcaatgagtaaccatggctccatccaattttccacatgacatctgtggcagtagaagtattaacaggacttctctcctggagagctttgccttaggaagagcttaaatttctgtaagaaagtcactgacacaggaattcagtcaggactctgcactaggactagaagctgccagggttcagatgctgacaaggcaatgtttcttatctctgagatttcgtgcccttcccccatgaagctatgctcctccagtctggcagggaactcgcctatggacaagagggtgacagacatcttttgatgatgagcatccacaggcacagggaacagaatcttgctattcattgagctgcacagctgtggcaactggattctgcccgggtgtcaacaatgggggcagggcttcagtttaggcaaaagggaaacagcttgagtataaatgaactgcttttaggctctttgaatttatcttccccagatgccctgagatttcagatccactctttattttactaaaacttcatagctgtgaagtgaccatcttctctgaaggctcacatggaaaaaaaacaaacatgtttctacatggtaaaaggcatgtttgcatatttacatatgaatatattgatggatccttggcattaatgattctacaactgtatgttcttattaaactctgggttcagcataaaatagtatcttactgatttatcttcagtgctattgtatggtctgcttggctgcaggttgtataagatgacaaagcattgatttagtgaattttttcacagttttgtgaacaaaaagcttgcatatttaataagtaagttattcaaatcttgaagaaatacaggcacgttctccaggcatttttagaaagaagagaaagagaatctatagcaggtggatatttccaactaggcaaaacgaaaagcacacaaagagttaactcaactgtataaatgaatatgctaatgaatgcataatttatctctgaagaaacatatttattgtttcactatttgattagatggcttcaatgttcaattaatcagttacctttcaatatcattcctgagagctgcttaattaatctgttgcactaccaccctattcatcctattagcaatccctcgtcccatttcaaatgacaaaatccaggaactgtgccacgtaaagactttatgtcaatgtcaagtgaaggttgataagtggctggctttttttctttattaggttaatcaaaccaatcagctttataggatttacatttgtcagaaaatgttaatgagttgaaactaatgagaaatagagggggaaaaccaccaagagaatggtggcacagtttatacacttcaacagcagtatactactttcattaaatagattgttttatcctcgttttctaaatgatggatttaaaatgtcctgctaattaaactcaaactcgtctattgtgttctatattgcatctcttactaacaaaggaagcacaatagatacacattcatatgtgtctttgaatcaaaaagtgtgctgtatgtttactactttctgggcactgtttcttccataatgttattaataatagttctaataatagttccatgaaaacttaccagtttgaaggtgctatgtacatagtatagagtagatttcaagaaatggttgagataccccaagacttaaatcatgggttgagttctttcctcatctgtttcatttaagcttgaaatatctctcttctacttctcttttcttccttttctcttactattgtctgatactccggataattcctcagcattactccctttgctctccagagcagggacgttttgatagaagttgcagcacaaatctcataccacctcctttaccttctcaatgtcctaggccaactttcattttcacccactacctcacatacacacactccttagcattctcagagggatttaatacactttgaatcaatcatctgttaccttaaataacttccaaagcaaaatacatatcaaaccataaggtgttgtttctttaattgtatgggtgccataagtctctttgagaaaactaatgataataatagtaatatttgtcatatacttgagtacttttaatttgccatgcacaactttaaattctttttttctatatgtctcagacagaatagatggagtgtgcaaggatagatggtgaatatgtattttggtaaatttgtagagaaaacgaagaaaacatataattcactaaataatgataatatccaatgtctgttgggggcaaagagcctagaatggacaaaagtagtatgtaaatttagaagggtgggagatcagatttaaggcatcctgaggtcaaggtatatttggagaaaaaaaatactatttaaacttcgttcagaagaatgacgtagagttttaattaatcaattccaaacatgtagagggagaattaggatggggaagagaaaaagtacacccaaaggaggtaggaagggtgagtgtaaaacaggaaaggcagaatgaatagaaaggataaatagaaataagagagtggaaataaatccaaagaagtaaacaaaataaaggaaaaaaaaatctgagcatggtggtgcaaccctgtaatttcagctacttggaaggctaaggtgggaggattgctgtagctaaggagttcaagaccagcctggacaatatatcaagaccccatcttgaaagaaaaataaagcaaggaagcaagaagaaaggaaggaaaggaaggaaagaaggaaaggaaggaaatgaaggaagggagagagggaggaaaggagggagggataaagatgaagagataagaaaaaaagaaaagaaagcaagaaagagaaagaaggaaaatggaataagctgtcctgttaaagcacaaagaccctcagaccgcatagaaacaaactccagctatgtcatttctacaagagactaattaaataaaacacaagaacatgaaaagtttgaatgtcaagcctagaaagaatatgtcaggaaaatattaacaaaaagaaagcaggtctacaaaacaaaacagactttgagggaaaataaaagcattaaaaaagataaagagagtcactaaataatgctaagaggttcaatttgttaggaacataacaattgaaaactttatttactgaatagtacagcttcaaaatatataaacaaaactggtttgatctatgaagaggcattaataaatccttcactattttaatacagctttcttggttattggcagatcaagtataaaaccatattggcaaggatatttgagatttgaacagcataatttaaaagcttttaggacactgcgttggtttgccaccttccccaagtcccaaattcaccccatatacactcccatcactcttgtcctgactttttcattggcttatctcagggtagtccttgatttgggtctgcaccgcaagttgtattatctgcctctggtttgtggctttactcatattctcaattttaccttcacagtttcttaagcaagatttctcccttccagtatcttagtgaaataattttttttcattttttgttttttttttcttccaaaaaaaaggatacatgtgcagaatgtgcaggtttgttacataggtatacatgtgccatggtggtttgctgcacttattgacccgtcctctaagttcctcccctcactcccacctcccaacaggccctagtatgtgtttttcccctctctgtgtccatgtgttctcattgttcaactcccacttatgagtgagagtcgaacatgcagtatttggttttctgttcctgtgttactttcctgaggatgatggcttccagcttcatccatgtccctgcaaaggacataatctcattcctttttatggctggatagtcttccatgatgtatatgtgccatattttcattatccagtctatctattgatgggcatttgtgttggttttgtgtctttatgattgtaaatagcgctgcagtaaacatacttgtgcatgtgtctttataagagaatgatttatattcctttgggtatatacccagtaatgggattgctgggtcaaatgaaatttctggttctagatccttgaggaattgccatactgtcttccacaatggctgaactagtttacattcccaccaacagtataaaagcattcctgtttctccacagcctcaccaatatccactgtttcctgactttaataattgccattctgactggtgtaagatggtatctcactgtggttttgatttgcatttctctaatgacaagtgatgatgagctttttttcatatgtttgttggctgcataaatgtcttcttttgagaagtgtctgttcataccctttgcccgctttttgatggggttgtttgttttttcttgtaaatttgtttaagttccttgcagattctggatattagacctttgtcaggtgggtagatttcaaaaatgttctcccattctgtaggttgcctgttcactctgatgatagtttcttttgctgtgcagaagctctttagtttaattagatcccatttgtcaattttggcttttgttgcaattacttttagcatttttgtcatgaagtctttgcctatgcctacatcctgaatggtattgcctaggttttcttccagggttattataattttgggttttacatttaagtctttaatccatcttgagttgatttctgtataaggtataaggaagggttccagtttcagttttctgcatatggctagccggttttcccagcaccatttatccaataggagatcctttccccattgcttgtttttgtcaggcttgttgaagattagatggttgtagatgtgtggtgttatttctaaggtctccattctgctgcattggtcccaatgtctgtggtgttaccagtaccatcctgttttggttactggagccttgtagtatagtttgaagtcaggtagagtgatgcctccagctttgttctttttgtttaggattgtcttggctatatggggtcttttttgattccatatgaaatttaaaatagttttttctaattctgtgaagaatgtcaatggtagtttgatgggaatagcactgaatctataaattactttgggcagtggccattttcatgatactgattcttcctatccatgaggatggaatgattttctgtttgtttgcatcctctcttatttccttgagcagtggtttgtagttctccttgaagagatccttcacatcccatgttagctgtattcctaggtattttgttctctttgtagagattgtgaatgggagttcattcatgatttggctctccgctcgtctcttgttggtgtaaatgaatccttatgatttttgcacagtgattttgtatcttgagagatacacaaactaaaattgtgtcctcaggatacagctttaaattctatatgtttattattttattcaattttgtgttcaaatcatcctatgtgctatcatttttccaattacacagatgagaaaattgaggccctgggagattaaattacttgctcaagagagcacacctattctattaaaagggagataaaataatatttataatttttaaaaatataattctgaaaactctagcagctttttgacaagtgttttgcttttgttgtcaattaatactgttaccaaatgatactcttcttaatttattcatatccacagtgacgaattgcacaaaattatccaaaagattattaggtaggtctcatttagtggcaaccaagagtaaacaaactattttaagcaaaaagataatttcttggcatgaagtactaggaagtacaagtgtacagatggccttagacatggctggatctgggtactgaatatgtaatcagaatattatctctccccatctccccgcatgctttcctctatattaacttcatttttagacaggggagactgagtagatcacagttttaggaagttgaccctgagtcggtctgcctgtgtgttccagtcctatctaattagaaacagaggttacaaataagttcttcaacattgtttatttctcaatagcacctagaacagtattggcacatagtagatgctcattaatttttttttttttttttttttttttttttttttgagatggagtctcgctctgtccccaggctggagtgcagtggcgcgatctccgatcactgcaacctctaccttccggtttcaagtgattgtcgtgcctcagcctcccaagtagctgggactacaagcaccacaccacagcgcccagctgatttgtgtgtgtgtgtgtatttttagtagagacggagtttcaccaggttgaccaggctggtctcaaactcttgacctcaagtgatatgctggcctcggcctcccaaagtgctgggattacaggcgtgagccactgcacccggcctaaatgctcactaaaatttattaactgaatggcttatgtgaagaaactcttgttgaattactggaagaggttaaggcaaacacctgtctttgataatacttattctaaaatgttatttataagcttggttatatgtatagtgagattttaccaagttatgatttgtataagaaaacatttggccgggcacggtggctcaagtctgtaatcccagctctttgggaggccgaggcgggcggatcacgaggtcaagagatccagaccatcctggctaacacggtgaaaccccgtctctactaaaaatacaaaaaaattagccgggcgtggtggcgggcgcctgtggtcccagctactcaggaggctgaggcaggagaatggtgtgaacccgggaggcggagcttgcagtgagccgagaatgcgccactgcactccagcctgggcgacagagtgcgacaccgtctcaaaaaaaaaaaaaaaagagaaaagaaaacttttattagagataataagttcaaaatataaacaggtaaggtagaaatggtacacacgaataacaaacataaaagtacagatggaactgtgttaggaggcaggactcatctctggaggtggagctcagataccagacaaaattgaggactaagacaaggactgggcggaagtagctttcctgaagacatgctcactagtgtgccatgtcagtttaccattgcaatggcagcacctgcgagcgaccaccgcctttccaggcaataacccgatgacccagaagttactacccttttccgggaaatttctacctaaatcaccccttgatctgtattaaagtaagtaggccaggcttcacacctgtaatcctagcactttggaaggccaaggcaggcagatcacttgaggccaggagttggagaacaggctggcaaacatggggaaacccatctctactaaaaacacaaaattagccagcccaggcctgtaatcccagctactcgggaggctgaagcatgagaatcgctcgagcctgggaggcgaaggttgcagtgagccgagatcgcgccaatggactctagcctgggcgacagagcgaactccatctgaaacaaaacaaaacaaaacaaaacaaacaaacaaaaaagtaggtgtaaatgtgattgcagacctgccctgaactgctactctcagcacactgcctatggggtagccctgctctctgcaggagcagtcacaagagttgtaacactgccagagctgttaacactgctgcctcgatacaactgttttcttctaccctaccaccagcttgtccttgaattctctgctggacaaagccaagaacagttgcggactaagctccactgtcctgcatcagaatggcttcaaaagttacaaattgtcaatgacaaaatgtaaattgacactaataagttaatcacaaaattgagcccttaaaaatgatttcaatgttatattaggaacaaagcttcctttcctgctgtttttctatgtattcccagaaaaaaattcatagtttgtgtgataattctttattcaagcttgactaaaacttataagcaactacatagagttaccttggactcctctttatcgtttaacatgtggatgtaacattcaacccaaactcattcaagtacagaagggtgatgttttcttaatattagtacagtagagttcatagatagatgtttttggctatgttataagcccaaaatggcatgattaaagccattttacatttctctgcatgctggagtattttgtaaaatggctgtttctaagacaaatgcataagagcttctgcgtataatgaagccatagtcttcaggtaaaaaagaaaaaaaaaccctctagttaggcaagttttctctttatctgaaggtttgtaagttcaaaattaaccatttaaaaatgatcagaagattttaaattaatgtacgtttttatgtagcacatgcaaagtttaaactgtttcttagtgacttaggagtgatcatcatgactattaattacacacagatgctgtcctaggctcttttcaggcatttatgttgtaattcatggtactactactgtgagtcctccaccctccattagagttatttatttatgctctgccttatgctaaaggacttaatattccttaaaatacatcttaaaagatttttttctgtgtcagtttgccaagaataatggcctccagctccattcctgtccctgcaaaggatatgatcttgttcttttctgtggctgcatggtattccatggtgtatatgtactacattttctttatccagtctgtcattgatgagcatttaaccaaatactgcatgttctcacttataagtgggagctaaatgatgagaacacatggacttatagaggggaacactctgggcctattagaaggaggagggtgggaggagggagagcagggaaaataactaatgggtactaggcttaatccctgggggatgaaataatctgtataacacacctccaggacacaagtttacctgtgtaacaaacctgcacttgtacccctgaacctaaaagttaaaaaaaaaaatttttttttaaatgttaagaaaacgaagaaatcaggacactgatgaattaagtagaatgaataagacgaagctggggacgatattagtacacaaagtacatgttgtgaactgctgcccatatgctggaagaaggcacacatgactagcaagcccccaaaacagggagatgtcaaatgggctgcagttgtttgtgttcaaaggtgcagaagaatcagaaccatttctgacactgagcaaaacttcccagggtctccacagcttcccacatgttctctgttttacctggaatgtccttccaccactctccacctggctaactctttttgaaaacactgttcaaaaatccctcatccgtatcctgaatgtttagttacctttctcctccatagtgttgaaagctcctcaatggagctttccaatggagctcctcctaataaacatgctcattataaatctaaaaaactagtttcttagagctatttttatagcttttcctactgtacacacacttcaggggaaaaaaaaaaaaccagctttatagttgaactaacacagtgcaacttaacacctgcaactaggggcctcacttcattcagagatatattttagcaggttagatatattgcaaatcattatacaactgtaggaaattattatttcaaccaaatatttgatatgtgttaagcaatgatgaatttgaagttactttaatgtatcttgagaacagtgattctatgttgcttctttaaatatggagcaatttactttcctgtcaatggaactgggtatgacattgacttttgtaaggtacgcaggcatgcacctgtacctgggccaaaggagatcctactccagcatgcagagaaatgtaaaatggctttaatcatgccagaaataaaggctgctctaattggatgttttgtctttgatattgtctctttccttgattaagctattagctatcacttcttacaactctccaaatacttacatactcaaaaatttccatgtgtagtgtaagttagattagtaaactagatatttaagcttattttaaaattatctaagtaaaaatatgatgtacctcatgtagacctaactgaatacattctgatgagtatgagatggttaaggtggatattaaacctgcttttctgccttgagagctcttctaccactccacatccagttactcaacaagctacagcatttcgcttctgaaatagctctgctcctgttttttagctgtctctttatttgggggcttatgtcatcttacatggcatattgcagaaataccctatttggtctctctgtcattacccttctaatccaacctttacactcatcttttggatacctttcataaatgcaaatctttctataaatacctaacaaccttggaataaaagccaaattcttttctcactcagttattcacacaaatttttgttatgtgtcatgcattgtgttggatgcttaacaacacatgcgaaatctttccaagattgtctcccttgcttcaactcccagctttcccccactcatagtctatgagtacatttattatccagaagtatgaactcctccagaatgcagaatattctctcatatttccaattgtttgcatattctggtgcttccgcatgaaatattcttccctcttgtccttttaagactcatctcctctgtaaagacttcttgtcacttcttcccatccttaggcagagatagagactttgttttggtgctcaaatagccatgttttcaatacttgcatgataagtttaatcatggtgtttgtaactttttgtgtccttgcattattttttctaatagattgggaagacaggggtattatcttgttcatcttgtgtccatgacaaatagtacatgttcagttaatgtctactgaagaaattactgagttatcacctgcctgctttcggtgggcaataaattgatggcactaccatggtccaagccctattgtatgtcatgtttatttgcaaaattgccttctaccttcccttctgattagattgtaagcccttgaagatcagggagttattactcatgtgatacctagaaaaatgcttagcatgtagtaagtactcaatccataattactgaattgaattgaaagtactccaacaaatttccttgtagtttgtttgaacttctaaaatgatgacatcattgctgtgtgattaataaagacatttaaagaaggaattacaaaacttcctagggaaatcatttctcctcttagttcccgctctcttctggtttcttacccactctaatagactaattagacttgcatagagatgggacagcaggctgtggaagggaaagctgtataatgcagtagaagtaccatagaaataaaaaaataaattggattttttgatgacaaaaaagtatagaaaaaattgctggaaacattaattcaagaagcatctaggtgagaggaagcagaatcagaactgtgtttggggaaggaagcagtcaaagtgaggcagttttgacagtatgtggtggatagtctctctggtatgactaattgagaattgattgtgcatgcagaaaggttatgttttattaagggaaaccttttttcccttttgtcgttatgaaatccactcttctgcagatgttattcccttcccatactaaaccctcattaatttataattcaccgcattgctttaaaagtgctgcacagatttcctgtttctctcacatgcagtgcttctaatagagaaagtcaactcaggatataggttgaaatgctgcttgtcttgagggctgcatgccagacttgatggtgccaaaacatttcaccaattgtctcttagatcattgtaaaggtttcaaagtgctatttcataggctttaagaaagtgaatttacactctaaaacaactctttcactattgactgtaaattgactctggtgtttggaatctggagtcaaagtcaaatggtttcctggtgggattctcttaatttcaaggacaagaactcacagagagaagggtacactttcttcaagtgaagattctgagggcagaggcaaaagaaacacagagaaggaaatgaataccccttctcccatcataactcttctctctgccagtaaatttgacagaacttgggaaatatttgggtacagagatgtagaaaaataagtgaaaatggcttttcaatttttaattacccaacatgccattggtgaagataagaattaaaggaggattagttttcacatttcttttcattgattactactttactgatatataggaaataaaatgataaattgacaatttagatatatgttttcaatttaaacatcttgaatatgaaatgcctaagagatatatagatagaagcttcaggactttttagagatttcaagtaaatatggtgtgtgtgtgtgtgtgtatgtgtgtctgcatgtgtgtggtgtgcgttggggtgaatgtattactatgaagtataatacaggggttaaaatctcacatatctcacatgttccagacagagaacatacatacataaagcaaaaccaggatgggggctgataggaatatgtggctggacaaaagggtcagtagctattaagctctggttgattactgccaaagaagaatgcaggccagtgtgaccaaatttggtgtttttccaagagaaactggaaaactatatttttgttcgtccaatgtcacatgaatatctgcaactaactaaaaattgaaattttatgatgtccaaataaaacacatatataaggcaaattcagccccacaggatactagtttgagacctctgaattaaagtcttattgggagtaaaagacacgtaacatgttaagaaattgaagagtggtctaagccattacataactggaagtcaaattaaataaaattaagtgtcaatggataaacttgtaagtattctggaaagggagagatcaatgttggttgaggtttaaccaaaattatgtgaagaagtggggctttgcctgaaacttgaggaatgattggctatcattggcaataaacaagggagaaatagagatgatgcttagggaagacagtgagtagcttattcttagtggaaacaaagaaagaactagaaccatttctcctaactcctggtttattgttttatcttccatgttctaccacctcctatttgatcttggataaaacagggatacatagaaatattaattaattaagcaaatatttattgagcacctactgtgtgccaaacacttgtctagggtgtaaggtacagtatatgttaatgctgtatacatgctttcccacatagagaaacaggtcagctccagcttttttacataaacattcacactagatacactttaattattctagaaggcagggaaattatttgagaattttcataatcctggggaaatatagtaaaaaataaaattttgaatatggacatactatatcaagagcaaatagttgtgccaatatttctagaagcaaatgagtattaaacaatatcttgtttatctaaagctaataaaaatttagaaatgggtagccaaactaaaatagcaatttgatcagctaatgaacacatttcattcaacagccattgaatgagtacttatcatagggacaagtattaaaatcaatgtaagtaatattattatactttgttccttggctcttatgccctttgataaggtggcatgtggatttggagagaatagaaaagagaaaaagaacaaatattttgaggagggtgaaactgatgtgtgccaccccaaatctttgattatatattttatgtagcatttcattgtataaagaaataatatacatgtataaataattttttaaaaattggatttctagtttcagcaaatgcctttatgctctttttaaaatatgacagtctggtttacaattgaagtacattatgtatcaaaggacccatatttgacagtgtacaaagttatgcgtttaaaaataattacactgttaaccaatgaatatgagttaatactgggaagaaaaactttattcaagtgttcattgcccatagcaaagtaaattatagaacagaaagttaataaaacatctaagttgatgtttcaaactcaatattacttttaaaacatcatcaagcagttgaaagccatgccaaagagattagttaaaggctaggtgactgaatacgatatatgtacttacaaagctttcattgcatagtgacattctgttcaaaacatactatgttgctggcctaacctttccatctgtttctcacagtcttcttatccaggtagttttccaagacatacggaatattagctatgcactctctaaatttaccttgagagagatcagatccatatcataagaaaaataaagtgtcagcatgaccatcttaaatctgtatcttggatattatttttaaaagctagtctttcatagctgacgtactacataacaaatacaatacattttaaccttattttcctgtgcaccttccacaaatccatactgcaatcacgaaaagggatacaaatcaatattcacttaataattttgattagaaaaggtataacccaaaggaccattccagtattgaaatttcagtaatatttcacctccctcagtcctatttctactgcatcagcacaacattatctcagctagcagccattaagatggttttctctttcatgttgatgctcttgcatacattttacagcctgctctgatggaatttttatcttcgcaaatgtatttcctaatttgtctatttctgtgtccagtaaactttagtctatagactaagaagtcaaaagttatagctacctttaagttacataactttagagacagaattttctacagtgagaaatttaacatactttcttaaggcattttggtgaacaataaaactttcttgttaaatttttgctttgcaatttacaagaattgggaatttggggtgatttgagaaaaagaggattattcaatggataccacctgcatcataaggctagactaattcttttgaaaggttaaaattggcagttactttaaatgatcttttgtcgacttttggaggtaacacagatgtctactacatttttcccagtgaatgtgttataaaatttaactgtagggtagtgaggctgtggattcagagacataataaagctatttggaaatctgggagattttgttttgttacagtagtattttccctgaagtcccttagtcaatagaaggaatgcaatttcctaggaactgcagattactttatatgggtgattgacaatttataaaacttgcatctttcctaaagaaggtttttatattgcacagatattttgttcaccacaagcaagattaaaataagctaatgaaatatgcaacttgttatttcacatttagtgactatgaaataactgctgctctcaaagaaccaatctgtcaacctccagaggactaaatagtgcatgggacaggggacaatcataacttagctagtcaaatgcattttttgtcttgtccgactatattattagatagtattggtaaaattaagatttttttaattaaaacttttactaaaagcttctatttcaaggaatttttgactatgaaatggaatataatggatcaaatttttaaaatattaataggttaatatttttatattgtgcataatcctggttcccaaacagataaaatttctatatacaaagagtttagttatggggggtaaaatgaaaactttaaaagaaatattttctatttaacaaagacgtacaggtgactcttagttactcaaggcaggacaatctcagtccacaaagagattgtaagtgtgtttgagtcaggagcctagtttttcctttatattttctccttcataattataagcatattaggacaaataacaactttttattgcattgggggctcttgaaataatgtagtatgttttctaccatatagaaaactatattttatcataaaaacagaaaagttttagcaaggagtaatccttcccagaagactggatctgttgattaacagcattttaatgtgaggactctgtctttgcaaaattaactgcagataatattatggtggaattagttgacaagagatgaatgtataagacaacagtttggcagaggaaatattagtatgcatgccatccttgaagaatattttaaaaatataatttacataaagatcttagtggtaggatttaacagattttgacagatgcattcaacggtgtaaccaacaagctagtcaacagatagaacatcttcgtcacccaatctctttccagtcaatctcccctgtacccagcgcatagaaaaccagtgcttccatttttatcatcataaattggctttgtctgaatttcatataaatgaaataatatggtatatacttagatattgtgataatgaaataaatgagaaaaaatagtatcacttagaagttagaagaggcaaggaaagtgttgtcaaaatagaaaaggcttgtgtatattgttcatgagctcaaggaaaaagatctgtggcaagaaagagctaaaagattcaaaagcaggagtagcaacgatgtgattttgaaagagtaaaaacatcttttctgaattgaaggtaacacgatgtgcaaacataaattcgtagtggtgtcagtcaacactgttacatgacctttttcagaaaattctgagctgttaaggagtaggttcagaagaatcagaagacatgatttagtcaatgttagtcatgggcaagatgggttcagcagaagatcagctgtggaatgataattagagccctagtaaaaatatgtagagaaaaagagataatagtaaggattgaaggaatggcatttactatgcataagacatttctgctcactgattatatgttgattggactagtttgttaccagttttagcagaaaatctgaaagtagccctctctagctcatacttcagttctctttccagctttaaataattaacttgtttacttgaatctatcaaggttgataatcctcagcaagtttaggaaatgttttacttctcctcctactggtttttttaagtttctacacctactggtattgtagataaacattagtatgtatttgttaataaaatcttctttcaaaaaatttgaaatttttacagtttttcatccttcacaaaagtatctatatttcagattaaatctgaccagaagtctagaccgctgtgcattgccagaggtaaatagattctgactttaaacacaaggaatgatacagcaagaaaaagacagttgttgccctagaagcagctctacaatgacatcactaacagtgatgctggtttctaaattgtcatctactccataaaacattaattttgcattcatcttttattgaaagcagtccttatacacagtttctattttaaaaatatctattttttaaaatttattgtaccatttatttcttggcccttaagtgctagctcaaagatcatgatgacttattatccctgctccatgattatgtcttcttaactgctcaacaatttggaggagctcctgtccttgtgggtctagattcccccaattttcagtgcttgctccacctagtaagtgtctttctgtgcatcttgaatgttctccaagagagcgtggatgaataagccagtgtcactacatgcttaagtgcaaatagcagccatttcagcaatcagggacaagagatcaggcaaaagcattctttaacattgtgcgatcttcacatttttatttaacgattactgatttattaaagctgcatatgttcagaagattctgttccttgtacaagaagtgtttaagtgcttttcttatatcaatttgttctttctggaatttttttttaaatcttctcttccaagcttcattagttatcaaaatcattctttttcatgtgccaggatgtggcccaaaggttaacttgtccatctaacttaatcaagaggtgactgtactctggtatccctgagacatgcagaattaaaaggttataaaccctgaatgtttagaacattgtttcagcacatattaattagtgacaaatgacctgaattgattctatctatatccagttcaaatgagcaagcagatatttgacttttagcttctaatgctagaagcctggatgttggatttttttttcacaaggagactcagtgtctagtttcaacagcttgaacaagttaggcttttgattttatcagtctcacacagggtgagcagactctgcagaaatgacttacattaagtaaggctgtcagaaactgatttatagagcaaaatggcattttatcaatttgcaggtagaagagaaagagaagggactttgcaactgtgtagaatggagtttaattctcaactttaccatttaatagctgtgtaactttggagatgtaatttaatctctttaaatttatttttcccatttctaaaatgagtataatacatattcaggactctggtgagaattacataggctagtatgaaaagtgcctagaaacctctctggaatatactatgtgctaagtaaatattagtttctttttcatcatttctattgagaacagaaatgtttatctagtaagagtttggtgcacttgtgggtggattccttcagaatgtcagcctacaaattaaatagttatttcgtgaacatggaattacacaaaggatgatatttttatctagtacaggattaatggattgatcttctttaacctagaaatgtctctgcgtggattgctggtattgaacattattagccttaaagagcctcactcatggagaatgtgagaggcacacagggaaatgttgactatacggcgctcctttttaaatactcctaatgagatgttaacttctcatattataatcttacttagaagatgacattcttagtttatttgactcctaaacttttgggacgagtacttaattagaaaaatattataggatcttcaatgaggtttggagataccttaaaattatcagaagtgattagggtgtggtttctacattttcatgttggttcttactgactttaatttctgatgattttcaaaccctgaaacttattttgtatcttcagtgtacatagttaaaattacacttaaaaacaattaaaatgaggtatctcattttgcaaaatagcactgtggctcatgtaatactatacatttttaccactactgccttcaagcacttataaaacttctttcctcatttttcatttctcatgttcagtatttcagttttgttgacaactgaaaatgggaatcagatttgaggaatcccttcaatgtggttgatttttgccccatgaaaaagaagtggtaatttatatcaactctcaagaagtttaggcaaggtgtgggatgaaggcaataaaatcataattataatatcatgtgctaatgtggaagaacaaattttgagtgtagcaataggggagcgtctgattcagactaaacatgtacctgcaaattagtcaagaaataatgagacaatctgttaccaaactcttggctttgccgttctctttctctggcactactacgaaccaagataaataattatacaatatgtaataaagccaccttgttaattgccacttaataaaaataaattagtaaaaagtttggttaatcaatcattggttcattggttgcttcaatagtaaggctgagatctgatggcatggctttgatggtccacattcttcccaagtgataaatagtaaactcttcttttaatcatcagactgtatttatagtcttgactagcatccattcaataatattaatttgtcataaaagaatatagaatatgcatcattttgttagcctgtcagcactgcaggaaaatcagctcacacatatgtcatgaagaagatggtggtttcatgtccctggttggcagtacatgtaaggttgctggtataatgtactttgccatttctgttccctttctgaaaaagaattccttactaccaaggctgcgcaggtccatatgcaatgaccaagagtacataaagataatgtccagttcagttcagttttgtggtgtgtttgtatttaaaatgtgaagtagcgtgtctatatgcattcatgtttatttgaacaaatgctgtaagtcccctgcaaccttttagttaagtattgtatttttctgcactagaactttatttgatttttatttttctgatttcatgtgctatttatttattaatcttgagcatgaatgcttatgtttgagcatagttagatgctttaaaatccatgcataataattcaagcatttgggtttcaaaagaaccagttcttttgaactggtcattttggtcattacctgtttacagtttcttttgattggtcattatatgtgagcattgtcctgcttcttcatatgtgtatcaattctgtatcatacactggatattgtgaattattgtagagactttggattctgttatattcccccaacaagtattgcgggttttttgttgttgatacttgtctgtttaataaggcaatcaattcaatactttgtgaccactgcggtaggcagcagttgaaatttctattcagatgttttagccttagtattttaagagtctgtactgcacagttcagagttctgctagatattaggtagagtttacacacagcacttgtccttcttctccctccaattctctctttttcagtatttcttctcctcgctttccaggtgctatggtggttccaaactctatttcttttaaaccagtgacaccatgaacattatttatataaattgaaggcaatggagacagaccaaaagtaaacagaaagtagaaaaaaattaaaagtcaaaacctagaaaatgaatggccctaggtgagtttgggtgagtttcttgtttttacaggattttgtctgaggaccaaataaataactaaatgtttgtacaaaatgtactatatatacatatttattccacaatttgtagcttagaatttgtatctgtagggaagttggtctatttggaactctgaaagcagaactccactccaaactttttaactgctgttatcaccttctggaatatgtccttttaatatccctcaaatttatttcatattatcccagtttatcaaacatttaggacccaattgtagtcgtaaaggaatctttttcttactgttctagctgacagtgcaatcatcatctcatattggaacttaaattccctggcttacttcacctctcagagccccagttttcaaatctataaacacagaaataatcattcttacctcataggggcattatcaatattaataatacaatattatgcatgtatgtatggtatattttatattaatataatatataatagtaacataccataccatacacacacatttatatacacacatatacatatatgtgtgtgtatgatatgttatatacatacacacacacacacacacacacacacacacatattagcatggttgatacctggtaactattcagcaaattatgggtgtaattatgggtttaacgtctgtctacaatttttacttaaattgaaaggcatgcatttttcaattgctacctaaagtctcagaaggctgcaatcaagtatgaaggccaagatgagaaagagtttatgcatttacttgataactcaaaaaaaaacacatatggtaaattattcttttgtgccacagtaaatactgaatatattggtgtcaagcaatggcttaattaataggataagaaaccatgttcatagaagttaggaaacaagtgtttaggggttaaattataattaaaataattgacctcttaataactgaaaatggtctgtacctaaaaagttggtataaagttattataagtaggattaactatcattcatcagcattttgtaacactcagatttgaaagaaagagaaaaagagagcgataaacaggatttattcacaagagaaccttctgtggcattttctgaagattagaaataatcagttctaactcctaagacaacctataagtgtaaaataataattgatatttataatgatgattctgagttgcacaatttaactcatcaaatatgttcattcccttccatagattatacttaataagccaagaaggggattctcaatcattttcaaaagatttttaataaggaatgaaattttaaaaatgttttcctccctggtttactttaaattcatgaggaaatttaatgagtcagatcatcccatttccaaagcattgcactatttgttagggtatacttttttaaacctccaagctgctctgtgaaaggttacatttatttttatgctaatttcctgtccttacactcaacttcaactgccaaaaaggaatgagactgaggaaaggagaaagaaaacaataggaaagccatttattcttatacatgtaggtcaacttattggtttatcgtcatttaatttgaatgtcacttggaagattttatagtgtggaacagatcgaagttgaaagtgtggggaataaaattttttattgttcagtaactaaatagttcttttttggaagccggaatttaaatccagtctggtcaaactgttaaaagaaaaagaaaaagtaaacataggaaaaggaaatttatgggatggaaaaatgtcattttctaagaacttcttggttgtaaaaatcctgattattatcccacaaaaaagtgcacaaatggaaaatgggtccaggtaaaaggggtcaagtttagcaagacaaatttgatggtgtggagagcttccacgtaaatacgacttcattttagattagttatgttctggggtgacgtctgttatggtgagatagctcacaaaattggtgctggagctgatcagctgcgaagtaataagaaaataattcattttgtgtttttaatgatattattggattaatcatgaaaaacaactttttggtttttttcaaatttatttattttaaattgacataaaatcatatgtatttatcatgtacatgatgttttgaagtatatatgcattgtgaaatggttaaatctagctaattaacaaatgtgttacctcacatagttatcatttttatggcccaaacccttatacatccactctcttagcatttttcaagaatacagtatgtcattattaacgctagtccccatgctgtacaacagatctcttgaagtcattcctcctaactataagtatgtattctttgaccagcatcttcccaaccttctctcccaatgactaccccagcctctggtaaccaccattctaccgtctatttctgtaagatcaacttttctagattctacgtatcagtgacattgtgcagtatttgtttttctgtgcctggcttatttcactgaacgcagtgtcttccaggttcatccatgtggctgcaaatgacaggatttccttctttcttgtggctgaatagattatcaccctcatgtaggcctagtttttttgtttgtttctttgtttgtttgtttttttaggcagtgctactgatgctcattcctttatgaattaatttctttatttgaacttttctggttgggaaaggcaatatacatagaaatcactaatacctgagaagaattcatttccctaattgcttccttttatggaagaagacagactgggaaagctttaaattctaaagtttaagtcttttagggcttgacatgacatcacatacccctttggaattaataggaagacaagttgccttgataatcctaaggttatcatttctgctgtgaagcaggacaccagcagctagcaccctcttaattgttgtatcaacttaagtgtatgtaactcatttcctcttattctgtctagaacaaagaaaaacaatgtgacaatatacctgttttatgggtctagaaactgaggagcaaataggattgtaaacatgaaaagatcattttcaggcactttcttgttccaggcaaggaacattcttgtacggattgagatgtctgaaaatcaaaacactgagtaatttaccaaaggttatatttcaagtagtgagagctagaacacacattctcaagtacagtggtattttattgccaccaactactgtctgatcttctcaagattcctcaactttcttatctgcaaaataaggacaaagataaaaatatttaactcaaaatataattagcatgattcaacggaataatgtataaaaatgattagtggtgctgtgtgtatataagataataatgctaataaggtgggcccatagtaattttttaataactattctcttttaatacaaaaatatatactgcaagactcacatgttggttggaaatttccctcaaatcacctactgattacccttgatttcccattgtttttagtttctcaaaactaatgaaatgaaatatagcagaatgctaacccatataaaaataaagtgtacccaaatattgtaatgtaaaaaatatatatatattcatatagtagagccagaagtggagttcaagcatgtttaaccaaataagagttttaatttgcagttcaatcatgggttcaaacagcccatttttggaccacaacaacatatatgtctagcttactttaattaccttacttcaaaaagtcttgatgttacaagaaaatacctgctttttaacatccaactcccttctaccagcatgttcttacttcctccttctccagcctgtatcccatggtcttttattatagttagatccttacaaactataactctcttgtcctttttatcttccacttttcttacttagcaaacccaaacctctataaatccagctatctgcataccctaggcttaaatacaaactggtaaacatagctggataagaattactcaagtattatgacaggtttcatacaatgtgcatgaccataaacctcagattaacacacaccacagctcagaaaccctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctagaaaggtatttaggtcaattaagccactagacaatgtgagctgctgataataaggcagagccagacagttttgttttgtttttttttttaaagttaaggtggctgccttcttgtgtctgtcacatctaattattcaaaagattactgccaaggttgagccatgcttttaagggtcaaccactacataattaccaactccatcattatgaatatgtacctgtggttccatcagtgcctgtgggtctatcactaccacaggtagtagctaaattttgtagcatttggtttcattctcagtaattgggaaagtatcctttgaggttttagcaattacccaaagcatatgctgtttttccaacaacatcaaatagattatgtagactttgttacaagaattttgatgctgttctgttacttgccctcccataattttgaattaaagatgtaatcaggcactgaatagaactgttgatatgcactgtgcatgtcaatcctctctgtgttatgcatgaagcaactttgtgtgtttgtgtatatggtctgacttcttccataaagtaattcttagactagattgaggttttatatgaaaaattttatgagaatatattttttctggttgcatgagaggatgttcagtctgattaaattgtcccagaacatgaggttactacttaagagatttaccgtaaccttatgtaacttcattcattattggtctaatttgctaaaaaagctctgcctttactgacaaatggaaatattcaggcttaagccttttcttgcgaaaaaaaaagagagagagagagagcgagaaagaaaagaagctttattatcattttacattcaagggcaatctcttttttttacgtatgaaagtaagtgagatccatctactactttgaaaatgaagaaagttgagatcattgacaatgaacatactataattttaaatttaaatgtttaatagtttacttattataatttatttataagaattactgtctttaaactactattggcttactagttgttgtttttttgtcacatataaaatgctttactggttccagttagtatatttattcaactgccaattaaagattatccctgtgtaaaaaaaaaatgaataaaacaaacaacaaaaaaaatcatcctgtagcagctcaatttgagcaaaaaaaaatttaattatctaacaactatgtggttgagatgtggctggtgggttcatctcatcatacagttcgaatatatagccagcatcacccatttagtccctgcagtggctgaaaacctggcaaggctttttctaacctgcttttctccttgaagatatttgcttacattgtcaataggctaagggggttgttttgaagcctggattttgaatttcaactgtcaagcatagtctattaatgtagaaggttttaagtttatagtttcctcaatgaatgcattttaaaatggtacagataactctatataatatcctccatatgaatttagtttatatgctagcaaaatttaaatgagatttaaaaaatattctggttgctctgaggagaaatcactcaggtaaatctagaaaaataaaacagtaaattgcaatatgcattctgttcatctgcttcagttgtgtacttgcttgaaactaatttgctggctatgttatcacttccctttaaaatggtctttactgagtagagaaaatatatctgtaactttttgttaattggcgcataagttttaaacacagaagacttcatcacgaacacataatttggtagtaaaatttttttagcatcaaatgtatctactttataaatttcatgctcagcaaaacatttgattatttgaataagtttaaggaaaaacacttttttaatgttgtttctgactattggactagtttttaaaactggtagctcatatctgtcatagcttctcccagtttctcaggaactttacacgcttgtgtacaccctttccctctgaactggatcctggcccccatcatgctcttaaatgtcccatttaagataaaaaatagatttccataactttaccttccccaactcttctatcaccttcttcttccttcctcttttacacccaaactttttgtaaatagctatctataactgctgttatgtccccacatcctcattttctatgcatacctttctcctgagggtctaattctatttcaagtttcagccctccacgaaaatgattcctcctaagaccaacaatggcctgtatttctaatccaatgggatttctgagttttcattttcatgccttctctggtgcattccaagctattgatgatttcttctttgaaacaccttgttcctgtcatccaacacagggcacaatactggtttctttcctaatcctgggtttcctttgctgctcactcatctacctacacttccaatgctggaattccttgagcctccggcatatgtttctgtaccagctctcttcttcctctaaatgtttccattcacaaccatgactaccattgttatgtctgtgttaataatgctcaaatatatacctctaaatcaaaacacttcactcatgtccaaacctaaatttctcctcagaatgtctcatagtttttgcctaaatttattatatcccaataagtaccccatcttctttcacagacttctgtcttttccatcttcgccatctctttactggttccagttagtatactttactggttccagttagtatatttattcaactgccagttaaggattatccctgtacgaaaataaatacaatgaataaaacaaacaacaaaaaaaaatcctgtagcagctcaatttgagcaaaaatatgccatctcagtaagtggcatatccacctttggttgctcaagccagaaacctagaaaacatttgttcacctttgttctttcgtttagtctccaaagacatatacaatttcttcccattttaagtaccatgtctaaaatgtttcaaatgttgatatggtttggctgtgtccccacccaaatctcaactccagttgtatctcccagaatttccatgtgttgtgggagggagtcagggggaggtaattgaatcatgggggctagtctttaccatgctatcctcgtgatagttaataagtctcacaagatctgatgggtttatcaggggtttctgcttttgcttcttcctcatttttcctcttgccactaccgtgtaagaagtgccttttgcctcccaccatgattctgaggcctccccagccatgtggaactgttaagtccaattaaacctctttttctttccagtttcaggtatgtctttatcagcagcatgaaaatgaactaatacaaatgtatatgtattttagaaaaattgaaaaggaaaattcccttttatatttacccacatatttaccttttctaatgctcttcatttttttcagaagttttgagctcatttggtattaattcccttcagtttgaagaactaactttagcatttctagtaatataggtctatctgtacatatctttattttgctttcattctgtaaaatattttttgttgaatacataattctagctggattgatatttttctttcagtgctttaaagatgttgatttattgtcttcttgcctcaattgtttctgattattctcttctatgtaataggtcaattttctcttgcccattttaatattttctgtctttgttttttagaagtttgactatgctgtgcctaagtttggctttgttctacttaaactgcttgggatttactgaacttcttaaacctgtaaatttgtgtctttcaccacattgggggaaatgttggccattatttcttctgcctcattctctctctactctcattcttgcattgaagacatttatattacaacttttggtatcaatgctcagcttcctgaagcactgatttttttaatgttttttccactttttatatgtaatatgttttatctctcttgaagtttactgattcttcagtcattttattctgctattaagttcaaatatacagtattagatattttaaattttactcatagacttccatttgtttcctttattataatttccatttctcagtaatatatcttctgtattaattcattataagccattttttcccttgatatcatgagactagcatggtaaatattttaaaatagtgtgagctaattctaacatctgtgtcatctttggatcattctcccttgattttttcccctgaaaattgctcatatttctctgtttcttctactatctagtaattttttatcgtatccttgacattttcaatgttatgttaccacttcttgggattctgttaaattcatctcaagagtgttgaattttgtgtatttgttgtaacagccaattaagttagattcaaggctgctgttcttgtgcagcagcttaaatttttgttatgttcttttaatcttctacaggcttcttggagtctgttcatgcatatatgatttgaggttcagacagaaatttggggagagtttatttacagaattttatgcattgcctctatagttctctcctctccaggattcccccttacaaaatttctagtagctgaggcagcccctctcaagtcagaaagtcaagattttttaacagtgattttagttatctccatgactcccagtgcagtccatacacatacgcaaacacacacagaaactcaccagtgccattctcttctcccaagaattgacaaccctataatagaatcttccactggttatatttcagtgcttttgagcagttgtttcttaaattttttcatgtgttatagttatctgtgagaggatcagtacaataagagcttttctagtcattactaaaggtaaaaactaaactctgcaaatatattttagccactttgtatacatttataatacttaaagagataataaaaagaaaaggttttggagaagaaatctcaagattgtgatttttttggaaataaatattttacgggaggcatgaatgatgatttagagttctctgagcttataataaataacctcagattgatttggtttttaagttctagaattaacatgtataactttcctagtgccacttatcaccctcctattttattggtgtatcatcaagccagtcactgaacatttacaggtttttaaaaagaatgtattgtgtctagtctataacagatttaggaaacgagataatagagcttgatagaagtgtatctaaaataataagtattttcacagtaagatcacaggaaacttttctttaaataaaattcatattctatctgacttcaaaattttcattatgtttggtaaaaacaaaattagaaaacatttcttgtagtttgtgtgtatgcaatatttatgacttatggtaattttctcttctagtcattcatgttattaatagaaaaaccttaccaaaatgaggcaaatatatactacaggataaggtcagaaagtataactatctaaaactggtactaacaaaagtcagcatggtgaatggagatagtttactttttagttgatgagtttaagaaaccttcctaaatatcatcaaaataactactaaaatatcatacataaaatacaatatttaaattgctaatattttaatgacatgaaaatgcttggagcacagcagaaagcaaatggaacatatgaatttctggcttttcacattattttctagaaagagagacaacgagcttcagacatgcttttagaccacttgacaaaaattatatgtatacaaacattgcatatgaagtctgctttagcttgttaacattctttataatgaccatcatatactatttattctgcctgcatgcnnnnnnnnnnnnnnnnnnnnatctgcttgtcagtttcatgattttttggaaaattagctgttgagattttgaattaaatagccattccctatgaacttacatggtgtttatcagtcccttaaaatccaattacacatactgtttatgtctgcaaagctttgaaccatacgttatactatgggaattcaatttatttgtgaccagtctaccactccctacacacaaagcacaaatcaaaataggttagcctttatttatagcatctttacattccttaatttccatccaaacaatctgaatatacacattttggcataatctgttaacaaacaaattaatgatgccccccaaaaaacacacagttgaaataagaataatttaaaagtttattcattcattgtcctcaaatttatttggattacctgaggtctggagtttgagaccaacctggccaacatggtgaaacccagtctgtactaaaaatacaaaaattagccatgcgtggtggcacgtgcctataatcccagctactcgggaggctaaggcaggagaattgcttgaccccaggaggcagagggtgcagtaagccgagatcacgccattgcactccagagcctgggcagcagagcaagatgttgtctcaataaataaataaataaataaataaataaataaataaattgctgctctagctggtgttttttaaagctcttgttgctggagtgtttgtgtgtcaggtgtgtatgtttctgagtgtggtgtgttaatattgtgaagtctgaaatattttctaagaggtggtttgagaatgaaacagaattctgcacctttgactcaacagaaaatcatagtgctcagatgcaagtccctccaaagcatggcttcaccatggcagtcatctggaattgttgtagggacatgctaggctaacatgtagcaaaacagatcttggggtgagaacttatgtcttccccatccatagcagaaagctagactttagtttttttaagctgttatttgctattactttgaactccctgtaaaatttatgtaaaatttcacataaaaagtattttctgagaacaatttatccatgttgggaaatgcttactagagatataagtactattgtttgttttcctgatcttataaagtaattcagcagaattgctttctaggggattctttcctttgtttccactctagtggaaagaaggcaccagagagtgaaatcctgttgtctgattgatgagattctgttccggctgtgacagtgcataactcctctcattgccctatctgttgacccccagagaggctaaaagtagcacaaccttgggatataagaaggtttttgtttggttttgtttttttactagcactgtttacaaaaataggaaccatcagcagccttagggtgaaaagtgaaatgtatcttttacccagaaagttaaggaaaaaattggtggggtcagattgcttaatggggctaataaagcaaatgccactagatttggctcctatataagacacatacaaatattttgttttcccaaaccaaaaactgagtccgtaactatagactataatcaacttttaaatcttactcactgattgcaagcagaaccaggggagactttgattactcacagcttaatgttatttgtcttcctatactggaaaacaactgcaatttcatttttcactgatggaattgatggcttattttttaaacttctgttttgaagcatagaacatatgtagtgctgattatgggtcaccaagttaaaaatgtaacattaggtattgaaggacttaaaaataagtaaaatgaagattaaagatggtatgtcattttaaatcagtaagtttttcttatcttttataagaagactaattctacaacaagtccataaatacagttttaaatgatatccttacaaaaaggaaccaaaccgaggagattttgttggttgaatttctccatatattacattatgtgaattaagacagagttaggaatcagaagttttcttttttggaggaaaagaaataagtctaattttttttaaagttatgttttttctttatctgttacttaggtatttcctaattttttccttataaaatcataaaggtgttatttgagctatttggccaattcattaaagataaatagtttatatgtttaatttcaaaatgagaattacatttattcgctttttcactatttactgaattatatcaggtaatttgagagtcaacaaaagtattatttaacagatttcgtagccgtagactaattaaccctaaaaagaaagtttaatggaaaacaaatgaacaaaagagccaagaaatattatttgaaaactgatcattttccactaatattaattcgtattttattttattttatgttttttgagacagtctcactctgtcgcccacgctagaatgcagtggcacgatctttggtcactgcaacctctgtctcctgggttcaagctatcctcctacctcagtctctcaagtagctgggactacaggtgtgtgccatcacgctggctaattttgatattttttgtagatatagtgtttcaccatgttgcccaggctggtctcacattcttggcctcatgtgatctgcataacttggactccaactgctgagataacaggtgtgaaccaccattcctggcccttaattcatattttaaaagaaaaatttcaaaaatctcaagtaagagctttttttgtttccagagaatatattaggaaaatttgaattattatttttactctcattattttagtatagtttgtccatttcagaacaaataaattatataaaaaccaccagacaattctgttcattttgaatgataccacatgtctgagaccaggccagaactggaacacaccacacaagaagggtaagattgaagcttatcctatagcttttgataaagtgtatttattcagcctatactttatattaaaacacaacatccattagaattatgttgttctataaatgttatattaaaaagcaatgtaatttgctagttaattgtttcaggatttgtgattgaaatcacaaatttcagaatttgtggagtcgtctttctctgtgagtcactaattttacaagacagcaatctgaggtgctttagaaaaaaatcatacccaagaacatgtaagtagtcatggctacctgaggagaagggaagccagactggttttcatagaaacaactaaatttccctttgtccccagccaatttcccccctgattctcaatctaaggggattagtagaaaaccaactagattataaatgagtaaatgaatttagattttgcctaggctttcatttttcagaaagatttctttgacttccaacttggggaaatttacctctcatatatgcctactgctggaagatagcaggcatcatgtattatttctttgtctctcttcatttattacaataaagtaaatgaggggagaagctatatcttagtcatcgtttactcatttctgtcctatttattcatcaataaatatttgcagagtgcctactatgtgttaggcattaaagtgagctgtggtaaagagaggaaagggtgggaggacagataccagatatcagtaaaagaaagatattaggagaactttgtgattgattagatgtgggtggctgagagtagtagcgaaacccagggtgactcccaagtgcccaattttgttgcttgtatagatggtcaaattagtgacctaaagaaaatgtacggagaagcttatggaagatagggtaagaaaaataagaaaacaattagttctgtttgtgcctgtaaaatgtctgtgaaacatccaggtgaaaaagatttgtgagcaattgcaaatgtggggctagatcataggagtgttgccaaagctggatatgcagtccttaaaagatccctctaaaaaaggatgtggttggtataatctaaacaactgcagtcagagaaagagaaggatcatgcaggagatcaagataccatggagatcaaacaaggaatgtgtgttatagaacacatgtaaacagaagttgcattggggtgaaaagggatgagatgaactacacctaataatgaacaatttttatcagatttatagtttgctacgtatagaataccagagcttaacgtgcctgggattatacaaaacccaattaagtgacaagtactttttaacaacttacctgttcttagacaagtcttttattgtctccttctcatgttttttctttatttgtaaaaatgaagatatttgataaaatgatcagaaagctgtcgcctaacattaatatattacatacagtattagaggtataaaggaaagcgttcttggtcagaagcaatttcctaacaaaagtagacaaatatagccattgtatgtcaaatacatattatatataagaaaatcagccatgtaaggaaatactgaaatagtacaactaggaaagttacaaagtaactactaccatttttgctctactggatgaattacttttgttacatatactttttatatataattttagttatatatatatatttatttatataaactgggaaatcaaatcaagaatatctgtgatccggatatctgtgatattccctttcaccagctacatctaaatggcatgctgccatacccaggattttaaagaaaaaaatgtttaaatctcaataatttaatttcagatgactgaaaggtcagtgaatcaaattattactagtcaatattaatacatatggtcatgggaggaaatagtctattgattgatttctacacacctaattgaaaaatatttaccaaaactcaagctttctgagccaaagtcaatgtggatgacttttggaatgtccttggtaccatgaagatctaaggatattaatacatagtaatacgagggtcaggccaatcaaaggagacgacagaagaggaatcattaacatccaaaggcatttttacactgtgataattatccccatttgctcaggttaatatgctttcaatggaaacatgtggaataaacagctgtcatggacatgtgccaccaaaataaaagctcttctcagccagaaaaacaattgggaagttagtgaaccagtacatgctcataccttaggaaagcaaatacttttcactgagcccatagacaaaattaaagtctggaagaattctttttttttggtgggggataggaaataatacaaatcttgaaaacattctaaaatattcagataggttccataaatatttgttcaaaaattaaaatagaataaccttttattcattgttcaatttttatctatcaaatctcgaattatgaaaacaaactacactatgctttacataagggaatagaaataaaagtaggcatagtctggtaataccaaatcttgcatccttaatgcatcatgaaaagatgcttgtggatgttttgtccaaatggctggcatcaacacccacatacaaactgctcctgctcaaaaaaatgcccttgtttttctctgagtacagcattgatatacatttggaagaaatcttattatagtcctgaaagaaagctagtagataatctagtttatttttgagattccagacagaactacattgtgtgtgtgtgtgtgtgtgcgcgcacatccacatgtgtgtgacagagagaaagagtccactgcataaccaaaaaatatgaatttggttcctagaatgcaaaaaaatatatctaaccagtacattttaacccagaaatgttcaatttaagcattaggtctataataataagtggaaacgtttgatcaactatcatttattcatttatttaataaatatacacatagtaaatatttattactattatcatctgtgttattgtatgaaaatcattatgttaatgaaattatatatttacatacttcggttttagattaagcaatatgatattgcctgtaagtgatcatttttacctcaaaaatgactgtttcatatttttctgcctagtatttgatttaatcactgaataatgatatatgttaattcaacagcttgtaaggtcaatttagtaaaagcacaaatttatatgaatgaaaataatggcctgcaaagttaagatttgactctgctgtagaaatggacacaaattacatcaatttaccaaaaagaatagttcttacaatcagagttaagcaagtacttgctcctcttggtggtttaccaactgccaaaataacagcaagatcagatttcttcatagaaagttattggtatgaaactttttggattaaacagttgtttctgtaactattaactaaatcattaaaagggttagcctatttatagtaaccttgaacctttttaaatttaatgttttcagatgaaagcattgatccttccatgcttcataaaatggcatcccactgggcagtgtcattagtgatagtcctactgggagagacaccagtccaaattattgaatgaagagcctaatatagtgaaagatacttctaaagtgcagcttgatgttttaaaaatgctttcatacataatggatgcctactgtactcagctatttgaggtgttgtagcacttactgaattttcacataaattgctgctctctgaataagactattgtaccagtttataaggcttgatatattttctaccttccaaatgggcattcaacgaacttaaattttatctttatattgtacttaactgtaactcagtaatttttcttaaaggaggagaacaaattgtacaatacagtccatattagaaggaattagcttttgtttttaaaaagaagagaatgtgttttatatcatttgacattttcaacttataaattttagcaagcatgcatccattataattacactggttttttactatgtaatttaccacagaacagaatacatatacagacagttaaattaattcactagataggggacatataggaaagtcagcttcttatagttaaccaatccaaatatattcataaaaatatagatggaaaacttgattcaagaaatagtttccatttatctttcaacagtagttttcaaattggttagcataaggtccaactttaaatggatgaattatgttttgaaaataaatacttgcatttaaatgattattttcagcagtgaattattcttcggctatctctctgcacagagcataagacatttatttatttatttatttatttatttatttatttatttatttatttagacgctttgctaggctaagattcaaaatgggttactagtgaaggaagaggagttttgcctagtttggcaagagatttatctacaagctctataaaaagacaagtttttatttggtgaaaccagttaagatgcaagagttggaaatttttgagttggagtaactattttttaaaaaaactaaccatgaaaaaaattctggggtctgttgtcattttggataacaaggatccgtcccattctattctcccatctacatccatctcccagatccttatagagagttatgcccaagggagattccaggtaaattaataattttattaccaattatagtctactcttaaatctttctgtgattcctgcccttggctagctgcacagaacttccatctaatagatggagtgtacatctaacataaggccaagactaaaatcaaatttgtggagccaactccatgtttccttctccctagcttatgtcacaggtttataagaagaaaatgaagtgtttctgcccccaggttctatcagctacactggaggaatagagaaaaaaaatgaaaatggacaagtaatctaagagttgtaggagatgtcaaaataggaggactagaaacagaagagttatcaagttctttttctttcaccagaaattatattctcctagcaattatgactttgtcatggctaacattagtacctcttaagagtaagtatagggtcagagagggtagaaggtaaaactgagttttttgttctaaccccagaagtgagactacaaagactttcagcgagaaaacaaaaccagctcaggagagctaattatttactagagaaaggctaggttgctggtttaagaagagttcccagattgagccaacaatgaccaaggggcttgcatgagagttcctagattgagctactgttacagtttggatttttcagtcctccaaatctcattttgaaatatgatctccaatgtcggaagtgggacccaatgggaggtgtttgggtcatgggggtagatttttcatcaatagattaataccctctctggggattgggggctgtgagtgactttttacttttgttaggtcctgggagaactgcttgtttaaaagagcctggcacttttcccaacccttgttttcctgtctcaccatgtgatctctgcacacactggctccccttccctttctgctgtgaatggaagcagcttgaggccctcaccagatgcagatgctgggtccatgtttcttatacagcctgcagaactgtgagccaaataaacctcttttctttataaattacccagcctaacaaacagactaagacagccatcagtggtcaaagagcttgaacaggatgccaccagcctgaatataaaggccaatccaggcagaaatggagaccaggagagctccattaaaaactaataaagctttaatttagatacaggtacagtagcaaaggtggaactgtgaggtacaaataaatgggaacattactacaaatttggataaannnnnnnnnnnnnnnnnnnntactacaaatttggataaagacattttagaggaatctaagcagaataaatctattaaacagcttttacactaatgtgtgggaaaagagtgaattcatgaatttcaacagaaaacaaagtaaaagagagacaggaaggaaggtaggaaggaaggaagaaaggatggaaggaaggggaagggaaggggaagggaaggggaaggaaaggaaagaagggaaggaaagaagggaagggagggagaaggagggaggggaggaaggagggaaggaaggagggaatgaatgaatatgtagacctgtgattaagatagagtacaggatgttaatgcttgattgatgtggtaaacgggtcgattcaccttgttggactcccgtattctcttctgcaaaatgcaagattagattgaacctggatgatttataatgttccttaaggatttaggaacttatgattcatgatactaaaccaagttgaataatggatccatttatctgttacaaacttgtttaaagcatgagagtttatcacaaagataaaattttggttaagagtatgttatacaacaaaggcgtccatgaaggtggactgaagagtattaaagggaaaagttgagatccaagaacataaaaccctgatttcacagatggtagtaatggaagttcatccctgaagagttttctgttggagagtgttctgctcaaaatcaatgcatctcaaatttaatgtggatacaaatcatgtgcaaatattatcaaaattcggattcagtaggtcttagagggtgcggtgccaagatttttatttctaacaagctccaattttatatcaataagtaccactttgctttcatatccaagtatatattatattccaatggcttacagtgaaaaaagcaaatttatgtataccataattgttcagtcaaaagtcagacttttggccatgttgacaatgatagttatccagaactagttttgtatgagctgattcattctcttaaatacaggacaatagttatgatcacatatcatcaaaaataggatagattatattcaacatattatcaagtttgatggataaatcagtggagcattcaatgccttttagaaaaattgtcatctaaaatgtcaaagcatgttttgttaatataattatataattaaatgggtatattttaggtattttgaaatctttttcatccaggacattatatcatccagggaaaaatacatagcagaggtaccagtgtaaatacacatttttatgctgcctttaggcataattcaatatattttattgtactaaatggaagctacattctctgaacactatcctgacatagagaaaaaaatatattcctgttaaaaatataaaattgatctggatattctttgttacatattacttgaacctgttcatctctatcaccatttactgattttcacctgtgttatttttcacattccagtcatgccactaacactttagaaagtagaattagtgctgctgctgttagttcctaccattcagatctgattccaatgtacattttaagatattttgtttacctagcaaagtaactaagaagtttggagaagtgaggctaaaaaaatgtattatgtcttaggctgcaagtggcctctcttgcagaagtttttctttgttgagagtttctaggttgcaagtgtcttccttattgaggcattgcagacaagtttttattatctcacattttctaaataccaactgtttgaagtgtcttccattcctaccctttcacaagcattcagttgatgccttgtactagaagagtgacgtcaagtgactgtgctgaataaaatagctttaaccgttaaggaaagaaactggtgtataaataaagatatctgttcagatttcctttgtaccgccgaatcctcttagcctgtagtacttttgaaaatagaagtaaaagtattgttctttctttcttaagtacacacttgtgttctatgagtctttattttttgtatattttctgttcacatttgaagcactgtgtatgtatgtgtgtgtgtctgtgcatgtgtgttgtttgtgtgctgtttgggaggcatagttgggaagaaagcatgttatagattaggatttaggatatggtttctgaacattctcttgccccatgcaagtacaaactccagcaaggtagtcaaatcttaaagctccaaaattatctcctttgactccatgtctcacatctaggtcatgctgatccaaaaggtaggttcccataaccttgggcaacccttcccctgtggctttgcagggtatggccccctcctaactgctttcatgggctggcattgagcagcttttctcggcacacagtgcaagctgtggatggatctacaattctgagggctgcaagatggtggccctcttctcacagtgccccaatgggaactctgtgtggagttccaactccacatttcccttctgcactgccctcgcagaggttctccatgaaggccccacccttgcagtgaacttctgcctggacatccaggcatttccatatatcctctgaaatctaggcagaggttcccaaacctcacgtcttgacttctgtgcacctgcaggctgaacaccacatgtaagcttccaaggcttgcaccttgcaccctctaaagccacagcctgagctgtaccttggctcccttcagccatggctggagtggatgagattcaggacaccaagtccaaaggctgcacaaaacagcaagaccctgggaccaacccatgaaaccattttttcctcctaggtctctgggcctatgatgagattggctgacgcgaaggtctctgacatgccatggagacatttttcccattgtcttggcaattaacatttggctcttcattacttaggcaaatttctacagctggcatgaatttctcctcagaaaatgggttttccttttctatcgcatcatcaggctgcaaatttttcaaacttttatgctttgcttctgttttaaacataagttccatttccaaatcatatctttgtgaatacataaaacaatgcttttcacaacacccaagtcacctcttgaacactttgctggttagaaatttctcctgccagataacctaaatcatctctctcaagttcaaatttccacagatctctagggcaggggcaaaatgccaccagtctctttgctaaagcataacaagagtcaccttagctccagttcccaacaagttcctcatctctatttgagaccactaggcctggacttcattgtccatatcactatcatcattttggtcaaagctattcaacaagtctctagtaagttccaaactttcccacatcttcctgtcttcttctgaaccccccaaatggttccagcttctgcctgttatccagttccaaagtcactttcacatgtttcggcatctttacagcagcgccccactacccggtaccaattttctgtattagtccattttcactcttctatgaagacatacccaagactggataatttataaaggaaagaggtttaatggactcacagttcagtatggctggggaggcctcagggaacttacaatcatggcagaaggggaagcaaacatgtccttcttcacatggtggcagcgagaagaataagagctgagaaaagggggaagctccttataaaagcatcggacctcatgagaactcactcactatcacaagaacagcagtatggaggtaaccgcccccatgattcaattacttcccaccgggtccctcccataacacatggagattatggtaactacaattcaagatgagaactggttggggatacagtgaaaccatatcacatctaaaccagaaatatcacctatgtaaatttcaaatagctaaattaatttctgaacagatttttggtcagatactaccaattcctttgttaatgaagaaacctcttcccatggggtgccaaagtaaaaagacagaatgcataattgccaaaaaatgtaatgattaggagtgatttctctgactatttaaattttatttgcaagatatcattagtctgtgcttatttccatctagcagggtatatggatagactataacccaacatatgtcaaataattttggtgggtagctcatttgaactaatatggaaactcctcgaagacaaaaatgtaataatacattagcaatgtaatgctatcataaattagaaatgaaaaatgttgttctatttttggggtattaatttttcctactgaacatgtacattcattcagaactgtagaaacaaaaaaggggaaagaaaagaaaaagaaacatagaaatatgacatttgtcctctaaatttcactttttcaaaacttaattccaacttgactttaatatagtttagccattataagcattctacctaatgaatttttaagagcatttatatgtaaagtagaaaaattattgttttgatttttttcattttctcagttctgcaaattaagtactttagatattttttaggtttgatacaaattaaatttcaacttatatgtaaatattaggtgtacattttatagttctgttctcagcactgtagtatgaggaaagcactgtgttgtatcagaagctatgaattatacaaaatcagaattaactgcttggatagccttttgcaaatcatttcacataatttggtctctcagttctcatcaaagaaattttcagaggctcggtccctaaataataactaagttataagaatctataggggtatgaccatgcttatgtcaataaaatagtaatgatggtgataataataataatcacatttattaagcacattctgatgtgccaggctctggtaagcagaataatgatctccccaaagatgtccagattctgttccccagaacctgaaatatgttaatttacatggcaaaatgactttatgatgtgattaaggttaagggcattgagatgaggagattatcatggattatccagtcgggctcaacctaattacatgaggccttaaaacagagccacttcctggccgcagtgaggaagacgtagatacagtgtggctggttttgaaaaaaaaaggcagaaagcaggacaaggaacacatgcagcttctggaaaatggaaaaggtaagaaattggattctcccatagagcctccagaaagtaacaatctgctgacaccttgattttagcccagtgagccctatgtcagacttctgatctccaggaactatatgacaataaatttgtattgtgtaaaccactgtgtttgtggtaatttgttacaacagcaatgaaaatttctgatgtaccaggctctctgctaagtactttatattagcttatttttggcctcacaacaactctaagaaataagggccattattatccccattattattaaggtttaggatattttaagtagcttttcaagctcatcacttgtaaatagtaaagccagcatacgaccccaggactgctttggttggataaagatgatgtccttaaaattattagaaaacgtatatctcaaaacaatttaagagtttcttgttttcatttcctctaccgtagaatgaaactaatttttctttactaactgcatgctgaaaagaagggtcaatgaggaaatctctgtgagacatatgggcccaatgggggggaaaaagctattatatactttgtgtaaaattagtcctccttttctttctaaagtcatcaattttctatttttctttaatccaatatgttcagtataaagtcatcagttttcaaccttcttttaatcagaggtatttcctggtattttataagggaaaaataaaatgtgacatcactaacctgttatattgtagaatataacaatgaatcttttgttttataaagggcctgccttccttctttccttccttccttccttccttccttcttcttttccctttcttcctttcttctcttttttcggcctaagcaggaactcattcacctaagaaggaaaacaaagttgctccctcttaagaaagacatcctgctgattttgtcagacaacaattctttcttgctttctttccttctttctctctcattttgtttctctctttccctccttccctccctcccttctttccttccttccttccttcttttttttctagggaatgggtcttgttctgttgcccaggctggaatgtaacgtcacgatcatagcctacgacagctttgaactcctgggctcaagtgatccccccacctcagcgtcctgactaactgggaacacaggcacccaccaccacacctggctaatcttttcgtttttttgtagagatggaatcttgccatgttgcctaggctggtcttgaattcctggcctcaagtgatctttctgcctcagctttccaaagtgctgggattataggcatgaaccactgcacctggaccactgttttctctttactcttatgatgcccccatttatcttaatcttattcttatcgcaactcccagacacctcctgtcctcttggtgcactaaagcctaactttctctttgctcatacagactgagagagatctttttgcccggaagctttgaacattttataaactccttaccaaaataacaccacttaatctgtgtcatctgtggtgacgagcttgtgaaagctatgtggactctttggcactgcatatgataccacattccacatcagaaatctggagcatccagaaagtaatttagctccttgttttcctctttggtgctgaaagcccttgaaaccacttgggggctgctgatatctcagattctctataagtaggaaactttttgataaaaactgcagtaccagcaggaccttttagtgtgatgagcactagaagaatgaacagggtgaaatttgttttgttccacaaagggacaaaaaaaaacaaaacaaaacatgaagatgggtatagacagaaagagaatctgtgaaagatagagccctggttcaaaaaaatgacatatttaaactcaggcaatgaaatagtgagacaacaagttttaaaatagataacagcaacataaataagaacttatttttatatgaagaacctgaggttgtacttaaagtatgcaaagcacggtggaataatacattttacacagcacgcactcagaatccgtttatgtctaaaattagcaaacaagatcaaagtgccatttactacctatggctgcaaattaatgattaaagaagaacaggttgatggttctacctaaaaagtaaaagaaaagttaagggaattaaaaatcacagtattgtagaataggtctcagttaaataatgcacatggatgttttccaaaagaaaactaaactagttctgctttccctctcttgttttttcttaactttcaacaattggctgttctcaaagcccgaatagttccattcactataagtttcaagtgcttagcaaaaatgctgatagcttcagtttagctgttttcggaagtatgtggatttttaaaatactcacttttttctgctatcagaaaacttaagggacgtatgagaaaataaatatgagccgaaaaggcctttttcatatgtgaaacattgcagagcataacaatacgcaagttccccaatacattgtagtttcctataattaaatacttatattcacatagaggaatatatcttacattttcaaattaggcgaataattttatagccaaatcttttagtttatatagaacccaaatgcttaatatatctttgttatataataatattttatattgtggtcttaaagccattcagaagagtcatttccccagaaaagtcaactctgttacaagaagttacagagagctttgcttcttattttgtagtgtgcaaagaaaaagagaaaaatgggataaggatggagggaaagaggaaggaaagttaatactttgaatgctaacactaaacaggctgttacaaaagcgttctgtcctcctcagtcactgaagaggaaatgcctattttgtatctccctcattgtcttcgcttttgctggacttgtcgtaccagtcaccccagaagtcactcagcatgccccctctcattcactggttctctgcaaggtcttttgacattcttggtgttaggcacattaacagaacagagtgactgaggtagataagattatcttaaagtaaattgtgaggtgattttttattaatagaagagttccatcctgaagaaattacttctcattctgcttggtgcattggtgcagttagatattctgatagtccaattgaggtgtgtgtgtgtgtgtgtgtgtgtgtgtgcatgcgtgtgtgtgtgtgtggtggaacgtacagaaaagagacgaaaaagagcaatgaagaagtgtaataaaattagtcctcaaatatgtaaagaattaaatggacgtttccatctcttctttcaccctattacctcattctaactattcttagcaggtaaagaaaaaacgtctttactctatttttgaatctaatcaatgcagaatagaaagtttatggtacccttaaggaaaagaattcatataaagtgtattctcacctaaacccccaaaaccgtaagaatgttttcttcttagtttctttaaaaagctatgaatcattttactaggaaaataggatttttaaaaggtcacagaatatactgaagacaagaaataatttttctttaaatactatataggatgaggaaatagagaagaaagagaagacttccccagccatttatgatgataaggaactttaagttcttttgccttcatatttgtataaatttcctaattggccaacactacaattcacaataacatgaattatataatgcatgtaatttcttcagagaaaatgccttactggatgtgtattgtgcactagttagccttgcttattattttttttaagtgaaacagcatgggttgttagcaaatcaaatttctttaaaaataaatgagcttggatagtctcctgatgtctacattcctcatggcataataaatgcccatcatggtttcgtggtgacattcatagtttcaaatattttgtcctgctgtcatggtaagtgcattcatacgtggaagattatatcccaagtttgcatttagaagatatagtcactgaacccatatgttgcccatcaaaactttttggctcttactgtttgaaaggggaaattgggggcctgggtgaggtcgctcacgcctgtaatcctagcactttgggaggccgaggcgggcggatcacgaggtcgggagatcgagaccatcctggctaacacggtgaaaccatgtctctactaaaaatacaaaaaattagccgggcgtggtggcaggcacctgtagtcccagctactcgggaggctgaggcaggataatggtgtgaacctgggaggcggagcttgcagtgagccaagatcacaccactgcactcaagcctgggcgacagagcgagactctgcctcaaaaaaaaaaaaaaaggggggaaattggactatcctttgtgaagcacccaccatgttccaggttactgatatcgtacattcattatcgacttaatgctgaaagataagtgtgattgtccctgctttacagtttgtgaagtagggaggtgtagtggttaaatatattcaaagtcatatggctaggaagtctggtgtcagggttcaaaaccaggacgtttgagtttcaaattgctgggttttttcctccactctttatagtattctgcttctgtattctgtagtttctggtcacacaaaacacaatgtaaaatgtcagcataagtgggaagttttctaaaaagtaaatgtgtgaataatgtgctaagaaattcaggacccaggtctcaacactacatagagaagaataatgacatttgtcttgagtttggtatccttgacaccaccatgttttgtctgttagcctgccaaatgtgtgtgtgtgtgtgtgtgtgtgttttaatcatctttctctttattagtataatataattttacctgccttgatatcatgtaggcataaggtattagtcttgttccatttgtaaagattccaggagtgttctgctttttataacacttcaaagttttgtgcttggagctccactatccaagagaggcaaatggctgttaaggaatctagtaaaacattccaatataaaaaccttcaggggcacatggtgatccattaataaaacagaaattcaaatgaaaactttagtttaacaattaagatgatcccgactccttgctaaattcccattgtcttatgggatacaagaatgcaatatgagatattgtacaatgcctttagtattttttctaatagatttagttccatcacgaactgctaaaacagtgtgagaaaattcttgaagaagttatataaatattaatgtatttcagagttttgcttattgtattgatatatgttcaaaatgatgtattttttcagcaatacaaaggatataacttatctcacctttctttaggcaaatgaatgacaacaaattacaatagtacaatatcactagatatcttctaagttcagtgattaaaatgtacctactaaagagaaataatactttaatcactgtaaaaacccaagcaaagtagaatttttcaaagccctgtggagtggcaaccctatatctttaatatctaagaactagaaaataattttaaatatacatatgttttatattccttaagagcaagtgactttaggtgagaggagaccaaaacttaagtgaattaccatttaaagcaaaagatcaaactagaatgttaaattgtagcaaaaaaggaagaaattatgtgactctttcatactataatattaccagtttggaaaataggcctggtaataaagtttgttttactaattctttctaaattccaggccaaaaatatcatgtaactttaacatggctttcatttccagtcatgtacagaagagtcctttaatcttatcttgctaaagaaaagaaatattttttgccttaaaactgtattctataaatcagttcatgtctgtctttctacatacaaattaatttctgtttgttgattaaaatctgctggggcggagaggtagctgtttgatgtaattggtctatcaagtttaaatgcaaatgattaagtagggtaaacattagcagggatggcaaacagaaccaaaagcattttctcatggtactctgctggaaagctgatgtgatttctagacagaacagacagcttacccaaaactatctaagtacaaatatggctacctctttcttctacattctctctcacctgttccaattagctgtaggaatcctcagggagaactgcatttcacaattagattttagaattgccgtacccttaataaatacgggagcctttaatgtaatatctgctatcttttcttatttcaatttacctcacctaacaaccactttgttttcagagcctctttgtagaaggtcagtgtgcagtagattggctttgttcacagactacacaggatcctcactggaggttttgtttagagctcatatcagttaatgtctcccaaattatttcttaagtgttacacttgatttaccaccacagtttccacattatttcacaatacaaaaactcacaaaaaattaccatactttcttcatattaatacacaaagaatgatgaacttttcctgtaagcctgcctgccttcttcttccttcctcttttctcatctccttcctagcttctttcactcaccatctcttcttttttcccttttctttctttttttcttaggattctgtatttttacgatgcaagctctgtttgtggtgggtgtttagatgacattaaaagatctctcttttaaaatatttcctttccaacttcagcaactatggagaaaatgctgatacaatatttaaaatttaatatacgaaagttaattttctattacatactccattgcatgttatagtaatgcacttgaaatatattatctccatttcatatcaccatgccaaacttacaaaaattcagtatctttaaaataccaagactatttagaacaaatacatgatgtggtgttcataaaaacaatattggattaagagtcacaagagtcatttccttaactcggttctatcttcaacactttaaattctctggtccttagcttctttagttacaggatgagtgactgcaataaattatctctaaggtcacttatcatttcaaatgtacatcttggaatcactaaacatttccttataaaagggcaataacagaaatatttcctacagctggagtcttcttatctgccaacctcaaccattcagagcccagctctgcaggaaacacccaggttttgagcagtcaaaataaatgctgatgtccatgaaccaaactttattcacaaggaaactccttgggcccctctcacagagactgtttactctttacattgaatctcttttaaagtttgattatgttgttttcaaaggcctggcatgttagtggcaaactggaaagggactatgagacaatcacagaagggagcaataaatgggcgagtgcttcgaaggctctgaggtgctgcacaaatgcgggctgttatcattagcgagagtgactgacaactgacaggaatagtgagagaaaagataaatcattgtaaacaaagcacaggaatttcaaaatactgtttggggtggggctgtttagtatattggcaagtcggttgaaacagttcagtaattcctgaaagtctcactgaattatagcatagtatgtgcttatagaaataacagttatcaaggagatgtttatttacattctgaataatatttggtttaacagatagtgtaactggaaagtgaaatcttaagcactatataatggtattttgacatgtaattttatttgacatcagaagagtatgcaagatgctccagatgttccaaatattctccatctaaaataatttaaaaataaaaatctataaggtataagaatctagatttcaaatacctagaaaataatatctgagtgatcttgaatacataaaatattactttaattttgaaatgtagtttatttttcttatccataatggtagtaattaagatgaataatattaattcattttgttccctatttaaatgaaacagtactatgcctgaatcagaatttcctgcatgcagcatggcttctaagctcacaagcttattatgagagtagtattggaaagatataaagcatagtgcctgccaatacttaaaacatattacatgctgaggcaatgcaataaaaatgtttaataattcttaagtgatagtggcaaccaatctaaagcaaactcaagttacagttgaaaacacttatcaattgatatagagttagaaaccaaaatcaaagtttgttcaatgtcaagttactaaaatattcattgaaaactccaacagcaaattaaattataagatgaaaataagaaatctgacatactatctttttgccagtccaggcataaaagtaatagggctagaaattccaactgaaaattaactgtatgctttttctcatattggagaatctgaatcctagaatatttaagccttgtcttatatcatattatgcataaataaactgaagcccaagaaagcaaggtcacaatgaggttaagatgaaacaagaaacttgttttctctagtctctttacactagtgttctttcaagtatgagttataaaacagatattttatgtagaattttttttaaaaaattcttatcatctactacctaacattagtggcagacagcattgtaagaatgaagacctgggtggttatcagagtccatgttcttcagggcttgaggccatgcttttggaaatcatttcccagagccggggcatttgaggagagtacagaaaagcaaatgaatggtgaataggagaaaggccatcagccaggcagctgcaggttagacggatggattgacttcccagcagagcaaggcacagtttgctcaattacccttttgtacagctgggaaagaaagacaggaacatcagagactgctatctctcagttaccaataacttttgaaagaggtatttgaaagacatataaatgatattttccactgcctccctgtgcagggaaagcattgtatgtcaagtcaaaactgaaattcactagtaaccaaaattaacagccatagtctttggcaactatctttggtcacactatcacctagaattggctttgtactttgtatcagagctttacatgaggtccttgatctactcatcagtgttttcagaaagacttctggattcccaaataaattcagaaacttctcttaaaaagaaaaattagtactgattaaaaagcacagtattacagaacttgttattaacattttatttttgcatttactttttccaatctcaaattggtaagcacaaagcttaagaaaacaaacaacagtatttctttaggagagtttaagttccagctttgggtttttctctttctgtagtttatagtgtgtggcaaaaagggctcgcgtgtgttaaagccaaaatgcattttgcattaacaatttgcgtttagaaatccaagcacctaacaccaccagagttaatatttgctttggactcttctacttatttagtctcaagcttttccaaagagctaacacaaaaagacagctttcctatttgcctagtgagtgtgtgatttcacacatagtgtatgatatgcttctacagagacttggtattagctgtttttcatgtgagctgtgtacttagttatgttgggaaatgtgaactttgtagttgaaaaatgcagcaaactgactgaggctcatatcgattctactttagaaatgtctcctgtctccttttcactgtgcctctttttcattcccactgccctatttcactatgagtacataacctaaacactttaacacgattaccttccccgagtcccttctccagctagtttgccttcatactgctgccataattttcaatagcaaaaatctgaccacttcactgccatccttaaaatgaaccaaaaatccttttgttgactccacattctttacagaataaagtccaaattgtttaagctattatttaaggctttcaaagtatcaccccattgcttctttcccaggtgcctttccttccatcacctcctacagcccctaaacctcagccacactggctgaacatgattatacccttgctccagcctttctcttgcaaggagtttccttcatccttctttccacttgaagaaattcttatctgtgatgattcagtataaatgtccattccaggcaaagccttctccagcctattcatcaatccctcctctgctcctgcaacatttggcatataatctccattattccaataaataaaagccaaagagacataataactttcagcactcgttgtatgaaaagcacttttttaaagcaacttatacttattaatttagtatattcatgataacactatgagcatgatactattaaaagggggaaagttcccttgtccccctcacagggcatgcgacagggagagtggctcgcttcttcagtgccccactgctcaaacctctagggagcacacagacgggcaggttatggggcaggttatggagctccgaccctatcgcagtgtcttgtgctcttttagtttcgccgtctataggcggcttgtgttaaccagcttaattagaccttctacgttgtcacaaggacagagggctttctgtatctcgggttcttgccttggtgtaccggaagaatcagatcacgtatgggcttggagaatgagtgcaagcttttatttagtggaggtagctctcagcagatgggggaagccagaaggaggatgaagtgggaaggttttctcctggagtctggccactcagcggcctagcctctccttcagctgcccccgccaactccgcgtctgtttctgcaagcccacggcctgccggcctgctggtgcctgtcaatacatacctcttgacgtccagctgctcgtttgttccccccaccttccccccgccgatgtgctgctcctccagacgaccacctgtgtgtctctgcctgctagggtctcagggtttttgtaggcccaggatgggggcatggcaggccagggtggtcttgggaaatgcaacatttgggcaggaaaacaaaaatgcctgtcttcacctaggtgtggggacacaggcctgggggtggagccctagccagggaccacgtccccctctacccagctcttcccttcccccttctgtatcatttaaagggaccacgctcttccctacccagcacttcccttccatatcactatcattgtcctcaattttacagctgggaaacattagtgcatattggctaagtaactcactagaagtcacctagcttattagtagcagagctggattcatccttaccaggtctgaggccagaaacaatgccttaattgctacactctgctgctaattatgtttcatttctgtcttctagatttttatctccttggaagaggtagcttatttatatgtatatgttgtattagaccgtcctctcattgctataaagaactacccgagactgagtaatttataaagaaaagaggtttaattgactcagttccaccagctgtacagggaacacagctgaggaggcctcaggaaacttgcaatcgtggcggaaggtgaagaggaaccagggacatcttacatggccagagaaggaggaagagagtgatgaggaagctgccacaggcttttaaaccaccagctcttatgagaaggcactatcttgagaacaacaagggggaaatccacgcccataatccagtcacctcctaccaggcccctcttccagcattggggattataattagacatgagatttgtgcaggaacacaaatccaaatcatatcatatgcccagcaggagtatagtatctggacattttagccaatcaatagctttatgtccaatttatctgaattaatacgaatcagagccttttagattaaggaaattttatttttaaaaataaaaatattttcacagaaaaacattcttagaaaaaatattgaggactgtttggcacagatcagtaataaataacttattaaattctaatcagatgtttagcatatatcttttacagtctttggattatatcaacaatattagataaagatataacctacactattcttcagatatatttaatttttttcattttcaaaagattttattggctttcccacagaaatcattataaatattctcatagctacaaaggctttagaacaaatagaaaatttccataactttatctttctgaagtataattgtgttgaagtatgatcagcgatttttattgatcttatgtgtttaccttggtgactgttaaataagattttgtattggaaattttctttgttgaacagctccctgtttttaaaattagaaacacaaatttatggatttctacataacaaactctctaaaatgatactctttacctaagaagtatgtaatatatgcctgttaattaaacatgtactaatagttatatttgcatgttgaggcttcctgcaattcacaaaacataaagaaaatgttttaaattgattctaggggtggtgttcttattagctgttgtaaatacacagagaggtagaattgtagctgaagaacacacacttatagcatatttttgtaggactcaggtgggaatgaacttgaaaattaccattggattttcagacagtaatacaaagtatttcagtcttttccatgtggtttgtttgtttggtttccaattaattacttcctgggggaagcattgggagttgtttcagttatagattcataacaaaatgagattcataaactaaatacatgatataatctgaagccctgctaggactcttacagctcgtctttataacctagtattcctttaatgagtaggaacagtgaacttttttttaaacccaaatgacactattgtctttaaaagctgttaaaaatagcagagccaaagacgtaatattataatattcagttaggggaattttgagtgtcattatctccctaagcagtaaccatgaacaaattatcaaagccattgtctcttttaaaatggaaagatgaaccaaatgtattagcacctcagtgggattgggaatatgtgaaaaacataatcataaaacagcaattgctaagcctctactcaagacactcttgttcatcagaggttttggtgctgttggaaagtcagcacctgctgaaatctgcctggggattcagctgcctagactggaatcacctctgctaatggatgccaaagctttgcccttgaagatgtttgtgtccttccctctccctataccagtggaatttagatgagactgtctaaatgtagaatatattgcataggctgaagaaattgtgtgtatcacttgtttttaattaatagactatttttatctgttcttagtttatggaaaaatttgagtggaaagtaaagagctcctatataggcccgcaattccctgcctccccacccccttgcccctagtttcccctattattaacatctttgcattagtgtggtacatttgttgcaattggtgagccgatgttgatacattattattgactatagtccctagcttacattagattttcctgttgtgttgtacattttatgggtttcgacaaacacttaataatgtttattcattatcatatcagaataatttcactgccctaaaaatgtcctgttctccgtctattcattctttcctccctcccttgagaccctggcaaccactggtctctttactatctccatagttttgccttttccagaatggcatatagttggaatcatacagtatttagccttttcagactggcttcttttacttcgcagtatgcatttcaggtcccttcgtgtttttttcatggcttgctggctcatttctttttattgctaaataatatttcattgtctggattaccacaattttttcattcatctattgaaggacatcttgtccaagttttagaagttataagtaaagcttgtataaacattcttgttcaggtttttgtgtggacataaacttgcaactcatttgaaaagtcgttaattgtgaaaagtgtttttgacagagaggaaagacacaggtctttaagttagaaagactttaatctcaaccttgccattttagtcattcagtacgtttttattggaggtctactgtgctacccctgccgtttttggtgttagaaatgcatatagggctcctctgcctgtaacctgagtgccccacctacattaaaaagcctcattagacttctggttcctgatctgaaagatgcctatcttcttgaatattcatgattttctattttattttgaaaattagaacagctgccacggacaggacttgtatttcctgggagcaagtgccaaattgctacatagcatcccattgagaaagaagtgataaaatgtgttagttcattttctttctagtccttctaacctatatgttttttaaaatatttgtctaaatatgaaaagcattttaatactttccaaaacaatattcttgaattatccacaatataaaatgaaataaggacatggaatcattttttgtatatctaatagtgatgagaattggacttgagctgagaattcattttgagctctatctccatcacatactggcttcgtgatattggcttattctcttgactttgcagggagaacagtttcctattggtaaaatgaaggataataatatttgttcatcatacaggtttctttgcttatcatacaggacttttgtgaagcccaaatgcaaaaatgtacaatgtatataaaagaatgttgcaaactataaaacaccataaaaacattcagtattattaccaattgctttaatgtatttctaggtctatttaatcttttattgtatatatttaatctatacaacatgaggttttgatatacatatgccttgtgaaatgatgactacagttaagcaaatcaacatatcactctcctcacatagttatcattttttgtgtgtgatgagagtacctgaaatccactctcttagaaaatttctactatacagtacactattattaaccacagtcatcatgctgtactttacatttctagttgtgtgtcctatacagttgtaactttgtagcctttgaccaacatctccccacttctgacatcttcccacccctggtaatcaccatccactctctgtttctgtgtatttgccttttctagattccacatataagtatgattatgtagcatttgtctttctttggcttatttcaattagcataatgttctccaggttcctctgtgttgtcacaaatggcagggtctcctttgttgaggctgagtaatattttattgtgtttgtatctatatagacaatttatttatcctttcatccataaatagacactttggttgtgtccatatcttggctattgtgaataatgctgcagtgaacaggggagtacaggcatctcagtattgattcctttcttttaggcatatacccagaagtgggattgctggattatctggtagttctattttaactttttgaggaaccttcacaccgtttttcataattgctgtaccaatttacattgccaccaagagcgtacaaggatttccttttctctacatcctcatcaatacttggtatctcttgttttttcaataagaaccatcttaacaggcatgagatgatatgtcattgtgattttgatttaatttccctaatgatgagtgatgttgagtaccttttcatatatctattggctaattatatgtcttctttggaaaaatgcctattcaggtcatgtgcctgttttttttatctgcttctctgtgggttttgttttgtttactactaagttttatgaattccttacatattttggatatcaaccctttatcaggtatatggtttgcaaatattttctccctattcataggctgactttttattttgctggttgtttcctctgctgtgtagaagctttttagtttaatatagtcttacctgcgtattttaattttgttgcctgtgcttttggtgtcttatccaaaaaaattattgccaagtccaatgtcaaagagcttttcccctatgcattcttctaaaagctttaaggtttgtcttacatttaagtctttaatcaatgttaaactcattttttgtatattttttatttttaatttaactaaccccttactaaattggggtgggattttttcatcacatcagtactgaaatctttattttctggaatttcatagtctactaatgtcagtgggtcaatacggttatgatctgcctaatttcctccagatgttaggatcctctgaaaagcagatgtcaaaatggatttaacatacaaagaatgtattaggaaaaacacctatgcaagaaaaaatgaggaagaagatgggggtggtcggtgtggagaataagcataccgcagagtaaagatggtcccaagtgaaagggagaggatatgaaggttgggtggaagcgttctagactgtcatgcagtctaaggaaggttcatcagggaatcggggtatccgtgagctataatcagccctcataggagtctcttgtaaccaagaaacttgcctgtcttagtatacttgttgcattcaattattagctgggaacagctggtaaaagtgtaaccttagcacaaatctggtaatagacagaatgtggcagttgggtaagttatgttcccagcagttggagatctatgaggaacattttcatgtccactagacttcacagagacttttttccctaaataataaacaaaagtgatgaaccacttatttaataatgttttactaaggatgtgaagaggagaagcagagacaagtgagacagaatgcaaatattaccaagtgtgggaaaccatctgagagcaggcacattcccagaagaggggttcatgtcagggtttagtaacactgtcctcatgttcgagttcctgtgtaatcagtctacaggtgccattgacctgctgtaagaacttgttttccttatccagtgtttttgtttatgttttaccaccttgtttgtgatagctagtcttccaaaaattcttctgggcggtgcatttaaccatttcctaaattgcagaataaatataagacattaaaaaactacatttggcctctgggatataaaatgaagttttcaaagagttaaaatctttgggagtactggaaaatttcaaaacgggaggcaccttcagatgcagatttcatacccttagaaatgataaaactacctttcaatacagcttcctatatttctcatctctactcattgccttcctaaattatcttgttctttttcccatctttcctcccactcttcaattaagaagaatgactgtcaggaaaaatggaacacatgaaaagttattgttaaaatattaatagatgtcagtatgactctctaagttcatgcattccagagttaccccactgggctaccattgtgggcaagctacaatgagcatgactctccattctcactcagtccttgaggtgacacaccatctcttaaggcagaaagatgattttatcttcagatagcagattatactgatttcccaagtgtatgtgactatttgttttatttttaatttcctctttcctgtgcttttagtctccttcaaaaatttatcttggacaaacattccatctctcctttctcctcaaagctagaaaactagatcttatagtaagctgacttcagttcttaaagaaaggacaaaatgccatagaaagccgtaatattcttcctatgaccttaacttatattgcaacccctccagggagctgtcaattaaaagcatggaatttacacaaatctaagtctcggaaatcagccagcaagctgcaccaaatatgtggaaaaatctattaaatagctttttaacctttactacttaccatgtttgattgtacaaatctatatcctcaggagacataggcaatgctaattgtgattcatgtgaagaaaagagcaaaaaggtatttcaactgatataaacatttttcagtatgaggttagatacttaatgtggaatataccagaagctagcatactggactagatcactcaaccaattcagaagcagaaatctactactctgctcatttagtagccctaataatccacttttttatccctggtaattcactacctcaattataacacagcattttctaagtctgtaattctaatactattgaatattactttaaaagctaaagcaatacagttcatgtaagctattattaacagatgctttctgtgaaaacaatgatgatcttattggctaaaagtctttgtgatatattttttctaaagcattttgagggatattaaagcattagaaacttttggttttggagtttggtagtgttatcaaagatagctttgattttctcaaatcaagagatctttttgttgtcatgacattaaactatttgcagaaaacaaatttaataatgtcacaataactgtgagttctttctgaagacagacttcattctaaactccaaattttccattacttcagatgattcaattaagatcctttgggaagcattatgcctgcctttctgttgataatgtttttacgaatgcagtacactcttcttcttgctaaaataggtgaattgtattcataatttcaatacaacttatgtggtaaaatgcacaggaaagtgtaatttttctccatttaagtagaactgatactctgaaatagttaaacttagattttcatgctcagaaaatgtacagagcaatagaatctaaatatattcatctgtcctttgcattacttagcctgaattaatataactaatatttcaaatataagtttctacatctccagttaagctagttcccaaatgaagtcaacaggatcagaatctagactaaattgaagaaaatttagttctttagcaagaattaaattgagaaaatgaatcaggggagaggggagcagaaggaaaatcatactttgctagttatttttattgtattgactaattatctgagtgaaggactctacttatatgagcaccttaaggactcagcctcaaatcctaattagaagtataatagtaggaaatagtcaactttcggaacttcagttaacacaaattattaattacatacatgtttttgagcaaaatatatagtataaagaaaaacatacttaaacatttctcctgtttagtcctccttactatgaaaatctactttaaaacaaaatagaggcgattgttctttttacacacaaaatctagatttttttggttcattgtattctttctgcctatcccccccaaagcacccccttcccacgcatacagagcatgaagtatttttaaatgttttttatttaagtttatcaccacttaagggcctgtgccttacttagcatgttggcatagaccccatagcctggccaaaaatactcatcatttaggaatgatgacttggtaacacaggggtttcattgtggacaagtatgtggaatctcagtctcctgctcagaaaaaagaatgtgaggatcattgccaaggaaaccctaaagcccagtgcttttagtgacatttcaaatgtaagtctagatctgtgtacttttttccatctatattatattccattaaaatgtttttaaagcaaaaatagcttttggggggacaattttaagaggggacaattttgggggaacactaatctcaaatcaccacagtgctcccctctcactaccctgtagctgtattccctaaaatttcaaagaatagtatagtagatgccttaaagttcattcctggatctcaagttaagaaatgctaatgagtgcagtagaatctgcatatattctgatttaaaattcatgaggcaactcaaaaaataaaaataaggtttcacaacttcagtcaattctgttgctttttgatcatttctaaataagatttttgcttataatttaaaaatggccccaaaaggaatccaaatgctagtgttgatgctgaaagtaaagagaaaatagagatctaacattttattgcattttattagagaaattttatgtgcgcttatgaatttgggaaaactgccagtcttaggacatgttccttatgaagatcaaagatctactctgtagaaattgttataataaaaattgagtttgcccaaagagagaaaaccaagcgtcactcagtgcttctcatgcactgtgctattgaggtagttcctatcttcccatctatagaaacctcaattcagtgatgaggtcaaatgaaatttcctccaagaagcttttaccaatatcctcaatctcattgctgggattcctttctatacagtcccacagcatttggtttaccaacccaaaacctcacactgatttcatcttgtttcttaaggaaaaggcctctgtattttacttatacattttcttcacaaagcacacctaaaacttgccctgtagcaggtgtccaataaatatttgatgcatgattgaatgattcgatgatttttgagataggccttaaaggaaacataggaatctgaacagagtagatggggccaaggaaccataaaattaggtagagatggggtaaagcctaaactaattgggagaaactgtgacgtatccagccccatagatcatttcatgcttgtagaataacaaactatcaggctaaggtaaattaagaaggtaattttctgcacagcaatgtaaatatcgatagtgtatttttaaaactttattgtttgtgtaattcttttctatgacataatatggattattatattggcttattgtttaataaaaagataaatatttagagcattaaattatatcaaacttggaagtaaaataaagagtacctatcttaaaacataatcctgggtactactagtagtttataatttagtaacatgggcattttccctctgaagattattccacagtggcaagtggtggggggaggaggaaggaataattactatttatcttatttgtaggcctcactcaattatatctacattataatgtataacacttgagaaaggcaatgcagaaaatgaattttgaataaacatatccctacttcagatgcagcagacccaaattggcctctaactacccccatttgttgaaggaaaattaacaaagaaaaagaaacgagaaaaagcccttctttctatttcacaaaatgacattagatttcatcaggtaacttctctaactcagcatcccttccaaattacttggcagttatagccctttgtatctcacacacacacacatgcacaaatgcacacacagagaacttactttatatacctcatgaccttgatgagaatcttaaactcttgtttatacaataaagtatgggagaagctgagagataagataactccatgtgattgaatcataaaatctcaggtttgaaaaaaatacctttttcactctatcagtagaactatgatattttatcagtctttgtcatttttgtaaaaagattgggaatccacttcctgaagtcaggaattaatccctcattgtgatttaatatgtttctgtgtggcaaacaaatttgataataaccagatactatcatgtatcattctgcttctatcccttagcttgtgttcactgattatttagtcctatgctaagattctatttttccaaaaattcctttattggaaacccagtttaatcacatgtgagaaaccaatggctgaaggtttaaacaagtgattctgatttgcataaggtttggtgggcaattttgcctcccaatgggtatttgtcatgcctggagactttttggctgtcataactgggggaagagtggtgctgtcatctaatgggtagaggcaaggctactgctaaacatcctgtaatatacacagcaaagcactctcacgataaagacttatttggtccaatagtgaccaggttgagaaacaccgctataaactagtgttacaaaatatttgcattttctttagagttgtacatatcctaattcattagtgaaacaaataggagcattagcatgtctgtcaaaattagtaaaaaaatatgaaagtaatttctaaggataaacttctcatttctatctgcctcctcagggacagttcatttgttcaaataagtctctgtaaaatttttgtgaaaccggcatttagttcttataagttctgagtccattgtagttgcagttaacccttttatgacacttagcagagctagagctcaaaacttcttttacggatgatgatgctattaatgtattggttcaataaataataattaaccaggctaaattacagcatgtgaaaatagactgtctaattctcattctattttctgtattatttgatgttcttctgcttgaaatgtggtagcagattctgaattttaatctacctcaattcaaatgtctatatgtcaggaatgcaaagagaatgattcctctgaatttggcagttagttttatggaaaaaagcatttgtcaccaaaatggccaaaattacatttttattatttcaattagaaataaaatgtttacctaacttcaaaacattaccagagtctgttttcagtgcctcttttaaatcattttctatacaaaacatattactgtaactagcttatattttatcgtcacttgcctgagattctatatatcagaattacttctttaagagatttttcttttcctgtgctcaccgcattgaatttccattaatacttctatgtaacctttgtaattctattgttctttacctttggttaataaccttttatttaaaaatgcctaaataattacacactgcttctcaagtatgacacattttatatcgtattgtatgttaagacattttaatagcaacagtaataataagtcataaaatgtcttaaatttataaacacatttaatacagaaggttctagtccaatttaaagtttcttttgacctgtgcttatacacacagccataacacatacagaacacacttatacattcccacattggtttacacttgacatttagcctctttcaggaaggatgtcacaggcattctctatgtccagtagtgcccgataatctctaggctacaaaaccatgaataatttaactaacaaatattacagggagaaaattgcaagggaattctagtaagctaaactcaatttttagacttggcaattcaaagataaaaagctgtttcttctatgaaaaatgtaaacagaatcattcgagttgacaggtactttgggtctcactggcacttcatctcaaagattaagatatcactagaaattaggacgtaatttatcaccaaatcaccatggtctttgtagcgactttatccctagggggcgcgagatgttagctctcccacagatgcaagccttcagtccttctgtcagatgaacttgggagtcagtatactctcacaagaagagagaagttgattattatagcaaacttgaaaattgattctaaaataagcacgattatggcttctaacatgccatccaacttactgccactcattctgccctaggccttatgtctgtaattgttggctttttacctactgccctctgtctagtgtggtatcttatttctttgtgttcgtcctgctcttcaaagttctttcctggctgaggatttggatttggatttggagctgtcattaaaagacaccattcatgaatttccaatacttgaataaacaacttttactttacggtcatcacaagtgaagaaagggacatttcatgatatcatttgcaaattagggagcacaagtaatcaatctttaatttctctttaaagggaagggaaaatgttctctcttgtcattccatctgtgaattcctataaaatgtgtttgctgtttgtttctcctcaagacagagcttgccacccaaaatcaaaatccaagttctctacacatccaagataagatatgaatggctttagagtatgtggcagaaatgagaattctcaaaattccagtgttgtcaactgctctctgattttccaaaatgttagtttgataaccaaaatggaaagaactccagagtcattttagtaggtgcccattagatgctaggcgttgtttctggagatacaaagcttaaaaatacatgatctcttccctgttctgattgtgctttcatcatgccaatacactatgtatttgaaattcatagagctttaagactcattataaaatattatgtatatgtagcacattaaagttctatagagaagagaaaagaaaaatggtctgtgagaaagggcaaagcattaaattcttggaaaaggaattttcttatttccctttacctggcaaaggattcacttcattggtacctaagctctgtaaactgttttcactccttggccaatcatgaaaacactgttagttgccaaaggaaggtatgatttcaaataataggagacaattacaggtgcatgccctgacataaattaaggtatagagatggatcctctcaaaattattacatattcaagtgccttgttataagctgatgaaaaaacaaaatatgaaattacaaaatggtttccttggctttgcagacctctacctgtgaagtgtatgaacaagacttaatacacacagcagaaattccacatttaggagccaaatatcacagagaacaagtaatgtcatgtgcaataaagcaatttcctaaatgttattagtctgcatgtctgcagccacctgtctaaagctcctttatttttattttaacaaagttgaataaaaaaatttcttcatttacagtcttatgcttggtttgatgttaaaagggattataattgcagtatagagaacacaaaacaattttaaaattatagagataaatttttattatgagactgaacatatgataagcaatttgaagtaaacctcatgtctcaagtagtaaatgaaaatgcattctcactttgcatatttggtattctgtcttaacaatgttaaaaatgctgaaaactagttgttatgttgcatatttacatgaagtgtgtgttctttgttatgtttctgttcactggggcaaaattcttaaccttaaatgaaattttggtatacatggtgattgatagataacagtcgaaagatggtatcctcccagtcctgtttcttcagaaagtcagaagatggttttatttatgtgttgcagattgccgtcgctttgcattttagcaccacctggtggacaaaatatcatttgtttttttctctactgtttaaagtagccccttcacactctatacccgattatgatacaccttaatagatattcagctgtgtaagttctaaattttaaagattgttgtaaataaactaaggttaaaaaattgaaatgtttcccaagtactataaccaatttaaatgcctgggtttttttaaccttcataaatatatccagatttgaataatgcttttcattcatatgcaaaaattgcttctttccacattttaattttttattgtttatattttttcttaatatagaattaaataagatgaggcagttttctgtatgtacaaaattgtggtttaaattatattgtcttccaaaaattcacataatcactttgtaaatagcactttatgaagcatgttcatactataaattcttactatgctaatattttatacaaaattaaattagtattttaatttatactactacaaaataagccactttccccttataaataaaattcagttgtggtcttatgtgtattaattctcagtttttaatagttttttgaattttacagaagaaaaatttgataatattttcaaatgaaaaacacaaatatagttaaagctagttttgagaattttaatcatgttagtctttgtgtagtcccacatttctataaaatatggtggaaattatttctatgaaatacagtaaagaagataattcatctgcagattccactatgttcctttggaatacaccacttacctgttctctagtaaaattggagatctgcaaattttgattgtgtgatagtcaaggattcaaacattcagtagctaaatagaaaggtggtaatttttaaatggaaaatatattctagtctcataccttttgtataccatttaaaataaaactatagcagatgacaaccttcatcgacatgcatcttgaagttatttgtcatttcaagaaagcatttaaaattttgttctctctctctttctctcttcttcctttttttttccccccaaaggccttggatggtatactgtaaattcagcatatggagataccattatcataccttgccgacttgacgtacctcagaatctcatgtttggcaaatggaaatatgtaagtgtgacctacctgggacttggttaattgcccttgttcttttaaataaaattctttctgtgagtaactgtgaatttcaaattaacctaaatgcaatattaaactgtgagtacaaatgtaggaaggtaaaattgtgtggaatatggcaaaaaaataattcctatcttacataacaaatgatattttaaaataaagccaataaacacatagttcttagaatgtattagtctgaaagattccaccttaagtgttagaggcaaagaaaaaagcagagttccagaataaatcagtggattataggacagacctcagtggaggatggcaacctttcttcatttgttcatgttctacttgatgtggttattgcaaagacaagatatatcagtagatagagccttagacagtctttcggaattaatcatcagtattacaagcttgattctggcatttagccttaaaaatgtgttgatgctataggtcttttttatatttaacggtgttgatttttttcccatatttcttgcagatagtaaaatcaaattttctcaggtatgaaggtacaagtgggtctgaaaatggagggtagagatcctggtagggagatgtggaatggctatgtaactttgagtaataaaatgtctcaatttaattaatcaatattaatgcaaagtgtttgtgtggtacaatttcccaatgctggaccacaggagactcatgacagtctgcaagcttcaagtagatatgtttccctggacacaatatcaaaatttccctagctccttgaaatgttaaaaggtatttgcaaaggaaaagaatttgatggtcaaatactttacaaaaagtttattgcggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaagtttattgcatcacttctcggagtctttcatatgtaaaatgcattaagaattgtctgagggtcatagtttgattcattgcttagatttatttgaccacacaacttttttcctcagatatctccaagaacaaacattctgcagaacacactgtaagaaatgtgcttaagcttgcactcaaggggtggtttaacacagtcttttaaaatataggttctgaaatcaacaggttccacaatgtgctcactgtgagattctgggcagaggaattaatccctattttttcatccataaaatgagataaaaatatcttcctcatagtgttgttgtcagagtacccgaagaaattgatatcaaaatacttacctagttcttgtcgtgtagtaatcattcaacaaagtgaactcgtgtctgtgatgctgcagaatcctaaccatactatgctcgtgtgagtgggaaatgaaaggaaaggaaaggaaggtggtaaggcagcacagcatttctctgtagcctccttctatttagtatccagttcactcgaggtaactttgaactatttctggtttcctataaatgtggaaatgtgaagttaaggcctctgaggacagagtctattagtgccaacaaaattccaagtgcctgggagactaccacacaatgcacttgttcaatcaaatttgctgccaaaacaaatggagtcaggtgatggcaaactttgatgatcatagaaaattctaactataacccagggagtagcattcacccagggagcagcacagttagtgaaatgtgggagttagtaaacccagggagtaacacagttcagtaaactgaactggcacagtggcactggaaatcaaacaataatggcaattttcaaatttttagttcagcaaaagtcttcagcaataaactgaaatatatttgaggcactatatgctctaaagtcaatcttgatttgcagaaatcaaacaataatggcaattttcaaatttttagttaagcaaaaggcttcagcaataaactgagatacatttgaggcactatatgctctaaagtcaatcttgattgcagaaatgctaaaatagagcatttgcaatgctctaatttaatgtaaccacctaaaagacaaaggaaagttttggaaaaatgagccgaagtaaacatagagaagaaatggcctgatttctcctggatcatattgtaaactccctgtgaatggagattacagctccctattcactcctcccaaccctactcctgacacctcctcaccattatctgccatagtgcctggtgcagaagagggattgaaggctatcaagagtggtacagtgtaaccataatgaggccaagctctaagctcaaatttttgctctgctaagatttcccagccaagaccttggaaagttacttaaccaaactcaacctccatggtctagtctgtagatgaggctaatatttaagtttaacttataaggctgttatgaatattaaaaccaattactgcatagaaagcccaaagaaggccgggcacggtggctcacgcctgtaatcccagcactttgggaggccgaggcgggcggatcacgaggtcaggagatcgagactatcctggctaacagggtgaaaccccgtctctactaaaaatacaaaaaaattagccaggcgtggtggcgcgtgcctgtagtcccagctactctggagcctgaggcgggagaatggcgtgaacccgggaggcggagcttgcagtgagccgaagttgtgccactgcactccagcctgggcgacagagcgagactccgtctcaaaaaaaaaaaaaaaaaaaaaaaaagaaagcccaaagaaaacacctgccataaagttaagtgctcaaaaattagtaactattatttattgaataaggggatgatgaataaggtagtggtctaacatactttgcataatgaaggaatgacttaagaagaggatttgcgttgtaaacctgtgattaaaacagttaagaagaatattgttgatgtattcagatatttaagcaaataaaacttttggactccaatattaacttagtaattgatattattaattcttaaaactgaatcctccatagaatcctaaaatttgtcatggactataacatatatcacatttaattttctcaaaggtcttgtagggtacataaaggagggactgcccctgattttacattaaattgcttattaggtgagagaatttttgtgggaccagaggaagaaatgcgttatatgtctcagtgctcttggcataattgtgtatgcagagtacatcttattttggtgatgtttttgtatgaaagacttttgagctcattgttatgactcagcaaaactatgggttgtattagttaatctgactcattccttaatggacataattattttacaagggtaaatactgtttctccatcaagactggttaaactattccatgtataaaggtcagctacatcagttttggttagaggtgtggacatttaaaataggtggattaaaataaagaatattccaaagataattgcccaaaatatccaaaccagtatttgcagctcaagtgtatacctgccgtgatggttatctgaacatcattttgtacctttgtttgcatttatttatgttttattttatattaaacatatgcagcccatgtaagtttcaaaacagttaataattctatcttctcaatgaaaaaaaaatctgattcctagagctctaccctttcatttttactcattatggcttctctcttatgaaggattttctgtaatcaaatatttacgtgagacttgtataaaaattattcttcgtagacaaaaaatatagatattggtagaatatggccaaggaaatgttattttgaatgtaatcctgaaacatctgaatatgcttgtgtttaaatgtattattattttaatttttaggaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcagtaagtagtctgcagcagtgtcactgctaagtgggattgatggccagtaccagaccatgttctttagaaagaagactgaactctctgtagtgtctctatagcaggtatctatataaggggacttaaagagatcttcattctgctcatatatactatcagcaaagaaaacaaagagtatgaaattcaaataggagatttgcagtgaggaactaaaataatattctctgttactttgtcatgtaaaaatgtcgtgagctatgaagtactactactgataactagcaggtgatcttaatttttactgacatgtacaaataagtgttgtgtgatacatacatagatatatgatatatatgtaatcatgtatatcacgcatacatatacatgtatttggctgaaccaaatgaaattgccattttgctgcataataaaaaaatataagcaaattcaaactatattttaacagaggtataaattttccatttatatatatccacatatataaatatcccatatatatccacatacaaatattttatatattatatatattagagatatagatacatttccatcctgacctttattgactggttattgatttagatttcaaaaagtattcacttgctttagaaaattgtcctaaaattaaaaaaactcactataccctgaatgcttatgtgggatacaccaaggggagaaagtagagtagtgatggaagaagagaaaattgtagaagaaacttggaataattatagtcactatgacaaaattactttgcctaatgatagcatatagttaatgttactgtgcaaataactgtgcaaatgaatgacttgagaagttataattaaagtatttcatcttttaaaactcaaataaaaagtcccgcctctattacttcacaatattttagacactacagggaacgaaacaggtctcaaaagtttcagaatgccagtctttcagtcttttttaattagggaagaaggtttcactttacaactttttcccctctgctttctgataacttgacagcgcttagaaattattaaaataaatagggaagaaggaaacccagagggccttccaactacagcaagtaactatggatttttcctgtttctcttgtaatagcctatgcaactaagtaggtctgtccctcaagtatttatacggacttcaaagctcctatgggctcatgatgcagattcaaagcatgcttatactatcaaaggaaacctttgttccctagaagaaccttgtaagagcatattacatgtttcagttgattacctttcagcttagaaggcactttccagaaaccatccacacttctcgatcgttgtatgaatcaaaccaagtgcaaaccaagtgtttgcagtcatgcctgtttccataaaacatcccaaatagtctgcatcctgcatttgccagtggcccatgtatttttttcttttcttctatttcactttcatgttattagaaagatgaatagtgcactgctcaggacacttttctaaagcgagtaatcaaaaagttttttggtgatagttataatgtcataatataaccagacatcaaaaatggaccacagtagctacagaggttaagtcacagcactctaatggttatatgtattaatttgtcattgtcaggtttcatttttaaggtgttaaaattttcctacactgagatggtaatatacaagggagttgagaaaattcagtttgtttcatttggaagaattatttgtgacagttttcaaaacattttgtaaaaaaaaaaaaaaaacattaagctattcctcatatgcaagaaatcatacctgtaaatcaggccaaatctgattttttcagaaatctgaaaaaaattcagctggcctaattcaataaaatttatcagctgatttggaatacagggaatttctattattgtgaaaacaaactcacaccccacctaccgccaacacccccctactcccttctctttttgatgttgttgaaaacaaagtgattctcagaaacagaatttgcattccaggctgtgggccagggagaatttacatagacaagttacacactcttgaaaatggtgttttatgctagaaatcgtgagaccctccaaatccagtaaaatgaacagcaaagcttatgataaagacaatgtttacaaaaaacatataggggctttggtttgtttttttgttttgttttgttttcaatgaatttactttgggtcactttctgtgaagcaaaaagcagctgtgacagggagactttcattctctgcatgtgtatattgcagtcacttaagagttactaagcccatcaatcagtcctctgtttccctctgttgaatcacttagcaacgtgcaccgtgtaccatagaatcaagtgtggttaatgggagccagtctcagatcaggctgctgctgattgccatcctcatgagctaagtcaaattgtttttattctaactacagcccctggcaaatgaccttgctatctttaatgcaggtttgcttgtttaattttaagctattcctcatatgcaagaaatcatacctatgaatcagcccaaatccaaataagtggcattcttagtcaccactaatcagcttttttcttttagttgaatggcatcaaaatcaaactgtgtttttatttagtgcacatttgaggttaataaaaccattcagaagcaagtgtcagcctttaaaggtgcccaaagattcgttctagtgattgtgaaaaaggtctagaagtcaaatgggtacccagagagccagaaggctgttggtgagatggagcagtcactgagcgggtcaccaggagaacttactttatgagatctgctgctaatttctgactttgggcaagtcacctcaccagtctggggctaagattcactcctcatcagtaaaatgaatactttggatgagacgggaggttttcccattctgatgctaggatcttgttcatgagttaatgaagacagttgaggaaggtaaggagctatttctacttgattagtgaggcttcagtctatttcaacatttcaaagtttttcatgataatttgttcatgaaaaaaaaaagaaaacagaggagttgctccagctctaaaaaaaatttgaaaaccacaccctgtgctaattgcaagtctagtctactctggtgctgctctgtggtattgcagacatagagtctgctctgtggtacatatggaccaggtcttatgatgatgataggccatgtttagtggcttcacacagaggtacttcagagcttttatttggattcctcccacttggatactgttctgactgctttatcaaaattaagtgtctttgctttcaccctcctcctgaaagtcattcaacctaaaagtaaaattttggggggcattgaggggggaagaagcagaaaatgttctgtttaacaatgagatctacaccagatatttcattttgattatttaaatataaaagataccttttgctcacagtagttggcttaaagtacttcatgatttatgaggggtgattgctgacaaagtactgggaggagccgttttgagtcaacacgaccatttgcatctgccttcacttgctctcctctcttattaaattgagctatcctatgtgtgggtttttatagtaatactagaacactgtgagtcatacagagcagttgtgccgtcttcactacattctcaccttgctgtgagctggctacatgccaaaaaatatacattttagtaggttgctgatttttagattctttgaaggctaatgttcatagctcttactagcaatagtctgggtattagaacaaaaggagctgtctatttcagtatatttctttctgaccactccccagccccttaccacaatttcttctccagctataaaatctcctgtataactgcagatgatataaaacaaaaagaaaagtagagggaaaagtaagggcactatttatgaaatgttttaattgacactaaatattacatgtagcttaacttttcactatatatgatcagcccttaatgggtattagtgaaagccctacaatttacttggttgaaagccactatccatagcaagctaacacaggaacagaaaccaaatactgcatgttctcacttataagtgggagctaaatgatgagaacacatgggcacatagaggagaacaacacacactggggcctttcagagggaggagggtaggaagagggagagaatcaggaaaaataactaataggtactaggcttaatgcctaggtgatgaaataatctgtacaaaaacccccatgacataactttacctatgtaacaaacctgcatttgtacccctgagcttaaaacaaaagtattaaaaaccgaaaccatttgagtcttagcattatatatcattgttcaagatactggcacatactacatgttgccatgaatatcagctgcccctgtctccaacacacacatgcgtgcacacgcacacacacacacaccttgtaaaatactatcagatttagaataaacactgtaagatatttttaatctccctattctataattttaagctaccatagtgtggccctattataatatagcttctaactacttaagatagccaggtcagcaaaaaaagaaaataaacaaaggcatgatttttccatttgataaatattcagttgaatgatttagagaaacttagccaagaagactcagaagcaaaatttggcttaaatcattgcccttgactaaattactttaatgatgcaagtaaatttgtagcattgcttttcccttcaattctatacttggttatgaatctttgaatcatgttaagatataattcacatagactattttttaacactttggaatcaatatgcaattttgctaaaatagtgcatgtcctcttttatggtcctccaactaatactcatcaattgtcacaacctaatataaaagaaaattacattcaagatacatagttaatatagaggactcaaaacaaacctttaaggagaaaataactcaggaaaatgaaataagtattaccattacattcacaatactcactgtgaccctcttttccaaatagaaagacgaatcataatgtaaacaggattaagctttaaacatcctttcatcaggtttccttaggtttgctacagtttcatttcattgaaaaaataaggaattttataaagcatttatggcaacaaaacacacatgaccatgagtaaaggaccaaacactgaaatacaaagtgtttatgattatgggtgcattgataaaacattacagggtttacaaagcaaagtaaagttatacattttctattagagaaagagtatgtgcacaacagtctggatattttactttggtgaactggaaagtagtgaaacttggcaaagcgacccaccaaatctgtctatttagaacctaaatttatggggagaattgtcaaatatcatcacatattccaggcatagtactcttgaaggagaaactaagaatgttttgaccttttttttctgttcattttgactcttcattggccacgtaaattaactgcatgtattacatctattgagctctcagagagggtgtcactaaataactgatttcagtttccagaaaactttgacttacttacaccccaagaattttctttttgtttaaatatttcagatgcattcttctctcaaatgtattagatatttgcctttttaaaacgtggattccaaataagattcagtgtttcatcaataaatcagagttccaattatgaacattaataacattctattaaaatagtgataatgtcaaggtttactcttatgtgaaaggctttaacccccacacaatatgtttcccagaaactggtgtctattttgagaagcttttttttcttggtcaactttttatcattttatggtcactatcctaccaatcaggtagtcaagtgtcacttctagtttgtgttaatgttaattttctctgttgtgtcttcctatttttctatatttattttttctattgttctatcttgcttatgttttgttcccaatcagtgtctttggaaactagaaatcatcattgtgaaaattgtatttgtggaattatatttctagaattaatagttaagtaggccctcttataattaaagagcatgagttcaacacatgggaggatttattgtttttgttcattattctaatatctcatgtaaagcatatttatgaggggaaattaactctagatattaacctaaagaaggttacatttgtttctcatataatctaaagatatccattttgctaccgcagagacattttgtcattttccctgttttctataatgatctagggaggtaacatgtctaataactgaattccaaattgagtaataattatacaaaagccaatttagtttagtttggtaatcaaaattaaaagtattaggtggtaaacaataagactataaaagaaaaagtagctgattgtttaaatacatttgcttataagaaaatagaataattttggtccatgagactcacaaacatcagtgacaatgaggcaatatactttttgtgtaaactaattgttggagctatttaaaaagcgcaaaatccatcattgatagaaaatagcagctaagaataaaataacttaaaatcagtttaaataataaattgttgctgcaacttttaatcaattgctcctgaagtctttattaaaatttatgtttcttagaactacctatatttaaaatgtttttgtccatcatctcaggttccacatttgaaagattttctcacatttacactttcatattgtgacttggcttaagaggtaaagttagagatatttcagaaatttgggtttataaattccttaacttgctttctatttcccatgattttagaacagtgtttctcaaactttatggtgactgagaatcccctagaaacttgtttaaaatgtagagttatgggattttttttttcaggaattctgattcagtaggccaaatagggctcagaaatctgaattttaaacaagtatctttgtgattctggttcatgtaaattaatgtcttcagttaatgagctggaagttactgataagtaagaagtgctcatggtaatcaattagagacaatatatcctatataggacattagcccctgtttcactatcaaatccatattcactatttataaagcattcagaaagcattatttatattttattcaaaggaattacaagcactgaaaataatatttaagataataaatatttgaaggggtagacctatagattccccaagtccagattgtataacgaaatctatttttattctgttgcttattcttctgtattgagtaaatgaattgtttttgctgtgaatcaaatcacagaagtcccgtttttcttacatatgtacttaaaatctttctctgcttaactttagagcaaccatctaaacctgaaattgtaagcaaagcactgtttctcgaaacagagcagctaaaaaaggtaagaattgtttttgattaatacctttatttagccagtgttgtaagtgccttcttctgaccttacattccaagacaagtaagaaaggctttgctcttgtggagatgacagtgttgcagctaccaatcagaaattatctacaaggcacagagggtacaacatgctcacagtctcaggtaaccatgaggacatcaaggaaggtggggtcatttctgaaaagaggagtctttctcatttgaattaatggattgtttaatagaaggatgaagccagttagcatgattcatgcctgtaagcccaacagtttgggaggttaaggtgggaggatcacttgagcccaggaatgtacagcatggcaagaccttgtttataaaaaatatttaaaagttagctgggcatagcggtacatgcctgtggtcccagctgcttggtaggctgatgcttggtaaggaggactgcttgagcctaggaggtcaaagctgcagtgagccatgtttgcaccattgcattccattgtggacgacagagccagaccctgtgtagaaaaaatatatagagagaatgatgaaagatgaatagattttcaccaagccaaaggtagaaatggctttccaacaatatgaaataataggatgtgaaagagaacggtgtgtttgggaaacagcaaattttggcattgatgaaactgggtgccaagacagaaaacaagaaaggatagaaagagatgaatctggagaggcaaagaaaagttggatcatgacaaatcttacatactaaatagggagtttggactttattctgttggcaaattatgctactgaaagattgaagtaaagaggtgagatcagattggaacaacacattagcagatatgtgaagggaagctgtattaaagtgggggacaaagttggagttccatattgaataataatgtaactaaaataccaaagttttcctttgttgggagatggaaacccaagtcctacattctttgtgtcatattaaattttactgcataaaattatttgatgaataccaaatattaaagttaaaatacatttaaagaaagtgaggggaattatagagcatgataatgtatatcctcttgaaatatatgtagtatgaaactggagacacagccccattttaacaccaaattattcttccgtatgaagatctatgattcatggtaatagtcagtgttaatagagtaatgttatttggttaatgttaaaaatgaatagtgtcaaaatgaatttggcaatgctttcaaatgaatgtgattttataatagtgacaccatctattgcacatttaaaaatcgtcaaaagtatattttcaaataaattgttaaaaaggtcttaaaaagacattgtttttataccagagagcatgtattcagtctttggtcagtgttggaaaataaacgggtcaagaaacccttggaataactctgcattgcctgagtttctggagtttccaaattgacagcccctgattgaaccaaggtaataacattgcctttttattttgcagttgggtgactgcatttcagaagacagttatccagatggcaatatcacatggtacaggaatggaaaagtgctacatccccttgaaggaggtgggtgtgagggcaggaggacagggagtacattcagaggacctgttctgactttctttgttctaggtattctttaaaccagtggtctccaacctttttggcaccaggaactggtttcatggaagacaatttttctttggatcagggtggggagatggtttcagggtgattcacaggcattaggtttattgtgtactttatttctattattattacatagtgatatataacaaaataattatgcaactcaccataatgtagaatcagtgagagcccagagcttgtttttctggaactagacagtcccatctaggggtgatgggacacagtgacagatcatcaggcatcagattctcataacaagtatgcaacctagatccctcatatgtgcagttcacagcaggatttgcattcctgtaagaacgtaattccacaactgatctgacaggagaaggagctcagtcagtaatgtgagccatggggagtggctgtaaatacaaaagaagcttcttgtggttgcccaccgctcacctcctgctgtttgcacccataccagtcctggaggttggagacccccgctttaaactattcaggatctaaatatgttgccctcttttgagctatgactcttatgctctgttactttaagtatgtactaaattaatacatgattttttaaacatcattttcagcccttgtacagaagaatcaagagcagaggaaataatttctgtatatggcatgatctagaagttaattaagtgagtgggaaaagggattccaggattctatttctgtgtctctgattcacggttttgaaacgacatctaacctcactacatgtcaattttctctcctgctgaatacagttagaaggaaaaaaaacacttctcaaaggtgtggtgctgtttcgttaaggattgtgattgtcagatgaaagaccctatcatcagtgttctttattttcttcagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactgtaagtaattcaatatataattatgctatttaatgtattagaaataatattcaaatgctattaatctttgaggtcccaatccaattactctttgaattctgcttccagtctgcaccccaaattgatggcacccaaataatctcttcctctttaggagaccatagcatgaataaacatttatccatcctataatatctttcactctctacattttatctatgagtgtctcttctgaattccactacacactaagttctttaaagataagatctataacttattttctggatgaatgacagacaaatatagactttaactggctttctaaataagagattaccattttaatgaagaaatttattttaataataagatcaattgcataagtttgataggatgttgtattacaagacattttacttaactaaattgtgtatttgaaacagagtatttgtctacaaaggaatcttcatggtcatctgttctaacttcattattttagttagtaaagtgaggcacagagtcttgccctaaattagctgtagatattagaatagaatctttttctccattgctgtgctttccttgtaagacaggtgccaagataatctaatgattagaagcaaaaattctggaattctagtcccagcattatcaattaccatttcttgaaaagtagcttaattactctacatctcagttttcttactttaaaatgggaaaaatataatacctaactgatagtgttgttatagagagtaagtgaaatcacaaatcaaaaatagcatgctacatcacacattaaattgtcattattaagtactttattattattattatatggtcattatcacaatataaacatagagctgaagatatttggggggaaaatgcaataaaggattttcttcttattattaatttatctaaaatttttgtgatactggcatgtgttctacagtaacctagcacttctacatctattttagagaaaagccaggaatgcctgctgagcctttcgaaagaatcacctcacctacatttctttttttggttccctagggcacaatatcttatatgagaacaaaagtgaaattcttccaaagttgccctaatattaaaaggtagttttgccttaaacttgggaaataagtttcaacttgatttaaacccaagaaattaatatttcattatgtatagcttatctaaaatcaaacttttttaggtgaaggcagaattctttctttcttttttttttttttgtgtgagacatagtctcactctgttgcccaggccagagtgcagtggcgtaatctcagcttactgcaacctccacctcttgaattcaagtgcttctcctgcctcagcctcccaagtagctgggattagaagcgcatgccaccacaccctgctgatttttgtatttttagtagaggtggggttccaccatgttggtcaggttggtctggaactcctgacctcaggtgatctgcccacctcagcctcccaaagtactgggattacaggtgtgagccaccaagcccggcccagaattctttctgttagaaatattcaattggaaataaaccatattagtgtaagtgtaggtgtacaacacaggagagaacatcaagataagtaataagaattgggaaattggcttcagaaagaatagaaatatctgtgagtatgaggcatgcagagttgggtagacggagaagttcttgaatggatacgaagaaaatgattttatcatgctggctgtgtaaggtgcacttgtcatggcttttaagaagccacagtgggcttcatggtgaaaacacgaagcacaaagaagcagtttaagacagtcctcacattcaaggagtgtactactccagtagagaaacaagacacctacatcagaaggaaattgccaatgcaaggttgtaagggtaaaagtcttaggaactcagtattaagagtcttgagggctcaggtgcccaaggacagtggttctcaaactgtagtgtaaatcagaagaacatgaaggacttgttagagcacagattactgcaccctggccttgagtttctgatttagtgggtataggacggtgattgacactctgcatttgtaacaaattccctgatggtgctaatgctgctgatctgaggactacgagtggagaaccactgctctaggaagacttcagagaacagaagaagagtgctaaatggaaaggagagacgagtccatttcaagaaaaaaaaattggccaattcatcttgagaaagcttgagaaaaatgcacctattcaatcagtaacgaggttttagagaatctagctctttaatctttgttttgatctgatttctgccttctgacactgcctacgtttatgccaccattcctcattgcctctattcctgcgatggatttcaaagtagtatttttccaatgaattgcaaaatagtatttctcttgtctgcccaccattctctgttcacccccaaataaactgccctccaaactgctgccagaaatatttttctaaaacacaaatgtgacaaaaacttctcagtgactccccagagctctcagattaatatccttccccctcccccaattgcagtatgccttgagttcgttttagccatggtcctacagtatgtctcaaccctcatcactgcctgtatccactgtggtctgttctactttccagattccttctgtagagtaatacttacatgcctatgcatatgctgtcattttcccacctttatcatttagcaaacacccatttatgtgtcaaaacccagctccagggtcagttcctccaggaagcttcctagtctcatgtaatgatggctaccaggatccctatgcttgtgtcatatgcaggttttatgtggtcatactcttaattattaagtttggtgtctttacaaatagaggaaaagttcattgaggcagggttttcaacttcctaattccagcacttaaggcttgcacaatatagatgccaaacaaatgaataaatgaagaaggactgtaggataaataaatacatgaaaagaaaatttcagcagacagttttggttattttgtaggggtttatgtagcagagtaagagagaagactctcacttgagctgggttcaagccaaattgtggataccaggctaaggaatttttatttttaatcttcatatgttgggaatgtgtaacagattttgagtatcattgtaatattcaaagcgctacttcagaaaacagattcagaggaaatatatatgaaaggatcaaaaggaaggagactcaaggtgaggaaccaagtgaaatttgatggcattgcttcaagtttaggttaattaggacatggactagggaagtgttagtgagaatagaaggggagaatcagacccaaaatatattgtaaagtattaatcatcaagacatggtgactgaatggataagagagggcaaaggagaaagccagggcaatgggcaaaatgatgatttactagtgggcagagtaaaattcaaagtcaggggcaaacgcagagcaagggatccttaactttgaggtaaacacgttagtggacatgcagagagttactgtcaaaacgcaaatgtgttacattaaccctttgatgactctctaatacaaagcggagcctattgaaaagggaacacagagaaggggagttttaaaatagagaaggaagtcagagattgccatccctggctgttctgttgtgtcaaccttgatcagagatgtgccacagtgacatgccacaggccaaacatgagcactagtcagagaagggccaagtaagaaaagcaagagaggcccggaaacggaaggtcagcagggcaccaaaaccagattttatttacttttcaacctcaccggaaactgctggttaggaaactacttcaggcaaatccagaaaaacaaataagaaatgtattaaatcaatcaccgtttaacctcagaatgtactggacaagtattcagagatgcccaagcatagagaaaaggcaaagaaacaatctataacaaacttctaagtttttttatctgcactttatctatagaaaggtaaataaatgaccgcaagagatagaacaaagcctccaaaagtataacttactcatttcacttgttagctaataaaaaaaataggttttcatagataatttttagtgccaccagtttggaaatatatacacatgcctcaataattattaagtcttgtggaaaacattctataaaacatacctttgcattatatgatttcaaaatttattattcattgtattatccagcaacataacaaatggataggttagtggatcatttctaactgccagcaccacttcattttatttcctgtttgctagatatggttcactgtatccagcatttaatttcattagcattctactattgagtgctgaagcataccctttagccctattttctccataaattgaccaaaatggaatgaaagttgcatcttggctccaatgaacaggacaaaattacaatacacttacagtcctgttgattgtgtcaaggttctccctcagttcataggattcatctttttttaagcagatcttctctcctgcatgccaaaatcctcgctggtgttgtttagctcatgtctcctctttttatttcatatgaagtattatcatgcaatatgagtacagtggcatctaatagctttagctatttgctagctgatttttgtccttccaaactataagattcatataatatataattaaatttccctatcataaagccatgcagtttgattgttcctatggtcttttatacataaaataattaccaccattcctacctcagttaaagacattttgctaagaagaaattgatttttatgtaacagggtttctttgtagttggccctaagattagtacttgtatagcaagtagctattagcttcaatccttctataaaaaggtatatttaagcaattaccattactagcttcttgagaaaattatgtataatttagtcatttacattgtatgcacagagtaattcggtacttgacaaaaatggttaacttgtgtctgtaactcttacagatcctacagagcaggtgacaatacaagtgctgccaccaaaaaatgccatcaaagaaggggataacatcactcttaaatgcttagggaatggcaaccctcccccagaggaatttttgttttacttaccagtaagtgcttaagtattacttcagttggatgactatcatttttcctgttgtttgacttctacatggatagattaagtgagaaaaaatgttattgctggagacaagagacgccacctataaaatgtcacgtggaagctttttctgcacctgccactgttcttgccttttttctcaatgctgagagatttcaaggacaaagagaaaaaaaagccaaccacaggaaaccataattgcaaaaacttaaagtttaattatccaaataaactttaagaatctgctcctcagaagcagataactacaaaatgaaaactgatgacagtgaatgaactgatgtggattctaaatctgcccacaacattgccccgaacacacctctaaccctcagaagtagggatagttctgttgcacgttatatttaggataatgctatggctcttttttggtcattatgtataatcttgaaatgccatttcctcaacttttctccatatcatagctgaaggaaatgatatgcatagaggatactttggaaaattcctctcggatgtgctctgcatgtcataaggatctggaagcagacaaggagagagctcgctctgaggatgcctgtttgctctcgcatatctttgtgtttgacatcactttcacattgagggaagccataatgcaactcaatactgcatttactgcagggttgtgcttacaaatttcatctaccacagtactcaatagtatttaagaatgtcattcactacattattcagaagactagtataagtaatttctttatgctgacagaaaactttgtttctcccaatgaattaattgctgtttttgtttcctttgcgaaggaaaatttaaaactaattaggtttctgctttggctatcggggatgacagagccaaatttgtgtctcagttttagcaataatacctgctgaatatctttctttgttaacttatattattcctacatcatctatatttttcctagtcttaatttcttaatttctttttttcttttgtcattttctttttttcttctcctctctctcttcctttcccctttctttctttctcattcttctcatttcatcctttcttcctttttactttccttccttccttctttccttccttttatgttttttcttttaatctggatatatagtgtatttccttttaagctgcctcaaatatttttgtcaaattacataaggcataaatataaaaataaaacattggactttttaaaaatgcccttgaaacttgagcaaaagccatgctgtcaataaaataaaagtcatcaatagaaaataaatcagctctcaaattccttaggtccaaaatattaattatttgcccaggaatcagatattggtaacacaaactgtactctttttgtgtgatcaatgaaacacattcccttttttatcttacttgataaaatgctatcttcatcaagaaatacaactgttctcattgtagcgaccaagtataatcatctgacattttgcctctatcaaaagggacagcccgaaggaataagaagctcaaatacttacacactaacggatgtgaggcgcaatgcaacaggagactacaagtgttccctgatagacaaaaaaagcatgattgcttcaacagccatcacagttcactgtaagtcacctacttcttcatcagcagcttcacctcaaaggcttctaatagcttaatgtagctatcttttcaaataaactgcacgtatatctttcttaaataacttggttgcaatagatgcagtagagagagaaagcatcgggataagctcaactttgtccagatttgtactgcaatattgaaacctttcatggctctgataaccgcaacttttggcagtggtacatctccatcttctttctaagtgtcttcaatttgtggtgtcaatgaacaatattcatatagaccttaaagaaacaactctgtatattttaagaaaacatttccatgttcttgaagtgcaccagctttgcagttgacccagcattatcatttgtgttacagaataaatttaacacccaaactcagacaatacaaagttactacagactcagttttgggaacaggaagtagagatcattagaagttatttattggctgaatgtactctatatagaggggtaggaaatttctggaaacagaacctcttgaaaatcactgtggacataactttttaacttttaatttgcttttgatctccaaatactccaaaaattatatttgcctcggtgtaacagaaaaagacacatgtaaataccagacatttaacttgagttcttcatgacagtccatattattgatgtacctgatgaatcatggaaacagtaaactaattcataccacaccctggtgacactagaattcagagtgctttaagcaaatgtcagtcttgcttagaggtatagtacaaacttcctaataagtcctttgcactcaacagtaccattaataaggtttcctctagacatcatccactacaatcccactgagtataaagagactttagaaattgtcttgagtacatagttctaactctttcatttgactcataatactttaaaaacatgtgggatatgagctaaatttttgagagagatacagggaggtacattggggaataaagcaaccagatggttgcttctgattgtctgatgttgggagtgctcccttgagagccctgtaaaaatagtggactgttatgttcacagctgggccatttctccatttactccttgcttatgttgcttgggtttgaatgtgtctaccatcaggggctagttacagagaaagcagtagcttccagtataacaatattatccagtcctgttccatgaaaataaaataatgaagaaagagaatatagccagcagatagaaccatatgtggaatagctagctgtctattatcattgctcatgatgtctttgggccaataatcaataatctagtgccttagagatggtgtgatgtgcttatttttaagagatgcaaggtacacaggtctctaaaagaaaagggctcttatttactttacttgtagataaggcaggggaggatagatggcagactgacaaagcaaaagacttggttgcagccatatagtgcctacgtgtttggctgtgatgggggaaaattaaacaaaagtgtgtaaaagtttaattggattttagtgcatttaattagatttaaatgcatcttggttttgacaggtagactctaacactgggttttaactctgttgctgactctgttcctcctcaaaagctgaaaaaaagtatttcaagtaaatcaacatctgattctaaattatatggaaacataaaaatcctatttttacccacttatctttgattgcttgcttattttccaaaaacaagatttgtttccttttcaaacatgtctaaaggaagtgtgggtagagaagcgccaacccattcttgcacatgtttgcagaatagactgctcatcaagtctcacagcctacaaattcctagttgctgatgaaagtcactgtttccctgccaatatatgcacacatagagtcttcatcagagctttcaaagtccatcattgtcctgtaaaattgtttatctcctctctggaaaattagctatccagctaacaaaaacttctaactcatccagaataaaattttcatctaaatacaattcacccaaatgttccaaggaaactccacttttctacatgttggtacatggtttcatattaatgagaaattgagaaagcatgctccttcccttcattcattcaatagtaatgtttgagagtctaccatgtctcagccactgtggatatatcagtgacaaaccaagtcacaatcactaccctcatggtgctttcagtctgataggagagacaaactttaaaaatgatgttgcagtcaacaagttgcaattatgacattttaaaccaaggagaaacttggagtgtaatggcaagtcttcatactgtagaacaaagacacaactcctagtgtggcaagcatggtcctcttcagtctggtctcaatgaattgtatgagtttaacttccatgagttgtcaccacttatacccaattactcaccattacaaaatctgccaagctttctcatctcttcacctttgcttatgtgaccaaagttttccttacatcttcccctatcaaagtccttctcaaccatcagaggccacgaacatatagtgttccctttacaaagcctttattactgctttgaaacccagtttggctctgttctctatacttccattaagtcttcatttgtacctctgtttctagcctgcctttcatctttcaacaaatatttagtgaactccaaatcagtgtcaggtttgctactaggtgctgattttatgggctgtgtgttatagtcagcatagtacctctacctcattgacttataaggtcattatttatctctgcatctctcatcagtgcttgggacttagtagctgtacaataaatacttgttcagttgagttggaattttctcatacagatcagactatgacagtaagatttttataaagattgttttccatcaactggatgagaaatggaatagcactttttaaaaatatctgctgctatagtaaattctctctgaagaaacacaactactatctcatggtttttcaatttatcacctgctgtctaaagatgcttgattttccaacatttatgccttactgtctctttatataatatttacctagtcatcatctttattttcttccagaagtgacttaagatttttttttcttaaggtgataggccctaggggaatatttatatcccctcaaaatatcaatcacgttaactgcaaataaatggataatcaattagattgaccactctcttgtctaaactagtctcaaggctggcttgaaaaactaggctaatcatgctatagtccaattattttagtcatataaatcagttctgaatgttcaaatgcagttagaagaaatttattttctttcatcttttcttctccaaaatattttgactatcttacatttcagagttagcactttgaacagattttctgcttcacagatttggatttgtccttaaacccaagtggagaagtgactagacagattggtgatgccctacccgtgtcatgcacaatatctgctagcaggaatgcaactgtggtatggatgaaagtaagtaatatttttggtactaccctgctgtttggtttgatttctttttaggtttcttatgcactttatattgtattcaagtaggtatattcatggatgtgtttatataccagctctctctctctctctgtttctgataagagaaataaaataacaataaaattttagaggtgctcaacacggtgacatccataattggtattctgaaacttagtttggggtgttatgtcaattatgtgtatatactaattatacacacaccacacgcatgtgtgcacatacaaacatagttatataccacagggcttaataatttacagtgtgtttttgcccacattatccttacgtgatatttacaacaaccctgtgaaatacaaagattattattttccccacattcttcatataaagaaattgaagggaaataaatcagaaagctcataactgacagagtagagactcaaggccagaccttactgagtatgaatactatgctttgataagacaccttttgtctctctgctgctgagaccactcttaagtttctgaaaacaggttccactggatcaagggctcctagaaagcaatcccttttatccctgagctatagtagaatacctggaacatagtaggagttaattcagtattccctgaacaagtgcttatactcttgtaattgtctgaaatgtaggccattggctatccttttagagtaaggaagtgtgactgataattggtgatttgagacaaggttatcaccaaaggaaaaggttgtgattgcgatccctccacttaaacccttggctagtatatccaaactcccagtgcatttgttaccagagcatgacatgtgacaagaacccttaacccatgatgggttcagaaaacacacataccatttgaaataggagttgacaagaattacctttataagaaactgtggagaaatatttttctagagtttctttttgatggaaatatattgatgaaattattttgtattgctttactgcctgccttttgatcctttttaacactcgatcctctgctacttgttgtcttactctgtgagctcagtttcttattgtactctctttcagccacagcctcatcacaacttgttcactaaaataaagtgccacttcctatgctgcaatctagcatgatatgtttgtagtaatcagtgatcacaaggctagacaagttctaggcaactagactaattcataatcatttgaacactcattgcatgttttactataggactagagaaactaagtttactgtggtttaaactgtttgtacaatcaactgcaatcactgttatgaattaactgtcatgaacagctcatgtattcaaaatagtgatgatcagtattccctgattattggttagttaatggggagtgggaaaaaatatcctaatggtcaaagaccacataatcttaggattgtgtctagttgcctgcttaggagcatttcaattcctgacataataggattattttctgtatatcaggctattttttaaaattaaatgatacatttcctttgttcatagaaattggaatagaacgctttccaaattataaattcagtaaatgaaagagcgtgaaataaaaatctgacatgtctgactctaaaacaacaaaagaaaaaggaaatctattttgaaagcatctgaagttaagaaaaagaagtttgcatttatattattcccagaagaattgttttaggcttaattattatctaataaatacactgagaattttaattctgccacatgaggtaatttactttttatttaatcaggataacatcaggcttcgatctagcccgtcattttctagtcttcattatcaggatgctggaaactatgtctgcgaaactgctctgcaggaggttgaaggactaaagaaaagagagtcattgactctcattgtagaaggtaataaaatacttgggcactaattcaaattgttctttgagaattttttacctggtttcttttatgatctcagttcaacatcttattttaattgtaatatttcaggcaaacctcaaataaaaatgacaaagaaaactgatcccagtggactatctaaaacaataatctgccatgtggaaggttttccaaagccagccattcaatggacaattactggcagtggaagcgtcataaaccaagcaagtatttgtcttcttgttatatgctgcacttcgtccaatgcgttttttttccttcacgaacctaccctataggttggtttgttaccacataaaatttgcagtgtgtaggttggtttgttaccacatagaatttgcagtacatgctcagaggaagcttttgctaacttcttaattttcctagaggaagaacatggctcaaagagaaattttatcccagggccatggagaagggaagaaccattgtgtcatggtcagtatctgtttttaaaagaatataaattaggtattacttcatgatcattcattcctaaaatgtgagtgattaaaacattaagatatacactttcctgcaaaataagctcatgcatctcagtataagtgaactctaatactgtgctcaacttatgcacattaaggggtgttacttcttaaaactatgtcctcgtgtaggaatggtggagaagaacacagttactgcttatgaatgtgtggtctgacatgcctatgcagtgctagggccagaataaggcaagctacatatatagtgcctaggatgtgcccttctgaacaaaagggtcataaaccagaccttaatatttgtacctttttattttagtaatagtaaagggttaaggatttgttaacactacctgttattttcttttactattaagtctttgaccctccccttaaaggaaaaatgagaatctggcctaccactagggattcagaactgtaatcccagtaatttgccaatctgcttgggttgctgacatacttgctaattccattgttctctacaacagtcttcgtgtctccctcttctcagtataatctgtaaaggcttctcaggagcacccagaggtaccactggattatttaaatcttctgtacttctcagattttgacccagttgaaatttgagaagacatatataaagcaaagagctgtaaattaattttaagttaaaatctccactcttcctctttctagggaagttgggccactgtcccagcttacgccatgcagttttgcagtgcaaagtggattttggctctttcaactataggtgatgcatatatagctgcataactctagatatggaaagccctcaaaagagtaggcacacttgaagtgaatgactcctgatttggttaagtgtgatggggaaacacagtaagaaagcatataagaggaggcaaagaagctctgggctcctcaaacctaggaaaatgcagttttcttgatttggaataaagacttgaaccatctaaattgctgacaatgtgcagatctatttttagcatcaaaaatggtggtttcttttctactctattgtttttgctctctagttcaattaagtgataactgcagcaaaaaagaacctttaggtactggtaatacagacatagaaaacagaaacataagcagacagtaagtttttgattaatgaaaagatatgaagatttaaaagaccatcctagaaatgagaaaatatattttgtagagtttaaagtaacaaaaacaaagattccgtgagaaagtcagatgaaaaatcctagtacgaagtgaaaaaatagcaggtaaatttactgtgaggataaaaataataatgccatctttcattgtcaaggagaaagattgattctggcccactgggtgatatgttatttttcttgttctgggatttgtgctgatgcatccataatcacaattttatttgttcccttctcagatacatggtgaatctgttattttacaactagaagatgtctctgcccctcctccaccccagcaactagaagataaccaaaacaggagaatagctcttgtcctcaaggcacttaccatgtagttgaggagaaagcaaacaatatagaaagagaaaaatgtagggaatgagttcataagatgaccgagaaaagagtgcaagtacattatttgcctcaaccttgttgggtttaggagtcaaatcctagggatgagattaaagtaaattgtattttatatttgaaggaattaaatgcagtgattaccctcattaacacctcacaaacatcagagggacagcaatcactgaaaaatcatccatcctctgtatttacaacagaaaactttagaaaaaaatggtttcatgtacccatgagcaaattatacatacatacatactttgatataatggtttaagataaaggaattaattcccacagtgaagaacagtgactaaatttataaataattaaattcatatatttattggtggaaagttggtgtttaaatagtcaccaattaattattttgaaacaagtatcatcaggccaaaatgttgactaaacctgagattctatttaaaaagaagagtttaattaacttaattattagaattcacaaaagaaacataaacagaaatttcattatggatttactaatctttgtagatattggcatacatgggtcttgatctatgatcttacatagcttttgaacaccagaatgctctatagagcaccacgcctatcctattacagtcatcattactctttcctatgctttttaatccattttgatttctaaacccaccttttttcttctttttccagacagaggaatctccttatattaatggcaggtattatagtaaaattatcatttcccctgaagagaatgttacattaacttgcacagcagaaaaccaactggagagaacagtaaactccttgaatgtctctgctagtgagtattttatttctggcattacaaaagtaagaaaatttgaagttattcttcattagtttaaaatcttcaattccatcttcctgtactgcattatggtaagttttatttatttattttgcatttggtatcatcatcataaggttattttttcttttttcctgtccattcttgtactatccttgtcttgacagttaaatcatttcatgttttatgggtcagaggccttatcctgtacaggaatagttcccaaaagcaacagagaataaaaaataagtttctcttatttaattcatgttttatgttcagagtggagataattcaaagatcatcttaaaacatttttgtaacagttttaaatttggtaaatttgtaattccctttgatctattattttgccttctaattctttgtggtatttatcctacccttatgttgtactagaatgccacaagcttaaagtcatttagtaaactagcaagagtgattttagaattcatgaatctagtttacaaaactgttccttttgtcatatcatatttaaactatagccgaaaatcagataagtgaaactatctcagagaatgtggaaaaatctgtcgatgttgaaatcagggtaatacatacataccaacaacagcttcttcagaaaacaattgtcatttaatgtgaaattgtccataatcttcaattctatagttgttcctattgttttgtcaaccttaaatcaggactggcctagaatgaggctcagttctggacaggatgctaactgacctgccaaacttttattcttcattcagttggaaacctgtatatgacattagcaggctaggactacactagctgggaattagcaagagctaggagaaaataatcatcaaaaaataatggtccctcacagattatgactggaatataaaggcctaatggattgacaggataaaagaaccaaacaaatttaactctaagatagaagcattgacttctcagaatgcaattcagtgagtattgatttgtcccacctaggaagagaacctaccctttcttcctgaacacaagtttctctttttatgttaacccattgaatggtatgcttcagttttctaggccttgcagtgactttatcaacatttaatatagtcgttttcaaattcagtgagcacctcctgagatgccaatttagcatgtatgaggagaggtccgggaatctgcattttatcaaatgtcactggcagttccgatgcatgcccatgcactttgaagtttatttatagagtttaatattagataataattcaacacagtggtaattcttaaaatggacaaagagcatggcattatcagagtcatttggagagctttgcaaacatcatgtatgttgcttcttaatctcggaggtatccccagttttaacctctactcctactactttgagaacatctctagtggtaagtccttgacactggaggatgacaatgaattctcctatatcgggcaggaaagttgagaaaagttgataaacatcacactgtagacttcctaggtgccgacttgcttccctaaaaaaagaatgactattaaaaggtggtggatagtgggaaaatcaatatggatttcagattaattctataggtcatcagttatgaaattttctatggtagattaatatctttgcagttgtagctcctctccttaaaacaagattaatttctttgtaggcaaggtcatactttattaagtgtgattttttttttttttactgttagctatagaatagacattttatctttgagtattattacatcatactataatggtaaaggtgactttcatatatcaacaaattttgtttttaatttcatattaacatttttcatttcagtaagtattccagaacacgatgaggcagacgagataagtggtaggtactatgctgccgactcttcttccttgactatcagctcaagatttatgaagtgtcatggtataagtaattttcttagctgtccacaattttgacttgaattaaaataccaaagacaagatagtaagaatgctaaaattttaccctttaaaaatcacaagtttgcatgttaattactgtagtgagctttagtcatttttaatacaaagtaatagctagattgactttctgaaaatccttggcattgtctgtaattgcatggacttttcttctttgttgcagatgaaaacagagaaaaggtgaatgaccaggcaaaactaattgtgggaatcgttgttggtctcctccttgctgcccttgttgctggtgtcgtctactggctgtacatgaagaagtcaaagtgagttgtggaaaaaagatcttcatcgttcattgactttcactgggagaaaatacaatgtgctaattttgctcactccagtcgtgcatataatttatacaataaggaagatgtatccccaaatcaggttgattatatattttgtttcaactaattttgactacactgcctttgtcagggacatggcttgggatactgtttcacatgtgtccgtttatttgtctcaatcaatagcctgaattcaattatttgattttttcagtgcttgagtgaattttttaaagcgtatacttcctaaaggtcaacaaccatagactttttggttgaagttggagaagattcattaaaagtacctagtacatcttgtagggactgccaggtgtctttgcagtgacacatctggccagcaatgaaactgctgctgaggtaggaatatcttattgttattactcccatattctagttagttgactttgatccatataagagtctatatcagagaaaatcatgtcattatgtcaacttgagtttttaaaaatggattaaagtaccaacactacattaaaaatgctttagagatgttaaacattattagttatatgatattacagatagtatgaaccttacaaattatctaacagtggtttataaggaaaatccgatgaaccagcgaagattcttaacatacacacatgtcttatacttctcatcatctcactcccaaccctagattcagataccattgataggggtggggttccagcatctgcacttttaaaaagtttcactggtgattctgcggcatgctgctagtttcaaacatgggttttaaaccaccttatcttataaatgtgtaaattaagttttgcaatgggatgtctatagctagtggaactttggacttaattttatattatgtctgatatgtcccctttaaaaaacgtaagaaagttgacttaaaagagaatcaaaagaaaaatcagatttaaatcaggacccatgatctcaccttgtaaagatgccagttccaatgaagcaatattcaaatggagctgccatccaagggaggcagaagctctgaaattttgaagtcacatagcagcatgagcatgtattgagctcatgttctcacaacacatctataaagtacacaccattattattcatattttacattttaaaaatctgaggcagagaatggttaaatgacttgcctaaggttacatagtttgtagggcacagaattgttatttgatttaaggcagtgatgttttagaatctttgtgttgaaggagtagaccatactttctctcacttgctttattttgtgccacattaggcagaaacatttctcctgttgtgtgttgtcactgatgcacacgatgtccactctcacatgatggcacaactgctcctcatcttggcctttctctccttagtcttaagcagcccacaccaatacttggtatacgagtcaggattctccagagaatcaaaccagtagagggtgtgtgtgtgtgtgtacaaagaaagttttattataagaaattgactgacatgattacggaggctgagaagtaccaaaatctgcaggcaggaagctggagacacagtagagttaatgtgtagttccaggctatgtccaaaagcctgagaaccaggaaggtgtaagttccagtctgaaacccacatgggctaaaacccaggaagaactaatgtttcagtcccagactggaagcaagaaaaaatgtcccagttcaagtggtcaagtaagaagttccctcttactaagccttttttgttccattcatatcttcactgattaaatgaggcccacccacatagaggagggcaatctgctttacttagcctactgattcggttcaaatattaatctcacccagagataccctcacagacacagccagaataatgtttgaccaaatgtctgtgtaccacatgacccagtcaagttgacacataaaattaaccaccacaacttggtaaccaatatgttctttttctcaatgaacattttacctataaacacttcacatgggtttgtgtccatggcatctatagaaaattcggaagacctgtgctatgtaagtgaaaggaaaagcaaacagttgcccagaggcaacatccattttatagaagttctccttctgtgtgtacaggtttcctgatattcaaatcttatcctccctttataatccatgataatttactcacaaatccaacagcttgcgttctagggtattttcattttattatgacttctgaatactccacagtaattttacttcttaaaacaatgaaaataaaatttccctgtaccttgaaaattagctggaaaaaaaaactataattctttacattagggtcaaataaatgttaaattcttggagcacccccaacatccagtatctcatcagacaccatttgtccctctatgaataaaataaatttgtgtgtgtgtatgtgttctttcctttgtttcttcatgtggtaaccccaaattaaaatgatggataaatatatgctggacactgacttcatggtgtctttaggtgagagcctcaagcatttcctttaaaatatttcattaaattaagctcaacttctaccacctgatctgaacattcatctaaataactgttacctaatcgaaaagttcaccaactctgacagagttgatattattggtaatcaaagtaataaattgcaattctcatctgaagcatcaaggctttttattaagaatttgtggaatacttcagatttgctgagtgctttgcattcctggttagttattccttgcttgtgccttctgaaataagcaggcatttttggaatatgaattagtcttcttaacccttcaagctgctcatgcagagtaagttcagattcataataagatctttcaagttaagaatgtctaacgccatttttgtgatacagctagcaaagcagtgaaattttagcaacatttagctaagttctttgcattgataattttaaaagtcattggagaaagataagagaaacaatcttttatttctagtaaaatttaagagtacatttgctaatatacctagtggctatttagccagcattcactccttattccactaatagaagctaaatatttttattataattttcaaaaatggaaaactggagcaagaaagacttggcaattgtgttcttttcccattgtgaaatgacatattcatttaggagtaaggactcatgacttttttgctgctttaatccatataacttcccaatggaagttttttgttaaaaaaaactgaaggtgctttgatgacgagaatagatgactctgatttttttccatgtatgtagggtattaactatcagagtcaggaaaaggcattaattagtccaccctatatctagttgtttaacaggtagaaaagcattgaagaactagagatatttcagtggttaccttctactatgttttccatttctctcatccctgtcctccaaacatggtttttagttctacaggaagttaaatgttactatttaagattcattcctatcttgcatatctcatagtacaagaactaatgaaaaattaaaagagctgaagttaaaggaaaaatgtaaaggcagagtgatgtagccacaaacttcttcacaagtatattaggaccataatttcaaggttggttgtatttaagagactctgacctccataattcctataactaaactggaagcaagtgttaaccaaacatctgtaatctcaaaatagtcattgtgtaaatcttggaaacttactgagagatttaccttttgcagctatggaactcaagactattttcatgaaaattagtgtgtaatatagaaataatccgaaaatctaaaagtcagaaataccctttgttagttctgccttatacgatgctttattattccagtactttcttggaagaaaacagagacaatcctaaattggctgaagggctaaagaggacttgcctacaacactgaaacctcaataaacaatgttatgttaacattgttaaaattaacaatgttaattaagcctttctagaatccttcctgttggtgtctcttaatatatggaacacgatcttgcaaaaaagttgattttaactgaattctatttcccagtcaatactcagctaaaagcaaatatatgttctcagaagagggactcctcactgaataaattgaaaagatagtgctggaggaccacttaaagcacattttaagtgacttttctcatttatcactgcatgagaacctaccgtttttctctttttttggttattttttactgaaatcctcaacaatttaatgaggtacatacaattaaccccattttgtagtatctaagtctcagtgggagtaacctgctcaagatatcataagtagtatcttgttccaaattccatatagtattttcaaatctattttgctgccttaccaggccttttttggaattaaaattttagctctgactttgattggctactggcatttaattggtactatggaggaaagggtatgatcttaagggcaggctgacacagcctctctctccacttgtatgagaagtcagactaattcaaacgttgacttctctcttttctctacccatgacctagcaggctgccagaaggaagaaaagaaaatacctcactatcttatcaaaccataaataatagaggggacttgatgggaaataaaacaatgtggaaatgccagagtctccatctagtcaatcacagggtcaccggccactcagagggcagcaccatccatggccctctcctcttctgctgcatgtgacctgaaagtttccacaaggaagaaagggcttgcatcaaaatataatgtgttcatatttcaaaatcccctctctatatattcgtttcatttttttaaaaaagatcacacttgttttaaatatattttccaaaggctaaggaacaaaaaagtcccattctctggcatgagccaggctgtatgtgtcccatcatctaccctaaagaaacattttgagctgtgatgctgagtgcatgcaggtggcttcctgttttcatgcacattcagtacagttgtgttttttctgatccctcagccttttacctaatggttgtcgtattcactattgacctagatggaaaagccattttctgttttcactgaggacacacgcattccctatttctttgtagagtcttagaaattctaaagacataaaattttcatgaggaatttctttgtagagtcttagaaattctaaggttataaaattgtaagttgtagtaataagaccaactatttattcttctctatttccttcttcaatcaagaaattgctcataactctcagtggggattagtgtcctgctgtcctcctctagtttttcattaaacttggcccaaggggagactccttctactgagctgtgaccaaagaaggggaaaaaataaccatactcctgggcatgaccctaactacctgcacaggtgtcaatggccggtttgctggaagtggtaactctacactgccaagatgccagtcctaaataccaacagctgtggtaccttctgtggtgtgaggcagggatgctcacggaaaacactcctctaactagcaagaaataaggatgcctcacacccgctctaagagaattttcaatttgttatacaaactgaaagcctgcttggaaaacctaaaatctcatgtactcctttatgtgtgaaatattttaagtgagtattgctttggttttctaaatataaaattctattatagtattttattggacttttccaaatgataccagccagattgtgatttactggctgcacctaccactgtcatccccttcacttgtcctgcctcctccatcctctcactatgctattgttcagttaaaggcatacttacgggatacccccaaagcagtcccctaccccttttgagatttcaaaacaagtgtagaatattgggaaaatctcaccaaaaaaggtcttaaatcttctgaaaagttatttgaaagtaactttagccctttaaacgcactgcgcttaagggaaattacacagaatgaggagttgagacttagatttaaactctcttctgctgctcttggccatcaagctccctgactcaccttcaatttggtgagtccctgcatgtaacctgccagctgctttcacatacactatcacatttatcctcacaccagctctacgaggaaatcctgttgtttcccctatttatagatgaacaagcatgcttaagaggaggggttgtctaagatcttggagctcagaattaatacatgaggataaaaacccaggcttgcagaccccaaggccaagacccctctctgccttgcagcttagactagagggtcacctttagcacttcttcccacggtaacttactatgatcctgtaatttaaattttctctcatttaaggttattaaaaagaggcaccgatgaggaaaatttaaaataaataaccatcataatttatattttataaattgtaaaataaatgtatatatattatatatacatgtatacttatataatatatacatatattacatatatacatgtatacatgtgtacgtataacatatatatacatatttatatatacatatacacatatataatatatacatatattatatatatacacatatatgtaatatatatgctattataacaaaataccataaacggggtggctttaaaaaaaaacaaaacaaatttattttccacagttctggagactgggaatttcaagatcaaggcaccagcagatctagtgtctggtaaggacccactttctagttcatagaggtgccttcttgctgtaacttcacatgatggcaggaggcaagagagctctccaaagtcccttttaggagggcactaatctcatttgtaagggctccacctttacaatttaatcatgtgatggtcatatcatctatttcagggggacacaaacattcagtatatagcagtgactactactcccttcaagataaagagcattacatcacccccagaaagttcccttagacttcttttttgtccagccccatcatccctgtctccttaggaaaccactggctaattgttatgaccagagattgtttgcctaatcttgaacttcatacaaatagaattatagaaaaggtactcttttataatgggcttcttccccttaacatgtttttgagatttattcatgttgttacacctatgagtggcttctttttttatattgctgatagtgtttaatcattagaatatgccatatctttaaaatccattctcttcttggacatttggatactttccagtttgggctactgcaaatagtatggctaaaataaacatttttatacaagtggtttttgcagacatatgtttctattctcttgggtaaaaacctaggagtggaattgcttgatcttccagcagacatttgtttatgggaaataaacaaatagtcatcctgcttacaactcccaccagtcgcatatgagagttttagttccttcccatccttgcctaaatctggtgttattctgttgaattttagccattctaggaggtgtgaattaataactagttttggttttaacttatatttccttgagatctaataattttaagctccataaatgtataggctatcttatatcttcctttgtgaagcgactattcaaatcttgtgcctatgatttttattggtatttgtctttctgtaattgatttgtaagagttcttaacatattttgcattaaaatcctttgacatatatagatatatttgaacattttttcccagtctgtagcctggttttcctgttcttaatgctgtcttttgataagcagaaattattccttttgatgaagaacagctatcaatttttcctattatgttcgtgctttttgtgtctactatatgaaatctttgcttatcccaaaatggcaaaggtattttcctatgttatctcctagaaacttctaaactttgacattgaagggtatgatctatctaaaatttcgtgtctagtgtgagataaaggtgggattttgtttggtttttgggtttgctgtatctatttatcaagccattccagcacttgttaaaaggacttcctttcagccgtaacacatttgtcaaaacttaatttaccataatagtatgagactttcaactgtgataatcttctggttgtttcagaggtcttatttctttgcatgttcatataaattttagcaacttgctaatttctgtgccacaaaaagttttgtggaattagcgttgcttttaatgtacaaatgaatttgggtagatttgacaacttactaatatttggtcttcaaatccatgatcatatatctcctcatttacttggctcttttcaatttttttctgagtaatatttcaaattttaaatgtagacatttgatatgtccttaaaagtttattcctgtatgtttatacattttgcagctattataaatacaattaattttgtaatgtttccaattgttcctagtagtatgtgaaagtgtgattaatttttcatgttgaaatgtatactgacatcttactaaattaccttgttagtagttatattcgttgttttgtggattcctatgtaaacaatgattgcatctgcaaatggagataattttactccttcccttctactctatatgccatatatttcttttgcttgcttttttggcactcataggcacctccaatacacggctgaatagaaatgttcagaatggacacctttgcatgtttccagtcttagaggggaaattgctcaatagttaccattatgtacgatgttagctgtatgtccctacccagagttagtcaaactgcagagttaagggtataatcctccagattacctagtctgcccaagaattctgactccacctgcaaggagttagggtccgaccacaaagtaagagggaagagtacactcaagatcacccttacttctgacaccaaatgcaagttttggtgtttcccaaaagaatcctcaggtttgataattcactggaaagattcacagaacttactaaaatttttatattcctgattatatttattacaagaaaatgttacattaaaaatcagccaagggaaaaacaaatagggcagagtctaagaggattccaaatgcgaagtttccattgtcctcaggaatacattattctaccagcatcgatgtgtaacaaaagcatggagtatggccaacctgaaaggctcacccaaactttagtgtctacagttttcactaggcattatgacataggcatgattaattggttgaacttaacctccagcctgtctcctcctcaggtcaggctgatatcacatagctcaaagttccctccctaaactatgattggtctttctagtgtcattataccccaccctaagactgactagtgtagaaggccctgccctgagacatctcattagcataagctatcaggtgtaatttaagggagcagcatagataagaaaacctgtgtaactcataaaattccaactgtttagatgttgcctcccagaaactgaaaacaaaggtcagatatctctttggatgaagcaaattctttactacaaagtatcctttatcaggttgaataacttttttactattcctagattaccagtagtttttatcacaaattgttggattttctcaaatgttcttctatatctattaaaataatcatattgtttactctgttaatatagtaaattacattcattgattgttgaatggtaagccagtcttgcattcttgaaatacatcttagtctattatgatgtatcataatttttatatattgatggatactatttactgacattttattaacaattcttttgtctatgttcatgaggaatattggtctgtaattttgttttcttataacattcccatcaagttttggtactagaataatgtggatcttataaaatggatcaataaaagggccccatcctcttctttttccaagtttgttaattcgttaaatatttgatagaattcaataatgaaactaactggaccttgagttttctttatgagaacttgcttcaaaacaaaatgtaaatttttaaattaattaattcattttttttctgtttaagacagagtttcactcttgttgcccaggctggagcgcaatgtcacgatctcagctcactgcaacctccgcctcccaggttcaaatgattttcctgtctcagcctcctgagtagctgggattacaggcatgcgccaccacgcctggctaatttttgtatttttagtagagacggggtttctccatgttggtcaggcttgtctcaaacttccaacctcaggtgatccgccctccttggcctcctaaagtgctgggattacaggcatgagtcacagcacccagccaaatttcaatttatagatacagggttgattctttttgaataaattttggcaggttgctcaataatttatccatttcatttaaattattgacatttttgaaaaaaaaaaaaaagccggtagaattttttatcccttttatgcctatgggttctatagtgataacccttttttgttatctgatattgctaatttattttttcttttatctttcttagtctttatagggtgttatcaattttcaaaatgacctcaaataactttttgctttttttatctctattgcttattttttatgattttgctcttatcattactacttttttctttacatttccactttttctcctttctctgatttcttgaaataaaaattttgattcttagtattagactttcttcttttataagacaagcattgaaattataaattcctctcagcactgttacctgtgttccacaaatatcggtatgttgtgttttcttattcattcagtgaatgtttccctgtggtttcttccttgaagtcaagtgactagacctgtatgaaattccaagcatttctttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggactacaggcgtgagccaccgcgcccggcccatttcttatttaattcttttttgtcaacacaacctactacataatcttttagtctttgaagtacattgagatttattttttggcctagcatgcagtttttccttgtgaatactccacggacatttgaaaaaaaaaaacttgttgggggcttatgggtgtagtgttgtataattgtcatttaggattaggttaaggtgaatcatagtttgtttaaatattcttacccttacttacttcttttaaattatacaaaatcacttcacatgtaatgtaagaaggtaacaagcatacacttctatttccctttcaggtattttgtgccattgttgttatttatcttctaagtactaagcctcacaacacactgtcattattttatgctctgcagtctattatctgttttaaaaattaaaaattatgagaaaactttcttttgtatctacttatttactccttccagcactcttcttatttttagtggatctgaacctttgtctatcactttcattctgaaaaacctcctttgacattactgggagtgcatgtctaccgccagtaaattctgagttttcatttttatgataatgttcttatttcatttttaattttgtttgctaatttcatgggtacagatttctaggttgatacttcttagaatattgagtaccttaaagatgtgccattgctttctggcttgtattgtttttaatgaggagtagttggactttggccaggtgtggtaatgcaaacctgtagtcctagctacacaaggagatcagccaggtgggtggctcacacttgtaatcccaccacttcgggaggccgaggcaggcagattgcttgatgccaggagtttgaaatcagcctggccaacgtggcaaaaccctgtccctactaaaaatacaaaaattagccaggcatagtgccacacgcttgtgatcccagctatgcaggaggctgagaacctgggagacagaggttgcagtgagccaagattacaccactgcactccagcccgggcaacagagcaagactctgtctggaaagaaaaaaaaacagaggctaaggtgggatgatcgcttgagtccaggagtccaaggctgcaatgagctataattgtaccactgaactccagcctgggcaacagagcaagaccccatctctggagaaaaaagaagtaattggatattatttttcactgcttttgaaaatttggaaaaaatttcagcaatttttttacatatatgtttaccctcctttcttcataagactcctggtatacatatattagactgcttgaaattgtcccacagatcctgtctcaatttttattgcctttactgttttgaaaagattcatgttgcataatttctatgtctataacttaattgtcactgattttatttcagttgcaatatctgatcttccagtaaccccatacatgaaattatcatttctgatctgtgtttctcagtcctaaatattcaactttattttcagtcttctctttctattattattatactaatgttttcctctaaattcttataaacttctgtaattcctattttacaatccttgcctactaatttaattatttgtagggttttattaattcattttttctcccaattataggtcacattgctctatttctttgcatgtttagtaatttttgtttggatgttggaaatttggatgttatattgttttgaattttgtttgacaggtagccaagttacttatggatcagcttaactttttttggagcttggttttaaactagattatgatggatgtatccaaattagtacttgaagaaggaatcaaaggaatgcttatgtaaatttctcatgcgcttttctttgcataactctacctctttcctgcaattttcatcatctccttccagccaagtatgatttctgccttctcaactcagtgaaaactcttttctgcttgggtccttatttttggcaccaccagaaaatacttccaggcacaaagcctggattgtcatcaagtgcaactagtggcttttcccttagaaatcacacagatcagagtactttgctacctgttgtccaatgacagaaaatacttgttcttttattctttttcttaaaaatacatgtttatggcaagagagctagcccagtgaagcaactggaacatatgtggattttggtattcaagagaggtcctggaaccagtccactgctgataccaagggacaactgtactatttacttcatcaggatcatacatattaaatgttggtacaattgtcttaccaattattgagaaagtgatatcgaatcattcaataaagattgtacatttatttatttctcccttcagttctgtcagtttttactttatacttttattaggtgcatatacttacaattgttataacttccttatatatgaaacctttgtaattacaaaatatctctcattatctctgataattatcaattatatgtaagaccacctccctatctgttttctaggaatcttctgtccttccatcctgccttcttttgaattacttaattaagttttagtattacattttaatacctctactggccttttaactatacctctttgtgttcgtttactgtggttgctataaggattacaataagaactcaaaacaatctactcatgttaaaaatctaagatttttgaagcataatcccatttaacttcctctatctttgttgctattattgtcacatctgttttatctgcatatattataaagatcaactgtgttttacatatatatgcatataaagcatatatattaaactgttagttgtcttttaaaatattttacatatctacaatctgtatttttttattctttcttacgtatctgaattcccatctggtgttacttcccttcgaagaacttcctttaatgcttcctttaggaaaggtctgctggtgatacttttttctactttcttttcatttaatttaatatgtctttcttttgcctttaagtgaaggatcttttcactgatataaaattttgggtttaaaacttttcctttcagcattttaaagatgtttaattatctctggtgtgcactttttttctgatgagacatcacctgttatttatgttattgttctcctgaacaaattttctgtggcactttcaaacatttctttttatatttgcttttggttagtatgtctatgattaacttgagtgtgtttttccttttgcatttcctccttccggacttctgagcattttggatcttcaagttaatgggcttcatcaaacctgggaaattttctcattgtttctttaaatatagttttgcctcattctctttctcttctgtttgacttcaaatacatgtatgtcagcatatgttagcctgctcactatcatctcacaggccactgaagatctgctcactttttttttttccactgccctggactccaccatctcctcacttttttactgttttctttctctctgttttccagaatctgtgacttacaattttgttcctaggttcactaatgctttcttgtgccacctctaatctgatgttaagagcatttagtgaattgttcaatatcaatattctagttttcagtcatagaattatttttgttcacattttttgctgctgatatttccatctgctctctcattgttaccaaattttcctttaagccattaagtgagtattatataattgacttaaaattcttgcctgctgattccaaaatctgtaaatctgcatcacctaaggacattccctggactttgtgttacatttttctattcagtgtatgtattgtaacttttttactatataatggattttgtgggtgatatgttttagattataatttctgttatatttttctaaaggatatgagttgcttttcctagcagacaattagattactggctaattactctactgtcaccttgcgcttgtgatggttaattttacggtttgtattccatgtctgtcttaggatgaatgtctagttcttttattttattttttttattattttattttatttatttatttttttttttgagatggagtcttgctctgtcacctaggctggagtgcaatggtacaatatctcggctcactgcaacctctgcctcctgggttcaagcgattctcctgcttcagcctcccaagtagctgggattacaggcacacgctaccatgcccagctaatttttgtatttttagtagggacaaaaattttagacaaaaaacttttagtaggggttttaccatgttggccaggctggtctcgaactcctgacctcaagtgatccacccacctttgcctcccaaagtgttgggattacaggtgtgagccactgagcccagcctgtgtctagttctgacacatagtctttcttgttttttctggggtttcagtaccaagactgatgtgtttgctaagcacttctggcttggtgaagttcaactccaaactgtgtgggtagtacctaaaaatctatcaggcttctaagccttctggtattgctttccactaagctctttgaaatttctcccacatatgctattcagggggtcatccaaggagcttatcatagtgtatacgcaaatttggaattcttgccaccctgtggctgtctcctttctaagatttttcttccttgatttccagcttttggtctacttagaccatgcctcccaagctgagaagtgccctcagaggaaaagccatgtaaaattttctttcaatttctactttatttttgtcactctcaaatacattcacatacttcattctgtacttttctgagggtttataattgttataaatataagagttaacaaagtacacttggtgttttgtttttttttcagtgttactcaaaacagaactccttgtagtccatgctttattttaaggttgtgaaatcatttgcacactcaatgagaatatggctttattcttaccatacaggtcaaggcagattaaaaaacttaaaattgcaatttatattatagtagtcactgtcctgatgtattacattgttgttttttttttaattttattttttaggatttaccaactgaatgttgacttctttatgtatcactctctagttgctccaaacaagttatgattcttactttagatgaaaggagtggcagttaatgaagtgagtttaaaagaaaacagacaaaaagagaaagcaaaaggagaagtagaaagaaaaagaaaggaggaatggaatggagaaaaaaattagaggactgagagaagacaaggggaagaaaaaagagaggagagaagagattttggggattatgtggcttttttaaattgccacaatatcttactgatttatagaaattatagttattaggatatatagttagtagctattagaataatcaaagacctgtttatgaatataattttgtgcagaactatctggaaaggttggattaagaatcactcaagttctgtcatttcaatgtagtattttgtcaacttgcttataaaaaaaagcagctgggtatgtatggacttcatattggtgaacactaatatattaaggaacagtggaaggaaatagacataaaggatcatgtcagttcaacttagtagaataatgatcttttggatgcctaccatgttctagtcactgtattatgtgctatggataaaatataaataaaacatggctattattctcaaagagtttgtggtcaagtcaaggaaactaaagagatgtctcacatctcagtgtttccttggggcagatggatggagaaatgagctaagagcttgaagggaaaagctggatttcattgcattttttgagctaaagaaagggatactttctaggatgtcaattagaagcctgaaagaaccatgccttaggaataggagcaagccaaaggtagaccaaattttactaaaattgcagtggggctccaacaaaggtcaataacctgatagaattgtgtaatcagccccttagcctaacaaaggaaagggggagccatagctgatagaaaataacattctgtagggtctctacagttcttttgttcatagggtcagcaaaatttaaaaggacaagatattcaaagagtcaagaaaatacaatcaataatctagagaaaaagtaggtaagataagcaaacaataactgaattatttgaatattgtagttaatagataaggcaatgaaaataactataaatatataagaaaatgtgtaagaaaagatactcaaaagagataaaaggagtagagaattcaaatgcaataattgaaaagagaaaaagaattatatctttcagttccaaaatgtcaatttgattttaaaggatcaaattgacatttgggaactgaaagacataatattaaacactgtgttttcagtggatgaatttaacacagatgggccacagcagagcacaggaaaaggaaattggaatacacatcgatagaagacacacagactgaagcacagagaggaaaaagaacagccaagaccaacaagagcataagaaacatgtggacacacacatgtctaagctatgtatagaattgaaattccagaagaatgaaagagcaagaatagcaatcaccggtaaaataaataaatacattgtggtttattcaccctatgacatcctatagaccaatgagaatgaacaatctataatcatatgcaccattatacatgaatgtcacaaacttaaggttgagtttaaataaaaggcaaacacaaatgaataaatctgagatgattccatttatgtacaaattacaatagcaggtaaaactattatgtgagaattcaggttgtagtagcctttgggcaggaagtagactgcaaggtcatataatggtctgcaattgtctcttattctggatgctgggaggaaaggaaggaagggagggagggaaggtggaaggggtgcactcttggacatacagctaccatttgttctgctttctcctagttagccacaaacccttaattgtgtaattaagaaaatctgatttaatgtcttaaagaataagagcctaggcatgggtaatcaaagtagccgctaaggcattggttttcaaactgtggcaggcagtggaatcacctgaggagttgtttagcagagatcgcaggtcccatccccacagtttctgtttctgtttctgtagttctggtatagggcccgagaatttgcatttcttgcaagttcacaggggatgctgatactgctggtctggggaccataatttgagaaccagccacgttaaagttgctatagcttctgttgtcgatgttctatcataaacttggtctcaataatctggttgttgttgtattcagtaaaacagaatattcataaagatagacatagggtgttagctcaactgggatacatgatagggaacaccagaagggaacgcgccttcatgaaatgtccttaagaaaatttttttggagaaaattcgcttagaacaaaaatttacactatcaaatgagttacttcccagaaagtggagagaaaaataacctagctaaaaacatgatgcacaaagtgttgtatagtctgttttcaaaataattgatttttttttctcttagcatacatttactggaaccccatcaccaagctaatttcagtagaatgtgctccattatcagtcaaggctcacagatatggaaatttttgcctagcggtttgctgtaaaacatttgcttttcaaagacacattaattcaaatcttaaaattaaatataaaagttgaacatgtatgtgtcaatatgatgaagtttatttaattctcttacaggactgcatcaaaacatgtaaacaaggacctcggtaatatggaagaaaacaaaaagttagaagaaaacaatcacaaaactgaagcctaagagagaaactgtcctagttgtccaggtgagtagtctgtacgaggttcatagaaataattccctagcaagtaggaaacatccttaaagatgaagtcctttatgttaagatgctccataattacagctttcaaaacaggaagagaggggttttttttctttttattatgctttaagttctcagatacatgtgcagaacgtgaaggtatgttacgctggtataaacgtgccatggtagtttgcacgcatcaacccatcatctacattaggtatttctcctaatgcgtccctcccctagccccccaccccctgacaggccccattgtgtggtggtcccttccctatgtccatgtgttctcactgctcaactcccacttatgagtgaaaacatgcaatgttgagttttctgttcttgcgttagtttgctgagaatgatggtttccagcttcatccatgtccttacaaaggacatgaactcgtccttttttatggctgaatagtattccatggtgtatgtgtgccacattttcttaatccagtcgatcactgatgggcctttgggttggttccaagtctttgctattgtgaacagtgctgcaataaacatacatgtggatgtgtgtttatagtagaatgatttataattctttggctatatacgcagtaatgggattgctgggtcaaatggtatttccggttctatatccttcaggaatcaccacactgccttccacaatggttgaactaatttacactcccaccaacagtgtaaaagcgttcctatttttccacattctctcaaaacaggaagagagtttttcgaaaggaaactttcgtgactcagaaagtgttttcggaagaatggaaacttaccagtttcccccactccctcctcaaaataatcattatcttctgaataataaaaaccaactatgagatgttaacattcaattatcattttatattttaatgcaaaaactttaagtgcaaagaagctttattttttgaattggtgtttgggttcagtaagaacagattctaataccttagatttgttttaaataaatgattatgaaaataattttaaaatatgaaaattttaggccaggtataggcaatggctcacgcctgtaatcccagcactttgggaggctgaggcgggtggatcactggagactagaagctccagaccagcctggccaatgtggtgaaaccctgcgtctctactaaaaatacaaaaattagccagtcctggtggcaagcaccgataatcccagctactccagtggctgaggcaggggaatcacttgaacccaagaggtgggggttgcagtgagccaagatggtgccactgcactccaatctgggtgacagaatgagattctgtctcaaaatataaaaataaaaaaataaaaaactttaatctagatatttaataaaagcgtgagtgtatgtatacagccaatatcccaaatcattttaatgaaaagcataacaaacttgtgcacgtgtgtatacatatacgcatatgcttttataggtagtatatgtatgtgtatgtgtatatatgtatccatgtatctatatgcacatatgtagaggcatatgactgttatatttaacatataaaatagctgtgtgtgatttttaagacaatctcaaaagaggtatgtttccatggcattgccacctgcaatttgaggtttttctttttatttgtgttcccttaaaccaagcaaatagaagagccatttggactattaatgtgtcctttagaataactgttactatagcttaccgatatgatatgacaagccccaaccgccacagtaaacctcgggttcattataaataaaccacaagtcacaatttgagtgggtcatccaagttaatcccatagtaaggatggagcgtgagaaaatactgaatttaaaaggatgcacacaggggagaacaatagaataattgaaacaagacttggtttttaaaatctgaaagccaggattttaaactgatggggtgaaaggaatcagaactggattgcttctctatctcacctttcattggaggtcaagtatgcagcattcccacatgactttttttgtttgttttttccacttctctagggttcttttccccagtcctttgtaaacatagattttaactactgttttcttcaaaatcgtataacttctcaatgaaaaactgtacttgaagacaaatcccacgaaatagtgtgatttgaagaaatgagtgtacttttaacctaaagagaaatgcaatgaaatattttcttgaaaaaaaacttgtaatattagtattaattttacaaaaaaagaaaactctgaataattccaaaaactatttgtagaatggatgaagcaatgcctgagattatagatgggcttggggacaatggagttttataaaaggccctcctgtaaagtaatttactaaattacttttagtacaaagtatctgttgatgttaaaaaattattgctttggaagcttatctaaattatttttttttcatttcagagataaaaatcatatagaccaattgaagcatgaacgtggattgtatttaagacataaacaaagacattgacagcaattcatggttcaagtattaagcagttcattctaccaagctgtcacaggttttcagagaattatctcaagtaaaacaaatgaaatttaattacaaacaataagaacaagttttggcagccatgataataggtcatatgttgtgtttggttcaattttttttccgtaaatgtctgcactgaggatttctttttggtttgccttttatgtaaattttttacgtagctatttttatacactgtaagctttgttctgggagttgctgttaatctgatgtataatgtaatgtttttatttcaattgtttatatggataatctgagcaggtacatttctgattctgattgctatcagcaatgccccaaactttctcataagcacctaaaacccaaaggtggcagcttgtgaagattggggacactcatattgccctaattaaaaactgtgatttttatcacaagggaggggaggccgagagtcagactgatagacaccataggagccgactctttgatatgccaccagcgaactctcagaaataaatcacagatgcatatagacacacatacataatggtactcccaaactgacaattttacctattctgaaaaagacataaaacagaatttggtagcacttacctctacagacacctgctaataaattattttctgtcaaaagaaaaaacacaagcatgtgtgagagacagtttggaaaaatcatggtcaacattcccattttcatagatcacaatgtaaatcactataattacaaattggtgttaaatcctttgggttatccactgccttaaaattatacctatttcatgtttaaaaagatatcaatcagaattggagtttttaacagtggtcattatcaaagctgtgttattttccacagaatatagaatatatatttttttcgtgtgtgtttttgttaactaccctacagatattgaatgcaccttgagataatttagtgtttttaactgatacataatttatcaagcagtacatgaaagtgtaataataaaatgtctatgtatctttagttacattcaaatttgtaactttataaacatgttttatgcttgaggaaatttttaaggtggtagtataaatggaaactttttgaagtagaccagatatgggctacttgtgactagacttttaaactttgctctttcaagcagaagcctggtttctgggagaacactgcacagcgatttctttcccaggatttacacaactttaaagggaagataaatgaacatcagatttctaggtatagaactatgttattgaaaggaaaaggaaaactggtgtttgtttcttagactcatgaaataaaaaattatgaaggcaatgaaaaataaattgaaaattaaagtcagatgagaataggaataatactttgccacttctgcattatttagaaacatacgttattgtacatttgtaaaccatttactgtctgggcaatagtgactccgtttaataaaagcttccgtagtgcattggtatggattaaatgcataaaatattcttagactcgatgctgtataaaatattatgggaaaaaaagaaaatacgttattttgcctctaaacttttattgaagttttatttggcaggaaaaaaaattgaatcttggtcaacatttaaaccaaagtaaaaggggaaaaaccaaagttatttgttttgcatggctaagccattctgttatctctgtaaatactgtgatttcttttttattttctctttagaattttgttaaagaaattctaaaatttttaaacacctgctctccacaataaatcacaaacactaaaataaaattacttccatataaatattattttctcttttggtgtgggagatcaaaggtttaaagtctaacttctaagatatatttgcagaaagaagcaacatgacaatagagagagttatgctacaattatttcttggtttccacttgcaatggttaattaagtccaaaaacagctgtcagaacctcgagagcagaacatgagaaactcagagctctggaccgaaagcagaaagtttgccgggaaaaaaaaagacaacattattaccatcgattcagtgcctggataaagaggaaagcttacttgtttaatggcagccacatgcacgaagatgctaagaagaaaaagaattccaaatcctcaacttttgaggtttcggctctccaatttaactctttggcaacaggaaacaggttttgcaagttcaaggttcactccctatatgtgattataggaattgtttgtggaaatggattaacatacccgtctatgcctaaaagataataaaactgaaatatgtcttcacaggtctcccacagctgtctgactcttgtctaaagtagaatgttcatgtgtggaaagtgattgtctttatcaaatagtggaaaactcactgtgactctccatctttccagagaaggagtgcagaaaaataaaattcaccatgccttcctactaggtcaggtgggctaccttagctagtccctagatttcaccagtgatagattctataatgcatctgtcttcaaagataggatcatacttactcttgggtgtcccatgtaactctcctaggacct

SEQ ID NO: 15420 - DNA, 47375 bp, Human
  misc_feature (1)...(47375): n = A,T,C or G
actggaagaaccttctaaccagtttccctatctccagagcccctcccctccaaattactctccccactgccaccaggtttctttttttacacagacttgagcatatttttcctttgtttcaaaacccattttgtcttctaattaaccataagataaagtccagatgctcaggcattgaacataaaaccctttatatcttggcccaaacctacaaaacttttccagtcctacaccttgcctctgctcccaaaacatgccttgctcttagccacatccgattatgatgcaccctttcttgaacatgattttattcactgcgccttcgctggtgccttgaatgcccttctcctgttctttgacttgtaaaaatctcatccactcttcaagatcatgctctcttgtcacttctattttcaggcaccctttggccctaattgacagtgctctcctcattgcttctacagtctacagcactattggtatgctactacagatagtctaaaagttgttttgcatctctttcctactacattgagtttcttaacggcaagattaagctttgttcgtctctatgtcatcagcagtttgtccagtgcctagtacatgttagatactgaataaaaatttatgacttgaattgggcaggatgcttgaacatcattttgtgaaaggaccagtgatttctttctgtataattttcagcctcttctttttcagatattgaaagaacctcagaataggatggttgatgggcccacttaagatagttgctatgttatagccccaatttttagccgagtctctctagggacatagaaaccgtgctttctcaaatgactgattggtgcctgagtatggatttttccagatatcagagttccttagaactgcgatgattttcaatctaagaagacctagattctaggttacacacacacacactcaacctcatcgttttgaatagcagatacagggtttcagtgtttttgttttactctctgtgggttctatcccagcatcttactaagggctgagatttcagggcatgaaacacggaatcaacaaaaacaaggtttttacaatctcaaaactttgggaaactgttgagttatcttgaaagcctagagggggagcatcagttagttttgtagagaactcggcgaaacaatattgatgcatacggctagcctctgtcatcctcctgagttaaacccaacgggacatgctggactatacaggagccactcgtggactccgtgaagaccagatgggtagtgttcttgaaatgagcagatgtctatttgtagaactctggtagtagctttggagtgggtggggaagagcttggttcccattccccctcaaagacaattatttgcttctgatgagaatccaagcaacaagttgccattgagaatgcagtgattggtcagcaaacgaagcctataggaagagccttcgggtgcattccttgtgacatatcgacccgtcctaagcccgacgcttaattatgggacctctcagctcctccctcccgcctcgagctcccttttggcttctcacaaggcttcctggggacgattccccgatgctagagtactgggggtctgggcccacagggaacccgtcagcctccctccttggagcgggcctgatcccgggaggcgcccgcgcggcccggaggcgggaacctagggggagaaggcgccggcgccgccctggcgcgcagaccatctgtgcggtcctgcgcgggggcaggcgcggcctcagcccccgggcgctggcggacccagcgcgtcagctaggccgcccccgtcggcctcccccgggcgggccagccccgacggcgctgactcagcaacgcgaggggggagttttgtccctccgcggaccccgtttctcccagcctcagcctccccgccgccgccgccgccgccgccgccgagccggtttcctttttccggcgctccgggtgcgagagacaggtcgggccccctaggcagcgagccgcagcgcaatcccggcgctcgcccaaggaccctggaagctaccgttaccccgccgggcagcgtgggcgccatgagcagctcgggtgaggtgccgccgtcccccgccgcggtcctctggaggagctccgcggtccccgtgaggcccggcggcggggaaggccgggggctgggacccttggcgatggcggggagggagctttcggggcaggctggatcggcctggagggagacagctccttggaggaggatgccgcttatgggtttccccgctgcagcgggcaccccaggatgcgcttacgaagttagattcgggacgcgggagccccagatcagccctttccccctctttttgcgttaaaatcctgtttggtctcccaacaggactgaattcggagaaggtagctgctctgatacagaaactgaattccgacccccagttcgtacttgcccagaatgtcgggaccacccacgacctgctggacatctgtctgaagcgggccacggtgcagcgcgcgcagcatgtgttccagcacgccgtgccccaggagggcaagccaatcaccaaccagaagagctcaggtgtgggcttccacttctcccatacgttccttgaccttcctgacagcgtcccattttggtgtcttatttaagagtggtcttaaattcgtactgaaagaactggtcgtaaattcgtaaagaatgaggcacaggtacaggcaggtctaagaacattacccatgtggtttgttttgctgttctgtggcttgttagtacatgcggttagagtacaaaagtgacatgtccatgagtatacgtttgagtgtaattgactatattatgttccaatgctgtgtggtttgtagcccgtgtcttggagatgtatggtcttggtcacaaaacagaacatgtgaaaatgttcatatctttggaggactccccagaaatgccctgaaggccctatactatgaaatagaaaagatacaatgtaattacattaaaatgtcatcagatgttacttttaaatatgcttcttggttacaactgaagctaatgtgctgatgggctcagttcccaccagtagatcagtttgtaatacagaaaaaagttctgttctcatgccttgctggtcaagaagtctcgttttgctatctgctttctagcaccactctcagaaaaaacaggtatagtgaaagattggatatccagcaatctaaataaggagcacattctcacaacaaaattgtactaaacggattttttaaagtctttctatacttaaaaacgaccccccagtctatctatacggacaggaagcacatcagtgcttgtttagagtcggttagaactcacaaagcacacatttaacgtgagtacattttattgtatgtacattatacctgaataaagttgattttttaaatgttaaggaaaaagtcaagaccttacaataattaatgttttgctttagaagaaagtgcttggagtggtgtgggctctcaggctacagatgatccagttagtaatgtcacagtggtcctacatagtttagattgcagtgacccgttagggaacaggtcaggtcttacacattttgcagtgtcacttttacatacaaaagatccaaatagcatgtgagttgtgtagtttattttcatgcagttttcacatcaccagtgcatccagatcccctctactagaaatatatagcatatagaagagaggtgacatacaggtaaatgtaaggtaaagacgaactaataggcactagtgactttcataaaacactatagttaactagagttttcttcttgttacaaaattatttttgtttaatgtagaatatttgtaaataccaagtaaatatttttcttgtatatttgtcaagttttgtgtgtgtgtgtgtgtttaatagtgtttaatatgcattgataccttatacattgttatgtaagctacctatctttttcacttaccaatatattataaacatattttcatattagtaaaaaggttatacccaatacaagtcaaagtttttccctcagaattttccctcagaaaagagataatttccctgtatttaagaccttaaaagacttttctaatggcgctctcagttaatttattttgaagtagagtacaatttggagaaggcattactctgaaaaatggattctttatttgatacgtaaagagtgtttttgtgttaaagatattaaacctttgcatatatattgctaataataattaccacctttcttgttttgtttttaatctttctgctctttctgatttactctttctgaattgtccagatcgtgtcatgagttcattggtgggaaatacagttggagcagtgcagtctatgtgaaccctcataatttcttgatgtgctttcttgtttcagggcgatgctggatcttttcttgtctgaatgttatgaggcttccattcatgaaaaagttaaatattgaagaatttgagtttagccaatcttacctgtttttttgggacaaggtatgggacagatctggcaagattctttttgtattgatatcagccttggtagggactgcctcttcttttgtagcttttccagttatagcctgccctttcataataggtgagacaccttttattctgacttccagagtatcaaaagttgactctttcaaaggcagaactgtttttggttggtaggtggccatttttttgcaatgaaataagtttactgactcatcttactgcttgcttgtctatttaaaattttaaattttatattcaatattcaattcaatatatctccctttttaacatctttttaggttatttgttcttttctaggacctaatttccctctcaagaacttgtctgaaaaacagtaaataattttatttgattgtttatttgtttatttatttttttgagacagtctcaccctgccacccgggctagagggctgtggcacagtctcggctcactgtaacctctgcctcctgggttcaagccatcctctcaactcagcctcccaagtagctggaatcacaggcacatgccaccatgcccagctaatttttgtatttttagtagagacagggcatttcaccgtgttggtcagactggtctcgaactcctgacctcaagtgatctgcctgccttggcctcccaaagtgctgggatcacaggtgtgagccaccactcctggccatattccatttcctaatcttcaaaatgtatattactgacctggtttggtggctcatgcctgtaatcccagcactttgggaggctgaggtgagaggattgcttgagcccaggaatttgagaccagtctggacctggcgaaaccccatctctacaaaaaatacaaaaattagccacgcgtggtgcacacctgtcctcccagctactcaggaggctgaggtaggaggattgcttgagctcaggaggttgaggctgcagtgagattgcaccactgcactccagcctaggcaacagagcatgaccctgtctaaaaataaataagtaaataaaatatatattacataggtgttcattaaatgttttgttttagcattggaatgtaaacactgtacacatatacacaatatattgggatacatacacaggtaaaagaagaaacttcagatattctgatgaagtcagatactgatgtttatttaccaattttagtttaaaaatacttattatggtgcttgtttcagcatcgtaagtccccaaactggggtgatacagaaaagattagcatggcctctgtacaaggatgacatgcaaattcatgaaggtttcatgtttttaaaaagaaaaaaaactattatgttgattccatggtaattccaagactcccattctgttgataatgccaataaaattattgacacttttttcttttaatgttatttaactttctttactctttaggttgaacgctgttatttcttcttgagtgcttttgtggacacagcccagagaaaggagcctgaggatgggaggctggtgcagtttttgcttatgaaccctgcaaatgatggtggccaatgggatatgcttgttaatattgttggtaaaagttctttctttaatggaactgaaactcagcatgattaagtaagcctgtagttaggcatgggccaattctttggtggttgtgtacagagtagaattggtctccaagaaggatatatagttatttctaaggacctttagttcacattctcacctataaagtgccttcttaaatgaggattaaggagagagctactgtgaaggatgggttggagaagaaaaggtagtattaaggagaactaattttccatgaaaaaattgttttcttctccattgatgtaatcaggaaacacattaaaactgtagctgtgttaaaatgtcttcaaaacatcttttggggaaatctcatcatgctgagcactttacaaaagtatgatagatacacttgagcttgaccaaaaggctgagaagtgacaaagtatagtagataaaaaggataacatagacagataaatatgcacattaaaaacctacttaggctgggtaaggtggctcaggcatgtaatcctagcactttgggagaccagggcaggaggattgctcaagcccaggagctcagtaccagcctgggtaacatagtgagaccctgtctctacagaaaataaaacaaatagctgcacatggtatcatgcaccatagttgccgctactcaggaggtcaagcctgggagttcaaggctgcagtgggccaggatcgtgtcacagcactccagcctgagtgacagagcaaaactctgtcaaaaacaaaaaacaaaaaacaaaaaaccctgcttcataatatgaagtataagattttctgaagtaagccagcaaaatatcgcctattttttgaaacaatcactatttttgccagggtttctaattttttaccttctttaacactagaatttgttttcttttagaaaaatatggtgttatccctaagaaatgcttccctgaatcttatacaacagaggcaaccagaaggatgaatgatattctgaatcacaaggtacaatatatgaagcagggtgggattgagtttagtgtactttccttcaaacttattttttaaaaggggttcctgggtatctctgtatacagtttgtgtacaagataactaccaatgtcaatgtctgtcaaaagcaatgtagctacttaataactttaaaaataattaatattagagggtttttccttttaaaaaacttccacttttatttctgttgatgttaatgttttcttagggggatagttaggaaataaagtcccatgtccaattaatattggccacaagcacacagggtgcggtgtctctcacttggttctagtggaggtgggctaggactgctttatgtgctagtaaaaccaaaaagagctattcgcaagattcccttaaagagtgtgctgtgttctgagacttccccagaccacatcaatgtggtttatccacccactaaagatttgttgtagttattgaactgctttttatttgcttcagttatcttaatgaatcattgtgtcttctctacataaccagttttccctaggagagttataattcctacggggatgctgctttgctagccaggcatggtttttgagaactgggagttgccagaatctgctgtcctaatccatgaggctgaaattggatttttcatctccctgggagaaagattacattttaaaatcaactataggtgtgtctccccaacattagaagtagactattttccaccctggaaacgctggggattcttatccaaaggctaaaagatcattaatagtacggcatttgattccatttgaagtcagagcaacatcctctttagcactgtggttaaatttcagactcacctttatcttggtgaaaaaatgaaatgaaaaaatgaaaattttattgggggctggcataaccatagtcatagtcagccggcagagaaggaaaaatggacagctattgaaattctaagtaaaaatctatgagagtaacatagtggcataattatcttgtctcctgctttttctgagtgataggcattatgtgatcacatgttttccccatgcccagacacataaaacacctttatgcgatgtttgcagagaaggagcagttccgtctagtattttggaggagtaacttatgccttttctccttatggaaagcatttttagctatgtgtttaagtggacaagttgaagaaaaacacatttgcctttatgaactctgtcatgggtctggcctgagttatacctcaaaatagaacttgcgttggtctatgagagtcatttacaattgaattcgggtaactgttggagtgctgaataagtttctgtcatagatgagagaattctgtatacgactgcggaacctggtacacagtggagcaacgaaaggagaaatctcggccacacaggacgtcatgatggaggaggtaataacaaaatttggatttttttgtgacccctctaaggaactctcagaatattcccatctgttaaagtaatgattaggaagctttagtcatggcaacgaatgtttaattgaattgaaaattacttattttacactgaaaaaactgagcttaaaacttactttgccttttagtgtaggacttggacttggattttctaattcctagtttagtggtctgtataatcattcttttatcatttcataaatattaaataccttctatgagtttggcactgaggaaacagatgagaaagacatagtcactgctcttaaagagctcagtctcttgggaaaaagaaaacacatctataatgatgataaatcctatgctagatgtgtaaaaactgatttggtggtcatagaggagggagtgactagctcagtgagctgaagctttcatagggaagatagctcttgaaagagtagtcagaatttaccaggtagataacaagaccattctaggcaaaaggaattgtatgaacagtgccataaacaaagatagaaccttcagggaatcatgtggctgaaacataacttttttcagtatgatgggtagcaaattaagctagaaaggcagagatgtaagggatgttggatcgatgccagaacatttggcttctttctgtagaaataaagacggagctattgatggttatatttgttaatgtatgtaaaaacattttagaaaatgtaaaaagcactaaaatatgaggtggtaatattatttatgatcaagacagttaagaaactttattattaatactatccatgtccagaatgaatatgcataaaactgcaattggtttgaggaaagaataaatgtttccgtttgtcagccagtaggccctttattaggcttcctttcaagactgtatggagttaaaatggcctactttttttcactgcgatggaaaacactaatgcttcacttgtgttttcctttaaatcttagagatgcagcatagtggagcagtggagtgtgtaatctctgaagtcaggctatctgagctctagtcttctcattactttatatcctgggacaagttccttaagctctaaaggctcagttcatatttaacatgtctagcctagtgcttggcacaatagctgtttcttaagtatttgttgagtggacgaatgcagaaatttcatttaccaaatgcatttaaataatctcatttttatctcttaaattcttacagaagagaggcatcttagtatagtaggaaaaaataggctttggagtcagacatacatgggtttaaattctgactcttttacttaacagtctgtgatcctaggtaagttacttaacctgtctgagattcagtcaggatctgaaatattttccttattggatttttggggaatcaaggattaaatgtaagcatgcaaggcatagtgcctggcacgtagcaggagttctgtaaatgttacttcttcccttcttgcttggaatgactgtcttgcagaggctatatctgctacataatttgcctttatttagggttagattaagatggtgggggccaggcacggtggctcatgcctgcagtctcagcactttgggaggccaaggtgggcggatcataaggtcaggagatcaagaccatcctgaccaacatggtgaaaccccgtctctactaaaatacaaataattagctgggcgtggtggtatgcgcctgtagtcccagctactcgggaggctgaggcaggggaatcacttgaacccaggaggcagagcttgcagtgagccgagattgtgccactgtactccagcctggtgacagagtgagactccgtctccaaaaaaaaaaaaaaaaaaaaagatggaggtatagtaggaatgaaggttctgcaaacagttgtggaaaagggcccagataatacttgctgtagataataagcatccttttggcttttgatgtttgctttaatgatctttgaactaatgatgtgtctaagattgatgtcctcatcattggtagagcgtggtaattggctggtaagaattagggcagatatgtttcacatatttttttcctcccctactcctgcctcagagaaatagtagatccaactttaccaaatcctgagtatgaatgttttataggattatttacttaatgattctacctaaactatttactacagaattctgtgtgtaagggttttttcccccttagagacagagtcttgctttgttgcccaagctggagtgcagaggcgcagtcatagcttactgtaactttcaactcctgggctcaaatgctgcttcagccacccaagtagctgggactacaggtgcatgccaccatgcccagctcatttattaaaaaaattgtgtagagattcagtctcactatatttcccaggccgatctccaccacctgggctcaagcagtcctcccaccttagcctcccaaagattgtgcatattataaagtgtgagccgccatacctggccctgtgtataaggttttaaaatttttacaatcccccaaatgacttcttttcattgaacctgactctttggtaatgaagagtctagctgcagttttaaagccccaaattagtacctatgatttgtgtaaccttgtaggcaagtcaaaatgatggcttaatcaacagccgtgaagctcagatagctttgaataaaatgtgtttatgctaaaggcattcttactgagaagtgagacgcaggctgcttgttgagatgacaggcaaggcagatctgttttggagatgtgtagttacctctattgcaatgttatctcagtgtccatttttttagcctgcggatccccttaagattattaatgtattctcagttgggcgcagtggctcatgcctataatcccagcactttgggaggtcaaggcagatggatcacttgaggccaggagttcaagaccagcctggccaacatggcaaaaccccgtctctactaaaatacgaaaaaaacatctgggcatagtggtgcatgcctataatgccagctgcttgggcagctgagacacaagaatcaccggaaccctgcaggtggtggagaccaaaattgtgccactgcagtccagcctgggtgacagagcaaggctctgtctcaaaaaaaaaaaaaaaaaaaaaaccttgtctgttaaaaagcaaaacatagccaggcatggtggtaacacttgtagtgccagctacttgggaggctaaggcagatcacttgagtccagaaacccaggagttcaagtgctacctgggcaacctagtgagacctcatttctaaaatcaatcgatcagtcaatcaaagaccaaaaccaatatttgtcagtgccacaaaaagggaaaagaagcctttatgattgacttaggaaattctatagcagtggctgtcagctattgaaaacaatatataggataggcctaacttgtcccagactcacaaagtcagtttccctggaatagaacctagttatctgtatttttattttaaagacatcttcgattaaaaaatatatttttaacatcaagtttataaaatgttcagatgtgttggcatatgctaggaggaggctgaggtggaagatcacttgtgcccaggaattccaggctgcagtgagctatgattgtcaccactgcactccagcttgagtgacagagcgagaccccatctcagaaacaaaaaatttttcagggtatattttggaagtgaagctgtcaggacttgctgatgaattggatgtggaggacgaggaaaagtattgggataatgtcctgggatcttgaagggtgaacttacagataggaaagaaggctttttggcaattagggcagtgtgagggaaccaatgtgtagaaaagggtagcaggtgtgaatgagagaagtaataattgaagaagcaaggttttggaagagggaaagaatagatgtggtctaaagtagtgccatcagactttaatgtgcacatgaatcaccttgggatcttgttaaaatgcagattgatctagtaggtgtgggggtggggccagatagtccgcatttctgtttctttctttgatataaacacctctagaagtaatctcaagatcattatttaactattagttatcatctatatgagttcattccctttaacatcacagaagtgcacatacttttagagtgtacctttttatgtctttctgtgcccgaaaacatttaatgcctccagaaggcatctgcttttctgcctgcttaggtgttttactttaaaaaaaaaaaaaaaaacaacaaagaaacaacaaaaaaaaaaacacagatctttgcccttctttcattccctaccagaaagtagtagacagctgtcttcccttctcttcttcctctgtgaataaacagtgaataaacagtcactaaggtaggttccttactccttctctcctataactagctcatttacccacagcactgaacttttttcaaagttgagctgttttctgtgactgctttagtgttcttatgaccattctattctttgatcaataggtcgttttacctttgagactactttctccatcagtaaaactaaaaaaagttggggtaggctgtgcatggtggctaatgtctataatcccagtgccttgggaggccaaggcaggaggatcacttgagcacaggaacttgagaccagcctggccaacacagagagaccccatctctacaagaaaatgaaaaaattagctggatatggtgatgcgtgcctgtaattctagctacatggtaggctgaggcaagaagatcacttgagcccaggagttcaaggctgcagtgagctgtgattacacccctgcactccagcctgggtgacagagggacaccctgtctcttaaaaaaataaaaagaagttggggtaaatgattgtagggttttgcatttttatacagtagaagtaactaatatttttacagtgctttagactttactgtactactttctcaaaaacccagtattgcaaatacaaatgaagactaagattctgtctcttctgcagtggtttcaagcactgaaatcttctagccttaacagtggaaaggtaaaattagacacagataataagaacttagaatactagcatgagagtttgccccaattcaataggcaatgagaagtcaggaagatttttaagcggaagaattatatgaagttttgctctctttcaagcagtttggttgttatcttcgaactaccttactgttctaacctctccttcattctgtgtctgcctgtagctgccttaaaaactgttgaaggttctcacgcttctaagatttataactgactctcaactgctgcatctttccttcttcctctcacttgatgtctgtcatgggcgtgggaattaactaaggcccatatcatttgtctttaaattgggatctacacattctttccccttatttcatatctcattcttttacctttctctcctgattctgtttcttttaccatgctacacttcagcaagtcatttaaaataaacagatctctccactagggagatttgtttttttatttttttgagatagtatcttgctttgttgcccaggctggagtgcagtgttacgatcacagctcactgcagcctcaacctcccaggctcaagttatcctcccacctcagcctcccaacatgctgggattacaggcatgagccactgcatctggcctgaaaatatttttagagatcagttacaatggagctcctttataaaatgagacttgagaggtaggacccttctttataattcaccttcttatgaaatatatttaaactggaaatagggcttggacctttctggcaccagctgcagtttttctagttataggttgctagaaagggactatatataatccacattgttttaggttagtttaaattctctatttaattagctaaagatataaaatcttaatcagaagacaaatggccccaagaggcaagtacagatgcactcagtgtagcttcccttgacatacaactgcccccaggggacaagcaaagggtctccatcaatcaaaaaatttagctcaattttgggcaggctgccctttatactctgggactcatatcacaattttaggggacctttctcagtaatctatatttaagggaataattagaatcattggcttcttctgttctttttaaaccagatttagaattaataggatcacatcattattcgtttgaggagttgaggaaaagcagaatcagttgccaggtgtcattgagccgtgtatatctttgccttcagctttccagcattttggaaagcccatattccaagtccaccccctttatcagattggttctaaatttggtttgaaatgacaaaagtgcttggggctagatgtggggctgggtgtggcggcttacgcctataatcccagcactctgggaggcaggcagatcacttgaggcccggagttcaagaccagcctggccaacatggcaaaaccctgtctctaccgaaaatacaaaaaattagccaggcatggtggtgcatgcctgtaatcactgctacttgggaggctgaggcatgagaaatgcttgaacctgggaggcagaggttgcagcgagccgagatcgtgccaccgcattccagcctgggtgacagagtgaggctctgtcccccgctcccccccacaaaaaaagtcacgtgttcgttaaatatttcttaacatatgtatctgacactattctaggcattggagattaaacagtgaacaacacagaaaagaatacctatctttgtgtagttgatgttctagtagggaaagacaaagtgtataagaagtataatatgccagaagataagtgcaatggagaaaagtaaaggaaaaaagatgtgaagtactgggatgggaagtgagcaatttcaattaaagtcacaaatacatttccctaaatgggctaattgttggttttaatattaatttaatgtgtaattatattctgagggatatggttgtactcttattttactcaattctgtataatctcttgtgttcactgttcagtatctttttgtcctggatgccaagtagatcttgtgagaagcaggtgacactccagtgttgcccaccagagagcagagttggatatctaaagctcactgcccagggaatgttatttcagaactgcagagtctcttatcaagaaaatatagtatcagagaccatggaaattattctttggagcatttttttttaatgagagcttatttaattaactattgttatttggctcagagtcagatattccttccaaagtgttacagactgacttaaatattaatgactttggataatttatagtcatggtaaacaaatagtataaaacaatgcaacatgtctcaagttacaaagttttactagaatctaaaagaaatatcacccttatccttatttatgccttaattatatttttattaaaattcagatttataaaatatatgtgaagggcataagcattgttttataaaaggactcactatagaattcatttagatagcagaaatgcatatttcctctaatgtatttgggagaaggaggaatttaacactttttactttaaacagggagtcaagtacataataaggtattttgcaaattatagtgtaaaacatttgtatttatctttagaatatgtttaaaagtaaccagaaattcacttagttatcttcatcttagttgggcctggcattgcctctccttttttggccagggcctggctgagctgaatttaccaccgttggataactgagaattgattgaaatggttccactactacatgtagatacacatgtaacagtagttactagttgaaaatacacatcatttaggtctttaaaacctttctaatctaagtatgttctgactgtacaccttcattgtcattgacttgaccatagttaccagtggcaatgtcttcttcataatgacagatgcctaaagttgtcatttgtagccttggcactgagtaaatacaaaatgaatgtgaatcccaaacagagctcattaatccttggctagagtaactcaattacggttgcttatgtgatactctgcctcctttctgtggtagaaaccaacttgggaaggatataacgttaaaagagagatggtttaatgactagatgttcaggctcgtaacacacacagtaaatcttaataaaggaaggttctctcttggaaaacagaacaaaacaaaatgacaggcaagcataacttcttctctaagttaacttgcttctgttaagatagaatcacagcagtgaacaaattgctcatatacacagcaatgtgtgtgaatctcacagacattatgtcagccaaaggaagccagacacaaaagataatgtgttctatgaatacttttatacgaagttaaaggacaggcaaaactaatcaatggttataaagtaaaaacagtggttatctggtggaagttgtgggttacttaacagcaaaggagccagagaacctccagagcctggaaatgttatgtatattgatatgaatgatggttacatgggtatatatgtatgtttttaaaaaacgaattgttagtgtgttttacacactaaacatatgttttgcctaagttaaaaagtaagaaaaaggaattaggtcacggagtttggatttgttatgggaggtaatagggaaacattggatcttcaacagggacgtgagttgagaaaagtagtgcttttcaaattctcctgtggtgatatggagaatggaacaatgttcagatcaactggtgtatctgtgtcatgtcgccagcactgctagatgctataaaggacacaaaatatccatgatctggttcttatctttaagaagtgtataatcttttatgggagacaagttatatgaaatctagaaagttacagtaaatggtaaatagatggagttttggaaacaacatattaaagtcagccctaagttcaaatcctaattctgccatttactggctctatgacttcaggaaagtgatttatttccctgaaccttgatatccttatctgtaaaagggggataatatccaccatctttgttgagaggcttaagaaatatggtagtgaaagatagtacagcaaagtagacggtcagtacatcttccctttttaaatcctgtagccaaggagcaatattttgttgttgttgttgtttttgacagcatgtgacctcagtttagattgtggttttccacttgctggctgtgtgaccttaagtaaattacttggtttctttgtgtctcaatctctgatttaaaaaaaaaaggtgaaggggaagtggagggaaatataccttgagagggtattatgagaattacgtggacctagcaaatacatagtatctagcacaatataggcacacttggtaaatataaaatctgtttctgttgaatgtgatagcggatagaaatgtgtagtataaataatgcaggtaatagatgattggatcagggtggtgactgtgggtgcaaaagggacaggcagatcatagtgttatgtttttaaaaagacaaggacatttgatatagaagataaaatactttctttattctgtccttgtgcagggtgtatctctttttctatttttgcattgctttctttttttttttgagatggagtctcgccctgtcccccaggccagagtgcaatggcatgatctcggctcactgcaacctctgcctcctgggttcaagggattctcctgcctcagcctcccgagtagctgggattataggtacataccaccatgcccagctagtttttttgttttgttttgttttgttttcttttgtatctttagtaaagacagggtttcaccatgttggccaggctggtctcaaactcctgacctcatgatccacctgcctcagcctcccaaagtgctgggattacaggcgtgagccactgtgcccagccttgtttttgcatttctataaaatgaaaataatataaagtatatccttggatcgtaatgatgttaacttgaaggtgttgtgacatcattagaaaatatgttgtctcacaacccaaaaaattataccttattactaaaagtcactcctcttctttttatttttgagacagggtcctcactctgtcactcaggctggagtgcagtggtgtgatctcaactcactgcaacctctgcctcctgggctcaagtggtcaccccacctcagcctcctgagtagctgtgaccacaggcacaggccaccacgcctggctagtttttgtactttttttttttttttttttaaaccatgactcagccctcaggagatcctgagaacatgtgcccctaatttttgtattttttgagatagggtcttgctctgtcacccaggctggagtgtagtggcacgatcatggctcactgaagcttctgcctcctgggctcaagcgatcctccctcctcagcctcttgagcacctgggactacaggcatgagccaccacgtccagctaatttttttcttttttaagatgaggtttcactatgttatccaggctggtcttgaactcctgggttcaagggatcctccaacctcagcttcccaaagtactgggattacaggcatgaaccactgcacctggccctcctcttctagtaatacttttaacaggcattgtcatccaactccagctgaaaaattagttactttcctatgactagagacccctgttgtaataaggaaaacatcaatgtataaagggaaggaaatccatttataaaatttgtcattttttggttacttgaaaaataatcagagcagcaactcagatcttgctgggtatcaatggtagacagattcttggctaaggaagtttaaattttcaggacaagtactaagcactaaatgttaacatttcagaatcgcattgttcacagtgtttatttgagaactcataagttgactgataacaaatctcagacatcggctttccagtttttgacgcagtattagatttcttgtgaaatttttagcttgaatttagccactaacttcttgtgtttcctaagcttaaggaaaatgaagaggtgaaaaaaataacatttccccctaaccattgctcgcctttcctcctcctctcttccagatattccgagtggtgtgcatctgtttgggtaatccaccagagacattcacctgggaatatcgagacaaagataaaaattatcagaaaattggccccataacacccttggagttttacagggaacatgtcaagccactcttcaatatggaagataaggttggtgaatggcactggtagtcactggctgtttactttcaaatggctgttaaccacagggaattgtataagattcttggttagcatgtatgagtatcaaactagacagcaaacaaacatttttccccacttcctctgaagtattttatgcagctaatgaagttggtggtgccaggatttatcagcttttccacaatgttcctcttcagagactttttaaactgtaagccagcagtcattttaattcccacatgcgcccctgtataggaccagaatcattctcaagtgcaaaacaatgaaagtgtgttgggtatttcttatcgtggattcagagcacttttgcactgaggtcccctcggggaactctcctgttgaagggagtaatcttagtttttcctgttccctttaggtcttcctcatctgcctagtaggaggatcagagcctcttccttttattggcttcttgatcctcttccaagcagatgcctgtcttgtaacttgagaacaggggccttgtgattagctctccaatttttcttactcagtgcatgttatttttcagaatgagttttgagggccgggtgcggtggctcatgcctgtaatcccagcacactgggaggctgtggtgagtggatcacctgagttcgggagttcgagaccagcctggccaacatggtgaaactccgtctctactaaaaatacaaaaattagccaggcatggtggcgcacatctgtaatcccagctacttgggaggctgaagcaggagaatcacttgaacctgggaggcggaggttgcagtgagccgagatggcgccattgcactccagcctgggcgacagagtgagattctgtctcaaaaaaaaaaaaaaaaaaattgcttttggagcagttcttgctagtaggaaaaacaggtagatgcacctcctaattgtgtctcttacgcgaattagaataagcaaggacctctctcacatgtattttgccaccttgtgtttctttgttacttaacaatgtggctgtagtacttagcttgtaggcagagatgatgagcttgatggaaacatgaacctagaggagagctgtgtgttgcttgacattcctggttttgtgccctaattaatgtgttcttgatcttgatagatttgtttagtgaatgaccctaggccccagcacaagtacaacaaactttacacagtggaatacttaagcaatatggttggagggagaaaaactctatacaacaaccagcccattgacttcctgaaaaagatggttgctgcctccatcaaagatggagaggttggtattgtttctgtattttgcacattggggttaaaacatcttttacttctttggtataataggaagatggggtttatgttgactttcttcctctttcttctgtttctaggctgtgtggtttggctgtgatgttggaaaacacttcaatagcaagctgggcctcagtgacatgaatctgtgagtgcaggaaatttaaaatggaaagtcatttgtgggttgttgctgttggagtgtgctgttggtacaaaatgactctgccgaggttcatccaaagatgaaggttgacctaagggcgcgtctctttctttgcatcctttagagtttgaggactcatagcagaaactccacatacttaaacactctaacccaggacatcaaaatcccactttctatctgagtggaaatcgttgggcgttcctaaaaagccatcctctatgagaaagacactttaaaaaaataattgactattgcggaaatgtgttcagtgcatttgggagtgtaatgaaagattttccagagcccccgtttgctatgttactttggtaactttgtattttgtcattgtgacaagtgggactaatttgcatgcatactttatagcattcctcctggtcatttatgacaatgaaggttaatttgtaaactaaatcatataggattccttgactgttcaccattctctattttagggttacttataaatagttgttacttgtaggaagttgagtaaatatcttgatagagaaatctgctaaaaaaaagaattaatgaggtttaaaaaatttttgaaaacaggtacatgcaactcccaagtgtgtctctcacactaactagaacatgcaaggacctctctcacatgtattttgccttttgtttctttgtatttaacaatgtgagtgtagtgcttatgcaaaaatattccccaatattttggacattatttatttaaattttaatcagcagtgatttaaatgaattcagaaactggttggttccaccagctcaaaagagatcagttttctaagaagttacttcaaacgcttttttcattattttttaaagttttcttgcctaaatgacaatgtaaacttgtcagcttctgatgtggagaatttatgtttaatcatctcctttttttcctgcatactcttgtgacacatagagaatggactcccactgagagactaagttctgcatgttccatattctttctgaagagctacagctagagccttatttatttggagctgttgagccccttcagtttcttctgaattccttttacaaccaaaagccagttttccccatgatcgtactccctttattttgtactatcattctttttacagctatgaccatgagttagtgtttggtgtctccttgaagaacatgaataaagcggagaggctgacttttggtgagtcacttatgacccacgccatgaccttcactgctgtctcagagaaggtatgaccctcagcatgcctgctggagtgtttgcacagatggatctacattctcctgtagactgtttacccaacaaagcttcattcatagtgtatatgatttctgttaaaagttagtttccaagtaagacatcgtacctgcgtcacttggggcttggctgcgtgcttagaggtaatataaaaataggaactttctatgaggagaatttgggtcagcagggagcgaccaagtaactgtttctgtaactttggaaggtcatggtttaaagagaagtcagcaagggaacttgagagaagataacttctactttataaggaatcaaaatgtgccctgaaagtgttcatatcttgatgacctatgttcagatttcccttcatttgtcattcagattcttttgcagtaaaatgtcaataacagtaatttgtggactccatacccatttctagttatatgcagagcttcaggaaattggatgtaaagtattttgaatttcctgtgaaatagtgtgtatagtaataccactttttataggttatagagttggaaacaactgaaattttatctttcacaaataaactcctcacttccagtcagtaaaaatagatattttcacctctgtgctcaggatcatcaggaaggaagaacttgaactactttaattctttaccaccacaagcaaaaatattctttctagcctaattcctggaaagtcacagaataactaccttatataaattgttctagaaaatcattttttttttttttttttgagatggagtctcactctgtcatccaggcaggagtgctgtagtgtgatctcagctcactgcaacctccacctctggggctcaaaagattctcctgcctcagccttgcgagtagctgggattacaagtgcccgccaacacacccagctgatttttttgtatttttagtagaagtggggttttgccatgttggccaggctggtctcgaactcctgacctcaggtgatctgcccgcctcagcttcccaaagtgctgggattacaggcatgagccaccgcacccagctagaaaatggtttgatagagaattgtttttgctatcctatccactagatttatgatctttaaaatgtttagaaatatcttagcatatcattatgccacattttcctaactagcctatctaaaagtcctgatttgctttttatactctatgcagaattgtgagtgggatggggttttctttctgtacctttttctcacctcttccaactacttcacttgaagggtgccctttcaaccccacagcatctaagatccctgtgctctctctgtattcaaaacttggtcttaaaggtttaattacattcctgcaaattataaggctagtgctttaagtagtagaactctgaggtattctcagttttatatgagatcaaacacagtatggtgtaaaggtgccctgaacttaagaggcagtcttaatgctgatactcctgatcctcatgtagttttcataaataaatgtaaaggttgaggtcttgtaaaccagcgagctgttttcctcattattccattcgtcagtaatctcagctctgtagttagcgagactcccacaccaagaaacaggtttttagggttacccaggagaatgtgtggagtataatttgcattacttatgtagatcaagaaaagtcattttaaaacagcaaaaggtgatttaagtgttatcaccccaatttaacaaaattctcacatttgaattataaacaaaacataaagttaggttataaaaggaattttagaccgggtgcagtgactcacacctgaaatcccagcactttgggaggctgaggcgggaggatcacctgaggtcaggagttcaggactagcctgaccgacatggcgagaccctgtctccactaaaaatacaaaaattagctgggcatggtggcgtgcacctgtaattccagcagctactctggaggctgaggcaggagaatcctttgaacccgggaagcggaggttgcagtgagacaagattgcaccactgcactccagcctgggtgacagagnnnnnnnnnnnnnnnnnnnnaaaaaaaaaaaaaaacaataaataaataaataaaatacatgaaaaggtttttcaaataagggtgctttataactaaactaaagttctttaaataaatttttaaactatatagagttctgttttgtgtttttttgttgttgtttttttgttttttttgagactgagtcttgctctgtcgcccaggctggagtgcagtggcacaatctcagctcactgcaacctccacctcctgggttcaagctattctcctgcctcagcctcctgagtgcaggcgtgcaccatcggcctggctaatttttttttttttttttttgtatttttagtagagatagggtttcgccatgttggccaggctggtcttgaactcctgacctcaagcaatccacctgcttcggcctcccaaagtgctgggattacaggcatgagccactgtgcccagccgagaatttgttttgtttgtttgtttgtttttaaaaaaacaaacaaacaaaaacttgtaatttccaagaaaaattcagctttttatcatttctatctctgttatagaatactcctatttttcaggaataaaaataatgaataccactgtcattttcttgggaacttccattctttgattagcatgggttgtttccttaggaaaatggagctaccttacatgctaatggtataaagcagaatttatattattatacctggaattttatattgaacattttctcttcattccactagagtttttgatcccaaaaacgagtttgaactacacttgagtaatagtacagaggtaaatgcatactagtggttatatttccacaattttctttcttttgttgctgatatcatggaatccctataagggagttccaggtattaatcattttgtaattgtagatgacccagagaacaatttgatctaggtcactccaggaattcattggccaaggggaaaacataggaaacattttcagacttagagtaacaagtaactatatcactttaggtgacatcgattctaacagtgatatttaaaaggaaagtaaagttggactacagtgggaggaatagaaaaccaaaacagacatataatatgccagctgcagaatgtatagtatataacgatatggttttaaaggatttgggggcaaagagtaaggattagtacaggtaagggtgtgtgaaacttgtgagtttgttggcgctatttgtgagacagaaaattactgagatccaagaaaactgccaagagtggagtgtttgggttagcagagccaaagagaaccaaatcccatatagatgagactcatcatatagttatttgcaagtgggagttgacagatgaaatcattaggcgataatacaggggtgagtgctcttctcatgctacaaagatttaagttgccttgacatcagtaaatgtcctgggtaaacatgaaagaaaaaagtcttttcccaaatggagccttcctcttgtccctctctgtgtcactatagtaaaggctgtaaatgaaggttgttgtgatgagtatcactgtccctttaagaagaccaaaattgagcttattttaataatgaagatggaagaaggagaacagtagaagtgcctggcttttgtttatgaaaatggtctttttacttttgctttgccattcagtctcttctttgaaattcaatatttgtgtaactggatcagtaaaagaatgcatttgggagagtatcattatttggtttccccaagtagaaaatcaggcagtatgatgagtttgttttgttttgtttaaaaaagactctgaccaggttttagaattattcctaaaataaagtaggatgcatttgctttaatcaatattgattgattaaaagcaagaatccccagcttcaaatgtttactgcttttagtaggttaatatagtttttcttagtcaagtagcatttttacatgcctattttatgtatacaatagaatagaaaggatgaaatagtatttattgctttgttagtttattatgtttttaccccaagagattcaaattccatttctactggagtatccctttagtgatcgtaggaaatatatagccctgaccaagtactgtttagagcaggctgcctgtatagagcaggctgcctgtatagagcaggctgtttctttcaagtggctacagaagagctaaaattatatgacacctcagcagggagaatctggcttcagactactcaccatcatccacttttttgcaggatgatcaggatggtgctttcacaaaatggagagtggagaattcatggggtgaagaccatggccacaaaggtgagctcagtttggtaatactaactccaggtgactgggcctgctctactctgcctgtctgggtgtcaagctgctctagtgtggaggatttctcagtaattggctccactgactagattattctacagaaaaatctgaggatctgatttgcccccaggattctcctgaccattatggcatgcctgaactcccaggttggctctgagactgctatgtgctgcatttgttgcaaactgtgttgaccctcccctctttgtagaccgcttggctagtgaggaggttgagtgcccttgccaggacacttgctatatggcatttgatgcattttctttttcttttttttttctttttttttttttttggacagagtcttgctctgtcgcccaggctggagtgcagtgacgtaatcttggctcactgcaagctccacctcccgggttcacgccattctcctgcctcagcctctggagtagctggggctgcaggcacccgccaccactcccagctgattttgtatttttagtagagacggggtttcaccgtgttagccaggatggtctcgatttcctgacctcgtgatccgcccgcctcggcctcccaaagtgctaggattacaggtgtgagccactgcgcccagccttgatgtattttcatctactacatcagtactctagaaagtcagaagccttctgtatgggagaatgggactggcaagaagctttctttaggcatttattagagactccttagaagttgtcatacctaaagtggaaatgaacactttgcttaccacttagcacttctttatactggcaaatcaaaacctagggagaagtcataacttacactaagtagactaaacaaaataacacagtaatatatgagttgtagaaaaattttaaaatacagataaaaagtctctaataatccaaccacctagagatcactgttgattaacagtttagggtatattattgtaaaattttgagaccacatttttaaagactgtctttagtaatagcttttgaaagagattttacgctttaatttttagggttccaaaccaaaagtggcaatcaccatggcatatgtgtacctgtgagcatgtagattcatgtgtgctgggggcattttatagccagttctttctcagagtccctttttcttttagccaatggattctggctaggaaaaacattaaccgcaccttagtagactagttagaagactgagaagaaccaggtagggaagccagagaagtgacattcagagatatttggaaacaaacttgagcatacattttacccaacaggaattagccaggcattttatttttaaaaaaagaaagaaaaagaaattttagcaactctttgttgttgcccctctctgtgtttagaatcgtgattttccagctatgttcctcacagccgtaggatttccaagggtaaaaggtagaggagggggtgtggaggtttggatatgagcatatgggacttccatagctcctatttgaaaaattgctgttttagaagagcctgttaagctgagttttgaacttgacagcattttagtatgctgattgggcagcacaggcttgtatgtgatagccaaaatctgaagaccatttatttgtcattcgagggcttttcatctctctatgagaataatcactggtggattttggctgactgtccctggaatatgctgtgatactcagcagcccagtgtttatatgtaaacaaatacaagtgctgttactgcatttctcttcatcatcagatagttacatgtctaccttctgtgatttctataattgttctgtgattttaggggtgcctattaagttaactactacgaattagaatactttttaaaattggtggtttcttgtaaggtgaattttattttaagacaaatacacattagggtcaagtagagaagggtttaaacctcagcaaagttagcagagtaaaaataactcacagtttagttatatctgtaagttggtgatagttaagagatggatacttgtcttaaaatttgaaagatttgattatttctagcaaacataagatactgagttaaagttttcctgttgcttccaatgaaccccctgcagcttctgtttcatttctggtctaatttggttcctataattggatttgttatcatataggttagcacctaggaaaagaactaaagttatatttgtttagatgagcctggatccgtcagcttgctgcgatatttttccatctgtaatagtcagtgagtttgaagatagtagtgttatctggttaagagaggataaacacttgtaaaatcaggaaaatgtgttttatgtagtgtgagttaatgtctttattattttgaacctaaatacttaaagataattttaggtcactttactgtatataatttttccatttagctttacctctttacttttactcaataaaagttttgcttttgctaacttactcatttcattattatgcttagagaactgtaaaatatgggatcttgctatccctgtaactctcctgtaatccttcttagtgaaatctgcagctatctagtaaagattaacttttttgttgttctcaaataactgaaatgcctgtgactatacacagcaaagcatttcagtagagagccaaaagataagaaatagaactgaagtgggggtagggagtcgttcattcaagccaaaataaattattctcatgtgtttcttggtaatgttctttctaacttaacaggaaggaaggaaagaaaacatgatctaatttaattggcacacttggcctgacctcaggagagcgcatagtatgttattatgttggcaatatgtgtttatcccagcagggccttcttgtctgtcatcctagtggacattggctggcaggtctgaggtaggacctctgtttatgctctcttgggagatatgacaaccttaagaagcattgctgggattttgtttctgtagataacattgttaacagtttgttgctattctctttgggatttctgactgttaagattgatgtttctgaaaaagcagtgttgataatacatgctggagataaacagagcaaagatacctgggcaagctgcctttcccctttgcccagccctggctttggttctccccattggtcatgttcatggctctcctgcccagaaactcttttgtaacacataacctgactattccaaaaatggacagaaggtttcttctgagcaggaggacataaaaggagaaatcagtttttgctttactgtaccagttggattacttcaagttgatgaattctagtattcatagtcagttgtactgaaaattggatgcatatctaacatgtaataccaacctgggtttcttttctcccctgcttcttaaaatacttgactatccattttgtaccttgttaatggatcatatcagaaatgaatttcacaattaggtgagggaacagacttcgggatttgatatattatctttcattttgaaaagttgataaaaatattttataaaatatttaagaatttaaaatcaaggaagtcacctttgattcctctcgttattagtcagaaattcatctgagaagagcctaatctctaagccaaagtgacctgcagatcccctagctagtaaatgatagagccagaattataacccagatggcctgacaccagagccagttttcttaaccactaaactgtgctttctctcaccttccctgttctagtagcatgtcgtccactcaagaaataacaggtcagttcatggtcattggtgaccagaaagagtggatgaagggatataaaactgtatgaaggacctggagatgttatgtaaatgtctgacattgggagaaaaggcccctagagcatcatttgtggctgggaatctgagtaaagagtggagattggggcattctgtgagggtttgtcacatgttagcacattgtgacttaggcaagtcagaaactatgcagccacccaaaatttccctgaattttgtccatgctgctttataataaggttatttagttgtttttttgttttgttttgtttttgtttttttgagacggagtcttgctctgttgcccaggctggagtgcggtggcgcgatctcagctcactgcaagcttcgcctcccaggttcacgccattctcctgcctcagcctcccaagtagctgggactacaggtgctccccaccacgcctggctaattttttgtattttttagtagagacagagtttcactgtgttagccaggatggtctcgatctcctgaccttgtgatcctcccacctcggcctcccaaagtgctgggttacaggcgtgagccaccgtgcccggccaaggttatttagttcttaactttttatcttggacaattttaaacatatataaagtaaacaggattgtattaaagaaccctgcatatgcctgtcacccaccttcagtagttatcaatattctgtcatgcaaataatagtgtatttgatagtcaataaattaaattcctagatggtctttctaatgaaccagtcttactatgaaactttacttctttgtgattggttcacttagttatgagattgtattccatttctagagcctgacacagcagaactctaaatgtggaattatcataatatagttcttaatgcttatttggtccagtttctcaatatgataagtaacaacttttaagtgaagatatggaggatattttctaattctgcaatgttcactgaaggaaaatacttaccttttaaaaattttgtctctcctggttttcattttgaaccaagatgagttttccatttttcacattgcttttgttcctttcagatacatgaacatttgaaattgtttttaacccacatttttaatcttttcttacaagtgagcctctctgttcctgatttctttcattttagtaaaattttcagacttccttctagaaaggagcctctaaatggtttcagttaaagatactttggcatgttagagattagaaagaaacatgttatcaattcagactatatgtagatttctgctgcttcctaaaaaccaacattatgacctttaattgtctcaccagcccaactgccacaagtgattttggagatggtatattcaaagctaggcacaaaaatcaacatattcttcataaaatgctatgttgtagaaccaggtgagttgtggagagacagttactaataattaattcttgattttagatgctgggcagtaatttaactcattgtagtgtcacatttctatgtcaataacatggacaatttgtttctttatgagctcctacagtttgtatgtagccatcaaatgaaataatgtatgcaggcatttttcaaactgtatattgttatataaatctaaggagttatgaacagcccatatttctgttggaggtactcaggacataaagctacagggcatcttgcttcgtgagaattcaaagttcactaatgtatttgtatttatttctcctcatgacatcagagtagagtaactcaggatgtgaacatgggtgattatacccaggttttatgtgaagaaactaaaacttactgacagttgtgtcttgtttgggttgcacagaatcagagatagaattggaattcaaatctcttaatttgacacagacagcttccctaaaattccctatgtattacttacaaaagacaatcagttatttgcaggtctgtttgaggttcagttctggatctctagtacaataatggaaactaggcaatgttgggccagacttgctgaaacaagagtgaattgtagaacttaaaagcacaggtttctgatttccgagaaaggggcaagttgcaaatttgttttgtcacctcagagggtttcatgtctctccaggcttgggaaaagtgctgctaccattaatctggattctgggttctttgataagggctttttgttgccgttgttgttgttgttgttgttatggagtcttgctctgtctacccaggctggagtgcagtggtgcggtcttggctcactgcaacctctgcctcccaggttcaagcgattctcgtgtctcagcctcctgagtagctgggatcacaggtgcctgccaccatgcccagctaatttttttttgtatttttaatagagacggtgtttcacctgttggccaggctggtctcgaactccagacctcaagtgatctgcccacctcatcctcccaaagtgctgggattacaggtgtgagccatcacgcccggccctctcagaagggcttttcaccatccatctttattaaccaaaaagcctgcatgactttggctgagaaatagtgtatgtagatggaatagaggaagcacatactctccagttcactggtgcttcctgatcaaagtgtgtgactaagagagggctatcattatttgggcaaggacagactatgtgacagagctcctaacctgcaatgaggcatctgcttcagggagaaatctcctcatattgaatgtagagttttgtgtatagatgtgtttttacctgtagataagatctgtaattttcaccagattgtctccaaggtgtttgcactggtttaagaaggatggaggttaagcacagaatctggagccagactgcctgggtatgcatcctggctaacccatctattggctgtgtaacagtggtcattggcatttaacctgtctgagcctcagctttctcatctgtaaaatagggataataattggacctatctcgtagggttgttgtgagaaccatgtgaggcgcataagaagtgcttagaaatattagctcccattgctactgttgttaatgttatctatagactgacggcaagagaacaagaacatgaagctccctaacctttcccttctagaggagggcatctaacttgccccatggttccagtttcagatctctaaaaattcagtgccctaatgtgatcattatgctacatcaccagtgtagtgggcagatgacccatagtgtgggcttagtgtcgtgagagaaagcagtggaggtgaataaacttagtgctgagaaaaaaccattagcagtagcatcaactcacatttatttattgatgggatgcaaggaaccgtgcataggccatggtggaatgaatgtctctgaccctcagaggaatttatacttattcacctgtgacacaggaaggggatttgaagagggctgtgatgtgacagaagtggcattcatggtgtgctcctcagactgtaagatataggataaatagaccgagaaaagcagagaagggatgattttttttccaagagggcagttaacagaagaagaactagggagtacctcccctcagtggggagacaataggaagacatggaagctgaggtgattgaaaagggtgaggggttggagagagcgcctaggaagcccaggactagagggcgtcaggaagaacatggtggtaaatagtggaacagcagagcagacagaaaatgggtcaaggagaaaggctgttgggttggacttaaggtagtttttggaaacttcaggaggggtcagggtgcaagcccagctgtcctattatgctccatcagcagcatgtcagtacttcgttctttcaaaggctatgtatagtggggttgcaaggaattgaagctgggacaattaaggctgtaaatcttggccccatatggtgtttgtaacctattgtaagaataaatatgtaaaacataaacacaagaataagcgcagagtcacacacgggataaactgcaagggagatggtcagtgactggaactgtgaggcctccttagggattcttcaagggtgaccctctttagggaggatgttagggctgtggctttttttctgaaaagggagagggaggccagccagagaaatggtggctgagaagtgcagctcttggcatttggagcatgcgttgaacaggtcagaggagtgaagccaagaaataatgtggcttgccattcacagagcttttgaggagtgaccgacaagcagactttgtctgaaacaaataggagtagcgatagtttggggtgagagaaaagtcattgagtttcagtgggaaaacaagacccttggatggcatctaaatttgtgctttcctctccgggttcaccctcagagatcctggagagctgtgtgtgccctcagggctgcctagctcatgctcattggtctagagaaagaagtcagccgggaggtgaacaggcttcttctgggctccttagtagaggggcacttctcaggctgtggacacttctgctgactgaactttgtggtggtttaatggtttaaaaaatacaaaccacaagccaaaacaaccccttttctctaccacattttccaccctgcatttttcctagtatatttactagggaaacggtaccttctaacctttgtttctgaaagaggccgcaagtaatatccggctataagagtatctcttcttttatcagcaaatggtttattaatgtaaatgtgtcctcaccacatagccagacttctatgttttctctggaggaaaaagaagcctcttctcagatcactgtttcaaatggcagtcataattataaggggtggttttggttctcttcctctggcttttttttttttaaacatccaacccatcctgttatctatctttctaaatacatgcacttagaacacatggtgtctctttgatttaaacagacaaaatagctcgccaaacatggtagtatgcacctatagtcttagctacccagggggctgaggcaggaggatcgtttgggcccaggagttcaagtccagcctgggcaacatagtgagactccatctctaaaaaataaataaataaaagatacaaaatacattataaatggacccaacaaaaatagggttcctgtttgttgatatggggtttgtgagcagatggagtttgtttcaaagttaggtacctgagctagactaaatgctatctgttgctgaagccataactacctcccaagtctctttgcccacagagtgctcaactggaagaagctgagccctatgagaaagatggaatttgaatttaagacctgggttcgatgttggctttacttactgccctctttcctcacagcattgttgtgagaataagaatcaaaacaaggatagtgatgtgaaattgcattgtgaagtgtaagctcctcacagggttttggagtatatatgtgtgtatttttttgttttgttttctaaagtgtaattcttttaatagataatgaaattacattgttccaaaatcaaaatataaaaaggtatatgaaaaagaattttgtttccatctctgtcactcttcattcccctgcctctctcttaggttattatttctatttctggtatgcctttccttattttttttagtacaaacatacacatatatattattgtcttcttttcttatactagtggtagcacactaggtcgtctgctctgcatcttgtcctcacttcacttacagcgtatcttggggacatttccttatcagtacatcagtacagcttcattatcttccattgtctggatctaccacagtttatttaaccatttcctttactaatgggacttgggttgtttcagtctttgctattacaaacagtattgcagtgggttactatatatatgtacagtgcttagaatagtgcctggcacacggtaagtgccgaataaatattagctttgttgcacataaattcatattgtatgcatgtaagtactgtgtatctataggatgaagtcccagaaatgacactgcttaatgaagagggtaagtgcatttgtaatttttctagatactgaaaaggacagatccaacatctctggacaccattccataggcattgtgtcattttgcacatttgcaacataccctgtacaaattcaaggaggtattaggtcatgcttcacccagtggatacctaacagaagcggttgacaaattgtcactactcaattatctgttgaaattatctgtttcatagttggggactatgccaaggccttagtgagtaatggagtttttcattgagagtcttgtttctgatgttttcttctcacttatccttcttttttttttgtttttttttttcattataatagcagaaaaatgtttataagcataacaccagttaaaaaccaaaagaaaaagattgataaatttgacttaataaaaacaaaaaatgggccgggcacgatggcttacgcctgtaatcccagcactttgggaggccgaggtgggtagatcacctgaggtcaggagttcgagaccagcctggccaaagtggcgaaaccccgtctccactaaaaatacgaaaaattagctgggcatggtggtgggcacctgtattcccagctactcaggaagctgaggcaagagaatcacctgaacccgggaggcagaggttgcagtgaactgagatcacgccactgcactccagcctgagctacagagcaagactctgcctccaaacagcaataaaaattgttagtaggctagaaaatataaactaaattagaaggccagttacataataggaaaaaaagtttgcaaccaatataaaatatagagtgtactgtaactgatgactatgaaaaagaaaaaagctccaatttaaaatgcgcagagggctaggtgtagtggcttacccctgtaaccccagaggtttgggaggccaaaacaggaggattgcttgagcccaggagctcaagaccagcctgggcaacatcgtaagaccccatctcaacaaaaattaagaaaattaagtgggtgaggaggcgcacgtctgtagtcctagctacttgggaggctaaggtgggaggatcgcatgtccccaggagtttgaggctgcagtgagctgtgattgtgtcactcagcctgggtaacagagtgagagcttgtctctctctcttttttttgagacggagtctcactctgtcgcccaggctggagtccagtggcgcaatcttggctcactgcaacctctgcctgcctggttcaagcaattctcctgtctcagcctcccgagtgactgggactacaggcacacgccaccatgcccagctaattttatgtatttttagtagagatgggttttaccatgctggccaggctggtctcgaactcctgaccttgtgatctgcccgcctcggcctcccaaagtgctgggattacaggcatgagccaccgtgcctggcgagaccttgtctcttaaaaaatgaacagagttctcagacagacactttacaaaagaaaactgtcaatagcaagcaaacacataaaaggagaaaaggctcaaattggatccaagaagaaagttagtaattatgtataccagatattgattaggatataaggaaatttaatacatttatttattaataaaattaataagcattgcttaagacagggatcttttctgaaatgcgtcattaggtgattttgtgattgtgtggacatcatggagtgtacttacacaaaccttgatggtatagcccatcgcccctaagctacaaacctgtacagcatgttactgtactgaatactctaggcagttgttacacagtgttatttgtgtatctaaacatagaaaaggtacagcaaaaatacattataaccttacagaaccactatcatatatgtggttcattgttgaccagaatgtcattacacagtgcattaatgcagatgattaaggctgtgcacgaagatttacttacagaaatgtttataacagtattgtttctaagcatgaaaaaatccggattccaacaataggggactgattaaacgtgttttgatttaatcatgtagattcggtacttaaaaattatgatgtagatagatgtatttcattatcagtaaggaaagagattaattggaaaacagtatgtgtattactttgtaatacaagaccaccatgtatgatgtctcatttttatgaaattaaagggtctagtacatgcagaaactttatcaaggatgcatgtaaaatttgacagagcttgaacatgtgtcccaaggtggtgggattgtaggcaactcaaaaattaatatttgtcttctctttctcctcctttcatgtttccaagactttttatgatgagtttgggtaacttttaaggagttaaaaagcagtgtaacatttcagaaattttggagagaaaatctatcccatggcataaaattttcattttttattgtttttcatggttttttttcatgtgcatctatatttgtaacatagttgtaattatactggatatgccactctaatctattttttatcacctaaacatttcttcatgttgctacacagtctttgcaacttcattataaagtgattcctgttctgtgaaatggtttctccctgatgattaggaagcttgaaatataagacaagtgccagtgaggcttctgctttcctttctgggagcctttcttcaaccttgagttatagctgccaggtgaaagattggcagtgactgaatgaggccttggtagtccagcttcttagttccatgctgccagacagaccgtcagagcagaacagataccttcattttgtcataacttttttaaaaatggcaaaaaataatagccacatacagtttgttagtgaggtgaaattcctcatagaacaaagacaacaaagaatataaaatgtttctaatatgttaaaatatattttatattctttgtattctttagtctgaaaggcttaaatcttacatttctggtgggatttcagaaaaaaaagttttcttaggtaaagcgtcttttttcccttaaactagcccatttgaaactcttctgtttctgaatgaatttcacctaacctgtctacagctatattcacagacactgtttttccctttacagactgaccctaccctttctgttacaaaatacagaaacgttgccagtgttttttggttggttggttggtttgaggtgttttgttttgaggactgttcacttttctttctttctcatcgcatgtaaacaagacattaaagtttaaacaaaatttaatttcaccttagttcctaaagctgactttatctatttgtctgtgtttcactcagtgtaaccttgggatccctggagcaggtttttattttgttttcttttcttttttccttggaatgcttgtgtctcacggccagtgtgtctaagggttaggagctgcaccttcccgcaagtcaaaagggccagccgaatcctgcctgagccggtgctttgctgcttcctacacaggtttcagacacactgatcctaatcttctcagtcaaactccaagacacacagtgtcaacagttacggcagccacaagttcattatctacatagggcgcaattacttggcagctacctagactgtgaggtttttgtgggtccccaaagaactcatatcctgaagagagagactaatcaaggcgggtcctcttggcagggacattgaaagggtgggttacaattgataggaattttaatttgtgaggacttaatctgatatgcttttggaacaagatagtgtagatgtacttattgtccatcttctgggagcattctttgaagattcatttgattgtatggtgatagtattgttgaaaggacacagaattttattacatgaatctgcttctatccttcacctgcctaactgcccagggccactgcagtgatttattcagcctgcattgtggtgagggaagggacgactaatgtctcaaacagtgtggtgttccctagtctgctctcctgcttgctgaaagctcctttttgggaaggcagatgcttagtttttcaggaagcactcacttaggatgcagtattttagttttaaataatacgcactggttgacctttgagcggacagaacttttgttgctagaacctggtggcactggtgtgggtgatgttaattaagggccaggtcctgacaccaacaaagccaggaagtttggaatatataatcaagacaagccagaagtagctacagagtgggcctgtactgtccttccgtctctcgtctattgaaagtaggggccctggatccaggaggccagcttatcaggagacaagagtgcattcctttacctgccttggtcggagcacttgaacacttttacagagcactcccaacccctaccattcccacccccaagacagggtctcactctgtttaggctagagtgcagtggtgtgatcttggctcactgaaaccacaggctcaggccaccacaccagctaattttttttttttttttttttttttttgtgaggatggggtttcgccatgttgcccaggctggtcttgaacaactgggctcaagcaatccacctgcctcggcctcctaaagtgctgaaattataggtgtgagccactgcacctggcctccacagtgtttttgagggtaaacgtatgctatgccacgtcaggatgatctgtctttgacttctgtcgggtgaaaaacaggattgggcatagatgacttcaccaaatcaattgtgttttcaggttaaataatgccctttgtcacaccttttagcatacaaaattagacttaccagtattgttgcctttaaatttaatccagtcttgcctcaagagcagcagttctcaaagtgtgatctttggttccctagggccctttcagggagtgtgcagggtctgcccttgagcaacatatctgtgtgaggctggatttccttcatctgcttcaagcagaacaacatactgcaacagattaaacacagatgcagatacaggaattcagctgtcttctgcaaatctagacattaaaatgtaaaacaatgccacttttttaactaaaaatatttttttacataatataatttttttcctcaaaatatattgtttatattcatttttcatacttatttttaaatgaattaatatttttaactttctgttttagtttctgatatagtaaataatgatagatattagtccacataaagaatgttttcggtccctaataattttaagaatgtaaagggcagggcttgaggccaagaggcttgagaactgctcactaggggaccctcttgctagaaacacctacttctccgttctcttggtcctgtgtagtgggaaatggtatagcacaggcctaggtttatgagaactgctcactaggggaccctcttgctagaaacacctacttctccgttctcttggtcctgtgtagtgggaaatggtatagcacaggcctaggtttatacaaactttcagagaaaaatggctccagtgtttactataaaacaagtagcagatacggtcagatgacagtcgtggtgctgatggccattgctagtccgggagcccttggatgtgtgtgcctgcctttctcttgattcagtacacatcgtttgctctgtgttctgtctgtggcccagcagcccattcttgttttaaatatacggacttcagtctctcactttaattttgctcttcttattagcaatggctcgggtaaagcatttttttcccatttaagttttttggagatctgttcctgaaagaacagatttgtttgtttttgtttttttaactttcagtagtttttggggaacaggtgggttttggttacatggataagttctttagtggtgatttctgggactttggtgcacccagcacctaagcagtgtacactggtatgttgtctttgttttatccctccacccctcccactcttccatcctgagtgcccaaagtccattatatcattcttatgcctttgcatcctcatagtttagctccaacttatataagtgagaacatatgatatttggttttccattcctgagttacttcatttagaatcatggcctccagctccatcgaagttgctacaaaatacattatttttttcctttttatggccgagtataatattccatgatgtataaatatcacattttctttatccactcgttggttgatgggcacttaggttggttccatgtttttgtagttgtgaattgtgctgctataagcatgcgtgtgcatgtgtctttttcatttagtgacctcttttcctttgggtagatacccagtagagggattgctggatcgaatggtagatcgttagttctttaaggaatctccataccgttttccttagtggttgtactagtttatattcccaccagcattgtaaaagtgttcccttttcaccacatccacaccaacatctgtaatttttttgctttttaattatggccattcttgcaggagtaaggtggtatcacattgtggttttaatttgcatttctctgataattagtgatgttgagcattttttcatgtttgttggctgtgtatcttctttttcagattgtctattcatgtcctttgcccattttttgatgggattatttggttttttgtttgtttgtttgtttcttgccgattgtttgagttccttgtagactctgggtgttagtcctttgtcggaatcatagtttgcgaagattttctcccactctgtgggttgtctgtttacactgctatttctcttgctgtgcagaagccttttagtttaattaggtcccatttatttatgtttttgttgcatttgcttttggggtcttagtcatgaattctttgcctaagccaatgtctggaagagtttttccgatgttatcttctagaacttgtattggtttcaggttttagctttcagcctttgaccatcttgagttgatttttgtgtaaggtgagagatgaggatctggtttctgaaggggaatttgtgttggcctagtggagcctgagatgcaggttaatcctccttatggaaggcaactattactaggatgggtacccgatgacaccacactttttctctcagctgagctttcaaccttaaatggggcattagtgccggggcacctctgtatagtcctaacccactggagaggccttcctaaggagagcaggttaagcagatgtctgagtcttctagttccgcctgatcgtcatcgtagatttcctcctaggaaaacaaggactgttttatcatttgactcccacactatcatctgcaaataagtgcatacctaggaatgatgacttggccccatcagaatgctcacagcagcccgcctggttgttgtaggagtgtgtgatagaaaggaatgggggagaacagccattgacactggtagggtaagaaaggaactgggatgcttgcccttctgaccctagagatttatgccctaggtgtggctgtatgaatgagaagtttttctgcctccctactagtatacaggtcatcactcaccatcaccaaggcagcggaggaagagagcatcagtacaggatctggtgttagccttaggtccaaggcccagctctgaacctcaccatgtgacctgggcacatcacctagttactcaagacccggttttctaatttttctaaaaatagagccatgcctgtcctatctgcttcacagaattgctaataagatttagattaaatgaaattacagatgggaaagctgaaaaatatgtatgaatattagttttgtaaaaggtttatcctacaaaaagggtttctgctctttgtcccttgccctctggactcataagtcttctgttcttttctccaggttacctgtgcatgacagatgagtggttctctgagtatgtctacgaagtggtggtggacaggaagcatgtccctgaagaggtgctagctgtgttagagcaggaacccattatcctgccagcatgggaccccatgggagctttggctgagtgatactgccctccagctctttcctccttccatggaacctgacgtagctgcaaaggacagatccagggactgaagccaaagttatgcaagggactgtgtgttgccacaggacacagtcagatttccagtctccaccaggaacctcttcagaaagtgtgctttatgctgaaacagaatactgttaaaggaaaaaaaagaggggggaagatcaggtcatactatctactctcctcatctctaacagctcaggatctcttagcattttaattagatgtaattgtttgtctttaactgtcaaaaagtttggttctgtgtctgtgttttaataagacgagaggacgagcgattgaggtgtatggagagaaaacagacctaatgctccttgttcctagagtagagtggagggagggtggcctaagagttgagctctcggaactgcatgctgctggacagtatcactgtctttcctagatggcagtcactgaattccattttttcaaggtaatttcttgtgcctctaatagcccaagaatgggaggttgatcagatctgacatgattccttcctgttctgaactgtggggtgtgcacatctctgcttgagtcaggtttgagtagaggcttagagacagttgggtgagaacaaccaaaatcttatcatggtctcagtcataatcattagggggaactctagccaaatggtttaacttctgcctgtggaactggggattgggtgggcaggaaaaggtgatatccattctttctgataactagatggtgctgagaagcttttgaataaaaactttgctaaatgagaataagctgatttatgtgatctgtctgagaagtgtttgtttatctacaaaagaaagcagccaggtggctcatgttcttgaaagtgaaaaaacaggaaaagggcttccctcttcagcttctctgcaagatgtgtactctttcccagaccgccgattctcaccggcatctgcaaagggcttccaagcgcctgtttaagaaggactgttcccctaccgcataaatgttctacccagatccagggtccctacaagggtggggagtgaggctctgttgggcccagccttagaataggtcagtaagttatcttactgagattgggccaccctttcaagaacaagggtaaaatagaaaacattttcacaaaaaaaactgaatttgccccaacagaagggaagtgatcagtatggaagggttgaaatgtatcaaggaatgtagaataaagaacatgattgttatgttggtcagctacacaaaaagcaactgtagaagagtcttaacagggttggaaaaaaggtaaaacgaaaatccatgaaggtagcagataactagggaggggaggtaattggaatgaacatactctaagatccttgtgtctttcaggaagaagataaatacattgtttaacttcagactttggtatgtaaacctgtgccaaaaacttctatagtatctactaaaaataagcagaggatacagttttcaatcaagaataaatagaatggaaaaatgcaatcagtcaagaagacaagatagggtaaagaaaaggcaggacaaatagagcatccaaaacaagatagtagagagaaatctaaatgtgccaataattatatgtaaatggactaaatgttcccgaaaaaaaaaatgccaaactgtatttttaaaagaaatccagccatatgtgatgacaagagagagacataggcaacctacaatataagaaaggatggaaaagatacatcaggcagatactaaccaaaataaaactgagaagttatactcataacccacagaattaaggccactccaaagtaacgaaacagactgtctaatttcagtttatttgcataaactgtaatgtgaatgtcctccctggagctgtggaacaccacagccctggaaataggctttaagacaaaaagcattactacagatcgaaccactacataatgatatgcttacccaattcttcagaaaaacaaagattctaagttatgcacctaataacattgcctcaaaatatgtaaaacaaaaacagctatatggaaaaataagaaatccagcatcatagtgggagattttaatatgcttcatgtagaccaagcaacaaaaaattcaggaaagtatataagagatttaaacatttagcaagtttggtaaaatggacgtgtttagaagaccacatcttcatcctgaaagcacagatgtgtggaaacgcaatgaccgagcataaacctgttaaaaaaaaaattgcatctaacaactgcacattcattttgatcacctatggaactttttcaaaaagcgaccatatactggacggtagagtcaatctcaacaaatttgaaagggttgttaccacgtagaccacactccaaccacagtgcaattaagttagaaaccaaaattaaaagattacaagacgacctctgtatgtttagaaattaactcatgggtc

SEQ ID NO: 15421 - DNA, 92232 bp, Human
  misc_feature (1)...(92232): n = A,T,C or G
ggaggtggtgggcggtctctctgtacagagttgtggctttgtttctgatgagttgcagctgctgtgcataatgtagactagatcaaatggggcatggagaagagccattcacaggaccggagtgacggtgctcgctctgatggcagaatactaaattaatcatcttcacctaaacctgtgctttctcctggcctgtacctcagtgaatacctgcaagttgcttaggctgtaacttgaagtcagcctacaatcctctttgtctccagatcctgtccactttcctttccgaaggtctttcagatccatttccttctttccacctccactggcactgccctcattcagagtctcatcatgtcttcctggattgcagcttccttccaggtctctcagcctcaagtcttaggcctcccattcaattttccgtgttactgtcagaggaatttttctaaactagcttaaaacccgtctgtggttctccatggccttccagatcaaatgtgctccctgaagactggcctgtgagccccttcacaccagtaatcctgaccctgcatgcaattcccagaacacaaggcatttgttctcaaatcctgcggctttctttgcttgcttctcctcctgcctgggatccttcccatcctccatggtttctctcctcctttcctcctcctcaagttcagatatttccctcacctgtaccccctctgttgtagcatttatcacaaactacactgaatctcttgactgggcagaagaatgaattgtttcccagcatctagctttgacataaaagttgctcaataaatacttgacgaatgaatgaactctattaaagtagggttcagtcatagttcagggaaggggccctgaaatagctggctctgaaagaaggtaatgccggttattgcgattatgttgttagatgggtagaatttcgcattcgattaagggatagttttgggtttcttcaagctaaagaaactaaagcctataaaaggtgatttaaaagacctcttctctagacttgatgaaacgctgtaattgccatctttggctaacactgaggagttcaggaatgccaagcaagtgtttccagaaatgtcaaacctgctgttttaaaatatgtcattccagggcacagttaaatatacaacttgctccgatgaggtgggagaagtgggccggtgagctgtgaaatgaaatctgcctaatgagggtcgaggccagcacacacagggacctatttgcagtaaaacaacgtggggtgacgcctaagaaatagacaacattaacacaaagggagcctactacgtagcacatttccgctaggcataaaagagacacctttccagaaagcaactctaaaaatgaatgcaccgcctagtgaggtgcgagccttcctccccacgaggcgtcccgtgcaaccgcacgcggacagcggggctccagcggaggcggggtggatgcggagacaaggcgcctaggagactgggctaaggctttgagtgtccgaacgaagattctttcgaacctattgattttttctagtcttatgattctttcgaaccttttgattctttccattctcggttctaagcattaaagcgcagctgagaaaggcagcaacaaagatgggaagagaactagcaggagttctcagagaaaaatgggtgataatttaggggagaagccataaagaagagactaagcgagaagcggagcacacgcagaagacgaaacaaggaggaggagaagagaagaagaaccttggcgaaggaagagagtgaccaaactcgtcccggacgggaggagggcaggcccgcccagagggaatcggctgctttaagggaagccccgccccctggtggtgacgctccaccaggcccgtccgcgattggctgcggccagagggcgggatggggttgctaggcgaggaggggatccggcgggcccccgccgcccggagcgctgagccgcgggagcggagccggggttagcggcgctgctggaagatggcgagcggccgggacgagcggccgccttggcggctagggcggctcctgttgctcatgtgcctgctgctgctggggagctcggcccgggcggctcacatcaagaaggcggaggcgactaccacaactacgagcgcgggcgccgaggcggccgagggccagttcgaccgctactaccacgaagaggagttggagtcggcgctgagggaggcggcggccgcgggcctccccggcctggcccgcctctttagcatcggccgctcggtggaaggccggccgctgtgggtgcttcgcctcaccgccggcctggggtcgctaatccctgagggcgacgcggggcctgacgctgccgggcccgacgctgcggggccgctgctgcccggccggccccaggtgaagctggtgggcaacatgcatggcgacgagaccgtgtcgcgccaggtgttgatctacttggcccgcgagctggcggccggctaccgccgcggggacccgcgcctggtccgcctgctcaacaccaccgacgtgtacctgctgcccagcctcaaccccgatggcttcgagcgtgcccgcgagggcgactgtggcttcggcgacggcggcccgtccggggccagcggccgcgacaatagtcgcggccgcgacctcaaccgaagctttcccgaccagtttagcaccggcgaaccccccgccctggacgaggtgcccgaggtgcgcgccctcatcgagtggatccgcagaacaagtgagtgttgcctgccccctccccgtccgtgtgagcctccaagggccgaggctggttccggcacccagtaggcgctcagacaatgctggcataaggggtggcggtggtgaaggtgaagggagacaccctgtaacggggacagggcccaggccgcgtagcctcccgtcctgctaatcatcaaagaattgcctcctagaggctgtcatttgttcaagggatggctggaggggacactcctttctgacatttctggtccctattcttacaggggcatagaatatgagcgagaagagatcttaaggataacctaggtcagctcacacattttatagataagctgtcaatgttgttatcttatatcaaaagtgcctaatgttataggcgctgtgctaattttttctgtgactgcagtatctcactttattttggccacaacctgatgtcatagacaccatcagttttgcatacggggaaattgagggtcagattggttaactgatttacataggagtgtggctgggacttagaattaggcaatctgattcccgatagtcctcttagccacggagggacactggagcccaaaaatggcagatgatattcccaggatcttccccttgcctatttgacagaagctgatttttctccaatttttacctctgactcagcttaagaagatatggacttagctggagaacttgcacagatctgtgagccgcttcattttagactctgaagggtttgtgatgtcatttgtgcaccttattagcctgggcagaatggctaatggtcacacttctaatacacactttaagtgttattaagcattgcatgaggtttaaaaaattacaaagtagaagaaggaggacctcaagaaattagtataaaacaagagaatgttataaatatttatgaggtatgttggtgtacccagttaaactttacaggaattgttcccactggcaagatgtgtgtgggctgcaataacacggaccatctctgtggaagaggtagagcttgagctatctccagagatgggcaggattttcagcaaaaaggagaggaataaaataagagggaactcactccagatggcatagtgtctgaagtgagcaggcatctcttccccttttctagcatcagcttttccccatttttgtatcttcataaggcttttgaagcaataactgatcattccatctggattaaaagaagatttctgagggactgctaagataaagaagtttccctgcgggacttggaatcatttcttctacaagatttcagtcatatatagaagatctagaaaattcttgagtgttaggacagttcctgagtcttttcgtcttctatcttttactttactcctcttgataagctctcttgtagatatataatttcacatagactttctgggaggatttttttttcttttaaatacgatcgtgtcatcacctctgaacatctgcgtaagaaatatgactttgacatacacttattgacagagctgtgatggccagggctttttggagatgatacaacaaatgcaccgtttgcattgcttaaatgtttaaaatgctctgtccttgcacctttaaaatgctgtgatccttgcagggatgtaaattctgtgcctggatttttcttttcagtattagttgtgctgtgaccaaatatgaaaataagctttttcttggtgcaagtcgccttgaggctatacagagtcattttggtctgtggctgtggactaccctaatcatatctgttcttcaaatatgtaactctcattaatcaaaagggaaagtaggtgatcatatatggtaaagagtacatccatcctaactcagtcttcaagaattcactcaaaatgcgtactctgtgctattaaccaataacaaaggacactgatatgtgaataaaattaaaaacacaagcacacacacaatttgatattgatgcctaaatatagtgtcaactttatggatgggatatttttaaatactcaaacattagtctgtatgggaaaactacctttttcagtgtattttgtgaggtaaaccatttgagtaatttcttgatatcctattcacccagctatattcgaattagatttttgttgttatttcgaatatgtaaaattttaaggcttaatttcctccagcttgggaaaatgaagtttattttctttgtttcactttatacttcatccaatggatgttgagacaaatacttaagaaaatatataaaaaaattaactttatcattcaaatgaagattttatagttgactcctatttttttatagttgaccgctatgcttctttaagtgaatatacctgcttaaattttcataggtaattagcatataaatgatatttgaatgtgtttgtgaaaagcattattacagtgttgagagtgggtgcagatgatttttttgggggcttatgtatacatatctatgattgtctgaatctttgaaatttagtttgtcagatatcaagttatcttaatttttttcaagttatctacagggttacctggatagcgtaatagagttaatttagagattaactgtttaatatttataaactcatttgtaatatctctaatatatttaccagctactttaaatcttatgcaaggaatgatatgtgatactgaagtcaagtatgagaaacatttcagagaattgatttgaatggaaaccataaagtacctgtcaaataagattggagttgatttgcaaagttgatttgacaaaaactcaaagcataatcttacagccattgtagtcactttctcttgaaatcttcattgtaagaatgacactggtactttcaaaactgtgtaattacagtaaggaaaatcgaagtgaattttattactcaagtagattgcaaatatttcattgttcaaaagtatttgattaggccattttgacaatatttctgagaagtgttggaagaaatgttgaacaaaatgagaaacagcattttgtagagaatcttggattttaaagttttacttaacatgtgtaattaaagtagcatgctttacttatttagaatatttaattatccattttattttactagaatatgaatgcccagagggtatttgtttgtttgtttcgctcacagatgtatctatccctggaatgtcctttgggatgtatctgtccctgaaacgtcatttggcaaatagttgacactcaagaaatgtttgttgccgaatggattacctgacctgccccagccttcttataactttcccagagtcagtgggggaaaaatacttaaaaattgttttagaattacaaaccagagagtaaattgttaataccttagctataggggagaggtggttagagtggagttagaaagttagaatatttacttagtttttgtttctgtatcattctattacccaaggactggcagtggaagtggggagtagaatgatagtttgtaaggcagtgtttccttaaacaggatgctagatacctccaaagaaatgaacatttgttgagcaggggctataaagtagtctttatgccagattatgtttcatgtgtgttatcttaattttcatgacaactctgggaaatgggtagcattaatccccattttacaaatgaaaggaaaactgaggttcagcgaatttaaaggcagtaacttctcctgattatgttatattactggtgagcaacagatctgggagacggaatgttcttacccaaatttgtctccaaagcctgtgccattgccactacaccaaatggcattcttctctggtgtctggaagggtgctaattataattatattagtttttagctagtttcttttcatggtctatgctagtgtttaatcagtgtccttattggcaaagatctgtcttctgatgaacagattttgtgttacaagtaattttcattgtttgatcttctctgggataatactactcatcatgcttaaaatagtctttcaaattagacatgataggtttacttttttttcaagcatatagaaaaatcttatatatcaaccccctttagaatttctgtaggtcagttaatttcaacaacagaaaggcagaagcaagaaaatcctatttagaatggaaaaagaaaagtatttaatctctactgatagtaatggtttaagctgttatataagggaaagatgcttaaataggactttagcattttttttgcctttaggttttagcttttaccataaaaggaattcttcagtatttctatatagataagtttgaccaaattgtaaattggttcacttaaaagtagaagcattaaaaaaaatgtttcttttacaggagcagccttgcctccatgtcaatttatttttttaatggcccaatcagaaacattgggccttgaaagagctgcttctacagtgatgtattggaggactagtctttgacatggtgtattgtttttctctgtaagcagctcactgaatcaggttgttttctttgtttgtttttttcctgaatcttctcaactatggcttctctcttgaaaatgtgaatttagtatattgtgaaactggagtgaaacacaaaatatccttttaaaaattagacttcctatcttaaaaattctctttggacggtaaatgtaaaaagcataaaagttattaacctaacatatatgcaatgaatatttatatataccagccatattttctgtggaatttacgtattatgaaatacaagtcgtagactgaactatatgaaattgtcatttttttaggtcaaaaaaatgggtgagggccaggcatagtggctcatgcctctaatcccagcattttgggaggcctggcaacatggcgagaccccatcactaccaaaaagaaaagggtgaatattggcaagctcaaagctcatatagttcaacctaatacatgaatttagaattccctaaataagacatttcctgaaatattaatttatactgtgttatccagctattttttcaatgaaggaaaactctttaaagttagtttaggttaacctgaattgttaaaggtgtttgaaatcttaaattgataatactttctttccattttctttttttgttgttgttagtctccttataacagataacagctgatagagttgttttctaggtctccaagagagatattggagtttatttctaaaagattttgtggaatttttttaatgcatggtgttttgtgtccttttttagtgatacgtgatttggttgtattttcaaaggtttgtgctttctggaaatctgcatggtggctcagtggtagcaagctatccttttgatgattctccagaacataaggccactggaatctatagcaaaacctcagatgatgaagtatttaaatacttggcaaaagcttatgcttcaaaccaccccataatgaaaactggtgagcctcattgtccaggagatgaagacgagactttcaaagatggaatcacaaacggcgcacattggtatgatgtggaaggtatgcaaagcattgagtttgctacattttcccccttgttcgttgaattttgttatgtgtattctgagcaaaaaagaagaaactctgtagaaatctaactttaaaagatatttatttttattttgaaaatttcaaatctacagcaaaattgaaggactacatgaagacctatctgtccttcatttaaattcaccactgttatcttatcccagatggcttgcctctccctctctctttttcactctctacatgcacgtgtatgtgcatgcacacacacacacacacacacacaaatcacacaatttttttgccaaaccatccaaaagtaggttgcagatttcacaacactttacctataagttcctcagcatgtatttcccaagtacagggacattttcctgtttaactatatactattaccataactgagaaatcaatgataatttaatattatcataccacatgccatccgtaactcagatttcccccattatgtccaaagtagccttggtagcccctttttatccagatctagtatccaatcaaagttcaagcattgcagttggctcttgtaaagagaccgtgctaatagtcctatggaaaaattccataatctagattgtcactttcttcatggtaagattaggtcaggtttcccagcaagactattatatagatcatgttgcgcattatatcaggagacccataacgtcaagctgcaagtggccaagttggacagcttggttaacatgatgaccaccagcaaccaggtctctccatttaaatttaaaatgtatatattttttaagagatagggtctcactctgttacccaggctgcagtgcaatagtacaatcatagctcactgtaatcacaagctcctgggcgcaagcaatactcctgcctcaatctcctgagtagctggaactatagatgtgtgccaccatgctagctaatttttaaattttttgtagagatggggtatcgctgtgttgccgaggctgatctcaaactcctgacctcaagggatcctcttacctcaaactcccaaagtgctgggattatagatgtgagccacttcacccagcccagatctctccattttacataaaggcacattttccttttgtattttaatctgtgaggtgatcatggaatgctgttttttttatttttattgtggtaaaacatacatatatatatacataacatgaaatttgacagtttaactgtttaaacatttttaagtgtagagctcagtggtactaattttcacaatgttgtgcaaccatcaccactatttctaaaacttgttcatcatcccaaacagaaactcggtaggcattaaataataattcccacttccatctctatcccttacccccagccattggtaacctctaatctactttctatctctgtgaatttgcccattttagatattttatataactggagttatacaatattcttccttttgcatcaggcttatttttcttaacataatattcttaagggtgatccattttgttgcaggtatcagaactttattcatttttatagctgaataatattccttgaatgtatatgttagtaatacattttgtttatccatctattgatgagcactgggttgtttccaccttggctactaggaataatgcgtaatgaacgttggcgttcaggtatctgtatgagtccttattttcaattcgtctggatatatacccaggagtagaattgctgggtcaaatggtaattctatgtttagctttgacagactattttccacagtagatataccatttacattcccaccagcaatatataagaattccaatttcttatgaaatgttattttttaaagaattgtttgttgttgttgttgttgttttcagatggaatttcactcttgttgcccaggctggagtatagtggcatgatcttggctcactgtaacctccgcctcctggcttcaagtgattctccagcctcagcctcccaagtagctgggattacaggtgcctgccaccaggcccagctaattttttgtatttttagtagagatagggttccatcatgttggccaggctggtctcgaactcctgacctcgagtgatctacctgtctcagcctcccaaagtgctggaattatgtatgagccaccgtgcctggcaagaattgttaatacaagcttgaactgtttaccttttctctttaaatgctatgaaaacagctattactctttttaaactttaggtatgctttgaataataacgtttttgtttttatgcacagatgtagatgtagagggaacttagaaggaataagtcaaccaatggaaatgtcatcagtgtaaattttttcttttctaggagtctgcccatgatgaaatgccttaggtcttccttacctttttattggcagtcacattataaagtgtcttatgacatgtctcttaatgtatatttaaacctttgaattactcttttactttttatatcaagccatatgtacccaaaatgggtcataagtttgagaacttaatactttcgttactggatctttggggtattgcttttctggttggaaacctctgtgcctggtggtgcctttgcccaagttcttgtcctgcatccaggaagaatgaggtatgcagacaagtggagggtgagcaagacaaagaggagctttattgagctcagaggagaccggcagtgggcatctcctctctgtaggcaggtcacccagtcaagtgttcagccctcagcacaaaggaaccctggagtgggtggcccctctctacaggcaggtcatcctgatgagtgttcagcttcagctttcagcagagaggagctaccctctggttgtcccatcatctctccatcctctgccttgctctgactgagcccagggcttttatggacctcagaggagaggaagtgtatgccgattggttcatgggcgccacgggcagcctggaaaaggcacaagtccccactccagtctatgggactggcagcctggcccccagccttcaggacctccctggcctgaaggtggggcctcaccagggaccccctcccttatacccaggagctagtctgcctcttgctgctttccatggcaccccggctgctcgtgctaaggggcacctgcaagccagtgctgagtcgccctcagtccccaaccttggttccctcttccatgcttgtcagtgcccagtccggtgggggcccaggcaacagggcccaagcatgtgcgtacccctccgggcagtgacagtgcgccgcctcagctccaaccccaatcccggataggagcagacgcaagaatggggagaggccaggcagcaggagcaggcatctccaagcctgcaagggtaaggggggcctaggaggtcgggggacgcagctgctgccagctcccagctcccgccgactcagtggagcatgcagccccagccgtgccccctgggagcctgtggcgggtggctcctaatcctcgctgggcctgggccagtgtctgggccaggggcgacattgccacaagcttccctgttgccctggggctaaggagtggcccggagctgattgcgggcctggggccaggctgtcaggagtgtcaggctgggaggtcaccccacgtgtggcggacactggggacttggccccaagtggcccgcgcagagcctcctcccgagcccaggaacccgggacccttagtggggtgggcgcagtggctgcacttctggccagatccccaaagctggagcagctcctgctttccgccccgcccccgaagcacagccccagctccgcataggggttcctctctgcctgactacattactcccccgctgtgctgctctgggcctgaccccattacggcagcccccagggcagcgggctctggggggtggcagcgggctgtggggggtggctgcagaaggggtggctgtccgcctccttcccgcaccttccggcctgctgctgctatcactttctagaattttctgatcctcctatagtttctaccagtgtttcttgtatatcagaagcattcaaaaagaggtttgacatactatttagaagtgaaaccttctccccataacaattagaggtgatttgaaaatcattaaaaatttttttgtagataatggacttactttaatgtgtaatttttacatttcagtccttgggaaatatatttaataaaacctaactttgaactggtggttttgtaatctagtcaagttgcttcattaatttgagatgatgttacttaaaataatggggtaaatacttaactttgcctttttggaaaaagttgtaaaaggttagaaagtaatttctaactgacaattaattgaggaaggtaaatgtatctcatactgcttaaaaaataaatatccggcctctacaaaacgtaggtgtactttggtattaaggccagagattatttggtgaagctagttatcatcagatttttctgattattcagacatctgaagaagctacattatgctgctgtcatttttattttcatgagcatcaacttttctcttgtttcagctgaatgtcggatatgtcctatgttatttctacaataactggcttatttctcttcgtacctcagcaaatattgagcagtttccccttgaagaggaggctgtgatggttttagtttcaacagggtgaattcattgtgtttagtgagtaagatgttgtgaaaccttgtgactaggcatatattcaaaaaacccggatgtcctggagtaattttttttttttttttgagacagagtcttgctgtgttgcccaggctggagtgcaggcgtgatctcagctcactgcaacctctgcctcctgggttcagatgattcccgtgcctcagcctcttgagcagctgggattgcaggtgtgtgccaccatgctggctaattttttgtattttaagtagagacagggttttaccatgttgaccaggctggtcttgaattcctggcctcaagtgatctgcccaccttggcctcccaaagtgctgggattataaacgggagccacatgctcagccgagtaattttactgatgttctatgtgatatatttaggaattctagcttaaagaagtatagacctttagagctgaaagtgaatatattgatttagtccaacccttttgttttagagaaaatcaaggcctgagagaggaactaacttgtgcaatataatgtattaatatagcaaatatttactgagttcctgccgtgccacatatactgtattaggtgatgtaccggtatacagtgagagcaaaacagaaacaactcctgctctgaggaatcagatagtatattagtagtgtggaatctggggtgatttgggccctagtgcctttgccttcattgccagggctggcccagcatatctagctgcctatgtgggtgagccttgcttcactcaacatgtctcacaaacctcaggatccatttaggaaatggctatcctaataaggctgatgaatagccacatccccttccaaagcctcgttattgtgagacctactctggacttgttcatggagtaagatgcctttttttttttttgagatggagtttcgctcttgttgcccagggtggagtgcaatggcacaatctcagctcactgcaacctctgcctcttgggttcaagcgattctagtgcctcagtctcctgagtagctgaggttacgggcatgtaccaccatgcccggctaatttttgtatttttagtagaaacagggttttaccatgttggtcaagctggtcttgaattccagacctcaagtgatccacctgcctcgccctcccaaagtgctgggattacaggcctgagctaccgtgcctggccgccttttttttttttttttttttaatcacagtgcgctgatttgtatgccatttgcctaccgttctttcttcacagttttgaagacattgtaaaaatcatatgatgttttggtatgtttattccaaagcagatttaataaaaactgaactgtagttttaggtcaacttttaagccatggcgtgtgcttgtagtcgcagatacttgggaggccaaggcgggaggatcttgagttcaagcccagcctgggcaaaataatgagaccctgtctccaagaaaacaaacagacaaaaaagaattgccttctttcaaattatacaatttaaggaagggcaggcaacgtatagttgaaattatttgatcaaagatcatagttttatgtaacttttagaagttttcttgggcagaacattgttatattttattttcttgcagatagaagaacagtagaaggcagtgcaatgtagtggcaaagagagagctttggaatcccgttgccttaggttggaatcacaactctgccttgactagctgtgtgcgtgtgtgtgtgtggtgtgggtgagagacaaattaatgaatttctctaagcctcaattcccacttatataaaattaagataaatactatctactcacaagattaggaggctcaagtgagaatgtgtgtaaagcactttagcctagcatctggtgccatggctacttatatctactagagtttaaacttactcttgaagatagggactttgttttattccattttctatttctagcacacacaaccatgcctggtatatataaggtaaataatagtctttttggaataaatgaatttttgccatccgaaacataaatacatagttatttgatctttggataatcttttttttttttttttttggagacaaagtctcactctgtcacccaggccggagtgaagtggcgcaatctcggctcactgcagcctctgcctcccaggttccagcgattctcctgcctcagcctcccagttagctggtgttacaagcatgcaccactacgcctggctaatttttgtatttttagtagagacggggtttcaccatgttgaccaggctggtctcgaactcctgacctcaggtgatctgctcgcctcggcctcccaaagtgctaggattacaggcatgagccactgcgcccggcctaaaatcttagatctttagttaatcttataacaatttataaaaatattcttcctagttttgctcctactctgagtaaataagcttgccttactggtagatcctagatcagtattatttgaacttttttttcttacttttaacctataatatgaaataccttttagttgtgtatgtacatttcatatatatgtgtgtacattaaaaaatttcatggaacaatacttttactatacattctggtattatttcttttagtttgttctatatcattctttaaaaaatatgtctgaacccactaatatatctcacaacccactaatgcatgatgaccttcagtttgaaaaaacactattcttgatcaccctgtggtagaattcatttattttcaaattctaagtaggaacaaaacaccttacaagttgtgtgtgataacttattatttgggtttttcctcccaacttgtttatatgtttcagttatttgcagtgaggactgggccacagatatttatctcagatgttctacttttagattgctttccctaaaatacgaatgagtgttgagttaggaaattggtcagaaatatagttgtcaggcctatgtattgctcatgtgagtctatggattctattattagttaggacagctgccataaagctttatatttgtcttcttaagccactataaacttgaggctgagccttttcaaactagtaattatgattgttttctcctctggaagaagaataaactgttctttggatttatcaaattttcttccctctccttttatacaatggacagagttatgaaatgtggccagaaagcatataatgtaaccaattcagttttttgtgtgaatatcaactccttttatcatgcagacaactattctttccccaaactggaggtcagactgagcagtagcagtgtgctttaaatattgaagtatgtttggctggaagtagattgttgatggaaaaggaagagcatggggaaaataattacccacctgttttcaacaatgctgttgaaagtttagatttggtccagaaatggaccagaaagcttatttttgaggagtattttctgtgtcattaaataggatattatgaattaacccagtaacaccagaaaattgtaatctaaaacaaaaaggaataagatgaacagtatgtaactataaaaatacaatatctgatattaagaaacagacaaatccataaatatagtaggaagtttaaaataggcctctttcagaactagtaggtcatagagatcataactgttagatcacaaaaatgtgagtaaggatacagtggatttgaataacataaataaaccaatctgacctaatgaacgcgtacagaatactgtccttatatctaattttcctgcagagtctgtttactaatttgaggtgtggatgactaagaaaccagctgtcacgcttagggaagatgcatctggttctgttagcgcttgtgttactttgtttttaagattatatattaaaaactaaacaacaaagatacacaggtaaaataggcccaggagcagtggagcacacttgtaatcccagcactttgggaggctgaagtaggaggattgcttgaggccaggagtttaagacctgggcaactggtgagacctcatctcttaaaaaatacaaaaattagtggggcatggtgatgcacccctgtagtcccagctacttgggaggctgaggggctgaggcagcaagatagtttgagctcaggaatgtgaggctgcagtgagctatgattgcaccactgcactccagccttttttttttttttttttttttttttttgacaggggaagacccgtgtcaaaaaaaaaagaaaaaaaaaagcttataatacagggttcataggatcaagtctaatacttcttagcatgggagcgaagatcccacagtctgactcaagcctataagtttagcctcagctcctacctctcctctgccaccggactacttgtccttcccaaatgtgaaccttcacatgttaggctatcctctgtctgaagtgcttttcaccagtttagctgtaacctcttctgaaacctctcctataataactgtcactatcctaccttcgagagctttttgtttatacagtaccatcagtataatacttatccacttatgttgttaatagtttttttgtttcctgttagtgtgtgaattctttgatgataaggacagtgtagtgctattcgttttggagttatctttgtgcaaaatgtattggcaggaaagagtcctagaggagggaaaactagagaggtgtttacagtcatctgggatgaggtctctttggagataagggctttacctagagggcatgtaggggaatgaaaagggagtataagatacatatataagaagttatgcaagaagaactgcagaattgaccatcgtttaaatagcagaacagaatgtcaaagagaggatgtcaaagatatgactttgaggattttgagcttggattagaaaaaatgggagtgggaaaaactaattggatggtggggattgggagacagcaagcgagtgagcatgtgtgtatgtgtgtgtgtgtgtgtgtgtgtgtgtgttcgttcaggtgaaagaggagtgaaaactggaaatattaatagtacttgatgtactagtcacaagtacccaatgggcagttagggaataggttctagagcttgggagagaggtcaagatgagaaagagatttagaagttttgagacatttggaaagcatatggcagtgtagatgattttgaaaattgaattaatagtgttttctggcataatttaattgcgtggagctagaagttcaaccagaacatatatataaatgaacagatgggtgctttttttttttttttttttttacctctaaagtgaatgcatttcgtactgggatgttttccttaaggaatgccaacaattcagatattaattctcagcctgatcatattttaaaggtacagttgataatcaaatgtgcattagtaaagtgcttttggtcttacctgatcttgcacattaaagacctggttgaggctttttcttccctttattttctcttttaaaatctgagtgctgcctaatttaaaaggaaagcaaaaaggtaaaacaatactccaaaacagaatatttgcttggagtcacgagttggctttagtaaattgaagcataacctagtataaagactgacctttaggagcagtgcagttgtgtactttgtaacgtgataataggcctaaatgaagagaacctaacactcctttaggatttggcccccagtctttagatctaatgtgtataaattggatgtacttttttcttttccttttttcctgtttaactcaggtggtagagaatgggagagtatatttaaaaaaaaaaaaaaggaaaatacagttcaaagagctatgtgggagacagtgttaaccaagttagacaaaaatgaaaacagatgtaggactgtgtaatttagtttaactctgtagaatcatatcattagcaaatatatattcagtgggagtggtgaaggaaatagattttcacaagataggttgctcagaatacaaagaccaggttcagttagttaagatttgatcaatgtgaacttgaatttaaaaattaggaatttggggaatttttttaagagcaacctctgatttttccattgatttggcccagattttccacctaaaatttttttacaaacgttatgctcattagcttttaaaaatatctcagaaagtacaaaattatcacttaataactcacttattgcctataaaaaattgttcaggaaattcaaagtcgtgagagaatttctcactatccttcaaagtagttttaataaagtaatatcattaagctccaagttgaaatatagggtagaaattgtctgtctatattcctagactttaaaatgcttttcctatttaaaaaaacacattgtagtttccttgtaaaagattaatagggttcttgtgtaatgcagtttgacactttatagttggcctgcagaggcaagtaaaaaaaaaaacaaaaaaaacttgctatgtttcttaacactgaagcattggctgtattttttcttttggctttctgtttgagacagaagagtgaatctttagtatctttgaatgaaggattgaatttattaatctcccctccccttaaaagctagatctttctgtggtgaaaagagtgataagagacttgtttcctaatcaagacggattgagtatcttaaaacatatgaagattagttgtgctacaaatcgattgaaagagtttaatgggtacgagtagatcacttgatcagaagatttagctatccgtaacaattagcattggtattgatcacaatttgcagtattactagacagattcctaatggttacactttgagtcttgttctttgatactggtaaatgaatggtaggtttctttctttcctttcctttcctttcatttcctcttcctttctttccttctttccttcctctctctctctctctcttaatttttagatctcagttttcatacgtattctttcctaaaattaatctgcctgagaaagatacttgctgtggaggttctatctcatattctcttctcccaattgactgaagacaggcatacttttctacccacctgaatcacattatggtgtattgccttggagttttacaaacttccagggcactaaaacaaaaggaacaatttggtgattactttaatggttaaacagtaccataagagcatcacccccaatttttctttgaaagatgtattttcagtaattatttcttatatttactattttattatttaccaaaatttgtaaaaaaaactatgcctttttgataaattgtgtgctagtgactattgtaataattcaatttagaggacacagaattaatacttagagcattacagtcattggaaattaagaaaaatttaaatacactaacatactatagattgaaaaattatagaatgattggtgaaagactttcaagcatgcaggtatatcacattcaaatagcattctgtggaggaagtagaatggaaaaaaagttcaaagagaaaaagagaagatgtggctgggtatggtggctcaggcctatgatcctggcactttgggaggccgatgcagaaggattagttgagctgaggacttcaagaccagcctgagcaacatagtgagatatgtctctacaaaaagtaaaaataaaaaaattagccaggcatggtggtgcacatctgcagtccagtctactcaggaggctaaggtgggaggatcacttgagcctggagggcaaggctgcagtgagctgtgactacgccactgcactgcagcttgggtgacagagcaagactcctgtctcaaaaaaaaaaaaaaaaaaaaaaaaagaagatataaaattccttaaagaggcatgttcaggcaacttttaaatagatatttctagaaatcaaatctctggcatttttatttggatatatttaaaataataatataaaagttttatttaaaaaaaactggtcatggtgcagtggttcacacagtataattccagcactttaagaggccaaggtgggaggattgcttgtgcccaggagttcgagaccagcctgggcaaaatagtgagacactgtctctacaaaaaaaaaaaaagagaaaaatttacattatgcaggatattcctttgtttacaactatttaaacttaagatgaaaacttgtgaataccaacttaaaaatttgtgaagcgtcgcatattttttcagttattttagtattaacaaacaaattgaagatcattggtttatataaccccctgagagactaatagtagaatagaacagaataatagaatagaatagaatagaataatagaatagaataataatagaataatagaaactcgcttatttatgattgttaataagtaggataaattgcagatcatttatactattaaagtgctttattgctttgaggtgtgcctgtaactgaatgttttacttccaaaattaaaattttctttggctgaataaagatattctgaaacctgacatttctcctttaatctttgttgagccaaatgacatatcaacttaaaaagataagcaaatatattaactgaatctggcagtagctgcagctgttattaatgtcaggcctatctacagatcagtggctgctccctgttagggtgaactctagctttgggtaagtaggttttgtgttgagaaaaaaaaaattaagacaacaaacctgaaccagctacttagttaggattacttattatacagtctttgacatttggtttcagaaaaataaatgttaagtttaacatagatggcaaataatgcctatctgtgacatctcacaaaaaattcttgaattattcataacttaatgtccccatttggttccatgttttaaaataattaaaaaaataaatttaaaaataattttaaaaataaaaaaaatttttttaaataattaaaaaaaaattcctaaaccaaaacttgaagttgatgaataaagacgttttgatattctaatgctaggatagtttatctttttgtcttatgaaataaaaattagtttgctactcttcagacatttatgagtttgaagaagataaaggtagacatcacaactcattaattgccttctgaaaacagttcattattatagactcagaggaaacgtgctttacttttatgagattgtatcaagacagagataaatattttataatatatttatgttattgatttcaatataataacatcgtggtcagagaacaccctttgtatgtaagtttgacctaggtcaaacttaaatcatacaaagtttgacctaggatatggtcagacttggtgcatgttccatttgtacttgaaaagcatgtgtattctgccattgttgggtggggtatagtataaatatcatttatagatctagttagttgatagtattattacatttttctctatcctttgctgattgtcttttctgctgattactgagagaagaatgttgaaatgtgcaaccaaaattgtggatttacccatttttccttttagttctataaatttttgttttatatatttcaaaattctgattgttgcatgcacatctagaattatgtcgttttggtgaatctacacttttatcgttatgtaatgtccctctttatctctggcatttttccttgctctgaagtctattttacctgatagtcatatagctactccatcttttgatttgtgtgtgtatggtgtatttttttcctttcttttaacttacctataccattatatttaaagtgagtttctgacctggtgcggtggctcatgcctgtaatcccagcacttttggaggctgaggcaggtggatcacttgaggtcaggagttcgagaccagcctggccaaaatggtgaaaccccatctctaataaaaatacaaaaattagctgggcatggtggcaggcacctgtaatcccagctactcgagaggctgaggcaagagaatgcttaggaaaccgggaggcagaggttacagtgagccgagattgtaccactgcactccaacctgggtaatacagcgagactctgtctcaaaaaataaataaataaataataagtaaataaattgtgtttcttgtagttgcatagagttgggccttgttttttaatgagttttacaattcctgtcttttagttggtgtgtttgcaccatttacactgaatataattattgttatgtttggatttaggtctactttctcatttttcagtttgcctctctcattttaatcccactgcttcctttttcctgccttctattggattgtgttttcaacgatatcttttagttgctctagtaaatacaagttactacttaacttttcacagttctacctaaaattaatattttacttcaagaggaatgtacgaacctacccaccataccctttatcctccccttttatgttgtacttaacttatatatatatgctgcactgaaaaccctactagacaatgttataatttttactttcaactgtcatacacagtctaagggacttaaggggagaaaaatagctgattgtatttaccatttctgttgcttttcattcattcctgaagttctaagtttctctgtggtataacttctcttctgcctgaagagccttctttagcatttcttttaaagcaagtatgcttataatggattatcttagttttccatctctgagaatgtgtattttgccatcattctttttttttttttttttttttttttttgagatggagtcttactctgttgcccaggctggagtgcatggcgcgatctcagctcaccgcaagctttgcctcctgggttcactccattctcctgcctcagcctcctgagtagctgggactacaggcgcctaccaccacgcccggttaatttttttttttttttttttgtattttgtatttttagtggagatggggtttcaccatgttagccaagatagtcttgatctcctgacctcgtgatccgcccgtctcggcctcccagagtgctgggattacaggcgtgagccactgcacccggccttgccatccttcttgaaggacatttttattggatataaaactcggggttgtggattgtagtttgttgtttttgctgtttgttttttagagtgctttaataattttgtgccattgccttctggcctccatggcttctgctgagaaattcagtcatttgaatttttcttcccctttatacgcacatcatttttctatggccactttcaagactattttattgctgctgctgctgctgcttctgcttctgcttcttctgcttctgctgctgcttcttctccttctccttctcctcctccttcttccttctcctcctctttctcctcttactcctcttcctcttcctcctcttcttcctcttcctcttcttcctcctcttcctcttcttcctcctcttcctcttcttcctcctcttcctcttcttcctcctcctcttcttcctcttcctcctcttcctcttcttcttcctcatcttcttcttcttcttcctcttcttcttcttcttcctcttcctgttattattattgtgagacagagtttggctgtgtttcccaggctggagtgcagtggtgcggtcgtggctcactgcaacctctgcctcccaggctcaagctattttcttgcctcagcctcctaagcagccgggactacaggcacgtgtcacaacacctggcttatttttttgtattttttgtagagacaggttttcaacatgttgccccagctggtctcaaactcctgggctcaagggatccgcctgcctcggtctcccaaaatgttgagattacaggcatgagccattgtgcccagctgactttttttctgtctttggttttcagcagtttgattataaaatacccatgcatggatttttttgcacttatagtgtttgagatttgctgagcttcttgaaatgtaagtttttgtcttttgccaaatttatggtgtttctagccattatttcactttttttttttttttaaatagcatggcgccatttttttttctctcctgagactccagtgataacaatagtaggccttttgctattgttcttaaaattttttcttcttttttttcagatctttttttcttctttctctgttattcataaggcaatttctacttacccatcttcaagataactcactttttcctatcatttccattcttccattaaacccattcagtttatttttttaatttagttactgtatttttctgaaattctgaaatttctacttttttctattttgcatgtttggtatctttcttttactttaagactgtttaatcttacttccttggaaggctgggcgtggtggttcacacctgtaatctcagcaattcgggaggccaaggtgggtggattacttgaggtccagagtttgagaccagcctggccaacatggtgaaaccctgtctctactaaaaatacaaaaattagctggacatggtggcacatgcctgtaatctcagctactcagaaggctgagggacgagaattgcttgaacctgagaggcagaggttgcagtgaactgagatcgtgccactgcactcaagcctgggtgacagagcgagactctgtctcaaaaaaaccaaaccaaaacaaaacgaaaaccttaattccttgtaacatggttataataactgctttaaggttagtctggtaattccagcatctgtgtcacattggagttggtgtctgttgactttttttctttataatatattgagcttttactggttatttgaatgtcaaataattttggattatatcctggacattttgaatcttatgctatgagatctgggtcttgtttaaatcctattaaaacataatacttgttggctgggtgtggtggctcacacctataatcccagcactttgagaggccgaggcgggcagatcacctgaggtcaagaattcaagaccagcctaaccaacatggagaaaccctgtctctactaaaaatacaaaattagctgggcatggtggcacatgcttgtaatcacagctactcaggaggctgaggcaggagaatcgctttaacctgggaggtggaggttgcggtgagcagagatagtgccattgcactccagactgggcaacaagaatgaaactccatctcaaaaaaataaaataaaataaaaataataatacttgtctgtttgtgccatcagggaatgacccagttaggttcagctgcaagttttgactcgccttatgtaagctgtaattccaatgtcagttcagttttcaaagcctttatagtgctattcagatctgtactgtatgtgcaccactcaggggccagtctgggtgctgggcagtaacctgttttgtagttcagttctcagtgcttttggtgtgctgtttaaggtcagacctgtacatgtgcagtttagagatgatcccaggtggtcacaggcaattttatgagatccctttctcacattccctcatatctgccatctcactaaagtctctgtcttccagggtctccagtatagaagataaataaagacatgaaagatctcctttcatgggaaagaaaggatgtgcaatatcatttgttatcagtgaaatacaaattaaaaccacaattagataccactcgtcttccactagaatgcttaaaatttaagagactttccagtggcatgagcaacttgttaggtgatgatgcagaataactaaaacatggatacattgctggtggtaatatgaatatggtacaaccactttagaaaacaatttcttacaaagttaaacttactataagatccctccatgccacctctagatatttacccaaaagataggaaaacatatgcccacattaagatctatgcacagctttaatcaccaaaaaacaagaaacaactgaaataaccatcacatgatgaacagataagcaaattgaactacttttattcaatagaatacttagtaatgtaatggaccatttatatatgaagaatatagatgagtctcaaaagcattatgctaagtgaaagaagcctaatacaaaaggctatatactatatgattttatttatatgacattctagagaaggcagaaatatagggaaagaaattagattaatggtaacccagggtctgggaaccttctgggatatagaaatgttctgtatttttattgtggtggtagttatgtgactgtatacattgcactgtacatgtaaatgggatgaattttatagcatataagttattatacctccataaacttgacttttaaaaaagctttaaagcaccgtgttaactagattgtcaaaattcttttgaatcatttacttaatacttaagtgaaaggaaattatttaagaacctctgtatgcttcaaagaagaataaaattcaaagtatcatgcaaaaatatttgccttgtatatgccgttttataaccttttttgatgcatggtaaatatcgtgacaataaatatatgcctgcagtaatttaaatggctgcatagtagcccattttatatcataatttactaaactggtctttcatttttgaacatttagattgcttccagttttatgctctttcaatttgaatactatagccctcatccttatagctattatcttggaataaatttctagaaaaggaatttctggttgaggtcatacctattttaaagattttatattcatattactaaattttcacccagaaatgttctataatcctttgtcatctcttttttttctttctttttaatgaaagacacttcatctttcattttctttaaaatttctgatggcagctttttggccaacagatattttactagctttttggtagttgaatctgttaggtagttaaatcttttaggtagttaaatctattcatctattattcctctcatggttttatactactttgttgtcatacttagaagggctttcctcattctgagagagtaaaaacatttatgttggcttctggtttcattaatggcttcatttttatgttaaattccatatggattaaagagtttacttggtatgatactgtaaaccaaaaagtatctgtctctaagatgggtctcaatcaatttagaagtttattttgccaaggttaaggacatgcccggaagacataaatacagtcacagaaaccgtctgtggtctttccctttctccaaagatgacttttgagggcttcaatatttaaaggggaaaagtgagctggaggggaaagagtaaaggtcatccacatagtgcaagagaaaaggagcagttgggggaatagtcaattatgtattcatctcatgctcagtaaatgggcacttttcatgagataaggtgaacatgaaagagctacctgtggagatatttacccctttatctgtagctatctgcttaggaacaaaaggaaaggcagcttcttgcatgactcagctttcagcttaatttttttcttttggcatagtgaattgagtgaatttggcatacctttcacaatatgatgtaaaactccaccagtattttttgccacctagttaacctagtcaaccacttttaaccatgtaagagttactaattttttcccccattggttttaaataccttgatcatattccaaatgcttttgtttcagttactgtgatttctatgttgttccgttggtctctttatttttatacctgaagtgaactgctttagtaagtgtagttttattatatgtattttagtaatatggcaatgcaggtcccctcttaaaccactcttattttttaattttttgggagatattctcagccatttctcagaaattctcacaaagttactggtacagtttaacttctaaatcattatgtccagttgcaacaaaaaaatctatgttttcataatatttataaattaatttggggaaatttgatatttttataagcctcttatctagaggcataatacactttactaaaatctcctacatccctcagtagcattttataatattgatttatattatgcattttattatacttcatcctatacattttgtgatttcgttgctggaaactttttaaaaattatatttgctgattattgctgaaatacagtaaaaaatattgatttttatattgtttttaagtagtcatctttttatttccagtgtcattttacatgactttttatttaacttaaatatggtcttatcaaagaaaaatttggggactgtatgtcaggattcaactaatattttctatttccattagattttacactgtgaagctaatattaaaatcagtctataagacctaaaataaaagaggcttgtctccatgaatctgacttttagtaattgtttgtagagatatatattaaaaagtcaatatttatattatatgctctgtcaaactaaggatgctaaatgtattttcttctcttggaattaagtcttattttaaaatgatttctgtccttcctccctacttgctacctgggggatatatttgtatgtgtcattagatggaattcacaagttatggtccaattaaagttacctttaaaaacctgattaggtaacactctaaaatgttactgtaaacttgatcttcttgctgggtcttagctagtatttcttaaattgctgctaaaataggacaattaagggatagacaaaagaatgctaggactcaagcctggggattatagtgttactctacgtcattgccttctagcataatgaaagtgtgagttggccatgtttgcaaattaacacagctattaaattttacatatgcaaaaaaacccttagattagtttacatttatatggccctgaaattgttattattattttttcttttttattatactttaagttctagggtacatgtgcataatgtgcaggtttgttacataggtatacatgtgtcatgttggtttgctgcacccatcagcttatcatttacattaggtatttctcctaatgctatccctcccccagtaccccacccgcctacaggtcctggtgtatgatgttccctgccctgtgtccatgtgttctcattgttcaattcccacctatgagtgagaacatacggtgtttggttttctgtccttgtgatagtttgctgagaatgtggtagtttccagcttcatctatgtccctgcaaaggacatgaactcattcttttttatggctgcattgtattccatggtgtatatgtgcacattttcttaatccagtctatcattgatggacacttgggttggttccaagtctttgctattgtgaatagtgccgcaataaacatacatgtgcatgtgtctttatagtagcatgatttataatcctttgggtatatacccagtaataggatcgctgggtcaaatgttatttctagttctagatccttgaggaatcgccacactgacttccacaatggttgaactaatttacactcccaccaacagtgtaaaagctttccagtttctctacatcgtctccagtatctattgtttcctgactttttaatgatcgccattctaactggcatgaaatggtatctcattgtggttttgatttgcgtttctctgatgaccagtgatgatgagcattttttcctgtgtctgttggctgcataaatgtcttcttttgagaagtgtctgttcctttcctttgcccactttttgatggggttgtttgtttttttcttgtaaatttgtttaagttctttatagattctggatattagccctttgtcagatgggcagattgcaaaaattttctcccattctgtaggttgcctgttcactctgatggtagtttcttttgctgtgcagaagctctttagtttagttagatcccatttgtctattttggcttttgttgccattgcttttggtgttttagtcatgaagtctttgtccatgcctatgtcctcaatggtattgcctagattttcttctagggtttttatgcttttaggtcgtacgtttaattctttaaaacatcttgagttaatttttgtatgaggtgtaaggaagggatccagtttcagcttcctacatatggctacccacttttcccagcaccatttattgaatagggaatcctttgcccatttcttgtttttgtcaggtttgtcaaatatcagatggttgtagatgtgtggtgttatttctaaggcctctgttctgttctgtatctgttttggtaccagtactatgctattttggtgactgtagccttgtagtatagtttgaagtcaggtagcatgatgcctccagctttgttctttttgcttaggattgtcttggctatgcaggctcttatttggttccatatgaagtttaaagtagttttttccaattctgtgaagaaagtaattggtagcttgatggggatggcattgaatctataaatgaccttgggcagtatggccattttcacgatattgattcttcctatccatgagcatggaatgttcttccatttgtttgtgtcttcttttatttcattgagcagtggtttgtagttctccttgaaaaggtctttcacatcccttgtaagttgtattcctaggtattttattctctttgtagcaattgtgaatgggagttcactcatgatttggctctctgtatgtctgttattggtgtataggaatgcttgtgatttttgcacattgattttgtatcctgagactttgctgaagttgcttatcagcttaaggagatttggggctgagaccatggagttttctaaatatacagtcatgccatctgcaaacagggacaatttgagttcctcttttcctagttgaataccctttatttctttctcttgcctgattgccctggccagaacttccaacactatgttgaacaggagtggtgagagagggcatccttgtgttgtgccagttttcaaagggaatgcttgcagtattcaaaaaaactggcacagtattcttgtgccagttttcaaagggaatgcttgcccattcagtatgatactgactgtgggtttgttataaatagctcttattattttgagatacattccatcaatacctagtttattgagagtttttagcatgaagggctgttgaattttgtctaaggccttttcagtatctattgagataatcatgtggtttttgtcattggttgtgtttatgtgatggattacatttattgatttgcatatgttgaaacagccttgcatcccagggatgaagctgacttgatcgtggtggataagctttttgatgtgcttctggattcggttttccattattttattaaggattttcgcatcgacattcatcagggatattggtctaaaattctctttttttgttgtgtctctgccaggctttggttatcaggatgatgctggcctcataaaatgagttagggaggattccctccttttctactgattggaatagtttcagaaggaatggtaccagctcctctttgtacctctggtagaattcagcggtgaatccctctgctcctggactttatttggttggtaggctattattgcctcaatttcaaaacctgttattggtctattaagagattcaacttcctcctggtttagtcttgggagggtgtatgtgtccggaaatttatccatttcttctagattttctagtttatttgtgtagagcggtttatagtattctctgatggtagtttgtatttctgtgggatcggtggtgatatcccctttatcattttttattgcatctatttgattcttctctcttctttattagtcttgctagtggtctatcaattttgctgatttttcaaaaaaccagctcctgtattcattgattttttgaagggttttttgtgtctctctttccttcagttctcctctgatctcaaatgtccaacaatgatagactggattaagaaaatgtggcacatatacaccatggaatactatgcagccataaaaaatgatgagatcatgtcctttgtagggacatgcatgaagctggaaaccatcattctcagcaaactatcacagggacaaaaaaccaaacaccgcatgttctcactcataggtgggaattgaacaatgagaacacatggacacagcaaggggaacatcacacaccaaggcctgttgtggggtgggggagggggggagggatagcattaggagatatagctaatgttaaatgacgagttaatgggtgcagcacaccaacatggcacatgtatnnnnnnnnnnnnnnnnnnnnggtagaattcagcggtgaatccctctgctcctggactttatttggttggtaggctattattgcctcaatttcaaaacctgttattggtctattaagagattcaacttcctcctggtttagtcttgggagggtgtatgtgtccggaaatttatccatttcttctagattttctagtttatttgtgtagagcggtttatagtattctctgatggtagtttgtatttctgtgggatcggtggtgatatcccctttatcattttttattgcatctatttgattcttctctcttttcttctttattagtcttgctagcagtctatcaattctgttgatcttttcaaaaaaccagctcctggattcattgattttttttgaatggttttttatgtctctatctccttcagttctgctctgattttagttatttcttgccttctgctagcttttgaatgtgtttgctcttgcttctctagttcttttaattgtgatgttagggtgtcaattttagctctttcctgctttctcttgtgggcatttagtgctataaatttccctctacacactgctttaaatgtgtcctagagattctggtatgttgtgtatttgatctcattggtttcaaagaacatctttatttctgccttcatttcgttatttatccagtagtcattcaggagtaggttgttcagttgccatgtagttgtgtagttttgagtgagtttcttaatcctgagttctaatttgattgtactgtggcccgagagacagtttgttgtgatttctgttcttttatatttgttgaggagtgttttacttccaattatgaggtcaattttcgcataagtgtgatatgatgctgagaagaatgtatattctgttgatttggagtggagagttctgtagatgtctattaggtccacttggtgcagagctgagttcaattcctggatatccttgttaaccttctgtctcattgatctgtctaatgttgatagtggggtgttaaagtctcccattatcattgtgtgggagcctaagtctctttgtaggtctctaaggacttgctttatgaatctgggtgctcctgtattgcatgcatatgtatttaggatagttagctcttcttgttgaattgatccctttaccattatgtaatggccttctttgtctcttttgatctttgttggtttaaagtctgttttattagagactaggattgcaacccatgcatttttttgctctccatttgcttggtagatcttcctccatccctttattttgagcctatgtgtgtctctgcacatgagatgggtttcctgaatacagcacactgatgggtcttgactctttatccagtttgtcagtctgtgtcttttaattggagcatttagcccatttacatttaaggttaatgttgttatgtgtgaatttgatcctgtcattatgatgttagctggttattttgcccgttaattgatgtagtttcttcacagcatgaatggtctttgcaatttggcatgtttttgcggtggctggtactggttgctcttttcaatgtttagtgcttcctttaggagctcttgtaaggcaggtctggtggtgacaaaatctctcagcatttgcttgtctgtaaaggatttgatttgcccttcacttacgaagcttagtttggctggatatgaaattctggattgaaaattctttcttttaagaatgttgaatattggcccccactctcttctggcttgtagggtttctgacgagagatctgctgttagtccgatgggcttccctttgtgggtaacctgacctttctctctggctgcctttaacattttttccttcatttcaaccttggttaatctgacaattatgtgtcttggagttgctcttcttgaggaatatctttgtggtggtctccatatttcctgaatttgaatattggcctgccttgctaggttggagaagttctcctggataatatcctgaagagtgttttctaacttggttccattctccccgtcactttcaggtacaccaatcaaatgtagatttggtttttttacatagtcccatatttcttggaggcttttttcgtttctttttactcttttttctctaatcttgtcttctcgttttatttcattaatttgatcttcaaccacgatagcctttcttccacttaatcgaattggctattgaagcttgtgcatgcgtcatgaagttctcgtactgtggttttcagctccatcaggtcatttaaggtcttctctacactgtttattctagttagccattcgtctaaccttttttcaaggtttttagcttccttgcgatgggttagaacatgtttctttagctcggagaagtttgttattaccaaccttcggaagcctacttctgtcagcttgtgaaagtcattctccatccagttttgttccgttgctggcaaggagctgcgatccttttcaggagaagaggcgctctggtttttggaattttcagcttttcagccctggtttctccctatctttgtggttttatctacctttggtctttgatgttggtgacctacagatggggttttggtgtggatgtcctttttgctgatgttgatgctattccttcctgtttgttaattttccttctaacaggcccctcagctgcaggtctgttggagtttgctggaggtccactccggaccctgtttgcctaggtctcaccagtggaggctgcagaacagcaaatattgcagaacagcaaatattgctgcctgatccttcctctggaagcatcatcccagaggggcacctgcctgtatgaggtgtctgtcggcccctactgggaggtgtctcccagtcagtctacatgggatcagggacccacttgaagaggcagtctgttcattctcagagcttgaatgccatgctgggagaaccactgctctcttcagagctgtcagtcagggacgtttaagtttgcagaagttgtctgctgcctttttttcagctatgccctgcccacagaggtggaatctatagaggcagtaggccttgctgagctacggtgggctctgcctagttcgagcttcccagctgctttgttaacctactcaagcctcagcaatggcagacgcccctcccgccatgaggctgcagcctcgcaggttgatctcagactgctgcagtagcagtgaataaggcttcgtgggtgtgggacccaccgagccaggcacaggagggaatcttctggtctgctggttgctaagaccatgggaaaagcacagtatttgggcaaaagagtactgtttttccaggtacagtctgtcatggcttcccttggctaggaaagggaaatctccccaccccttgcacttcccagttgaggtgatgccctgccctgcttcgacttgccctccgtgggctgcacccactgtccaaccagtcccaatgagatgaaccaggtatctcagttggaaatgcagaaatctacccctcttctgtgtcaatcttgtcgatcttgctgggagctgcagaccggagctgttcctattcggccatcttggaagtgactgaaattgttatttttatgtgttctctgttttgcttcctcaccaagactctaaactctggatggaagtatatctgttgtttataattcccaatagtcttagtataatcccttacacacaacgaccattgtattgtgaccaatgtagtagtaaaaattggaaaagattttcaataaatattatgacaatgaatgcacgtgtgtttacgtgtatatgtacaagttaaagttaccaaagatgattataggtcagcaatgactaaaggtgactaatatcataatgactaaatatggcttggtagggataggaaaatcagcatcttacccatttcctgccagactcaaggtgaataagagaaagctaaaagattgccttgccctaggagacaaggttaagaccgagttactaggcttatggtggtcataaacctgcaaatattctgagaagtcaaagtctgtttgacatccccatatggatattcaatgggcatttcaaacttaatgctttaagaacaaacatcttaatttcccattgctccaacctccttttattcatttaacatatatttattgaagggctactatgtggcaggtactgttttagtcttggaatgtccatcaatgggcataacaaagatctctgcccttgtgttgtttataatctggcagggagaaacaggcagtagatagtaaacacagtaggtgaattgttaagtgttgtagaaaaagcaacaaggtagaaaaagggtaagaggaactgggagtgctggtgggatgggcttggggatagtgatggagagatgtaagtagcaacttcaattggggaggtcaggatgacctgactccattgtcaggttgaaattggagcagagagctggagttgagggagttagtcaagtagtaaggttatccgggggaagagcattccagcaaagggaacaagtagagcaaagtcaggaggtacttagagtatcccgtgaacagcaaggaggccatgtgtctgctgcagagccagtgatggagagagtataaaaggaggtttaggaaggaaagctgggtgatggggatcaaatcatacagggccttaggccactgaaaagactttggcttttagtctgagtgaaatacggggagtctctgaactgttttgaacagagaaataacatctgacttgcattttaacagaattactctggcatctctgttgagtaaagaatataaaacggcaagggcaggaacaggggaacctgttaagagcaattgcagaggctgggcgcagtggctcatgcctgtaatcccagcactttgggaggccaaggtgggtggatcacggggtcaggagatcgagaccatcctggccaacatggtgaaaccccgtctctactaaaaatacaaaaatacaaaaaattagctgggcacggtggcgggcgcctgtagtcccagctactcgggaagctgaggcaggagaatggcatgaatccgggaggcagagcttgcagtgagctgagatcacaccactgcactccagcctgggtaacagagcgagactgtctcggaaaaaaaaaaaaaagagtgattgcagaaatacatgcagagaaatggcagtggcttgtacagggccacagcaatggacatgaggatgaacatattttggattctgaacatattttgaagttagagtcggcatggttttctgacactttggatataaaatgtgaatccaaggctttttgcctgagcaactatttaatagaagaatgaaagtgccattaactgcagtgggaaagactgtgggtggagcaggtttggagaagataagtagttcagttttggatatgttaagtttgtgatatccaagtaaagattttgaataggcagttggatgtacaagtctggagtctgggaagaaatctaggctggggacagaaatttgagggttgtcaccctgtagatcatgtttaaaaccacgggactgtatgagtttcattataccaaggaaataagtagtaagagaagaggaccaaaggcagaaccttagggatgccacctctgttgcctttgttctctttcatcttttcagtaaatggcactactatctccctgatttctcaagcctaaaatctagaagtcgtccttgatttcttccttctacatccagacccgtcctctttgtctccactaccaccaacctagtccaagtcaccattatcttctaatacatctccatgcttccccatttgtccccctacagtcattttccatccagcagtcagaatgatcttgacagaatgaaggtaattctaattgtatcacacctctgtgcaaagcctgccagtgttctgcacagcaaacattgtgaatgaatgttctgactcacaaatcactgtgaaatattgtccaacgtgaaacagagtgaaaaggcagcctacagaaaggaaaaaaatatttttttcttagaataaaatattctaataaaatattaaccccctaaaaaggggttaatatccagaatatacaaagaactcctacaacataacaataaaaaacaaataatctaatttaaaaatgggcaaaggacttaaatggacatttctctaaagaagatatacacatggccaacaaacattgaaaagatgctctacatcatgaatcatcacatacccatgttcattgcagcattattcacaattaccaagaggtggaagcaattaaatgtcaattgacagatgagtggataaagaaaagtttgtatatacaaaaaatggaatcttattcagccttaaaaaagaagggaatcctatcatatgctataacatggctgaaccttagggatattatgctaagtgaaataagccaaaaagacaaaatactgcatgatttcacttatatgaagtatctgaagtagtcaaactcttagaaacagaaagtagaaaggtggttgccaagagccggggagagtggcaaaaggggagttgtttataatggatatggagcttcattttttgcgagatgaaaatgttctagggctgggtgcggtgggtcacgcctgtaatcccagcactttgggaggccaaggcgggcggatcacctgaggtcaggagttcgagaccaacctcaacatggggaaaccctgtctctactaaaaaaaatacaaaattagccgggcgtagtgctgcatgcctgtaatctcagctactcaggaggctgaggcaggagaattgcttgaacctgggaggcggaggttgcggtgagccgagattgagccattgcactccagcctgggcaacaagagcgaaagtccgtctcaaaaaaaagaaaatgttctagagctctattgcacagcaatgtggatatagttaacactattgtactgtacatgtaaaaatggttaatatggtgaaatttgtattatgtgttctttagcacaataaaacaaaaaccaaatccctcctgtggttcctactgcacttagaataaaatccccaacttcttgccctagctgccaaagctgtttatgatgttgttttgccagaatccctcgacctcaacttgtgccattcttcctttgtctgttattgtccagccacagtagctttctttctattccttacacttaccaaacttttccccctgcctttgaaatgttcttcccgctgacttttaccaggctagctgcatcttgtttttcagatcttgacttaatgttacctcctcatgaaggctttttataactacctagtctctagttgccaccaatcactagctgtatcacatcactctacttaaattttctaggccgggcgcggtggctcacgcctgtaatcccagcactttgggaggctgaggcgggtggatcacgaggtcaagagatggagaccagcctggccaacatggtgaaaccccgtctctactaaaaatacagaaaattagctgggtgtggtggcatgagcctgtagtcctaggtactcgggaggttgaggcaggagaattgcttgaacctgggaggtggaggttgcagtgagccgagatcgcgccactgcactccagcctggtgacagagtgagactcagtctccaaaaaaaaaaaaaaattctgcatagcacttctcactatctgatatttttcttatttatatttgtttactgtctgcttcccctatgtaagaattctataagttttttatattttagaatttaaagtttttaaattttaaaagaatgttatgagaaagcagggaccttgtctgttttgttcatcaccatatccccaagcacctagaatagtgcctggcatatactaggtgctcaataaatatttgccaaaagaaaactgaacttcctagtcttaaatgatcatttcttgaaaaggactactcttctccccaagctccagacctgtctttttgaattccttcttgggtatttctgtctaaatattctacaaatacctcaaattcaacatgcccctttctgctcaattactcttacagaccttattttttctgttaatggcatcatcattagcccaattgatcaggccagaggtcctctttgattcctttctttctctcaactcccactatctatcagatcctgtcagtatcttgtctcacatctttcccttctcttccacagagttgctaccacatcattttaggcctaattactttttacttgtatcattgtaagaaactgcctaaccgggctttttgcttccaatcccccacggctttccagaccatactgtcttctattcatcatactacttttctgttcaaaactaacaaatgaaatgccatttttttttatgctttggaaagccacggaaaactttatcctcagcctcctttagaccctacttacctttccagcctcaccattcatgacatccctgcagctctgtgctgctgccctcattctgtggccttatcagcctcatagctggtggtcacatacaccagcagcctccacctttacaaagccattttccctgactgcagtgctcctgaacccccgctccttttggctgacttacagttttatctttaagatataactaaaaaactgcctccccaagaagcctttatagatcttccctcaactccaaaattgaaattagtggcatagacccataatatctctattattaatatcattttttttctttttttttccaagataggtcttactttgttacccagactggagtgcagtggcgcaatcttggctcactgcagccttgaactcctgagcttaagcaatcctcccacctcaacctcctgagtagctatgatgacaggcatgtgccaccatgcccagctaatttttttgtattttttgtagagatggggttttgctatgttgcctaggctggtctcaaactcctgagctcaagcagtctgcccaggcttccaaaatatttattgagcacctactatatgccaggcactattctaggtactgccctcagcctcccaaagtgttaggattacaggcatgagccacctctcccagcctatttcattttttaaattgtggtaaagtatacataatataaaatttaccattgtaactgtttttaagggtacaattcccttgcattaagtacatttacattgctgtacaacattcaccactgtcctctgctatcatatttaattatttatggatgtagttgtcccctcctctgattggaaacaaaacgcttggcgttatttgtaagtgctgaattaacatggatgaacatgaatataatcagatcatctcctgagatgagatgtcatgtcacaagtatccttgtgatcctgcttgggtaacttcaggattgtgttcagttttcttccttgtacttattcaaaatggcattggttagagttcacggagtcctggatttttaaaggttctttgcctaatttcttctttacaagtttttggtgcgtacacttaacctaacttttttgtcttaccaatatctatcctataaatatgccagtgaaatggagcatattgcgttaggtaaggtgtgcatatttcaagaactagatgtgtttcaaagcacataatgaaacttcagcaaaaatgagattaagagtttaggctccaataatattgctgcgattttatttctgtcaaagttttgttatttttgctgtattgtttgcttttcttcaatgttttgtaagccccggttctttgatgaactcctaataagctgtgcttaaaactatgacattgacctttctccagaaacaggtttcagaattgtctgtttttcatgttctctccctgccttttctcttgtaatcaaatcagcatgtttttgtttttgttttggagacagagtcgcactctgttgcccaggctggagtgcagtggcactatctctgctaactgcaacctctgcctcctgggttcaagcgattcttctgcctcagcctcccgagtagctgggactacaggcacgtgccaccacacccagctaattttttgtatttttagtagagacagggtttcaccatgttgcccagactagtctcaaactcctgagctcaggcaatctgcccgcctccacctcacaaagtgctaggattacaggcatgggccattgcacccagcctaaatcagcatgtatttttaaacatcatagaatgcgagggtttgaagtgtcttttgtgatcatctaacattcactttgcatataaataaataaataaagacccatgttaatgccaaagggagtgagtggcagaagaatctatgacggaagcatatcttttggtgctgtcaatgaaagggaaacaaatgcttggcattatttgtaagtgctgaattaacatggatgaacatgaaaataatcagatcatcagttattctccctcctgatctgaaggatcctgtgtgacatcatctgagatgcactgggggttgaggaaagatgacccttaaaatccacatttgtactttccaagagcaaggtgagatcatagagaagttacacccgctcctttctccactttttagtctttatccactaaaaacaagatgtgagaaaatcaagtgacaagaatgatagggtaataggctgtcaacaaaatgagtgtgtgggcttatataggtataaacatggtgaaggtgatagaccatggatgcttagtcccttttaagttccatcttccgtttaacacattttgaaagaatttattgtgtcttattttcccctgatttgtgtagctgtgccaccctagataacagtttttctttttgctcttgccaccttcttgataaaggcaagtacagttagaatcgtaggtacttaataatgcttcggcatgaatatgcttcacaactttgagatgtgtaccctttattttctttctgttataaatcttaatttctttgtgccctacttttcatatctgtaaaatggatgaaatagtagtatctgcctcatataattgctgtaaagattaaatgctaatacacataaagctcttagaacaggtctggtgtatagtaaacacacaaagctgctattattattgttactggtattaactgatatattcatactttttataactgctcatcctattaattaaatgtattttttcactatatattctttttcaatgtatattccttttaatcttccttcttagcctccactatagttcagatgccttctccaatttcaaacaatttaatgaaaagaaaagaaaatttatacatccagagatggctgatttaatttcttcagtcttttggagggtagaattattttccttctgagagtaaacttattttttctatgttacaggtggtatgcaagattacaattatgtgtgggccaactgttttgagatcacattagaactgtcttgttgcaagtacccacctgcttcacagcttcgacaggaatgggagaacaatcgtgagtctttgatcacattgattgaaaaggtaaaagtagatgactggaatgttggggtatagaaacaggattaaataagggagaaatttggatgcatgtgaatgataatctatacagtattagatgtcatttatctctttttattacttaagattataaattatctttaaagattattagattataatctattaaaacatattctagctctgcttcccctgccccttacccccagctctctgctccatagggcttccttttcctatcttggaacacttacttatacaaactgaaataattagccaaatttgtactctcaggttcttacaatgtcatgtgatcatatttgctagtgagcctttaccactatatgaaccatggacatcagtttaatttaaacatcacccagactaatacagcaattgaatacaccagcagttacaccttgttgagaaaattagaaatctggctttgaggagagggaattttaaaagcaccttactagtgtcgagttcagacatatgacttaagtttaaggatttaatacttctgtctgtattttatttaaacttcaagggattgaaaatgttttgggggagagagaagagtcactttattttttagaaattctagtatcggtgcagagagaaattatgcgctcttgccttccaaattcaccgtctctgagcttggattcttgtcttcttaggttcacattggagtgaaaggatttgttaaagattccataacaggatctgggttagagaatgcaaccatctcagtggctggtattaatcataatatcacaacaggcagatttggtgatttctaccgattacttgttcctggaacttacaaccttacagtagttttaactgggtaagaatttaaactatgtagactcttagttaaaatgtcaagtctctgttttatatctgagacagaaatatagtctagtacatgttgtttattttttgtggcttttatttttccttattttctgatttttctcgttttataataagaaaatactattgtggagttttttgtcacatagtctaatagtacaatgggatgtgaagcatagttgtagcattagaggaaggacaatttttaaaacttgaaaagatattcagctgtgtaaagcattgccttaaagctaaccgaataccagagtagaagaaacccattgctctgtaaatgacattttgaagaactgtcttatcagctttctaatatattaaatgaatggtttcccacctcccctggaaagctttctggaagctcactttgataaggatttaattgataacctttaatcttgagctttcctacttgaaaaagaagttggaatgtcagtttgataagacactgcaaagaattgtgtaatttatcccttctttgagtactgtagcagtggttacaatggagtaacaaccacatctttcaacatgttctttcctttgagtgtaatttttttggtatacattctagtgtgtggtacttgagaagatttggtgagagaaatagttgttcaatctggggttctttgtgagataatgtcctaaaactcttaaatttacacatctctctttatttagtttgagttttgatagatcgctaagtgtaagaggatgaaaaggctactgtgcttttataatattaaagcattgtatgtcttaactataaaccatttactttttcaaatttttttttcaggtatatgccattgactgttactaatgtagtggtgaaagaaggaccagccacagaggtggatttttctcttaggccaactgtaacttcagtaatccctgacacgacagaggctgtatcaactgctagcacagttgctatacctaatattctttctggaacatcatcctcctaccagccaattcagccaaaggactttcaccaccaccatttccctgatatggaaatcttcttgagaaggtttgccaatgaatatcctaacattacccggctttattccttgggaaaatcagtagagtcaagagaactttatgtgatggagatatctgataatccgggtgtccatgaaccaggtaattggtatggtcttacacataatttcagtagtgcccctcaaagccatgttcaatattgctatgtttcattcagaaaggtcgcctacagtttgtataactggcattaagaaaacctaactaaaattaaaagaaagcaaaaaagaaaatgtaaccaatcttttcccagaagagaaggaaatccttttgctaacccatattaggcatggtatttaataagtgcatagattagatttattctgctaatagtgttttatttatttatattatatagcatatatatgctttgagcctgctcagacatatgtattagtaaggaagctgctttataagatgtttctgaaggttttttctgcctcctttgccaaaatacatgtttaaaaaattttttagtataggatttatatatgttgcggaaaaaaactgagtccatgatgattaagaaggaaaaaaagccttccatgtaattattttgttttcaggtgaaccagaatttaagtacattggaaatatgcatggaaatgaagtggttggaagagaactgctgttgaacctcatagaatacctttgtaagaactttggaacagaccctgaagtcacagatttggttcataacactagaattcaccttatgccatccatgaatcctgatgggtatgaaaagtcccaggaaggtaaagaatagcatttaattcttaatcatttgatcatcatatagaatgattattttgatggagaagagaatttgaactggttcttttggaatttcttccaattttttttccttttaatttatgattgattttagctcttgtattcttatatgatgatctggtctgttcaacaattaggtgatcaaatttatatatttagtggtgtcttccacttggtaatggttctaatttactagaaatagagtataagacttttataaattgttttattttagcaatagttctgttgacaaagagtcaaactctgtaaaatatttgaagagatttattctgagccaaatatgagtgaccatggcccatgacacagccctcagacccagaggacatgtgttcagggtagtcagggtgcagcttggttttaaacattttaagaagacatgagacatcagtcagacacatttaagatatacattggcttggtccagaaatcgggcgagggttgaaagatttattatcaatcgaaaggaatgtctgggttaggataagaggttgtagttaccaaagtttgatcatgcagatgaagcctccaggtagcaggcttcacagagaatagattgtaaatgtttcttatcagacttaaggtctgtgttggtattaatgctgattgacttttcctgatttccaaaagagaggaggcataatgaggcatgtctgacccccatttcccatcatggcctgaaccagtctttcaggttaactttggagtgccgtggtcaagaggagggaatctgttgagataggccctgcctattgagcggggccttagaattttgttttgggtttacagttcttattaaatcattattttgggaaccttatttcataagtgaaaaaccaaaccagatatctgtctgagtcagtgactctgttttgactctcagttctactccctctgcatattccagacttgctaatttattgacttctcatttctttgccttccctgggcaagcccatctctcctggggcgttatagtgtgggatgggacagcagacccttatgcacaacactaggggagtaagaattcatcttttcccagcccatgatttcttccaggcaatgatatctatcaggcaccatagtataatatggagcctcatgacttattactagcactgacctgaccattgggaggatcagttggtcattagttggtcattagtacccagaagttggtcattagtaccccagaagctcacttgaacaaataggcacaagatcttacttatatatgtatatatttcagatttttccccctaaggttctcattctttgtcagtgccacaagtcccttctacatactccccagacctttctgaaaggtggaactaattacactagtgagccctccagttttctttagtctcgcaatttttctcattataatgacaatagtaaggctcccactccctattaaaatggaatatgcacagttaagcttaaattgaactttctcctccatcaggttaaacttccagctgtgctcttggctaactttacctttttgtgatcactttaatgtgagcatatcacaattttcttttcatttgctctatttcttacaatgtcttagtgagctttatacaagtacagagaggagtatagagttcctggccaggcgtggtggctcatgcttataatcccagcactttgggaggtcgaggtagatggatcatttgagaccaggagttcaagagcagcctggccaacatggtgaaaccctgtttctactaaaaatacaaaaaattagctggacgtggtggtgcacacctgtaattccagctactcgggagactgaggcacaagaattgctttaacctgggaggtggaggtagcagtgagccgagatggcgccactgcactacagtctaggccacagagtgagactctgtctcaaaaaaaaaaaaaaaacaaatagagttcccctctgatcagtaatttccactcaacattgtgataatgtcattatatgtggattattgacacttaaacagtgctttaatataatttgtctaattggaatatttttcctcccagattatgagcagagggcaaaaataaaaagataatggttttacctctctgttcaaaatatctggaagagatacagtttttaaacacgcaatgtgaaaaagatgtgttttaactgtaatgcctggccaggtgctgtggctcacgcctgtcatcccagcactttgggaggccaaggtgggtggatcacgaggtcaggagttcgagaccagcctggccaacatggtgaaacctcatctctactaaagatacaaaaaattagctgggcgtggtggcgcacacctgtaatcccagctactcgggaggctgaggcaggagaatggcgtgaacccaggaggcagaggttgcagtaagccaagattgtgccattgcactccagcctgggcgacaaggcgaggctccgtctcaaaaaaaaaaaaaaaaaaagaggtaatgcctgacaggttcttcctgcctgctgcacaggcaaaacagttcattgagaccatggtatcgcagtaaagagtttaattaatgcaaggccagccacgcaggagaattggagttatcactcaaatcagtctccctgaaggctcagaggttagggtttttcaaagatagtttgatggacaagggactagagaatgggttgattggttggggatgaaatcatagggatgtggaaaacagtccttatgtgctgagtcagcttctagttgggaaccacaggaccagctgagttacaactcactcactggtccaggtgacgtcagctggttgtcagaaatgcaaaagtcagaataacatctcagaaggccaatcttaggttctacagtagtgatgttatctacaggagtagttgaggaagttacaaatcttaacaacttccaaaacaatgactggttatcctttaattacacatacatgttagccaaattcaggcccctcttataatcccaaccttgtgacctttcattagttttacaaaggtggtttagttttgggaaaggttgttatcatccttgctttaagattaaactgtaagctaaatttctcccaaagttagcttggccgatgcccaggaatgaccaaggacagcttggaggttagaagtaaggtggagtctggctgggcgtggtggctcactcctgtaatcctagcactttgggaggctgaggggggtgggtcacctgatgtcaggagttcaagaccagcctggccaacatggtgaaaccccatctctactaataaatacaaaaattagctgggcatgatggcaggtgcctgtaattccagctacttgggaggctgagatgggagaatcgcttgaacccgggagatggtggttgcagtgagctgagattgcgccactgcactccagcctgggtgactgagtgagactccatctcaaaaaaaaaaaaaaaggcggagtcaaccatgtcagatttcttttactgttataattttgcaaagacagtttcataatcataggtgattgataatagcgaagcctgatgtgttcacatttgccttgagttaaggtatctaaagtagtacgtgttggaataaaatataagtgaacatggcttatattcaaatcctttatcatatcatacaggagattcaataagtgtaattggcagaaacaacagcaacaactttgacctgaaccgaaatttcccagaccagtttgttcagatcacagatcctacgcaaccagaaactattgctgtaatgagctggatgaagtcctatccatttgtactttcagcaaacctgcatggaggtatggcaactttatattctactaatcagttcttgttgagagcatttggaaatcctggtggaattttatctgtttgtagtgttatgctttcttaaaatgagtatcctgttactgctcttatggcagacaacagtaaaggtcttttctcattactttttcagccagtgtcctggctgtttctttcctccttctttctctctttttttcctcctcttctcttctccttttacccccatctcttctctccacccctttctcctctcttttctcacctactacttctctttcccttctcttacctcctctcccctttcttctctgtcttgtcttttttctcctctcctctccttctcccccgcctgtccccctactctgttcttcctcctcctctcctcttcctctcatagttcttcaggtattttgtatttatctctcacattgggaacttggtaacatattctttgtcattcataaaaattgatccaaatgtttagttctgttttctccctgaagtttaataaactcttttatgtaaatttagattttgatattctcttttttacttggtatatccttaactgcagcagagtgaccacattctcatgtagtacctgagctcatatacctccatataatttagcaggatggatcggttgaataggatgagtgtcaagattaaaaatcgccacaatgtccaactaaggttgcgaataagagtgaagatatcagtacccaagagaaccaaactgtgtccacacataaactcacttgaacaaaatgttcactcatttaatgtacagtgctcatgtatatgaatgttcaatgtacatgaacgttcattcaggattattcacaataacaaaaaagttgaaacaacccaaacaaccatcatctgataaatagataaataaaatgtggtctgtccttacaatgaatattatttggctcgaaaaggaatcaagtgctgatacatgctacaacatagatccttgaaaccttacactaagtgacaaaagccagtcataatagaccacatagtgcatgattattatttttttctttatcaagttgattatatttttatgaaatttttagaataggcatatccatagagacaggaagtagattaaagattgtattgggctggagtgaatagtggtaagaggtgataggggagtgactgctaatggattttggggtttctttttggagttatgaaaatgttctataactggatagtggtagtggttgtacaaccctgtgaatataaacaactttaaatgggtgaattgcatggtatttgaattacatcagtaaaactactaaaaaaaaaaaaaagtgacaagtattagcaccaggggcaatggggaagaaatttagtttcaacatttactggaatatccagaagtaccatagtggagacttcatgtcatatagagtagcctgccattttagaatgacagtacatactgatggatatttagatttaggaggttaattgagattctccaaaaattgctttgaaagattgccaatagtagaaaaaagtacttctacagttggtaatcatatattgttctcaaagagtcaaataagaactatgaagttataccctggttggcaaaataaattttttgttttcttttattatattttatgtgtttaatgctatgtttgataaaattcacttatttagagctttaaaaatagtctcataataaatcacacatcatgttggctaaatctggaaagttaataatagttacattccagtgaaaataagtcacagatttacagatgtggtgtccagaccttggcatggtgagaggtaggaatcttcagtcatgcagacatttttctttccatgacatattttgttttctcatcttaaaatccttatttaaatggagtttgaaatcttggcaaagcagtttgaaggagaatttctttgttgctgtacaggagtaaaaaatcctcatagagtccgcagctggagcttgtgaattaagctgataaaagacagattaaaagaaaaaagcatacaaattttatttgatgtttgtatgtggcacaggcaacaggcagtgggggagttcataggaaagacgtgaaaccctcaaaaaagcagtgttaaggacttagtgctcttataacaaagggtaataccttgtggaaaagtgactacacaaaggaaggggtttagacttctaggggtaaaaaattgtgggaaagtgactaggaaatatgcgggggaaactaatgaaagatgagggttattttactaaggtttgtttgtgtcaactcatcttggtgttgactatcccatctctgatggtaccaggaaggtgcctttctcacgggaaatttatgccctaattttaggcagaaagagggagggtagatagcctttcctgcatctgctgtttctcagttgccttcagctctaaataattaacatgctaaagagttatattctggggcagaatgttctgattcctttccctgccatctttataatttagaaggatcttgaaagaagataggggaaagcaatattctttttcataaaatttcaaaaattttgatactaatttttttattgaggtgaagtttacataattccagtggcgtttagtgcattcatagtgttttgcaaccaccccctctatcttgttccaaaacatttttatctccgcaaaaggataccccacacccatttaacagtgactcccctttcccttctcccctcaacctctggtaaccaccaatctttgttctgtctctagggatttacctattctggatatttcatagaaatggaatcctataacatgtgacctttcgtgtctggcttctttcatttagcatagtgttttcaaggttcactcatgttgtggcatatatcagtacttcattcctttctatggttgaataatagtacattgtatatacatatgtatatatcaatatcacatttgctttatccatttacgtactgatggacatttgggttgttttgactttttgactacaatgaaaaatgcttctatgcccattggcattcaaatatctatttgagttcctgttttcttttccccgtgccccccttgttttgaaacagagtctcactctgttacccaggctggagtgtaagtggtgtgatcatggctcactgcagcctcaaactcctgagctcaggcagtcctcccacctcagcctcccaagtagctggaactgcaggcatgcaccaccacacctggcttatttttaattttttgtagagacagggtctcccagtgttgcccaggctgatcttgaactcttgggctcaagcaatccacctgcctgccttggcctcccaaagtgctgagattataggtgtgaactactgtacgcagcccctgtattcagttcttttgggtgtacacttaggagtgaaattgtcatatgataattccatgttaagctttttgaggaattgccaaactgttttccacagaggctggactattttacattcccgccagcaatgtatgaggttccagtttcttcatatcctcaccaccacttattattttctatttttattattatagctgtcctagtgggtgagaagtaggacctcattttggttttggtgtgcatttccacaataactaatgatgccgaggatcttttcatgagcttgttggccatttatctatcttctttggagaaatatctgttcaagtcctttgtccaatttttaattgagtttttgtctttgttgttaagttgtaagagtttttaaatactggacactggacccttatcaggcttgcaaaacattttcccccattctataggttgtcttttctctttcttatgttcttgatgcataaaagtttttgattttgatggaatcccgtatatctgtttttttcttttgttgctagtcctttccgtattgatgctaattatttttttgaggtagactgtttggtagaagtactataaatctttttttgtggctttagaaaattagccatttgaaagatatcttctcacttattcactttgaattgaagaaattagtgtaattttcatttctgttgaggaaattctgcttggcaaattttattgttttctcttctctggcagtattctgaaaagctttatgttaataatccatcttgaaacagacaacatgatacattttcctcttttcccttataggttctttggtggttaactacccttttgatgatgatgaacaaggacttgccacatatagtaaatcaccagatgatgctgtgttccaacaaatagcactttcttattccaaggtaggcttgtctttgaatataaaatgttacaaaattaattcttttatttaaaaatatgctttaaagtcctgcaagactcaggtcaagtgcttccatagttaataaagcatgactttttcagctgtttccgaaaaatagctttttctcctgtttcccacctcacttttgaatacactacatgtctttctccattggccttttatctatggttttagcacagtacctggaacatatacatgtcaatttatttcatttgacaaataagttataagcccagtaaagtaggccaagataagggcttaatgaattatagctctggagccaaatcttgcccaccacctgtttttgtaaataaaattgtattgacacacagccacagctatatttttatatattgtgtgtggctgctttctccttcaacatttcaaagtaagtcagtataatttactatattaacaaactaaagaaggaaaatccagtgatcaaagggcaaagttgggtagtttcaacaaagacttttgcatctaaaaagtctgaaatatttgctttctggttttttacaggaaaaaattgccaaactttagtctaaggtatttaagatcctgtagttacatatagcaaggaaaagcaggcagaaatttctgtattttccaaacttcctatgataaacatggattactcttacaatcgggaatgttaaaatgtgtgtgtgtgtgaaaatttaatttaaaaatcgttcttaggaccaggcttggtggctcatgcctgaaatcgtagcactttggtagggcaaggcaggagaattgcttgagctctcaggagtttgagaccagactgggcaacatagcaagagcttgcctctactaaaaataaaaaataaaaaaaaaattagccggttgtggtgacatgcatttgttgttccagctacttaggaggctgaggtgggaggattgctctatcccaggagattgaggttgaagtgagcttgatcacaatactatactctagcctgggtgacaaagctgagaccctgtctcaaaaaaataaaaattgtcttagaaaacatgttaaaagttgaggcttgtaaactaagcttgttagtttcaatgtttggtgttactactgacttagtattgttattggttatattggtactattattggttataggtaatgaatattattactgtaactctgcactctccagtcacagtcctccatccttccacttttcccattccctcatcctctgcaaatgaatcttgtgagattgttcagagtttctactagaggagtacagctgttcatttcaccttagagaattattgctttctgtttggacatatatgtttttttgaagtacatacgtggagtaataagagaatgtatagtgtcccaaccatcaaaataaaaattaaatggctggattttgcatattttctcatcacattctatgctcattctcatgatttctgcttttcgccttcattttggcttctagttccttatcttctctttgttttcttagaccattaacccttttgatttgatttacctttctctgtagggtagacccatggacataccttttcaatgattctcctaagggtcttgtacacccctttgacataactgctttgccctccagtcctcagtaattaccattatctcttttctccataccaatattacaagtacagcctagagtggtcacactgtcacggcaatttgctatagtccatatgtgtgctctccaacttcagctgaaccctcagtcctacatggcaacatttcctgtttagctacttgactccctggctcagttcccactatggtgattcagagcctttatcctctatctgagcctcctgttccagctctatccctcttattcatagtagatcactttgcattgaactcaagtagaactttgagtaatctgatgtgagttcactaagattctgtcttctcaattgtttctcatgtgtgtcttaacaatattctcctccatttcttgatcccactgcattctgcctcctcgaatcttgtgtcttcatatcttattttataaatgaggaaggtgataattaaactccccagtcttcactcacagccttttttctcttggtcaataagcagctcctctaaaaatattgtcttctgctaaccttagtaagcccccatgaagctaccattcaaagtttctttatttttactcttcaaaacttctcaaaagtagatagtcttgggagacatctgagcagccaaagacaatgatggctatgtgataacctatctcccagggtttttctttaaacaatataaaacgacttaaaaactaccaaattttacacaaaaccacactgttggcatcacaaaagatcctgaaactgcaaaataactgtaaattttttaaaaatcaagaagtctcagcatgatctatcatgcacctaccccaccttcgccccaccacaaggctttgtggtgaggtaaaacagaccaagaaaacttacggagaagacagaagtgggtgccagtgaagggcagctgtgaaggtaatttggaatgaccaccatacatcacatatgcactaaatccaaaaatactaaaagagtaactgggcagattagagctctggaatacagggaagagatttcaaaatgcacacaacttaaaggatctggtgtgatttaatgggataagtacaatttaaaaggagaggatggttacagggagatcttccaaactcatagcttctggagaaggaaaaaaagaggcaaagatagaaatgaagaagtgctccttggcaattagatggtgaatgggaaaaggaaacagtggggagaaatgtaaggttttacaagacagaaaagaactttaaaatcagaagattctcagctccacccttaccaccaagacaaataaataaccacactgaggtacctggattttgctagaccgacagaaaagtgtaccattaagctaggaataatattaaatgcccaatatcataaaaataaagaggaaaataaagtccatggaaaatgattgcagaaaattaggaaatgaaacttcacatatagacactaaggagaccctaccattagcaaaaaataatcgagaagcagaagaaaactgttcagttggcattctaaacagattaagtatacccaaatatacgttgagaatatgagaaactacctcaactcagatagtcaaaaaataaaaacagaggccaggaaacaaaaaacagggataaataaaataaagtttataggactcaggaaaaaaatggaagaaaaagacaaaattatctctgaaatgaagaataaatgacaaaagttagggaactcatacatccaatttcaaacttactacaaagctacagtaattaagacagtgtggtactggcataaagacagacatatagatcaatgaaatagaactgagaacccaggaataaattcttatgttgatggtcagttgatttttttttttagaaaaggatgccaagacaattcaataggcaaagaatagattttttaaataaatggtgctgggacaattggatatttatatgcaaaagaataaactagataccttcctcacaccacaccccaaaattagcttaaaataggtcataaacctaaatataggaactaaaactataaaactaagaaaaaataggaatacatttttgtgatttggtcctcctctagatatgacatcggaagcacaagtgacaaaaaaagattgatacattggacataatccagatttaaaacttctttactgcaaaaaaaaactgtatttgtttcctagttctgctgtaacaaaattccacaaactgggtggtctaagacaacaggaatttattgtctcatagttttggaggccagaagtccaaaatcacagtgttggcagggccattctccctctgaaactgtggaagaatccttccttgtttctccctagtttctggtgctttgctggcaaccattggcattccttcacttctaggtgcatcactccaacccttcatcatcacacggcattctccctctgtcttcgtatcccagtttcccctttgtacaaggacaccgtcatattggattagggcccatgctaatcaccttattttaacttgattacctctgtaaggaacttatttttaaataagatcacattttgaggtactgagggttaggacttcaatatatttttggaggacacaactcaatccataacatataacatccaggaagtaaaaagacaacccacagaagctgggcttggtgacacgtgcctgtagtcccagctacttgggaggctgaggccgaaggattgcttgagcccaagaagtagaggctatcgtgagctatgatcatgccactgcactccagctttggtgacagaaggagaccccagcccccaaaaaataaataaatagatgacccacagaataagagaaaatttttgtaaatcatatattttgataaaggtgttatatctaaaatatataaagaactcttatggctaaataataaaaagacaaatcatccaagtgaaaaataggcaaaggatctgaatggacatttctctgaagaagagaaaatggccaataagcacatgaaaagatgctcaatattattagccattagagaaatgcaagtcaataccacaatgagatacctcttgttacccactagaatggctgtaattttaaaaaatggaaaatatgcataggcaaaggtggaaaaattgaaaccttacatacattgctggtggggtgtaaaatggtataactgctttgaaaaacagtctggcagtgctttaaaacattaaatatagaattgtaatatgacccagcattccactgctaggtatatacccaagagaaatggaaacatgtattcacacaaaaacttgtacatgaatatttgtagcagcattattcataatagccccaaatggaagcaaccaaaatgtccatcaactgatgaatgggttaacaaactgataagtagacatacaaaatcatacagtggaatattattcagccataaaaagtaatgaagtaatgatacacagtacaacttgaatgaaccttaaaaacctactaagtgaaagaagtcacaagagactacatattgtatgattcagtttatatgtaatgttcagagtaggcaaacccatagagacagaaagtagattggtggttgcctagggtttggagtgggggtggggagtaggggttggggaaaaatggagaatgctaataggtatagagtttctttttggggtgatgaaaatgtcctaaaatttattatggtgggtggttatacaactctatgaatactaaaaaccattgaattgtacactttaaatggagtcaatgtgtggaatgtgaattatatctcaataaagtggattttgaaaacctaaagaagactgaggggtggaggatccattctgtattcgtatataagttaaaaaaatgagatctaaaagttatataccaagcccggtgtgatggctcacacctgtaatctcaacactttgggaggccgaggtgggcagattcgttgagcccaggagttcgagaccagcctgggcaacatagtcaaaccccatccctacaaaaaatacaaaaattagccaggtgtgtgggtgcatgcctatagtcccagctcctcaggagggtgaggtggaaggatcacttgagcgtggggagattgaggctgcagtgagcctgtgtttccactactgcactctgagctgggtgacaaacaagacccagtttcaaaaccaaaacaaaaccaaaacaaaaccaaagcaaaagagcatgcatataattattacagtaatctaaaattatggtttttatttgataagagtgatgggatgataagcctataattggcatattaagtttctagatggggatcgtttattttattttgtttttgttaggacagagtcttgctttgtcacccaggctgtagtgcagtggtgcaatcatggtttactgcagcctcaacctcctggggtcaagctattttcccatctcagcctcccaaggagctggttctacagacatgtagcaccatgtgtggcttttttttttttttttttttttttgtagagatgaggtctcactgtattgcccaggctggtcttgaacttctgagctcaagcagttctccaaccttggcctcccaaagtgttgggattacaggtgtgatcttacctgtccctgtttatatattttaaatggttaattctctgtggtagaaaaatgggaaattattctttttctcttcacactttcagtactttttttctgtttcaaaaagagataaatgaagttttgaccatctttcaaagctcaatttcttctaggaaactccccctgccactctcatcagatgtaatctttctctcctcttgctttcaatggcatgcatttgtgtctccatggcagtttttcttacccttcattgagttatcagttggacacctactgtatgctagatgctgaggacacagagacacaaactgtttcaaggaatagtgtattgtctttagggaagagaaaggtgcaactagttgtaatagggtaagataattgtacagagggcagtcagagcacagaggggccatcttattcctgctagcagtcagggaaagctgcttgcttttattgtgtgtgtattatcttttttggacttcaagctccttgaaagcatgaaacgaaagtataaatatgagcagaaattttttttagagaggggttcagctaggttttatattacttgtaattgcgagtaataaatgaagtcaatattttcttacggagcacattgtattttgatttttaaaaatagataagttcagatagtgaaaaatcaaaatggcataaaaagctatacactgaaaagtctcactgctcatagccccaccccactcccacctccacccctcacataccctgttggaagccacttttattattttcctgtatctttccagtatttttttttgatggagatacaaacaaatagaagtaaagattctttttgtttttccaggaaaattcccagatgtttcaaggtagaccttgcaagaatatgtatcctaatgaatattttcctcatggaataacaaatggagctagttggtataatgtgccaggtaaagattcttttatatcaaggccttacaacttgatggcctttctgctttcctagatggtgcttcttgttattatcttttagttttgaggaataataattatttttaaaacatggtttaaatagtttaaaatatttaaataatcttttcaactacttttatgtttgatgtacgttgagggttgagtaagaataatgcactaaaacttgattaaatggttacattttacttctggctattagaaagaatcttacatgtgctaatagaagagtgtaagctatatttgaattctttttttttttttctttacaacgttactttcttttttttttttttcttttctttttttattatactttaggttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccctttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacaatgtaaaagtgttcctatttctccacatcctctcctgcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgttggagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatggtcatgcctaggttttcttctagggtttttatggttttaggtctaacgtttaaatctttaatccatcttgaattgatttttgtataaggtataaggaagggatccagtttcagctttctacatatggctagccagttttcccagcaccatttattaaatagggaatcctttccccatttcttgtttttctcaggtttgtcaaagatcagacagttgtaggtatgtggtgttatttctgagggctctgttctgttccattgatctatatctctgttttggtaccagtaccatgctgttttggttactgtagccttgtagtaaagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacaatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagagttgttgaattttgtcaaaggctttttctgcatctattgagataatcatgtggtttttgtctttggttctgtttatatgctggattacatttattgatttgtgtatattgaaccagccttgcatcccagggatgaagcccacttgatcatggtggataagctttttgatgtgctgctggattcagtttgccagtattttattgaggatttttgcatcaatgttcatcaaggatattggtctaaaattctctttttttgttgtgtctctgcccggctttggtatcagaatgatgctggcctcataaaatgagttagggaggattccctctttttctattgattggaatagtttcagaaggaatggtaccagttcctccttgtacctctggtagaattcggctgtaaatccatctggtcctggactctttttggttggtaagctattgattattgccacaatttcagctcctgttattggtctattaagagattcaacttcttccacatgaaggtataggtgttttgcttgtatcgcaagcatcaaagtgccctcacatgaacacgttagcttatcaatgctgataagagataaatttggctttttactaggaatgttgcttaccttttgggatctgagctgtttagaacttcttcagagtgactaattttaatttttatcttttaggaggaatgcaggactggaactatttacaaacaaattgctttgaagtgactattgaactaggttgtgtgaaatatccacttgagaaagagctgccaaacttttgggaacagaatcgaagatcactaatccagtttatgaaacaggtgactattcaggagtgaagtatgaaatttctcccgagggtgaaaagatttttgtgcgtacacgtggtttttgtgcagtgattttggaatacactctttaaaatttcaattcattttagtatatttaaccagtttgtatattccaaggtgtttaatatatttatctagaaaattcgtgaatggaaatgagtttatttgtatatgtgaggaaaagttgaagaaaatgattgaacaaggtagtgatattttgctcttaagggttagtggtcactttttacccgtgtttaaaaaagaccagcataaattggatacacacctaatcattggccaagtgatagaaagatgggctgtggagtgaatgtttttattctttttcttgttgccagtgatttactgtgaaatgattaatttccttttgtttggatatgtgtggtggccagtaggtaaagattataagaaatatactaatgttaattaggataatcagactaatactttctgccagtacatttctgcatttttctttttcctgagtggtgtgacataaagtctgtgagtttttttttactatatttaaagacattttattctgaaaaattttaaatatacagaaaagttatgactagccaataattattcctatacctagatttaacatttttaacattttgttatatttgctttattttaatgtaaattttatttacacactcacatacacatacatatttttgactgaactattgtaatataaattgcaggtatggtattttacccctaaatatttcagcatctatctcctaaaaataaggagctactacatactatctctaagtgctactgtcctacccaagaaaattaacagtaattccctaatattacctaatacttagtttatatttaaatgtccatatttgtccccaaaatgtaattttacagctgtattttatgaccaggatctagtcaagtttcatgcattgcattggattattatatctctttactattctttgaactataagagtccttctgtttttaaaaaatgccatttccttttgaaaaggccaggtctgttttcttgtagaatgtcatatattctgaaatcatcagaatgtgctaaagtttaaacagtgttatttatattcttcatgataaagagaaacaaagcctatgaaaaattagccttcagaaatattttaatgaacatttacattgaactttactctgaactcctaaattcctgtttgttccatttatttgtgttgacaatctgttattttgaatatgacctcccaagataattagatgatgatgtttattattgaaatctggtgtccttgtacttaatccaggttcatcagggcgtcagaggatttgttctagatgccacagatggcaggggtatattaaatgccaccattagtgttgctgagattaatcacccagtgactacttacaaaactggagattactggcgtctcttggttccaggaacttataaaatcacagcatctgctcgagggtgagtgactgaatgctttgaaatagagtgctcggaggacaaacatggctccattctggaggattattactagaacgttctagagagcctgttaagcaactttgaatggattgctgcgaagtttagggctggttatacctttgactctcctttagtggcagatagagtacacgaaaaaaaaaaaaaggaaagattcctggggtaaatattctagttattgcttagttgactcattgtgacatgcttccaacctggacattaaacaagacattttagaatacacatcaaatcctgatcctcatggccttaggttttttatttaaaaggagagttaggctgaagtaattctacagtcagttccaattcatagtagaatttattggaaatgtgttcaagatagtttttcctttaaaggagtaacagaagtgttagttgatgaagcacaaagaacatagaaaatgcatagaaagaacatttctcgttcttttaatttgctaaatacaggcaagcccaaagcaatgcagtctatttaacatgctagtaacttttttttttttttttttttttttttgagacagagcttctctctatcgcccaggctggagtgcatggcactatctcagctgcctgcaacttctgcctcctgggttcaagggatgcttgtgcctcagcctcccaagtagttgatattactggtgtgtgccaccacacccaactaatttttgtatttttagtagagacagggtttctcttgtagttttcttttttatcttttgataagtatagatgttaccacaggatattttcccttcctcctgctagctaacttatttctgaagagttagtttgaatacccattgaagtaagggtaaaatatgaaagcattttagtcgttgcctttgttttttaatggttttcagatatctagtggtccgtaaatgaatgggttagaacctcacactaatgagtaatgaggtcttttctgtgattcttccatttttggcagagtgttaactaaagcagcaggggatccgagaaacagggtgagaaggatgtgtttggcagagaatgtcataacctagcacctctgcaactttcccacccgtataccctgatagaagacaagtgaatttaagttccaggagacatgggagtatccactacaagcactaaatttcttttgaagccatatatttaatcttaaaaacctaggccaggtgcggtggctcaggtctgtaatcccagcactttgggaggcagaggcaggtggatcacttgaggtcagaagtttgagaccagcctggccaacatggtgaaatcctgtctctactaaaaatacaaaaattatccaggcatggtggtgggcacctgcaatcccagctactcaggaggctgaggcaggagaatcacttgaacccaggaggcggaggttgcagtgaactgagatggtgccactgcactccagcctgggtgacagagcaagactccatcttaaaaaaaatcatgaaaaaaaatccattcatattttgtaatatacccatgtctattctttattaatgtattaaaaataataaattactcaacgttaaaattttgtctctttaggaaactgcaccacatttatcccaaggattcttacgttctctgcacacctgccttcccagggtttgggtactccagctgcaggagtgtggttctgatctgtctcctttatcataggtataatccagttaccaagaatgtgactgtcaagagtgaaggcgctattcaggtcaacttcacacttgttcgatcctcaacagattcaaacaatgaatcaaagaaaggaaaaggggctagcagcagcaccaatgatgccagtgatccaactactaaagagtttgaaactttaattaaagacctttcagcggagaatggtttggaaagcctcatgttacgctcctcctcaaatctggctctggctctttatcgataccattcctacaaagacttatcagagtttctgagaggacttgtaatgaactatccacatattacaaatcttaccaagtaagtgtcactttctattgtctttttttttttttcaagacagtaaaatcagcattagccatgttgaatagttgtaatttatatagaaatatttgggaacagaatgtacagagagttggagtttacttattttgcaacatgtatttgcttggagatcttttttttttaattatgctttaagttttagggtacatgtgcacaacgtgcaggtttgttacatatgtatacatgtgccatgttggtgtgctgcacccattaactcgtcatttacattaggtatatctcctaatgctatccctcccccctacccctaccccacaacagaccccagggtgtgatgttccccttcctgtgtccaagtgttctcattgttcagttcccacctatgagtgagaacatgcagtgtttggttttttgtccttgcgatagtttgctgagaatgatggtttccagcttcatccatgtccctacaaaggacatgaactcataattttttatggttgcatagtattccatggtgtatatgtgccacattttcttaatccagtctatcattgatggacatttgggttggttccaagtctttgctattgtgaatagtgccacaataaacatacgtgtgcatgtgtctttatagcaccatgatttatagtccctttgggtatatacccagtaatgggatggctgggtcaaatggtatttccagttctagatcccctgaggaattgcaacactgacttccacaatggttgaactaatttacactcccaccaacagtgtaaaagctttccagtttctctacatcgtctccagtatctattgtttcctgactttttaatgattgctattctaactgatgtgagatggtatctcactgtggttttgatttgcattctctgatggccagtgatgatgagcatttttttgtgtgtcttttggctgcataaatgtcttcttttgagaagtgtctgttcatatccttcacccactttttgatggggttgtttgtatttttcttgtaaatttgtttaagttctttgtagattctggatattagccctttgtcagatgagtagattgcaaaaattttcttccattctgtaggttgcctgttcactctgatggtagtttcttttgctgtgcagaagctctttagtttaatgagatcccatttgtcaattttggcttttgttgccattgctattggtgttttagacataaagttcttgcccatgcctatgtcctgaatggtattgcctaggttttcttctagggtttttatggttttaggtctaacatgtaagtctttaatccatcgtgaattaatttttgtataaggtgtaaggaaggggtgcttggagatctttttaatagtgaatcttgggaactttaaggagaattacttgttagattagaagtagatagcctgtgattccaggaaatgtaaaattgctcttcctgataattattttgactgattgtaaaaccctttccatcactcagctacagatctattaatatgttctgactaaatattgtttagtttgttttattttgcttggggcaagggaggaatttagaactgtaagctcacctgttagggattatgtgtaactttttttttttaattagaaaatgaagcctagttgctgtcctaattctagtctctattcacagtctcttacttgaagctttagggacatgtgtgatcgtgggtcccagggaaaacatacagtcctggcttatgtaaaactgatagctgagatagcctttaccttcactttgtggtggttgctctgcctcacttgcactgcttcattttagattttgttacagttactccaaaattatttctatgatttgttgattcctatggtttgcctgttgtagttaaggtctttacattttgccttgagcatatagttctctgctgcaaacctcatgaacattatttagccttttacctttttactttgtctttcttcatgggtccttttaatttcatcagaaaacttagttcctcaaattctgatttataatattcatagatgcagagtgatacttaactttctttggcaataccaattacttttcttccttaactgattcttggatatttctggctatttcaggttttaatatcatacaatcttagtgccatagagttcatatacttttttattttaaaataaaaccaggctgggcacagtggctcacacctgtaatcccagcactttgggaggcccaggtgggaggatcgcttgaggccaggagctccagtttacgttgaactatgatcacaccactgtactccagcctaggtgacagtaagatcctgtctctaaaacaaacaaaaattgggcattattttgctgtctgtttacttagttgatttaatttttttaacctcctaattcaagacacactttttagttaaatattttctcaaaatatgccacacatgccagtggtggggcacaagagagttttaggtggtacaccaacaggcactaagtaccattgaatagcgtcatgagaaagcaataaggtttctgttaatttttctcaatttaatatgattatttttttctgtccaattcttgtaaatctccctttatgctaaagaaagcagaccttaagctcaaagctcttgggcaagcagagtatttgaccattgtttaattttcattgaattagtatttttttccccactcaaattacttttactgtgaaactggtgttgcatttatagtaaaatataacgtgacttatttacaaatattaattttgattaaaaagggagggccagggtggtggcgcatgctgtaatcccagcactttgggaggctgaggtgggaggattgcttgaggccagaagcgcttgaaaccagcctcagcaatatagcaagaccctgtctctacaaaattttttttaaaaaattagctaggcatggtggtgcaaacctgtagtactactcccttaggagactgaggccagaggatcacttgagtcctggaattcaaggctgcagtgagctatgatcaagccattgcattccagcttgggtgacatagtgagaccctgtctcttaaaaatataatgacaataatataaataaataaataaataaataagggaggttatctatgttcatacatacttaaatatttctgtaataaaaatttaatttgtgagttagtacaaaatatattaactaaatagtagtgtagattaaagaagatagggcaaatattgtgatgattgtatgagaattactgaatttggaaggatggtaaactaaatcataatctttcctaaatctttcctaaatctgataatatcatctatttgataaatgttctttggtcaaggaaaactaattttcttaaggttttctgatgcagtgattcactctttaaagactttttaaaactttttgtgttttgttttcatttctatttttaaagtccataagtcaacattaacatagtgcttgattacttgctgatttttttgtttctggtttttgaaagtttgggacagagcactgaatatcgtcacatttggtcccttgaaatctccaataagcccaatgtatctgagcctgaagaaccaaagattcgttttgttgctggtatccatggaaatgcgccagttggaactgaactgcttttggctctggcagaatttctctgcctgaactacaaaaagaacccagctgttacccaagtaagagaatagccgaggttgacatgctttaaaaggaaaaagctcaacattaatatcagggcaccatttttaaaatttttaatttcttgctagattttacagagtcacttgtagtacattatgaactttactctttaaaaatgaaccatctttgtagtatataccctttgttaatagtgtctttctattatatttccttgtatgtcttaagaggcatgcaggaaagaatactaaaaatttacattcaatttcctactccgtcatttaatagccacactacccttccagtctttattcatagttctttactttttttttttttttttgagacagagtcctgctctatcacccaggcttgagtgcaatggcatgatctcggctcactgcaacctccacctcctggattcaagcaattatcccgcctcagcttcctgagtagctgggactacagatgcccaccaccatgcccggctaatttttttatatttttggtagagacggggttttgccatgttggccacgctggtctcgaactcctgacctcaggtaatccacctgctttggcctcccaaaaatgctgtgattacaggcgtgagccatggcgcctggccagttttttacattctgacttgagggacttccattctgaattacttataactaggacactatattgaaaaatctagtgaaagcctagtttttcagtatagttttctttttcatgtaatacataaaaaattattggacatcttggctgctaagagattttagaaaaagcaatatggtgttatctactttagcaatctgtgactacagaaaagaactttgactggggtgtgatggctcatgcctgtaatcacaacacttcagggggctgaagagagaggaccacttgaggccaggcgtttgagaccagccagagcagcagagtgataccttgtctctacaaaaatttaaaaaattagctgggccttgtggtgcacacctgtaatcctagctacttgggacgctaaagtgggaggatcacttgagcctagtaggtcaagactgcagtgagctgtgattgcaccactgcattccagcctgggtaacaggctggaatctcaaaaacaaacaaaacaaaacaaaactttgacccagaggcttgggcacgtatgattaagcatcctagttgtacgttgcctcagagaagggaaggaaagagtgaaacactcactaattggcactgtccatagtggacttaggaaagggaaaaagaactgatatttattgaatacatattttgtgctgggtaatataccaggtattttatatacgtcattatatcctcaaccctgtgataatgattatctccattttataaatgtagaaactgaggcagtcccacagctagaaactggtaaaactagaatttaaacccacgtatgtctactttgaagcccagtgcagttctgcctccccaaaacaaattgggaaagaattgatgtcatgattaggatcagaagggacctgtgtaattaggtgacatgaacttaaatcagactgaccaaaaattatgttatcttcctttgtgggacaggtgctctgtgttgcgaacttactcaactctgccattagagcacaaaacagtcatatgtaaatgaatagtcatgcttatgtgtcagtaaaactttatatacaatagcaggcaccaactggatttggcctgctgttagtggtttctcacccctgttctaagtcactggaaggtctctgggaacattagctgtacagtagttttttgcttatttttaatatatttgaagcaaaaggaaatttaattttttattttttcattcatcttagttctgtcttttaaattaactatgtgtagaataaacagactttctgtttgaggcatgagagggtacccattgattctacatgcagctagtaactcgttaatttctgtttctgcttcagttggttgacaggactaggattgtgattgtcccttctctaaatccagatgggcgagagagagctcaagagaaagactgtacttcaaaaataggacaaacaaatgctcgtggcaaagatttggatacagacttcacaagtaagactaatttttaggctactaaagtacttaggagataattttctttctgctagaagattgattgatcctattttgtcagtgaataatggagtactttcttgtctgggttatgaatgtgaggtataaatgaattcagacatctggaaaagtttttgaatttttctccattattatttgcaaaaataatttaagtttttcatagaaattcaatccattatattgggatgtttgtttcttcactagttgtgtagagatgtgtattctctctcccctcctatgtatgtgtgtatgtgtatacacgcacaacacacacgtatgtatattgatttggagagccctatttcttatttacttaaatgggacctttttcattgaatatgtatcattgacatggttcaatttcagtacttatagatctctaacattctttttcttttttttttttttgagacagagtctcactctgttgcccaggctggagtgcaatggtacaatcttggctcgcctccgcctcttgggttaagcaattatcctgcctcagcctcctgaatagctgggattacagggacccgccaccatgcctggccaatttttgtatttttagtagagatggggttttatcatgttgaccaggctggtcttgaactcccgacctcgggtgatccgcctgcccagcctcccaaagtgctgggattataggcattagccactgtgccaggcccaacattattttctaatggcatctagtatgccatgaatctatgacagtactcttaatttattcaaccattttctactgatagatatttactttatttctgattttttgcttttgtaaacagtgctgcagagaacacccggctttctgaaactctaattttcttccaaagataatgtatttgtccattttcacactgctgataaaggcatacccaagactggaaagaaaaggagttttaatttgacttacagctctacatggctggggaggtttcacaatcatgctgcaggatgaaagccacttcttacatggtggcagcaagagagtgtgagaaggaagcaaaagcagatctgataaacccatcagatctcataagacttattcactatcacaagaataatacgggaaagacccgcccccatgattcagttacctcccaccggctccctcccacaacaagtgggaattctgggagataaaattcgagttgagatttgagtggggacacagccaaaccatatcattctgccactggcccctcccaaatctcatgtcctcacatttcaaaaccaatcatgccttcccaacagtcccccaaagtcttatttcagcattaactcaaaagtccacagtccaacatctcatctaagacaggtcccttctgcctctgaggctgtaaaatcaaaagcaagttagttacttcctagataaaataggggtacaggcattgagtaaatacagccattccaaatgggagaaattggccaaaatggaggggctacaggccccatgcaagttcagaatccagcagggcagtcaaatcttaaaagttcaaaaattttctcctttgactccatgtcttgcatctaggtcatgctgatgcaagaagtgggttcccatggtcttgggcagctccacccctgtggctttacagggtacaggctgtctcccagctgctttcaccagctggcattgagtgtctgtggcttttccaggggcatggtgcaagctgtcgtggatctaccattctggagtctggaggatggtggccctcttctcacagctccactaggcagtacctcagtagggactctgtgtgggggctctgatcccacatttcccttctgcactgccctagcagaggttctccatgaggggcctgcccctgcagcaaacttttgcctggacatccaagcttttccatacatcttctgaaatctaggtggaggttcccaaacatcaattcttgacttttttgcacccgcgggctcaatgccacatggaagctgccaggtctcggggcttccacccattgaagcaacagcccgagctgtaccttggccccttttagtcacagccggcacagctgggacacagggcaccaagtccctagattgcccccagcacggggaccctgggcccagcccacaaaaccagtttttcctcctgggcctccaggcctttgatgggaggggctgccgagaaggtctctgacatggcctggagacattttccccatggtcttggggattaacattaggctcctggctacttatgcaaatttctgcagctgggttgaatttctccccagaaaatgggtttttcttttctattgcatagtcaggctgcaaattttccaaacttttatgctttgcttcccttataaaactgaatgcctttaacagcacccatgtcacctcttgaatgctttgctgcttagaaatttcttccgccagataccctaaatcatctctctcagattcaaagttccaaaaatctctagggcaggggcaaaatgctgccagtctctttgctaaaacataacaagaatcatctttgctccagttcccaacaagttcattatctccgtctgagaccacctcagcctggaccttattggtcatatcactatcagcatttttgtcaaagccattcaacaagtctctaggaagttctatgctttcccacattttcccatcttcttctgagccctacaaactattccaacctctgcctgttacccagctccaaagctgcttccacatttttgggtatcttttcagcaacacctggctctattggtaccaatttactgtattagtctgttttcaaactgctaataaagacatactcgagactgggaagaaaaggagatttaattggacttacagtcccacatggctggggaggtttcacaatcatagcggaggatgaaaggcacttcttacatggcagtggcaagagagaatgagaaggaagtgaaagtggaatcccctggtaaacccatcagatcttgtgagacttattcactatcacaagaatagcatggcaaagacccgcccccatgattcagtcacctcccactgggtacctcccacaacacgtgggaattctgggagatacaattcaagttgagatttgggtgggggtacagccaaaccatatcagataggttatttatatattccctaaattattttgtaaagctggatatgcttattctttttgtttttttaataagatttttctttaacttgcttagagtcattagtatatacacatcctgaagtacataataaaactcagactaacctaccttctgtaatgtatctttcttgcttgagatagtggcttatggagaaataaaatatttatctacaaatttttaagttagcattttgattgtattcaagtagagaatattttcttagatactcatactaagatttaaaatttgatattttatatttgacttttctcttttttagataatgcctcccaacctgagaccaaagccatcattgaaaatttgattcaaaaacaggactttagtctttctgttgccttagatggtggttccatgctggtcacatatccttatgacaagccagtacagacaggtatgtagaatgtcattttatatatatactgtttaagcttaggtagcaaatcccaattaagtaatgtcccttccacatttttataaatagtgagcatttgagcacactctatgagcaaattaccaaccaaagaagattgtacatacatcagcagttcagttacttggagagctcagatctaatggtagcccagctttattgagtctagctatcttgttccatctgttccatttagtccacaagcatttactgagcaattattatgtctgtaaatattgagaatataaaagtgagtatgacacggtttctgcctcatgaaactcctatgtaaccaaatactaacagtacagatttgtccttccctgttttaaactttgactaagtggttgcaccttatggtgagttaaatagttggttgtttaatctctgtggggtcgcagtatatggagatagtttgggtggttttcagtgcatcttacaaagaatattgttattaggctacagttgtcccaaaatgcagtaagacataccaaaacaagtttgtattttagtgtgatagtctgttgtgaaaactcaccattagaaccttttcatgtaaagaggatgtttgtcttctattatcttgggctaaataaaaccttttagggttaattatagtaacagtatacttaagtggagtgcaaaatttattaggagaaaaagatgacttgtatccatgaaggttaacttgggggaaaaaaatcatttggatttctccactgacttctaaatttttctttctatagtggaaaataaagagactctgaagcatttggcatctctttatgcaaataatcatccatccatgcacatgggtcagcccagttgcccaaataaatcaggtagatgttttccataccttttgttattgctgttgttgttgttgcttttgtggggaaaggagtttcaccttaaggtcttcctgattccacatctcttaatgcttttatagatgagaatattccaggaggagtaatgcgtggagcagaatggcatagtcacctgggcagcatgaaggtatgctttctagaacatggttagaatggagttatggccaggcacaatgccgtatgtgtaaacccagtgctttgggaggccaaggcaggtggattttctgagtttgggagttcaagaccagcctggccaacatggtgaaaccccatttctactaaaaatataaaaattagctgggtgtggtggcagacgcccgtaatcccagctacttgggaggctgagtcaggagaatcgcttgaacctgggaggcggaggttgcagtgagtcgagccgagatcgcactactgcactccagcctgggcaacagagcaagattccatctcaaaaaaaaaaaaaaaaaaaaaagaatggagtttatgaatatcagccattgagtacaagaataggtgacttttctggtattgtaaagtgaatggcatctgcctcatggctttcttgacatgtttagcccttacattaacccgacagtacttttttggccattttaaccatttttaattgtacagtttagtgacattaattaaatgttgtgccccaaaaaccatatctatttccaaaacttcatttgccccagacagaaactctgtacccactaagcaataactccctattcccctctcccacggctcctggaacccctgtctactttctgcctctatgaatttgcctattctaggtatttcatgtaagtagaatcatacaatatttaccctttcacttagcaaaatgtttttaggattcatccattttagagcatgtatcattacttcattcatttttatggctgaataatattctatttatgtttataccacattttatttgttaattcatgtgtcgatgggcacttggatttctactttttggctgttgcaaatgatgttgccatgaagattggtattgcaggtatctgtttgaaccctgtgctgccatgaacattggtattacaagtatctgtcacttctttggggtagatacctaggagtggaattgcctggttatattgtaagtctatgtttcaccttttgaggaaccaccaaactgttttccacagcagctgcaccattttacattccttaccagcaatgtttgaggtttccaattttcccatatcctctcctcaccaacacttatttgctggtttttttttttttaaacagagtctcactttgttgctcaggctggagtgcagtggctatggctccttcgcagcttattgcagcctgaacctcccaggcccaagcaatccccccacctcagcctcctgagtagccaagaccacccgcatgcaccaccatgctgaaccaattatttttaattctttgtagagacagggtctccctttgttgcctaggctggagttctttatatattaatataaaaggctgagcgtggtggtggctcatgcctataatcccagcactttgggaggccgaggcgggaggatcacctgaggtcaggagtttgagaccagcctggccaacatggtgaaacccatctctactaaaaatacaaaaaaattagctgggcgtggtggcaggtgcctgtaatcccagctacttgggaggctgaggcaggagaatcgcttgaacttgggaagcagaggtttcagtgagccgagattacaccattgcactccagcctgggcaacaaacacgaaactctgtctcaaaaaaacgaataaacaaacaaaacccattctggatgctgtgtattctagataggaaattcttatcagatacatgatttgcaagtattttctcctattctttaggttaccttttaaatttcttgattatgtcctttgatacatgagtttttaattgtaacgaaatccagtgtacctgtttttgttgttgttgcttttgcagttgttatcctatctaaggatctgttgctaaatccaaggtcatgaagatgccccgccccaccccatgttttcttttcttttttttggagggcaaatgtgggatgagtgggaggggcggggtacatggcccccctgcccacctccctgctccctgccgcctatccttgtgttttctttgaagagttttatgggcttggcacggtggctcaggcctgtaatctgagcactttgggaggccaaggtgggtggatcatttgatgtcaggagttcaagaccagcctggccaacatgttgaaaccccatatactaaaaatacaaacattagccaggctgtagtgctgcgcacctgtaatcccagctacccgggaggctgtggcaggagaattgcttgagcctgggatgggaagattgcgaagagccgagatcttgccacttcacttgagtctgggcaacagagtgagaccctgtctcaaaaaaaaaaaaagaaaaaaaagagttttatggatcaagctgccatatttcagtcattgatgcagtttattttttatggtatgaagtaggagttcaacttcgtttgtttgtatgtagaaattcagttgtgtcagcactatttgttgaaagactattctttccccactgaatggttttggtatccttcccaaaaatgagtttaccatagatgtgtggatttatttctggactctcaattctattccattggtctatatgtttgcctttatgccagtatcacttttttttttttttttttggttgttgttttccttttttttaatttattttttatttatttttatttattatttattatttattatttatttttttattatactttaagttttagggtacatgtgcacaacgtgcaggttagttacatatgtatacatgtgccatgttggtgtgctgcactcatcaactcatcatttaacattaggtatatctcctaatgctatccctcccccgaccccacaacaggccctggtgtgtgatgttccccttcctgtgtccatgtgttctcattgttcagtccccacctatgagtgagaacatgcggtgtttggttttttgtccttgcgatagtttgctgagaatgatggtttccagcttcatcagtatcactgttttgattaatgtaggtttgttgtagtaagttgtaaaattggaacgtgtgagtctttcagctttattgttcttaaagattgttttggctattcagggccccttgtcattccatttgaatttgagcattggcttttctttttctgagaaaaggggtgttggaattttgttagatgttgtgttaaaaccgtatatcactttgtgtagtattgacatctctacaatattgtcctcctatccattatttaggtcttctttaatttctgacagcattttaattcattgtccatccacttcaaattaggcaggagttgttagcagatgggtggttggctgatcattttattcacatgtgcaaccagaaaattgactttattcccatttctgcctgtcttccctcctttatttactaagaacttactactgggaggcattttgctatattagtgataaataaaatatactgcctggcctattgtacgaattaactgtgttacataattaattgatttgatctggaagagagcaactctcagcaggccgtgagaaattaaagacacaaaaaattatatctagtcagagatacagccttttctctttagaggagatggcatttgggctgcagagatagtgaagcagaacattccagaaagaggaagcagtacatagcagaagtctaatttagttagaatatggggtgtaatgcagagccacagaagtttaagaatggaaagagtgcttgttgctttgaatgctttgttttaataagaatgggaaactgaggttttgagcaggggtaacaatattgacatgatctgagctatgctatgggaaaactaatctctaaataatcagttaagatagtttggaggaaggagagactggtacagggagaccggtttggaattatctagacaaaaagtaatgagggcctaggttatgctagtggcaacgagagtagagtcaaaggatgacattttagatattctatagaggtagaattgacaagattcagcaaattatggatgatagtgagatagagaagtcaaagacaagaggtttcattgctatgtaagaaaatgagttaataccattaactgagttaggaaaaagaagagattttgggaaaaggtggtaagttgggtttttgaacctgtctgcacaggcagttcctgtaccttgataatatcaatgccgtattgcagggagtggatattgtcaccagcaggggtccaggttgagggtatgagagagctgatgatcattatctccatagcttcaagtacaactgtgacatttctgggttttgagggaagctgaccctcttctgcatgtactcattcattcatttcttcagcaaacccgaataaaccccatctacctggcactaccaggcactgtgggaagcactgaagataggaaaatgaattcgacatagcccctgtcctcaagggctctcatagagtttgtgattgattataatacagagaggtttatttatatttgtcataaaatgctttacagcttctttgtttacgtcagctacgttttcttttcatttactccatttgttgtattacaaagccttattctttcttttacttattaattttcccacatttgattttgaactttatattctaggattatagtgtcacctatggccattgtccggaaatcacagtatacacaagctgctgttactttcctagtgctgcacgactcccttccttgtgggcagacaataagagatctcttcttagtatgttagtggaggtgagtcttttccttttaactagaggcaaactcccaggaatatgttcagtgaaaacctttatcaaaacattgtcttttaccaaaaatgtatattatttattttaaatttatatagaaagaagagttttggtcattttatgtttcctaaatagatgccatttattcacatctctggaatctgctataatttaggtaatttgaccttgcaagatgctgcaagttctttaatttgaatatcacagagttactggagtcaatataccatggtgggaaggaaatcactcaaggcattagaagattgggttctaatgcttcaggctatgacaatatcagagttctcttttatttccagctctgtgagcctgaatattgaatgaatagcaaacaaggtcagagtcagtggggagggaagagaagaagcaggccatacagagtttgatacttgtttgtgtgtggtttttgttttgtttgtttgtttggttggttttggtcatgcctcaagctagtgcctctaccatgtctggcattatgacaacataaatttatattttaaacattttttcaggttcacaagggagttcatggatttgttaaagataagactggaaagccaatctctaaagcagtcattgtacttaatgaaggaataaaggtacaaacaaaagagggaggttatttccatgtactcttagcgccaggtgtccataacattattgccatcgctgatgggtaccagcaacaacattcacaggtaagaaactcaaattgagtagcatcatgtaaatttttattcttaataatacttctgttttattttgaaactcttgttagaaatcttgaagggaataaagaaattaaaagtgtgactgcctcttgattatgatatcttgttatccttgtaccccttgctaacaaaagggaaaattttctagcattttgtatactttagatggcaatgcatcatctccttagtttgctatatggggcctaataatatagcagggatacagtacaccttaagcagaatttgtcatgattcttacactttctccttctaggtctttgtgcatcatgatgcagctagttctgtggtgatagtctttgacacagataaccggatatttggtttgccaagggagcttgtggtaactgtatcaggtaaagacattttgatttttagtagtaaaagttaaaaacaatcttgacatttcaatatgagagtgggtcacctctctcatattgatcctgaaactaatcacttgtcttctaatgtctccttatctaaatgtgattttcctggacctctgttctcgcatatgttctcctggcttgcctttctctgccgagaccagctccatcaaggagaccctaacccagcggtgctagagaaattaaagacacacacagaaatatagaggtgtcaagtgggaaatcaggggtctcatagccttcagcgctgagaacctccaacagagatttacccaggtgtttattaacagcaagccagtcattagcattgtttctatagatattatattagctgaaagtatcctttatgggaaacgaagggatgggccaaaataaagggatgggttgggctagttatctgcagcaggagcatgtccttaaggcacagatcactcatgctattgtttgtggtttaagaacgcctttaagcagttttccgccctgggcgggccaggtgttccttgccttcattccggtaaacccacaaccttctagtgtggatgtcatggccatcatgaacatgtcacagtgctgcagagattttgtttatggccagttttggggccagtttatggccatattttggggggcctgttcccaacacttctctttcttcaggtctatactcaaacgtcacctccacggagaggctttccctgatcaccctagctacccctgtcactatctctatcctgctttttttcattatagcactttcataacattatatatttgttcatgtatttgtctatattcaatctctcccactaaaacataagttctgagagagggaggaatctacctgtatcctccaagcctagaacgatggttagcacgcagtgggtcttaatgaagagttgttgaatgaatgaatgatttgctttatattaaagtcataagttcctaggactttgacttatattagttccgctttttcaagatccaggaaagaggaaatgtttgtttacgctggaactaattcatgtcattgcttggattactgaaaggttaggaaggaaaaaaatgtggtaaaatgaatactctgctatactttatctatttgatacaaacagccttagtttatttctaagtgcagcttggatgaggcagaataaccaagttttatcacagggttcctgtgggagagacccttagttgagagaaagtagtatattggaaacatggcccaatcatagatcctgtgtggtgtgtttaaagggttcttagcttgtctcagataaagtgtaaataacttagtggttaaaaacacaggaggtagaattcagccatggtttaaatctggctctgtcacccattagctattgtgaacttagtttttattacttttagtttctaacacttttattttgataaccttgtacaaatttaaaataaacaaggagatttggatgaaatgaaagtttactggaaaggaaaagtataatagaagtcataaaaagcaggttgcagaacagtagacacagtataatttcattatggtaaaagaaaaaaaatacatgtacgtgcatatgcataaagaaagatctggagccaggcatggtggctcacgcctgtaataccagcactttgggaggccgaggcaggtggatcacttgaagtcaggagttctagactagcctgggcaacatggcaaaaccctatctctagcaaaaataaaaaaaaattagccaggtgtggtggcatgcacctgtggtactacttgggaggctgaggtgggaggattacacacacacacaaaagatcttataactaaaaatgatctctgggtaatggaaatgtaaatataggaggttttttggttttggcttttgttagtttgcttatctgtatttttaaactttgtatattgtacatatactgcttctataataataaaggttgttcttaagtgcatgaaatagaaataaaataaatgaggggtatattattaaaagttccattgtaagcggctgcttattaatatccttaaagtataatatcacccacatgatggtttttgtttgtcaggtgctactatgtcggcattgatcctaacagcttgcattatttggtgcatctgctcaatcaagtctaatagacacaaggatggctttcatcggctcaggcagcatcatgatgagtatgaagatgaaattcgcatgatgtctaccggctccaagaagtccctcctaagccatgagttccaggatgaaacagacactgaagaggaaacattatattctagcaaacattgaaaaacacattttgcatatctcccagcataagtaccaagcaaaattacagttcctcttgggagaacactgcattaagaagagagactctcttgcttcttcaaagagctttgggaaattaaattgctaaatttgtattctctgtgaatttcactggcagttttgaacttcccttccttaaagtactctaaacctttaaaaaaaaatctgatttatgcagcagagatgggacagccactttttctttttaatttaagatgagctatttggagcttatgtaataatggcataaagccaactagaggatgttgtattttgcacatcagatgtttactagtggctttagtatttttctttgttttaaatggccaaaagaatccagaaacattaaggcagggacagcagtcagaatcgacataaagctttaaaaactcaaggttttttcaacctactgaggagtacttttctctagttgttaaatagctggagtttttcttattcaggtttaatggaggttgaattgatttttaaacacatataacagtaggaaatgaataaatgggcttctgcatttggctttctacctgttccaaggctagatcggaactggtagactacgctgtaagcaggatttcactacctctcttaaggtttagcaaacttctaaatagcccattttaagggagaacttactaactttattgtgaaaggtctaaatgcccacttgaatgaagctgagagagagatctagcaaaagctaaaactcatgttgtctatctttgaacttggtaaaaacccacaggtgctgctgcttatatctgtgaagcactagcttattctaggaatgcctgattctttaatattgcctaaatcggaacctttttctatgttgcacacatggttttcagatgacccagccatctacaagatctgaattctactgaaaatatctagaaatgtggaagagacctacttgcacattcttaacctgtatttgaacacaaaatatctatacttcatgctccagcccaagcctataccctgtaatagcatactattattgaaatcgcttgaccggtcttgttcacataggcctctgggagtgatttggttctttgccctaatgtttcatttgacggtctctttttgatcaaccaatttttctaaaagttcagtcgaaagcttttaagtatagcttcctcccttgaaaaaaaatgtaaactatgactgctgagtgataaaacactgtggtgtgaaagtgtcatcttcactgccaatcaggcaaagaccggaaagatttgcattttattatgtctgtcttatcatgcaatggaaatgatgctttttgtaagtatgcatcttaccaatgatgtaacggtttaatacctttgaatgttttaataaccaagttgctgctgaacttatactaaatcaggggaccaaaaaacttgctcttatcttctcaaattgtattctatatccattaatgtatcagttatcccaaagccttcaggtggaggggtttaccaccttcctaggtcgttcaaccaggttttgtgaggaatgcattcaaagtggctttataaaagaagattttctttagcaagaataatgaggtcatgtcatttgttaataagtatctgtgataaatccgtggttcaaggttaagccattctggtattctggtattagcaactgtaaattctgccacctcatacatggaacagagcttgtgggatgctaatagttagtgaagtatacatgatttaatttctaataatctttatgttttctttaaggatggtggtgtattgctctttttcagctttatttttaagagtacagtcaggaaaccaacaaggggcctaagagtggctgcccctgcttgggacattacagcaagtgaaacaaagttaatgtgacaagctttgctttgttatcattggtcttcactagaggataccttttacatgtacttctctcttggatcaaatatgtctttaactgtacatctcagtggctggaggccatgccttttaagcatgtgtaaaatttttaaagaaatgaacatacacatagttattttagtaatatttcctgaaagaaaaaccaaattctgctataagtcttgatcttcaatgaacttttaaataatgcatttagctggaaaacaagactttcccagcttgtattacctagaagcgtgaatgtataggatacctgactactaagactatattctcagccctgccctgtcttttatttgcgggtctaatctaatattagaatatattaaccgcttaaggcattgaagccatatgggatggggaatgcatttcttcagtgtttctccgagagactttccatttccttggagttatggcggcaagtaagtatcatagtattaagaaatttgcctaaatctgagttgtgcctttctttactcacaaggcatgggctttgtcctggtgatcagtttgtaagccttcttccttcccagctccttaataaaagcaaagtgattgagtaggtaatgttcaaagtgtctgcctgtgtacatgtacttgtattgattatgtagttcagtaagatgtgcccaagtcatttcagaaagaaagacccttcagttttgatgcattttgctgaacacttgggtagtgagtgggatcctatccagttgaggaatgcttgcaatgctcattgaagggatttgctttgggactttgtcatcttccagaaaggaaacatattgtatatttggcccagtgtgattgattgctttatctttggtaacttttacttgaatgggatttgctgaattaatgactattgaatttaaaactaattatgagttgacaaataaataaaaggtagtgtttatgtctgagcttattgtgtttgagctaacaccaggttactcagtaaccatgacctgctcctccatttccatttattctcaacattaaatagttttatcttgttgttgccagaaatgcacttgtgccaggtattgtccctgctgtatgaaaagcttcttggcaatgaattctgtaatagtgccctacattatggttttctggtggaattgttttaacagtgacaacccaggatttccaatatatttttgttttattgttattaccaaaaattccactatgattgatgttcagtgattttctatagcaacttttttggtaactctttgggtttctgatttgttttagctaaaattttggggatatgatttgggtctttgattaatgtcagctgaacttggatttctagttcatgaagaaatctctcccaatacccatttatcctatttttagcaataattcgttaatgattccacttgattttcagaatattgtcctggttgattttgatttgacagcatacattatgaaatttgaaagtaggttaccattttgaggcagttggatataaattatgtaaatatgtatgattatgatttttataaatggcataacatgagtgtactaactaccttctatgctggccatgctacagattttctggaggtatgacaatagtatttttttatgctcagattaaaaatcagcttttcacctctccagtttttccaagtga

SEQ ID NO: 15422 - DNA, 54420 bp, Human
gggaggtatgtggaaagctctccactgccagagccttggtcctgaggctctgcattcatggcaatggtaaccctctttccaggtgaatcagaaacagggcaccccagaatcagcccagccatgaggagcatctctagggatccccatctctgcagcccccaccaggttcaccactcctggtcaggttcacgatttttcttcgccttgcagctccttggtgctctccgcctcccccctgcccctttcttcctcacaccggtggctcagcctccccccgacagttttcttggtttctgtctcagcgtctctctcatctctgagcccctctctctctctcctcctctcggattctccttttcctccccttccttcctctctttcaacctcccctcccaccccctccagtccagcaatgggctgggaacgcagcaggagccatgacaagcccaggcggctctcccgacccttggtgcccccgaggccatttccccgcgctccctgtgccggcagcagccgcgtgcggagagggctcgccgaccagaaggggcagcaggttggagctgtgggtacggggggctcagatcaaaggccaggaatgtctggccccctggcgtaagacttccttcagccatggccctcacctcgtggaacgcccgccgttccaggcctctgtgggactcgggtcggctcattctctgccctttctgccacagttccctacacagcggtccctgctccccaccggcagtgcttccttcaccccagaccggggctgcgcagagtcctggtgcctcaggtggcctgggagggggcctagggaaaggcacccaggtgaccgggcgtgagtccccaaaacctgaccatgatgtcaataccacccagggctgagacctaattcctcgctctggagagggagaggagaggaagcaagcccgaagggggcctggaaggactcctttcctgtggggaggggtgggtaactggaggcatttggtgtccgcacagggcaagggcctttatcgccaaaccccaggctggagctccctatcagtagaaccggggcctcaggcgggacggtcgggcagtgaggggcgctccggagggcagcaaggtcttccaaggacctgggccgccctcggccagagctgcgcgtttcaccggtccctgatggtccaaccgagaatcccactgaggctgtgggtcacgcctccgacccgggccagaggtcgggcctgaacccctcaaggaggagaaagtgacccgactccgagagcaggaaatgcgactggccgctggtgtcagttgcaggaaatgcaaaggcagcaggaggtcccgataccgatctgatccctgacaaaagactcaaatgacactcggctccgtcccccggcgccgcccgcagccagaccttcgagcctccgcggacttttccgcacgttcctcggacacccgggaagtgacctcccgcggccaggacgagaggccagagagcgggcggactcgggaggctggaagctgggagggggtgcgttcccccaccctctgatcctgacctgcccgagcggggcttctggaaacatccctgtgctttctaccctcgattcctcgcgggcccacgtcccaacgggtcacggtccccgccagcaaaggagccacccgttcatgcccacgccaagccctcgccatgtgaacgcccgggtcaaagcccccgcgccctaaccctggccagcgggggaccgcggcggtagcagagggtccggcccaccgcgtccccccgaagccccgcggcgtccggggcgcgggctttgcccaagtttgctgggcgatgcccttcccggagcccgagttgtgggccgggcgggaggggcgcgtgattgacaggctgaactacagactcatctcttaccttaggccgcgggcgctgattggctgctcgctgacatcctcaaacccggctgctccgcgctgggctcgggaggggggcggctgcgggtggaggtgcgcttctgacaagcccgaaagtcatttccaatctcaagtggactttgttccaactattgggggcgtcgctccccctcttcatggtcgcgggcaaacttcctcctcggcgcctcttctaatggagccccacctgctcgggctgctcctcggcctcctgctcggtggcaccagggtcctcgctggctacccaatttggtggtaagactcgcctcttgtctgcccgcggcccggtttctccgccgcgtccggggaaggtgggggcgccggctgggggtgggccgctgcagggctggggctcctctcctcgcctccctccagccccccacccgcccacccctcctggattttctgctggtgtcgccttcagaatccaactcctggctcctctgataatcaccattttccctgctccccgctgcaggggctggaggacttttcccatctcagaaggtttcttattcttagatcctaaccctctgcccgtcccaatctagaggcccccgaagaccccccatttgcttgcagttgggtttctggaaatccagcactgtccctggggcccagccactcctcttctccattttggggtcttcatgggcaaaaccatcctgttccttcactgccaccccacctctgccggcgcctccatcaagagattccccataataacccccctttgccttcctatttcagaccccaaaggcttcagggctcctcccggggcaggggagtgggtggggggatttcatcagattctccccaccgctctagattcatcttgagcctctgaagtgaatatggtatttgctgatccgggatgccattgaattcggattttattcatttcttgcttgtccaccctggcaaaaggggggttccttgaaaatgtgttgtctgggaggggtaggcttgttgttctttgaccaaaaatccaattctccatgtcacatttcttccttttggaaaaccgaggaccgaggagaaagggagagggaagggagaattccgtccctgagaaatgtggatacaaaagacattttagtaaataagactgggaagccgggagcagtgcttggggggggctgtgcgtgtctggggggcctgggtgaggaataaacatcgctttgggagccccagctccaggagtccccttgttttccgagcggccccatcgccgctctcccaccctccgcaggtcccaggggccagaggggaagacactgaaaccagttctctaaattacactccgcctctccccagtctccagccccctacattccggaaaactttaattaaagaatcttcccctcctggacataggagagccttggcctgggcggggggaggtgaggaggaagaatttgggatctgtgagtgagaagtgggctgtggcccccggggtgaaagtcagaaagaagtgccaccacggtgcggtaccgcctgcaggtccccagactccctgcctttcgccaacccagagtccagggtaggaggagcagagacagcgagacttgggggccacaccccgagtcttccagttgtttggggatggcagcatttgtgtctgggtgtttggggctcctgggagagagggtggggacatggccaagggtctctgtttagagggtgctaggagttgctcccaggacagccagccaaggggaagtctttcttctgcccaacccacacttttccggggggctgggctaacctgaggcttccagcacataaagaagtccatggggtggccagggcagccagggacttcaggaaggaggttcggccagtctggggaaaggctgctgccaacaccagtccagcctcacccggccattcctgaccctcttcccattcccgggccaaggccatgccgtttttcgccttgctttcgcagagactctggtgggttgggggagggtaggaaggaaaggtttggcggcccataggtggcagggactgaggaagagagaccagtctctccggccctatgaactagaagagggcactcttccagttggtgtagattctggtgtgaaatggtatcttggggaccatctagatagggattgcccaataggaagaaacgctggggaaacctggaaggtcaagacattggccctaacataatgctagacacatggcttgtttgggaatttggtgggggacaggaatgctgctttgtctaagccaaggagagaggtgtgtgtgtgtgtgtgtgtgtgtgtgtgtgtgtgtgtgtgtgtgcgtgtgttctgggtctatgaccctaagaggtgttttctatacaccagtgtgtctctgtgtgcaaaagtgtttgtgcctgcaactgggctactatggatgtgaaatcgtgtgggcgtgttgggggatccatgcccacgacaggttgtgctgtgtgtgtctgcacacgagtgtgagcaagtggctggtgctgtgatgtgtgtatgtacatgtgtaagagacagagagaagtctagaagtatctttgcccatgtaaaggtcagagcctgtgtctgcctgtgacgctgggcttgactgtgttcatgactgggcatgtgagtgtgtgtgtgcgtgcgtgcgtgtgtgtgagtgtgtgtgtgcgtgcgtgtgtgtgtgtgtgtgtgtacgtgcgcgcgcatgccttcatgacagtgtggggaaagccccacagatgtctttgtgcatgaatatcagtgctcatggccatgacctgattgtgcttgtaaggaggagagtgagcctcaagtccatagctgtgtgagggctgtgtctgagtccgcctgtgatcctgtccccaggtgctgggcccagggctgtgtggctgtgaatatctttgcagacatctacctgtgggtatgaatgacacctgagcttgggtgtttggtgggcagccatgggcctggagggaaggtccaacaggaagcaaaagtctcacaaggtggctgcagggggcacagctggccagggatggcaagctagagaggcaggggcacaggcttccttgacaccagcttgtcctgtctgtccaggcactagagtcactggcccttctctctgaggttgtttttctttggtcttggagctggggtggagggtgagtcaccttctcagggttagggctggggctgtagggtagatgggcctctgattcctgatcccatttctgcccccactccccaacccagccccccgcctggcagtcagattccagtactttgagcatctaagcccatcttggcctgccctctttggcccacccagctcatgcattccccaggaaggatttacaggggaagtcatgtagctgggatttctgtccacgcggaccctcaagcatgacaccctgagtccacactgctcagaccccagtcctgacagaaggttgaccagaagggacagctctaaggggcctcagactgacacccctggaaggaagagatgttctccaggtagtgacagagccgggacaggaaacaacagcactgatttctcgaattccccttgtcagtcccagttagctcctggtggagaaacttgtctttcttcttcttcttgggggcgctggggtggggggatgaacctatgttattagggcctagcccagcacctgctacattccagcgatggacgtgcagatggagggggcctgctggagatcaggagctcaccctgccgctgtgtgactgaggaccagtggccacccatctgggtctgcttccttacacttcacccaggagtccccagcctgccctgcctcacagcttgggtgaaaatgttttgcagaggacaagggcagtgagctgggaaatagcacacctgagttctcgccatcccaggacccatcctcccactcgagcacctgcctaagacctacctcagtttccccatctgtcagatgtcctgctgcctctcccacccactcccacctccacccacctttcagaggcttgtgaacatgttcagtcaaaccccgtgggggtcagtgggctgggcccagggaggcacctggagactgcgggggaggaaggccccaggccaggtgttaacacttgtaacaggcaggaattacagctcgctggggctgggctggctggggctggtgaggagctgagctagctggaggctgttgatcccacagacagacagacagacagacagatgggcagataccagatcggatggccaggctttaaccgggtggtctcccttccagggcagacctttccctgggggggatatggcggggaaattagtccaggtctcttggaagttaacagccctcccgctcaccccgcccccattatgggtggggcttcggagtccagagggagcaaaattggtggccgatctgttggtattcttccgataggatcacattttgcttaaaaagaagaaaacaggtcaaacgttataataataccaagagcctgagctgagttatgtccttagaagaacctgctgtaatatgtatgtggatggcatgggggaaggggacgctctcagggaaagttctagactctcagagcattttgtcaacagctccggggccaagaggtgagagatgggtggagtctgagtatcacccccacctccaccccagggatcctgagggcttgggtctgtgatgtctgccctgcaattaatcctggcctggtgggaagacctttggcgatgaggtcaaaagaggcaggagctggactttggtgccaagtcctttaggaggtgcttgctgcagcttcaccagtggcaaacccagccaggccctaccagggcccacactctggcatctggatacatgctcagtcactgacaaaggtggagaaactgaggcagacagcgagggctctgggtggaaatctccaaagaatgcactcagcctagcaagcatctctcatcctcctcactacagaacttaatgctaataaacattaatggtacttgggcagatgtagaattggaagaagtctctccttggtctgggcaggagacaaggagccaggggataaggagccaggggatggcacaggaaaggtgacttatcacagaggaggatgcagctaacaaacccttccagggaaaaggaagtgggaaaaaggaagatttttctggtctcagaatgtgatgagccaggagttgagcagaaccttttccacctaccctgatgtgagccacagaaaccttctccagctgccaaggagggcaagacatcctccacccctcattcctaactcagggaggaggtatgcctagccccacccccaccccccgccaaaggttagagccatcctgatattacatctgtacatccatgttatcttgtatgctggaaaatggtgagagtggggagatggagagacctatgtctgaattccaagtttaataccaatggaccctgtgacctaggatgagtcccttcccttctctgggcttcattcaagtccctgcctccttctgggcttcattttccttaaccacatggaggggtcccttttgcctctcagagtcccagggctatgacaggttctgggctcgttgctgtgaagcatgacactctactgcacacattccgggcctgtattagacagtccacccgtttctttctgtggctccatctgacctaaatcgcaaagagctggctgccccactcctgccaagccaacctgcttgcacttccaaacctcgccccaaacactcccactcttctggagccaggccatctgcattcacatctggctttttcatgtactacctgggtaactagggcaagttaacctctgcaagcctcagtttcctcatctgtaaaatgagtgtaatgattgcctctatttcatagggttttgaaaatgattgagtgaatacttcttagaatgataccttgcatacaggaagcatatcgatgttagctattttcacctcctatctgcaagctattggctcactgaagccctggagccaaacttgcctcttccaagaagccctcccagatttgccccacctggctctgttttccccttttcttctttttgcctgtttgccccacagtgctttagctttattcttaagttgagggtgctgggccaggctaatctcacttcagctctttacctgctcaggaaggggagggcagggtagagaaggttgctggagtgtcccctaatcattccccgacccccagagtctgccagactcttgctgggacctagagccagggggctgggcacagaaggggtgggggaggcaggcttcccagggggagtggcaccagggccgcccagagcagcctgagcagaagttgcttctctaggagctgagagatgattcagaaggtgatttatagtcggaaggcagaaagcttggctcctggcagaagctgctgcttaattacattcttggggcgggggtaggggggtggaggtatgtgtggggaggcagcaggggccagacttctgcctcctccccatccaggccctccctgtccctttggctgtcccggctctaagcagggtccttctttatcccgctgccagagagggaattccctgctctcagtgagaggctaggccaggattgcaggaatagcttctgggagtggagaaggtgggaaaagaggaaggaagctggatcccatctcccgggacttctccaagggagactggatggcgacgggctggaaaacgggccttctgggaaggagcactgggtctcctccctgcttctgggcagcggaatagctaaggcacctgggcagagttgagtttctttctttctttctttttttcttgaaacagagccttgctctgtcgcccaggctggagtgcagtggcacaatcttggctcactgcaacttctgcctcccgagttcaagcaattctcctgcctcagcctcccgagtagctgggattacaggtgcgcaccaggatgcctggctaatatttgaattttttagtagagatgggggtttcaccatgttggccaggctggtctcgaactcccgacctcaggtaatccacccgcctcggcctcccaaagtgctgggattataggcgtgagccaccgcacccagccagagtttctagaatcttctgagaggcaactccacgctctccttcgggcaccctgtcctgctgctgcctgggagggcctgcctgcaggtttgctccttttctgttgctcaggtctcagtgggccatgggggctggagagaaggtcctgcgctcagaggctgaaacccggttcttcagcgttaggcagcctgtccctcgtgagcacagtggctaccccaggtgcacaacggttctgccagcaggcacggccccataccctcatgtcaaactaatatctcagagagtcaccccaatgccgctgggtgcagctacaatcacttccgcgccattgacaggagcccccattctgtttccatacctgctgagttgacatcagcatttcccatattaacactgacccatgcaacaacccgcccgatgacacctaaggccgcttagttccctgcatcgcagccgtgaatcccaaatccctcactgctagttcttaaggctggaaaggtgtagggcgggcaggggtagagttgctgaagccagtagtgtcgatttatctgtttgcagcctggcctgtacagccgggaggagttggcaggggtcaggatggggacactagacagctctctggttccccctgaggcgggccttctcaaaatggcctcattatgtgtgtggagtgaattccagaaatgtcaggcacacccatacatctagggaatgaaggagatgccagagcgggctctggggcgagaggggccagtgtgaggaggtgggcggcttccgggcagggagttagggcacctgagacctggctctgccaccatcttgatattaggcaacttcctgaactgttctgagtctcagtaactaggagagttggataagctgctggccaaagacttccagctccgagattgcagtcatggaggctgtattccgcgttcaggtcacccagctatttggaccatctgtgcctggtggagggggtggtcactgaaagctggtctcagggaagggtggggggtgcagagctctaaactctacacacaaagagctgtgagacagtggatgagtctcctccctccctcagttttctcatctgcaaattggatgatgataataacacgaccacctgccctgcctgcttgcagggccgtgaagagcttcaggtggaataatctttgtgggcatgccccgtgaccagttggcctcagacctgaggcctctgtgccctctgccaggggctctccattgagcatcaggacccctacaggaaggagctgaggactccttcctgaggacacttgggaagtgtcaggttctttccagagaagttaactatcactgtgagtcctagaaaagaggaataagaaggctgggcatggggcttacgcctgtaatcccagcactttgggaggccgaggcgggtggatcacctgaggtcaggagtttgaggcctgcttggccaacatggtgaaaccctgtctctactaaaaatacaaaaaattagctgggcgtggtggtgggagcctgtaatcccagctactcggaaggctgaggcaggagaatcgcttgaacctgggaggcggaggttgcagtgagccgagattgcaccactgccttccagcctgggcaacaagaccaacactctgtctcaaaaaaaaaaaaaaaaaaaagaaagaaagaaaagaggagaggaataagagctagtccctgctcagacagtgctaagaatggacctaagagcccccctgagcctctgagcttgaggagttgatatttccagcagaggaagaagtggggctggacaggggagtcctcagctccttcctgtaggggtcctgatgctcactggagagcccctgggagagggcacagaggcctcaggtctgaagccaactggtcacggggcatacccaggttcacagctcagggcatggggcttggttatcctcctggcctaatgcaaaaaccactggccagacccagagtgagatttccaaccagggacacatgggaagatgtaggtggaggtgaggggggcgagggcaaagggctgccagctggaaggggctctgctgaggcctgtagtcatcagggaatcctaatggcctgggtaaggcctagcaaactaggagacaggcacaagccattccctccagctcggctggaaaaactgcgaggactgagtgtgtgtacgtgtgtgttggggagggggatgggagcaacaggaccaagcacccaggtctgtctggaagacctttctgggaaacctgcccctgggcacagagtcccacttatctgccagagccagctgggccggcaaggaaaaccaatctcgcagggcccattaggaatgcaaatagggcttgtgctgtgagtgagcaggatcccgcctcctctccagctcccaccaatcatcttcacaaggtggattgctgagggtgccactcccctgctctgacacctcccatggctcccctcttcctatctggtactgaggctccctatgatttcacttctgtccacctgcgcagttgtaactttcacaaaccccctcgatccccccaataacccacttcaactggaatactcacctctttgcttgttcattgaaatacttccacctcctctctctgactttaaaaggcagcccaacctggggcctgttgacctggggtcagtctgctctgcgctgctcagctcggaccccacttggctcaggtcatgtagctaacagccctgaactatggagggtccttagagggtctctcaaggtggatgggcccctcgacctgagcaggctgctgtcccaggagtggagatgagccttttctccacagtgtcaattcccctgggtttctttttctttttttttaatcccagttccacttgtaaacgtttcctatttgtgtactatttccccctccatgttcaccagttcacacgatgcttaagtgtctaagtcattaattttaagattgcaattggcagaagttgtttctctatctaggaacaggttaatacgtttgttgaccatgtgctatgtgctgatccccatgcagacatcatgatttatctgaatctaattcttgccagtttatagatagggagtcccacagtgcagcctgggcatggcatgggaagccctgagcccacaccctgttggacctaaagcctttttccttctaccaccattcaggctcagttgtggacttgttattggggtaaaaatttgcttgttcatattctactttgttccccaaaggatggttttgagacaagtttacacttgaccttccactcaaaggctgatgctttgggcttatagatactatttgtgaacgtctgggaagtctcttatttggggatgtgtcctcttcactggccacctttccacaagccatcaggctgtcctcaagctgggattgcacagttgctgacagcagtggccatgtgaggattttgttgcccctgggatgggtaaggggcgaccttgatcaaatcactgcctcccgggcctcagtttcctcatctgtgaaacagaaagggtagcgtaaatgacctctcagattccttccagcactaagctctttccttctacttagtcctttttgctgctttgcatctggtctccatcatatacgtgctagaaagcagctgggcagaatcttctttcttgccctagtccaattcttgtgttggtatctctgaaacagccaattgttcatttcacttttacaattcgaccttcagctttatttctccccgaggagccagcatgctttctcctttctgataaagcatgcttccctttatgtcctggctatgagaaaactcagaggtccacctgaagccacatccttgcacccgtgtggaccttccctgatcctgctcttccgtttttattttgttattgaatctgatgtgttttccgtcatcagcctcttgagggcagacatgttggagtctttgtacctggcctgggcataatggatcctcaataaagacttgtctttgggatacacatttgctgtcaacctcttcaaatcctttctggaaagaagcaaggcacatgcgaattaaaaagcaaaataaacattgctctgggagggagttggtcctgactggatagttttgagttatgagaattccagtctgcttctgtttcttttttttctgtttatttatttacttagagatggagttttgctcttgttgcccaggctggagtgcagtagcatgatctcggctcactgcaacctccgcctcccgggttcaagcaattctcctgcctcagcctcccaagtacctgggattataggcatgcgccaccacacccagctaattttgtattttcagtagagataggatttcaccatgttggtcaggctggtatcaaactcctgacatcaagtgatccacctgcctcggcctcccaaagtgctgagatgacaggcgtaagccaccaggcccggccttctttctgtttctttactgtcagcttttccccaagtctacaaaggtcttgtcttcagagaagtcgcctcttttttttcctccatgatcttctccactctaaagctgaggttggttcctaatcttcctctagggactgtctctcgttcctggccaatgactatgtccacccctacccctggctcccttcacaactggttcctcccaccctcccttgccttggaagccgacggtgctattgccaccattccacaggtgacggagtgcccaggtagcacccaccctctctccaacagagctgctcccgtccccagcagccatcgtgagggccaagccccactctgcagatggagccccaaggaggagcagaggggagcggcggccagggatctccccattcacccagcaaggtgtcctcacaactctaaccggctctcccctcccctccgcttctgcccttgggcaacacatgtgcaggtcaccccacccagtccctgacttcggaggagagaatgtctagcctcaggctgggtggttctccatcttaactgaagcttccataggggattctggagcctttctctgctaccagtaaggatggagtctgtgacctctgcactgtcctggaagctaaagcagcctcgagaaagcagcctcttcatccccatgttacctgtgagaaaactgaggctcagctgggcgcggtggctcacgcctgtaaccccggcactttgggggacaaaggcaggcagatcacctgaggttgggagtttgaggccagcctgaccaacatggataaaccccaactctactaaaaatacaaaattagccgggcgtggtggcacgtgcctgtaatcccagctactggggaggctgagaaaggagaatcgcttcaaccgagggctgaagttgcggtgagctgagacctggccattgcactccagcctgggcaataaaagcgaaactctgtctcaaaaaaaaaaaaaaaaaaaaggaaaagaaaaagaaaaaagaaaaaaagaaaaccgaggatcacaggacccaaccaggagctgtaaggagctcggaagcaagtgggcggctccagtggcagctagtaattcctcgcttatgatgtcccgggtatcacatacattgaggaaacaaagcacacacattagctcatcctcccgacaaccccaggaggcagagactcttgttatccccattctacagatgagaaactgaggccctgaggcaccattccattgccgaaggctccatggttggtaaaccccagagctctaaacaagagacaaactgcctgaagccaggcccttcagtgacaccacaccacaccacagccaggaagttcctccttagatctgacttcagtctttccttaatccaggcccaggttttcttcctggggatgtgaatatcactgtcaagtttcagtttggtttggtttgagacaggatcttgctctgttgcccaggctggagtgcagtggtacaatcacagcccactgtagcctcaatctcctggggtgaagctatcctcctgccttagattgccaaatcactaagactacaggcaagcaccatatgtggctaatttttttaatttttatttttatttatttttgagacagagttttcactcttgtcacccaggctgcagtgcaattgcaagatcttggctcactgcaacctccacctccccggttcaagcgattctcctgcctcagcctctcacgtagctgggattataggcgcccgccaccacacctggctaatttttgtatttttagtagagatgggatttcaccatgttggccaggctggtctcaaactcctgacctcaggtgacccgcccacctcaacctcccaaaatgctgggattacaggcgtgagccactgtgcccagccttttttctttttttttgtagagatagcatctccctacattactcttgcttgaactggactcaaacaatcctcctgcctcagcctctcaaagtgctgggattccaggggtagggttccagtttgcacttgaggaccagggttcgtctcatccctgaatcttcctgtgtctggagttggttccttccagtgggttcgtggtctcactgacttcaagaatgaagccacgtacctttgcggtgagtgttacaggtcttaaggaccccaagagtgagcaacagcaagagttatcctgaagagcaaaagaacaaagtttccacagcatggaaggcgacccaagggggttggtgctgctggcttgggggtgggggggtgggcggggaggcagcttttattccctcatttgtcccagcccatgtcctgctgattggtccattttacagagtgctgattggtccattttacaaacctctagctagctacagagcactgattggtgcattcttacagagcactgattggtgcattttacaaacctcttgtaagacagaaaagttctccaagtccccagttgacccaggaagtccggctggcctcatctctcattccttctctagaacaattcctcccaggtgacccatcctctactcacctttaactacttgttcttcctcttctgatctcttaccagcttttctacaacttcctgcaagtcctatagccacagaattgcctttaaatcagggaaagagggggcctgccatcagctctctgatttagaggcttccgtctggtgtcttacagcacttcccttccccatagggcagggagtctggaatccagcatgcctgccctcaagaggcttatgacggaaaacacatcagattaaataacaaaataaaaacaggctagttgtggtggcttgcgcctgtagtcccagcactttgggaggccgaggcaggcagatcacttgaggtcaggagttcgaaccagcctggccaacatgctgaaaccccgtctctactaaaaatacaaaaattagccgggtgtggtggcacgcacctgtagtcccagctgctggggaggctgaggcaggagaatcgcttgaacccaggaggtggtggttgcagtgagccaagatcacaccactgcactccagcctgggcaacagagtgagactctgtctcaaaaaataaaaataaataacaaaaacagaagagcaggatcaaggtcaaggagaagacaaatatgcaagtcaaggtcaatgcaggtgcaaggatggagcttgccctgagtttcctcacagccaggacataagggaaaacacgctttacctgaaaggagaaggcatgctgggtcctcagggagaaatgcccgcctacagcctgtgcccaccctcttcagctgcgccatgagaatttaggctcctggagtatctggcccagacagccgtgagcctgcttccgggctctgcaggcctctgcctggggcccattctgccagggcaggccacactgcctgtggccaagggctggtcaagggaaattcatttgcaagggctgtggctggagcttgagggtgtggctggggcctccagcatgggatgcagaagggatgggcaggctgcaggcctggggctagatctcccatgtcaccattgtctagcgtgaactttatcaggtaacctagccctctaggtggcaagtaaggtttttgccaagataggaggatagaatgattgtttaacttttttttttctttcttgagacatagtcttgcactgttgcccaggttggattgcagtgacacgatctcactataacctctgcctcccaggttcaagcgattctcctccctgagccttgcgagtagctgggatcataggtgtgcaccgccacacctggctaagttttgtatttttagtagagacaaggttttgccatgttggcaaggctggtctcaaactcctgagctcaggtgatctgcctgtctgggcctccgaaagtgctgggattacaggtgtgagccgctacgcctggccaagtgattaactttttaatgaaagtacaggaaaagacgtaaactgtctttcctctgctttcaccctgcaataattggtacagaagacttctgtgaccaaatgcgtgcatacaccaagcaagctgtcaattctgcggcagacatcagccagcgtcctctaatccaattcaattctgatgatctccacctggacatagcatctgatcccataggttgaggtcttagttcccaggacagcctcccacttccagtagcaatcccaagccccaggctgctttacatgtgctcctgactgacctgctataaatcagggttcctgtgacttcctccttgggttccattaatttgctagagtggctcgcagaacacaggaacacacgtttactggtttattataaaggatattacaaggatacagatgaagaggtgcatagggcgaggtatgggagaagctgcactgagcttccacgcccttcccaggcacaccaccttccaggaacctccacgtgttccgctatccggaagcacttgaaccctgtccttttgggcttgtatgggggcttcattccataggtatcattgattaaaccattggccactagtgatcaacttaatcttcagccccctctccccttcccaaaggatggggttggggttagggttgggagtccaaccctctaatcttggccgggcacggtggctcacacctgtaatcccagcactttgggaggccgaggcaggtggatcatctgaggtcaggagttcgagaccagcctgaccaacatggtgaaaccccatctctactaaaaatacaaaaaaattagccgagcatggtggcaggtgcctgtaatcccagttactggggaggctgaggcaggagaatcgcttgaacccaggaggcggaggttgcagtgagctgagatcacaacactgcactccagccagggagacagagtcaaactccgtcaaaataaataaataaaagaaaagaaagtccaaccctttaatcctgcctgggtcttttggggtaaccaacctcaatcttgaagctgcctaggggctgccagctcttccgtcagctcattagcatacaaaaagacatcactttggagtttctaaggattttaggagttgtacgctgggaaactaggtcgaagaccaaatatatattttataatatcacaaacatgcgtacaggcgagcacacaacttgtcagtgtacagcttaatgagctggatagaatatcttatgtttaacagtttgtgaacctggcatgaaacttttcaatactgggcacatggtagatgaggcttcgttgagtggtctcaatgctacagccaggccttagggcttggcggggaaacagttccactagggtcgaactggcacagcatcgggaagaaggcttgcctcctctaatgtggctgcatcatctccatccctcccttggcagacccacagtggcactgccctccctcacagctgtggtcacttacctccaagtccctttttgttaaacttggaccatgttttagcctttctcagcctcaacggatcttcttttctgatcagtttagtcagtcttattttaatttaatttaatttaattcaattcaattcaatttgtttttcaagatagagtctcgctctgttgcccagagtggagtgtaatggcgcaatcacagctcactgcagcctccgcctcccaggttcaagctattctcctgccccagcctcccaagttgctgggattacaggcgcctgccaccatgctcggctaatttttctatttttagtagagatggggtttcaccatgttggccaggctggtctccagctcctgacctcaggtgatgtgcccacctcagcctcccaaagtgctgggattacaggcgtgagccaccgtgcccggccactttggtcatttttaaacggtctaattaggagtgcagcagcagcagatatgactgtgttgttgtatactcctcagcctggcccctgccgccctgcacccgctcctctcccaaccccaacatgggtaagcacatgggcctgggtacagcagtcctggactctagatggttctgcctttttatctgggtggacttcacctctccaagccttggttttctctctgcaaaatggggataacgagggctattgtgaggatgaaaggatataacgcatgtgagactagcacagggtcaggtgtgtactcagtgagttagacacacattttgctgacattaatttcatgttacagtctgcgttgttctcgtgcacacctcacttctccgtgcctctgtgctaccccctgccttctcttgggatgactacaaactcctgttcggtcttgaaatcatagttcagccatcacttcctctgcgcagccttccctcagcaccgcggccccagcaaaggcccttctgagcacatctatttcatggactagactgtaagtcacctgtgggcaggaccagttctccatcatctttcaacccataccaccaaacatagcacagggcacacagtggatcctcaaagacaggttgtgggatgaaaggacactgttgagagtcacctgctggtcccagactcttgtctccctgctccagctggattctcattgcctctgtgatgctctgccaggaagaccagctggtacttgttgtgtattttcctgtattctcagatacctcttcatgtgcatctgtcttgtcttcccagtgtaagagtcagcccctgagggcagggattctgctctgtaggcctctgcatcactagcgagcctcacacatcatcctgagtgttgcaggagcacagttaggaattctgttatcaggccaggcatggtggctcacatctgtaatcccagcactttgggaggccgaggtgggcggatcacctgaggtcaggagttctagaccagcctgaccaacacggtgaaaccccgtctctactaaaaatacaaaaattagctgggtgtggtggtgggcagctgtaatgccagctactcgggaggctaaggcaggagaatcacttgaacctgggaggtggaggctgcagtgagccgagatcgcgccactgcactccagcctgggtgacacagtgagactccatctccaataaataaataaataaataggaattctgttagcacttggcccaggaatcagactccttcccaagcaggctgcagttcaggctcagctggtccccactctctgggacagcactcccctcactctgtgatctcccaggaagtccggctctgggcatctaaccttggtgtggggaggcaacatagcactccagaaagagggtaggctctgtgacagaaccacctgtggtgcaaatcccagatgtccacttcatagcttctagaactttgctttgggtggttgcttaaaaatctgagtctcagtctcttcctctgtataatgggaataaaaaatatgatctcaaggtagttgtgaggttgaaatgaaataacagacagaaactggctaggcgcagtggctcatgcctgtaatccctacattttgggaggccaaggcggacagatcatttgaggtcaggagttcgagaccagcctggccaacatggtgaaactctgtctctactaaaaatacaaaaagtagccaggcatggtggcgcacacctgtaatcccagctactcaggaggctgagatgggagaatcgcttgaacctgggaggcggaggttgcagttagctgagatgacaccactgcactccagcctgggcaacagagtgagactccatctcgaaaaaaaaaaaaaaaaagtagaaataatagaaactgagttgaaggtgaatcattaaagatgttctacaggtcatctaatgtagcagggttataaaaatattctctcccaggccaggcttctttagagcagaaagatctgaattccttccaaaacagaaaaggctggcttcagggaatcccacacactttatgttggtttgtcccaaccaataagcctatctgaagaaagaagcgggtggggaggcatgtggcagaagtctgtgacttggtggacaaaaggcaatgcagactctggcatgaccttgcgttctggtatcctgttcagccagagtactcacaaaggcctccagttctcaggaagggaagggtgaattaaatgtggttagctatcagggatttttttttttttttttttttgagacggagtcttgctctgtcaccaggctggagtacagtggtgtgatcttggctcactgtaacctccgcctcacaggctcaagtgattctcctgcctcagcctcctaagtagctgggactacaggcacgcaccaccatgcctggccaatttttgtatttttagtagagatggggtttccccatgttagccaggatggtctcgatctcctgacctcgtgatccacccgccttggcctcccaaagtgctgggattacaggtgtgagccactgcgcccagcctatcagggatttttatgggggttccaaggagtggtctgtgtagatttaatatcaccctagttaatggctgaggcactggctgtgtaagcccttgctaagcacagtgagtgagtgtggctggaagtgcaggaggcctgggtgggatgcaggctgatccagggctggcagtcactgtgtgcatccaacctttaggcgagagagggctgctaaactctgagaaggaattcagggtgaagaagagctgatgtgccaatggtatggctggcacaagcctaagcagataccagctattctcctgcaagctgatcaaaaatatttttattacataatacttgacatatacaagagaacaatcatatatattagacatgatgacagaatgaaaacctgagcctcactatgtccctgaaggaccagaccgtgactaggccgtcgtgtccatctgtgggtcctcctcagcccattccccatctccctctagatgtgaccacatcctgaattttacctatttattccattacttaaaaatactggtttttggctgggcacagtggctcatgcctgtgatcccagcacttcgggaggccgaggcgggaggatcacctgaggtcaggggttcgagaccagcctggccaacatggtgaagccccatctctactaaaaatacaaaaattagctgggtgtgttagcacacgcctgtggtcctagctactcgggaggctgaggcaggagaatcgcttgaatccaggaggcagacgttgcagagagccgggatcacgccactgcactccagcctggagaccctgtctcaaaaaaacaaaaaaccaacaaacaaaaaactggttttcccaggtaataatgcctaaatgaaatgttttattttgcctatttttagcattataaaaatggtgttatactgcatgtggccctctatgttgagctattctctctctgcattgtgtttctaagtttcaaactgttcctggatcttgctgtagttctcacatgctcacagttgcataatagtccatctttagaatatacagtttatctattttgtctcctggccatggatgtgcatctcgctgtgcacagcagggaaaggtgttcatggaggtacctgcctaggcgtggaactttgggttgcaggatgtgtgaatgttgagctttacaagatgatgccaaactgttttccaaagaggttgtgcccatctgtgctgtcatctttgagattgtttttcccatggcccaaggcccttcttcccgcccgaggcaagcccactcctgaggactccactgccttgggccttcaccgtctttctctcaggatcccattccctactggaaaactctttcctttccctcctccacttggccctgaacttcccaggatttttcaaaacccagcctggagctgccgtcttcctgggagtcctctcagcctcacttccactctctcccaggtttttggaacagcttttccagacagctcttgggccagagtaggacatcgcatagtgtgtttcttataacatcagccccacataatcctgttgagaaaggcttctggagtcaaataaacttaagaatcgccacaggcaacttggagcctcttggtgtttattgttctcatttgaatattagcagctcattagcatagttgcagcactgagaggtcctgccagtgtgacccgtttttatttgtttaacttgttttccaaaaatatttaaccttggagcccttttcccattttcccccatttggaaaatgggatcgagaagattctcctgcctatttcagtcagtttggttttgtggtcttattttcctcggtaaccaagctgagagtcctctgacttctgttgtaatcatcccgtgtaaactagttcagtccagaccaccctttctggagggcttgagtggaaggaatgaatgaatgcactcaggaattaatgaatgaagcagtcagccaatcagtcagccatccagctgagccccctctcctatgcagcagccaggaaccagggactgatcaggcaccgctcatcttgcaccaggggacacccgggctgtctggctggtgaatcattctcccgtcttaggtcccctgtagttgcatttttaggatctgtcacccaatgaggctgggagcccctgcggggcaggaaccaagttgcgcttgcctctctgtgtgccccgagtgggacatacagatgggatctctcatccaactccttctgagaggggcaggagaacattgtggttaagtcttcagcctctggagccagaccagatgtgtccctaattacctgggtaatgtgggccaatctctgcctcagtttccccactgagataggggtgatgataacataccttccttacagaattattatggggttaatatgcggcaagcacacaaacagtgcctggcatagaggatgtcactggtctttattagcactatgacaatggcaaccaacatttattgtgcacctactatgtgccagggactgtgataaaagctttatctacatcatttcaattcttcctccccgcagcctctttgaagtgggggatgtttttctcattaggaagttgagtcctcccaaggagacgtggtaatgggtggtagcaataagatcaggattggggtcagccagatcacaaagccctggcctgcaggcgtggagggtgccacctaccacctgcggatgggacagctcctctgtttctttttactgataattaccctgccgacaacctgatcagttcttttttttttaatcctctattcatctcaacaaaatggaaatccatggtactgcaagggttagaatttaacatgtgtgcacacgtgtgtgtgcgtgcatgcatgtgtgtgtgtgtgagagagagagggagagacagagacagagagagacagagagcaagagtgcacaagtgaaggagaaggagttatctgagaagcctgggggttactagcaccttcatgacagaccaaggaagacagagatccccgggtggggctggctttgagactgcacagcggcagaatcgcttgtgagtcagcagtgccgcagaacagcagggtgctccggaactgggcttggtgtcgtcacccactgccccttgcacagggccctgtgtgccgggaaatgtttgcaggctggacacctgtggttgcttttaaccaggcaagtgagctgggttagaggtagccacatgttcctgagggctcgcagctttggatctgagagggttagacagggcgtcaggggctgagggtcactggaggagaatttgctgtcgtccctttgcccacgggccggctggtcttctcagaccccagaggccagctcctctgttcttccccacctcggaggggagccccagaagtcacagggtcagctgtctgctttccacactgcctagggctttattcttgcaccatccccagttctggccacaccaggggagtgagacatggggcgccggtagaggggctgaatgcgctggtgtggggtaggaggtttcggatgcacattccagagggtgtttatgggggagcagacaagcctggggattcattcctggtagggaacaattccctcagcacccgagggtgggaaatgagggccaaaatggtggctcagagggacacaggtgaggtaagcaggtaagaattcccaccaggtgtctcagaaatgtcctgggaagggcctggcatggtggctcacacctgtaatcccagtattttgggaggccgaggcgggcagatcacctgtggtcaggagttcaagaccagcctggccaacatggtgaaaccccgtctctactaaaaatacaaaaattagccaagcatggtggtgggtgcctataattccagctactcggaaggctgaggcacgagaatcacttgaacctgggaggtgcaggttgcagtgagctggaatcgtacctctgcactccagcctgagtgacagagcaagaatctgttaaaaaaaaaaaaaaaaaagaaaaagaaagaaagaaagaaaagaaagtcctgggaagctggtggaaggaggtcgagatcttcctgacctgggaaaggagggaattcccaggcatctatagaccaataggactgtcgaaagtttgactggtgtgagaatgggttaaggtgctgaattttagatttttatcctctccacggtggtacagtgtgttctgcaaacaaaggagagccagccttgaagagcccttctcagagctgactatgttctttggctcctcagcccagtgagatggccttagctctgagccctgtgcaatatgcaaactggaccagatgacccccaaggctccttctagctctgacaggtcctgtcgggggatccagcctgcatatagggcctgggcttctttcagccccatagatggtgacccctcttcaccgctagtaagattgaagctcatcagcaggacctcaggccctggcctcctttcttcttggtcccttgggttttggagttttatgtgacatcaatgtcccagaaatgcccatcctcttccttttctctcagggcacagtcccctgaggtcttgtggtttatccacccccacccctgttctatgtcctccttcacttgctctcccccacgcccctcccaccagagagtttataagctggctgtccccttgctaacctcctgctgttccctatgaacatgcctgttagatttcaccgtgtgacactgtcttggttatgtccccgtcgtgcctagttcagtgaagaacacatagcaggtgccgaataaatgcactctgctgggataaactggttatctccagagggtggggtctggacagagtggcaaaatagcgatagcatgggatttggggtccaactccacctccacttcctggccgatggcaatctgtcattggtaaactggagccggcatctctactctcagggctgttgagaggattcatggagaagctgtgtgaggaaatgctttgcaggttggaaggtgctgggaacgtgtgtcatctaccctggcctctctctcaggaactcttgcccacatttgtcagcatctgctgggtgtgttgtcttgggagaggtcttgttaaccctctgccaccttgaattctctggtcccctgaaattctttgtcctgtctcacacacaaatgcctccagccctcaggtcgggggtctcctctcctcctgcaatgccttgggcgtgggtccagccttgtctgagacacagagaaatggacctccagtgcggaagatctgcaccaacattcgaaagaaaaaagactgataggcgggagcccagcatttgaatttacagggatgttaaccccaacagcggccggagcagcagagcaggacctgagcacttccttccctttctccttagccttccatgaacatgctctctataaaccctgtcctggtaaatgtctcccctcattttttttttttttttttttttttttttagacagggtctcactctgttgcccaggctagagtaaaatggctcgatcttggctcactgcagccttgacctcctgggctcaagcaatcctcccaactcagcctctcaagtagctgggactacaggtggtcaccaccatgcccagctaatttttttttttttttaattttagtagaaacaaggtcttgctttctcggctaggctagtcttgaacacctgagctcaagtgctcctcccgcctcggcctttcaaagtgccgggtttacaggtgtgagccacctccctcagccctcactgctttttttgccatctcagtgccaccatttcctagctatgtgactttagacgagtcacttggcctctctgagcccatgtcatcatccgttaaattgggttctttggcaaattaaaggatgtattctatgtaaagtgctttacatggcaactggcacatagtcaggcctcaataaatgttaactattattattaataatggccactggccaggcgtgatggctcacacctgtagtcccagcgctttgggaggcagaggtgggcagatcacgtggtcagtagttcgaggctagcctggtcaacatagtgaaactctgtctctactaaaaatacaaaaattagccaggtgtggtggcatgcacctatagtcccagctactcgggaggctgaggcaggagaatcgcttgaacctgggaggcagaggttgcagtaaaccaacacggcaccattgcactccagcctgggtgacagagcaagactctgtctcaaaaaaataataaaatggccactctgagtgcctcagtgaataggctccttactaccttacttagagcagagttgaggaaattggtgaagttcttcactaccttattagccactctctacccaaataaatgtaccccaccttatcttattcattatgggtaatcacctgtaaaagcgttctttatttcattcacagcctgagtgtccccaaaaaggtgctccatgacgtcatcccccctctggaggacacctcctcccacccatggtgatttgagccttctcttaggccagggtgattcctgggggaaccttaactggggctaatgtgcactgacattttgccttttgtgtcgaacacacatcccatttgcagagatttagaattttttgactttaaatgttcgctatttctatgtatgtgtaagagagagttgttttcttttgttttgttaagagacaggatctcactctgttgcccaggctggagtgcagtggtgcaatcacagcttactacagcctcaaactcctgggctcaagcgatcctcctgcctcagtctccccagtagctgggactacaagtgtgcaccaccacacccagctaatttttctgtgttttgtagagacagcgtctcgctgtgttgcccaggctgatctcaaattcctggcctcaggtgatccccctgcctcgaaattctgaagtgctgtgattataggcatgcgccaccatgccagagagagagattttatcttttctacacaacgtgtgtttcccccagaagaaatgccttcctacttctgtgatgaatgtaagtagaatgcagacagaaattacagaaactccctgtgccccagcacccttaccagggcatgcctggcctggtggagtgacagggtgttgtacacagtgaggggaaggaagggagtgggagaggaggtgaggctctgcagagcagagtggaccatttctggtcagaaaacagtgaggaggccgggcgtggtggctcacgtctgtaatcccagcactttgggaggctgaggcgggcggatcacttgaggtcaggagtttgagaccagcctggccaacatgttgaaaccccgtctctactaaaaatacaaaaaaatttagccaggtatggtggtcctcgtctgtaatcccagttactcaggaggagaatcgcttgaacctggaagacggaggttgcagtgagctgagatcacgccactgcactacagcctgggtgacagggcgagactctgtctcagaaaaaaaaaaaagagtaaggaaagcgaagtcctgggttggggggaaatgtagctgcaggcaagaaccaaggaaggtgtggagcccccaacccagtagggaaaaggcttgctgccttgaacccaaagagtgtgagcatcctgtacctttgcagacagaacttccacctactcacaaacagatacaccccactgcacagctaagaaagctaaggggaaaccaggaagaagggaaaagaaaagaggaaaaccccagaggaaacgaggagtcaggcctgggcagggggttccagatgacgcatgaggctgcaggaggaaaaggtttcttttgaaacacatcttttatcctgtccttttccgatgtacgtgagcgtgtgttttggaacgcacataaaacgcgagcgcagtagccggcctctgatttctgccaaggtggacggaaacggaggggcgtgcccaaatgcttcttcttcatggctgctggatcagggaagttttgcttctgtggccgtgaacatggagatttgctgagaggccaaggagagagatgatgggggagggctacttcgggagaggaagtggacaagaccagaggttggaaaacaggggacgggttgatcctaacaacttggagggactggtactgggaataggaggtggggcccagggggagggcagaggacccaggagccccagctgtggacccagggtggggctgtgggcaggtccccagccctgtctgtgacctagggcagtgcttctcaaccttgagggagggagggaggataccacagaggggagggagcacctagaccacttaaatccctttctctgcagggggcccaggcagccttgtttctaagctcagcagggccacttactatgcagccagggatgagaaccaatggcccaccctgctgagtgctggaatgtgtaatgaagtcctgcgtgggtctgtaatgaacccagattcggctcctaacaggtgctgagtgcatgtttgcaaacccaggcgcctgttgcaaggagaggacagagctaaagcaaggagcctgcggaggaatgggtggcagggactgatgaagttgggggaaggaggtgcagaggaaaatgttgaggctcgctctggactgcctcgcctggggatggagaatggggctgcaagggaggggcagccagcgctttgaacttgggtggggcctccctaaatagagtgggggaagtccaggtgctgggcagggctgtcttcacctgcccatcctcagcgccgtggggggatgaggcgcaaagaagccctcctgggaatgtggtggaaatacccaccttgaaaggtagagagtggaatcgttgccctgagcacctgggtgtggtcgcagcatcccccgtgaggcctcccaacctgcagctgcctcctgcgtgcgcatctgccactgctggctttagggccagggccaggcccagctggaggtccaagctggagccctgggcagtgtccagtgcactgtggcctcaaagtgcccagccatggtttagtactccagctggcaaggccctgggttcaaaccctgctctgaatttgtccagttgcttccccatggtgtcatttggtttgttcctctgtcccttgtgttccctgataacaagaggttacctctcaaagcttggttagatcagattaaacgtctttggccaaagaacatcatagggaaggttggggccttcctgctgcatcatctcataccattctactgtcacacttctggtggaggcttttaatgatccagtttcctggactcctctccagaggctctgatcctgccacgctggtgttggagcctgggtgtctgtatttttcaaaaccaccccaagtgatctgccgtagtgtatagcctgcatccctgaccccagtagccagctggtcagggactgtccttggttttctgaagagcatagaataagagagtggatgggacagtccaggtaggtgccagccctggtggccagtgctatcaggtgtgaggcagggagggtggcctctgggcccccataaagaggagaatgggcttcctcagggcagctccaggttcaggtaagagtccttgcaagaccaggagtgccccacgcactgtgctcccggcgtccagcataaggcctggcccagcgtgaatgtttattgaataaagacacacaccaggctggtggctctctgaggagccctggggagctgctctaagagtgagctcccagccaagcagcacagctttgtgtgttccccactgggctgcttctaagattcaaacaaaggactcccaaactgtggagctagcagctgtgttaaaaggcccagagagccagcagggccatggccatcacctgccctcagctcgccgtggagacagcctgtgggacctgggagagacgaaggaaaggactgggcactcagtggggctgctgagggcagtgaaaggaggcagggaggtcctcgcagggaggtcctcgcagggccactgcacctgctgaagcaggtgctagattctacatggaaacgagtgaaagaatccctcctctcaaaaaactcaccatcaatggagtcggtggacaattcacttgagtgcattgaaggttacctgtgacggatgtataagagctggggaaatggccagagggaacaatttgaattggagacattaaaaggggatttaaacatgggaccttgagggatgaatagaagtctggagtcagaagcgaacaagagggctgggcaggctatgtcttgtcttttaccagaactggcttgaagggtatagcaatgtggggacccagcaaaatcctggtgtgggaaccagcagacttggctgctcagaacggcagcctaactctgtaaggttctcatttcccaatctgtaaaatgggagactgacttagggtttggaggggtcaggaaggggagaaatgttacaaggttaaaatgaactaaagatgcaaacatggcttaggaaaaatttgaattagaattccacttagtggagtgggaggcaaagaaacagatggccaagctccaggaggaaaagctggccaagctgagctcaacttcaaggcccagctcgaatgtcacctctttgaaggggacttctttgccttctcccacttccttcccctcagcacacctattccttgaagtcccaagtgggacttctcacactctgcaactgactggtcacctgcactgaggtggggtcactgaggagggtggaggctacatcttttttttttttttttttctgaggcagagtctcactctgttgcccaggctggagtgcagtggcacaatctcggctcactgaaacctctgcctcccaggttcaagcgattctcctgtctcagcctccagggtagctgtgattacaggtgcccaccaccacgcctggttaattttttctgtttttagtagagacaggcgtttcgccatgttggccaggctggtctcgaactcctgacttcagttgatctgcctgccttggcctcccaaagtgccgggaatacaggcgtgagccaccgcgcccggccgaggctacatctcatacatcttgggcacatagtatgcaggtactgaatgaggcccagccttcagatgatcaggtctggggcacttcaagaacgatctgcgtgctatgagagagacaagctctggctgggagtcagcaggcctgggctgtgctctctgcactgcctccaaccagtggaggaacagcagggaaggcacatcgcttccctgggccttaatttccccaaggagctgaactaggtgatgtcaaaggtcccgcttagctttgacattttatgacctaacactgtaatagaatcactaacatgcgtggccatttacagaatgctcctaaagcccttccaggacactcctattgttcccccgcccccgccctactccaatagcaagaaaactttcacaggtggagacttttcttcaacaggtctttattggctgggcacgctggctcacacctgtaatcccagcacttggggaggctgaggtgggaggattgcttgggcccaggagttcgaaacccagcctgggcaatatagcaggacttcatctctacaaaaaattttaaaaacttagcagagcatagtggcatgtgcctgtagtctcagctactcaggaggctgaggtggaaggactggttgagccaagtagttcaaggctgcagtaagctgtgattgtgccactgcactgcagcctgtgtgacagagtgagaccctgtctcaaaaaaaaaaaaaagaaaaaagaaaagaaaaatggcctttactgaacatctatctttgtactgatgagcacccccagagacacctgggcccaccagggtttctagaatgttctagaatgttcagcatcccctgagttgccaagactagacatttagggggagctgtatgacaatcacccaaaactgatgggcagaaatgctgtgaccccaagtaggcctctgggccttgatgacatcctcagtaacagagagcacggcacccctttgtgtgtctgaaggcagagggctgggaccctacctgagcacgcacagggcatctgggctttacctgggagtcctgaactgcgcagcaaagtggagaaacggacccagctctcagcatgtgtccttgggagctgctcccctctgtggtcaccaggcagcacttgcccacctgtgggcttggtgcctctcagggagacgctctggggtctgaagagtgaggtccctgccttttacccgtctctggacacccctctgggcctaggcccttccctgtgaatcccctgcctgaaggaagagacccacagccctggggttcctctggggtgccaagtgggggactgtgtttggtcctggggaggatgggctggggctgctgagcaggccaggggtgcaggacccctccatcccccgcttctcctgtcctcctccttcttccacccttgactcctctcacctcttgtcccctcttccctcctgtttccactctctttcctcctccccaggtcccaccagactgctccatgccccggaccacaatttggctgaaggcaacaatccctctctcgcaccctcctccctttttccaggcttatcaacttcactttcctgtgaaatgaaggggtgggggggtgggtaagaaagaaggaaaaagcacttcatgctcacaacacaacaaaaaacaggtttaaacattttacaggtttcaacatttttcaggcggtcttgtcacatcttatcagatcagccagagccgcaggcaggcgctccaggagctgctttggagaacagaagctgcaacattccagcccaggcactgccccgccctccacaccccttccctcccttcccttttctccccaaagaaacatcccacagggctccctgggatggagcacagggcccgcagcctcttccctctgactgaggtatagtctgtggccaaacccttggctttgagcttctgcccgcaccctttccttctccccacggctgcccagaaccatggtcctcccgggctctcaggtggtccctggcagctgagctgtgccacctcctcggaaggcccctcgtggccctgaaagggaaccttcagaagctgcgggcagaagggagttgctaaagtcgtccacagcatgtagaagtggtcatttggccagcagggctagtgagtttccggggctcctggggcctgtcctcgggggctcctgtcggaggggaaggaatagctttttccttggttatcttttctccgtgtgcatgggtttttctcctatggcgtggatcactgcctgggatatccccttccactcagtcacccccagacctcacctttctgttcctgctgcactcacggtgacattagtgacacaatgcagggtgacaggtccaggaagggctggccaaagcccaaaggctcagagttaagccgaggcaacgtgagggacagacccagaacctggatcccaggacaacagggaagagctggctttgtagcttgtaacaggagcatggttagggctgggaggtcccactgtgtggtcagagaggggtccccaagggaaggcagctgtgcactgaaggcttaggatgcatcataagaaaagcaaaaaggggaggccgggcacggtggctcacgcctgtaatcccagcactttgggaggccaaggcgggcagatcacgaggtcaggagatcgagaccatcctggctaacacagtgaaaccccgtctctactaaaaaatacaaaaaaattagccgggcatggtggcgggtgcctgtagtcccagctactcgggaggctgaggcaggagaatggcgtgaacccgggaggtggagcttgcagtgacccgagatcgcgccactgcactccagcctgggcgacagagcgagactccatctcaaaaaaaaaaaaaagaaaagcaaaaaggggaaagcgcagaggaggtaggggcacagtggctccctctgtgtaggtatgttggctgtgcatctcgtggggacctcgtccggaatatggaaaacacaagccagacctgggcgcctgctgccagtgttggctgggcaggggctgaggtttcgggagagcccacctttccagcctcctagtgtgaggttcaggccctgaagctgggctggctgccccttggcccccagccccctccctggtgcctccaccccttggcatatggcatcaatgctcccaccgtgacgctcagtgtcctcccaccgtgtgcccacagccaagatggggcctaaagtataattcaacttttagctccttacaagcatccccagatggatttctagcttccgtccctctcttgggcccagctctgtctctacgtggtgcctggaagtccctctggccccacgcacttcctcgtcttgttcccaaagctgctttgcttcttaccttcccatcttggtggacaccatctccatcttcctggtcatcctggctcaaaactttggccatactttcctccttcctcctgtttctcatgggaccaaacggctaccagtccttattcacagcttcctgtctgttcctgaagccactgtcctgagatgaccagcgggcccatcccctgccacagaccccggtgacccagacacatgggtcttggcccagctgcacaatgagagctgagccctgggaggttgcaatggatccccaggccccagagtctccttagcatccacgtcaaccccgcctcccagccgctttcccagcacccacctcttgtctcattttgcacataactaacaggatgatattccaaagcccagctaaggaaggtgctagtttgtccgaataatgtctggcactcagggcccctttctagctgcttcccctcctctgcttctctgtgtggctcctagaccctggcttggggaggcatgccaccttgcctggggctgtccccctgccacctggctccacctgagggcccctagccatccttctccagctcggtagctgctccacatggagccctccagaggcagtgaggacacacttgcccccgttcctagagatcgctcgccctgaccatgcaccctctggcccagaggttactggggctgaaagttacaagtgccttgggaccatgtctcactcatttaaggcacccacagtgcccagacctagtaggtgctcaagaaatgcttgttggtctgttactgacagcagcctcctgggctgggtgctcctcaggtgtggcttcattaatctccacgttcccagaacctggaaccctgccaggctgagagtcatcactcaattcgtgcgtgttgagtgaataggcagtgaatgactttgtttaccaaggccagactttaacctgctctctgaaggacaggcacttccactgactccacaaatcaccaggccccagtcttgacagctggggctaaatcaagacaggagcccactgggcttagagcccgggcagctgctccttcatggttttatctcaagaccttgggtcccagctcagggcctgcacccactctaccctcacccttcccttcctgtcctagacataggcaagggtgctcccacccctgctggagatgcaggcgagccagagggccccgttgagagaatgaactagccccgttgagagaatgaactagcccctaatggcaaggcccagagacatgtcccacttctttgatgaaaggcaccccctgaggcaccttggcgctctcccacagccacaggacacagccccacctgagtccctttgggctcagaagaaaccccctacccttggccctgcactgaaatgtcaagaaggtccagacctgtgctcagtacccgcagggtgcacatgtgttccaggagggcgaggaacagtggcagctggaatcctgagctaggtttctctggttttgtcacaagctccctgccaagcagccaggtgagcggctccagtccaggcctgtggcctccctcatccacagcagtgattgcctcgtcactatgggtgtagttgggtgcatcagagcccaccaggcccagccccacggtgtgcacacatgcccctgaactggctaggcttcctgtcctgacatctgccaatcctgaacggcttcttgacctaagtggaaaggtagaggcctgagttccaaagccaacgcttggttcctcacttcctgctctttcctcaaacctttcctttcccttctagaagtttccgtggagggtggagcccttctgggcccaggaacaagttgggcctctgtccagtactgcccaggagccagcaggtggagcacctggccctggcctgttgtggggttgacaggagcaccgtggcccccaccacagggagaggaaaatgaccacaggagaggtgatttctgactccttctcctcaccttccctcctcctctccctctcagcagccatgtcagtcattttaagagacactagatcttcagatcagagtcttaagatgccttccctttgaggctggcacagatggttagatttccgcatggagaaaggtaagggcaaagggcctatttctgcaaagaaggcatgacttggggagacttggccctggagagcaccctgagaccggagggaggaggggagcctttccctgggccgcagcccctgggtccaccttctgcagccccacccatgtgaagccaggtgggtcctttttgtgcccagccccagagaagcttctgagaatgtgcattcatcacccccaggttaaaagcctggtgggtaaaagaactgtgagccctgggttctcctcccacctcctgggcagccagctgtgtgaccccggaaaatgacaaacctctctgggcctcaatcttcccgtatagaggaagagggaattagactagacccggggctctggaatttcgtcctgcacaggggctctaggtgcaaagttgaaggctggggatgcaagcaccatccctcctttgatttttttaattttgctatttaaccattttaaagtgtactattcagtggcattaagtacattccaatgctgtgcgaccatcaccaccgtctgttttcatcatcccaaactctgtacttattaagcagtaacttcccactccctcccttccagaacccctggcaacctctgttctactttctgtccctgtgaatttacctagacacctcatgtaagtggaatcatacagtgtttgtccttatgtgtctggctgctgtcgcttagcttcttttcaagtttcttctatgttgtagcttgcatcagaatttcattcctttttttttttttgagacagagtcttactctgttgcctaagctggcgtgtctttacctagaacttcatgtaagtgaaatcatacagtatttgttcttccgtgtctggcttctgtcgcttagcttgttttcaagtttcctctacgttgtagcttgcatcagaagcatcagaatttcattccttttttttttttggttggggggacagagtcttgctctgtcgcccaagctggagtgcagtggcgcaactggctcactgtaacctctgcctctcaggttcaagcaatactcctgtctcagcctcctgagtagctgggactacaggcacgcaccaccaggcccggctaatttttgtattttagtagagatggggtttcaccatgttggccaggctggtctcgaactcctgacctgaggtgatccacccgcctcagcctcccaaaatgctggcattaccgccaccacacccgcttccttcctttttctggctgaatagggtcccactgtatgtatgggccacctgttgtttatccattcatctgctgaggactcttgggttgtctctaccttttggctgctgtgagtagcactgccgtgaacactggtgtacaggtgtctgttggagtccccattttctttcctttttttttgaaacagagtcttgctctgtcacccaggctggagcgcagtggcgccatctcagctcactgcaagctctgcctcccaggttcatgccattctcctgcctcagcctctctgagtagctggggctacaggcgcctgccaccacgcccggctaattttttgtatttttagtagagacggggtttcaccgtggtctcgatctcctgacctcgtgatccgcccgcctcggcctcccaaagtgctgggattacaagcgtgagccaccgcacctgggcggagtccccattttcaattcttttgggcgtataccaggtgtggcattgctggattatagggtgattctatgtttaactttttgagggacagggccctcttttcatatgttctgtatgtaggggagaggagggagattgtgtgtgattccatttgggaggccacctggttgggtgcaggactgcctaccctaatggatcactcaggggagtgggtgctggcagcacagtgggtgtccctggcagcacagtcagacccccatcagcaggggattggccgtcactgggtggacggcagcatctgaggccaacaaccccagtgtcagatcaggcaggacgcactgtacagggtgcctttaggtgtctcaccatatgttaggtgcgtaagtcaatgcagcatccaggctgacctgaattcactgattaaaaatgttctctaaaaatgttctctatggccaggcatggtggcttacgcctgtaatcccagcactttgggaggcagaggtaggtggatcacttggtcgggagttccagaccagcctggccaatattgcgaaaccctgtctctactgaaaatacaaaaattagctgggcatggtgacgcatgcctcttatcccagctacttgagaggccgaggcaggagaatcacttgaactcgggaggcagaggttgcagtgagccaagatcacgctttgtactccagcccgggcaacagagcaagattctgtctcaaaaaaagaaaaaaaaggtcctctctgccttgtgctcaccatgcaggcctcctgcagccctctggccacagcaggcgttatcagggtagaggcacagaactggggtggggatgggagttagataaggccatgcacaaggtttaggtcttgcctatttgtggagggatatttcactccaaggggtcaacaccaaagtttccacaagcagcccgttgtgcagggcacccgcagcccatccgcctggctgcccgtgtgtgtccttggcccagctgggcagtgggtggtcggagtggaggatgagccggcttcaggaggagggtggcagggtcctagggaagggaagggccgggccaggagctgggtataaatagcccctggcccagctgcgaaggcctggcagggtcctccgccctccccctcaccagctgtcagtgccaggcaggtctctatcccccttgggagcctggccatcatctcagatcctaaacgtaggaacttcctgagcggaaccaaggagtcttgtcctgtgtgtaggcggaagctccggatgccgggaggtctggcgagtgaggggcatcaggctcgtcctttggaagagttcttcattcctttcctccagaatcatgaatacctagcatgtgcccggccctttggaagaccgagtgggctggggtgtgtgtgttgtgtgtgtgtgtgtgtgtgtgtgtgtgtgtgtgtgtgtgatggggtagggaccggggaataactggagaaaacactaccactacctctcttcttggagactgagactggcatagccagatggaattggaaacaaatcagttcagcactttgggataagaaggtttgaattaggtacaggaaagattcaggcggaggagaggtgacttctgtctggagctcacagaaggctttagaatggtggtgacctaggaatcaggtttcgaaggatggtgtagaatggttgccgggggccgggcagtggagaggtgcttcgagccgagggctcagcatgtgcaaatgtgcagaagtgtgaaacagccccgctggagtcattcagctggctaggcaaatccgtcaaagccacgcacactttggcacaaagaatcgaggagcatgagagtcactgtgccgcctcccgaagtggaacgtgtacttcaataatggggaataggagtggcgagttaaagtaatgtgtctgcgatggtggaatttcagcagtgtgcgggcaggaggctcagggtgggggtggccgggcatgtttggggaagggcagccatcctgcagaaatcaatcccatggccacagcctctttagtctccgacactggcccaggagctaagccccatcgccagaggccttgctaattactcgcaggatgaccccatctgaactgaagcctttgaatggagcatcctgaaaatgtccttttgcctgcactctttgagtgaccttgaaccctcatccagatcacaactgtctttgttctgccacccctgtgaggactgaggtctgatccaggcatcctttccagtgttggataggaaggggctgagatttctgatgtgttctaccaagtcagggatgcaaggatgggagaaatgaggttggtgacaaggcagggaacaaagtgctggggacagctccacacacaccgtaaccatagcaaccaccatctagcaagggctccccacgtgccatgcactggattgtgtcacttattcctcctgtcgtgtctattttaccgataaagaaactgaggtatagaggttaagaaaattgctgagatcagcagctaggaagtggtagagctggatgggaccctggcaccatggctcccaggtccacagttggtgggacctgggcaacaggaaggagacagggtttggtggaaagagggaaaacagctcatcatgactgaggctcaggaattgttctcagaggacatcacactgggagtcagacaaactcagggcttgaattctggctcagccacttccttgcataagtcgcccaactactccatgcctcagtttcctcatctgcaaaatggggataacaatgcccacctcccagagttgttgtgaggattcagtgagattatgtatttgaagtgactggcacagagcaagtgctacataaatagttgtcattagtattgccagtatccgggtaactgtggggacagaaggaaatccctgtggggcagaggagagactgcgtctgcacagcaggaagggctcagtggcaccttcttcctggagatgtctgggaagcactccgacctttgaggccaatcaagccatgcaggcagtgtgccagagctcaggtgctctgctgggctgcgaagacccacctgggaccctgagggaggtaactggtgaaaccaggaagcagggagccccttggagagctgggtgaggagccgccttgccagcatgggccccccgactcctcagtcccccaagccagccggcctggctttctctgtggatatggctgtgtgacctcgcacaagttggtcctctttcacggcctctgctttttctttttccttttttgttttgagacgaagtctcgctctgtcgcccaagctggagtgcagcggcatgatcttggctcacaacaacctccacctcccaggttcaagcgattctcctgcctcagccttctgggtagctgggattacaggcgtgagccacctggcatggtcggcctctgtttttcatctgtataatgggctttgtgctcccttagggctcctcctgtgggttctgctgctggaccagggctcagcctccagtttagcttgagggtgcccaggcctgcagaaggtgtcaagcaagggctgggagagggggaggaaggaggaggcaggaaggcaacgggaggggaaggaggagggcagaggaagggtctccgagtgcctctcactcccgcctcagctctccgctccagtggtcccatatagggctctgggtcccaaacaccagaggaaggagcggggacagcccaggcttcttccctgggtcttgttcctgagctgcccatctaggatggtgcaaggccgagttgtctgcactgaactctccctcagtttcccctccagtgattgcagggctgtgggggcagctggcacagcagggctgggctggagatgctgcttaagagcacgggaggggcagcctgagcccagagggaggctcaacggggacctttgcagcctggcagacagggcagggtacttagctccctggcctcagtttccttatcttggaaatgggacaatggcgatgataatgaagtttttattacagacctgccgtgaggattacataaggtaacagacacaagcactcagaactgtgtccagcacatgataggcccataataaaccacagggattatatgatcactctaacctgcttctaacagggcaggggcagtgctgtgtgcgccgtgtgcccatcagggctctgggctcactgactctacccactcaggcatgtgctcagtatggaggcccagggtgcagatgggccaggcctgaagccaccttcaccccatgaagacccaggcaggcactgcccagcaggcagggtcacatagtgatgacccccatgggctctggagtctgacaccctgggttccaaccagcaattccataggagctctgtggtctggggtgcttcatcaacctgcaaggctaagccatctgtaaaatggggctaataatgaccctactttgtgctggggctattttgaggattaaatgaggcaaacccaaggaaaagcctctgctcagggccaggcaccggggaaatcagtaattagccattaccaccgataaatcagaacttctgggccgggcgtggtggctcgcgcctgtaatcccagcactttgggaggccgaggtgtgtggatcacgaggtcaggagatcgagaccatcctggctaacatggtgaaaccccgtctctactaaaaatacaaaaaattagccgggcgtggtggtgggcacctgtagtcccagctactcgggaggctgaggcaggagaatggtgtgaacccaggaggcggagcttgcagtgagccgagatcacgtcactgcattccagcctgggtgacacagcgagactctgtctcaaaaaaaaaaaaaaaaaaaaaagaacttctggctgctgcttctttctctttagaaaaagctcagtgcttaagacctggaatgcctcacagatgttaccatccaaactcccagatctggctcctcagttcctccacccaaaataaacaaatggaaaaaggagaacctgcctctccccctgacaactgagcctggagacaaccaaggtggatgggtagcatgcccctgcacggtgcccagggagctctgtgccttggagtctccacgaattggccaaggccaacatcaagctcaagtatggaggagggacccgggggaaggcacatggcactctctgacccaccacagaccaaaaagccgtaggcaagctaattcactctctaaacctcagtttcctagtccaggagatagtgatgttcttcatgtttgggaattgatcagaaatgttgtatataaagtgcctggcaagcagtaacagttgccaaatggcagatgtttggctcggccctgtgtccagcccagaagcttttgtgtactaaaaagcacacaaaaaacctcaccctgccccatggggtcttctcccggcccctctttccgaggcttttgcccatcactttttgtgggaaacttgacttaggccaatgctggaccaaagccttggtcagtgctggacacagagggagaggagatgggccccttcttccagctcacactgcccctggtcatagagcagattgcaattgtccttgaaggccactgacactcacggatcattttctcaggttctcccagaaaatgtcatttctgctgttcctgtgctgagggcagggaacggaaaagtcgtaattcctaccttggttttctagtattttaaactcttctgccccacccccataaggtcattctttctgttgttgactataaaacctgagagagttgatgggatattgattacaaagcgaggggcagaggaatggagtgaattgaccagtcacctggtgttgggtgtgggcagtgagatctgagatctcccttctgactctgtgctaaacttgttttgacacaaagccaagctccagtctctcatgagaaaagaggtggagctctagaaacttctaggaaactggaaagatggtcatggaggccctggtagacaaaggacttggtgcaagccagcaattccttggggagatactgggaggctctgggctgggctggcaccatcgcagggaagaggctgagggcattgccaagggtagtgtgtgtgtgtgcgcgcgcgcgcgtgtcccatgagtcactggaagtgtccatgtggccccagtatcctggactgccttggaaattgcccagcctgatctcttcaatgcccatcagggaagctggacccagaacctggaaaggactggatctgggccccaaataccatctttctagtccaaacctcttttcatggctttgcattgcccccaagggcccccacaagcggcttctgcggtcccatccccctgcaagctggatgcagccagagggctgacttgcgtgggtcagagctctgcgctttgaggggcggcatgctcccgaggtcaaaggtagcacattcaggtgccagggcacaggccctctgcctctccacctaccccggagggttcacaaagcggccatggtgcccaggatgggctctgtgctttgtgcccacagtgttactaccctctgtctgcctgcaggtccctggccctgggccagcagtacacatctctgggctcacagcccctgctctgcggctccatcccaggcctggtccccaagcaactgcgcttctgccgcaattacatcgagatcatgcccagcgtggccgagggcgtgaagctgggcatccaggagtgccagcaccagttccggggccgccgctggaactgcaccaccatagatgacagcctggccatctttgggcccgtcctcgacaaaggtactgccttggggctgagggggggggaggggctgggtggggggagggatcaggactgtatgcccttccaccccagtcagggtgcctcttctctgaagccagggtccctctgggagggtgataaatttggttgcatgactgccacaccttcccaggcgctgctgggggctgggccgccttgagatgctccaggatcctgaggtttgagggccgacaccaagaaggccacagacttccttcctggcttttgcacagtgggcgcctcaggctcctgctgtggacatttgtgacatttccccaatgctgtgttaagtgctatgcaaataccgctttggggtgggggtgagagcattgccacccctaggtccctcccatctagaaagtcctcagtaggtgaggaagctgcctggtgctgtggtagcattgcgttgcccccaagagcccctctgggtttctgttcatcctcatgccctgtcagctggatatgcccaggaatcatggtggggctagagggtgcactggcctctgggtaactttccggccgtcttgcagcctgggagtctaactggctgtgcctcaagtggacagggaaccacatgatttgactttgaacctgcaggccctgggagggaggctaagtgggacaactcctcccaagaaggggacttgggggctcatggactgggtggaagatgggcagctctttgtggaacggcagtgtccaggaatttaacgatcctggccgggctggccacagccagagttgctctgccacccaaaccgctgagcctggccctccctcctattagaagctagggaatgaatgagagctgcctatacagccagaaagaaaagggatctgacgttcaggtgaaggggtggggtgctgggtggggttgggggggaagctgacaacccccattttagagtgcagttcccctttaccggtgcctcaggtgctcagggtctgtcccacctacaggcaaagtgctggctattgtcatgggacaggagggtaattagcaaatcaatggatgatgattctgtttacgcttctattgccaaaactaattattccttgttgacataaaagatttggcctcttaattggggccaagtggcggcggtttgcatttcaaactcgttcttgtcggtgtgttggtctcagcgctttccggtgcccctcctcgggccaggtagcgctgaatcaaacaaccctgcgtctagacgcgctccccaaaagcgagtcacctctgatcgctcttcccgtctccggccaagagccaggggaaagcggctctgggagcgctacccattcactccgcgttgaacgttttaagtcaccaccgtaggttctggcacacgccccggtccctagatggcccgaggacaggtttgggttgcggggggaggggcgatgtgtgcccgagagtttgggaatttgctggcggcggcgaggagagcatcccggaagacgccgcgagcgcatacgcgccccggtcggtgcccagagcccggaccttgaacccaggttcgcgcccagctccggccccacgtttgcaccccgcccccggcgagtccccacaccaccgccgcgtgggcggccaagggttaatctctgccccgcgctttgagacccggggcgcagcgggtcgggcagcccggggcgcgcgtcttccgcgagtctgggggcggcggggtcggcggccggaaggggcgaggcgcggcggcggcgcggcgggcccgaggcgcttccccaggcgggggcgggggcaggggcgggggcgggcgccggaggggcctgggcggcctgaaaagcgcccgagcaccgcccccccaccgcgcggccgccgcgccattcacacgccctctggccattcggcgcggcgcggcgcggcgcgggggcggggggcgccgcttcaatggggatttcgcggcccggcgccggggccgggggcgcggcccggccgcgggagccgcccgttgctacgcggtggcggccggcccggcggcccgggcccggcggccgcattatgcgggtaatgcggtgtgacaccgcgcgaacaaaggcggattgagcggcccagcgggccccgccggacggggaaggcacagcggggctgtcagcgccgctcccaggctaatccccgccccgcccccgccgcccccgcgttcccggggctgggaacccagcgcggcccggggcccgggcgccgctgccgccgcgagaggccgcaggccggccggaaacgaggggcgcccgccctgtgaacccgccctcggcccctcttccccgaggcgcccccagggctggggcgtctaggattggggcgagtgagcggcgcggctgggaccccgaggccgggagcacaactggacgcgggacgtcgggcccccttgccgccgtcctcggtcggccctggcagcgcaggcgcggggcgcgggcgggaccagctctgcactcttcgccctcccgtcgttggaagtgggacgggcccctctgtaggtggctcaggagggcgtgggggccgcggagagcggccgcgggagccaagaggggtcccgggcttccttcttgcagcactcggccaacagcccaggaggggaggcgggcgcctggcttctaaataaatttggtcacatttatgaccaattttgccgactaggccggcccggcgtttcacagcctgtgtcaggtggcgagtcacctccggctcccgggtcctgccatgaggagagagatggttgggctgcaggtcttgcaggccttggcctccctaatcgtcaatgtccacatctataaaatgagtaaaactttccatgtgaatgaagcacatgcagagacgatgaccgttgtgaggaggctggagcacacccttgagagtctctcctttccctgcgctggaccctgggacagaaccaggggaactgcccggtgtccctacccttctgggagggagttggccgtgcctgggcgtgagggcaggagaatggggatggggagactgaggcacgggccactgccctcctggtgaggggctctaggagcggagggaagccgtgtccattttacaaaaagggcgactgagaccgagaaaaggagaggggccgtccctatgcatccacgtgcggaaggggtgggcctgggcaggtttaggctgtagattcccaggcctccctccttacagacctggatctcactcaggcgtgggagggctcaggcctgtgcagggtggtctctggactttgggaaggtggagggcagggggtgtgggaccaggacagaagtggctgccttatctctgcagcaacctgccagagctttggtgtcggcgcctgtttctaacaggcactgctttgccctgtggcatttgaggtcctgagctaatcagcagcccagggcctcagtttgctcatcggtgaagtgggaatacccaactgggtctaaaccagccaaagagggtggggaagctgcctccctcttgcctcagggctggtgagctcttcaactcttcctggcctcgttcccctcacgtcctggcctgggaggtggaggcagggcaggcgctcccaggccgggtcctgagtgctgcctccccacgacctccccgcagccacccgcgagtcggccttcgttcacgccatcgcctcggccggcgtggccttcgccgtcacccgctcctgcgccgagggcacctccaccatttgcggctgtgactcgcatcataaggggccgcctggcgaaggctggaagtggggcggctgcagcgaggacgctgacttcggcgtgttagtgtccagggagttcgcggatgcgcgcgagaacaggccggacgcgcgctcggccatgaacaagcacaacaacgaggcgggccgcacggtgagcccggctaccctccccaaacccttcagggagcagccccccgcttcccctccggagctgccctggcccccacctcaccccttccggcagccctgtgggtcgcgggctccttttccccttggccaggcttggcctcctccccaccccacagccacttcgtctgtccaccctccttcctccttgggcagttcctggactccaccccacccgggatgagtcggcctgggagcatggccaccccgtgggatcaggtgccacccaccacccatcctgtgcaccttggcacgcggtgtagggctgtcaagtcctgggaacctggctttgaattcagcctccactcccttactatgcttgtatgatctagggtgagtcacgttaagttcccagcctcagtttccccatgtgttaaatggagataactcctatttcttttttctttttcttttctttttttttttttttttgagacggagtctcgctcagtcgcccaggctggagtgcagtggctggatcttgggtccctgcaacctccgcctcccgagttcaagcaattctccggcctcaacctcccaagtagctgggattacaggcgtccgccaccacaccagctaatttttgtatttttagtagagacggggtttcgccatgttggccaggctggtctcaaactcctgacttcaggtgatcctcccgcctcagcctcccaaggtgctgggattaccaccgcgcctgggcaacaactcgtatttcatgcgctgtgagaagtggacgtgctgtctacccatgcttggggtgtgaagggggagggaaacatggtcactattctttaggtcttgcctcagtccccatcagttctcttcctgtcacagaggagtagagaaggctggagggaagggggtgggcagtggcagagagggaaggcctggatgtgccccctcgtggggtcggtctgttggccagctgccacttctctcccccagactatcctggaccacatgcacctcaaatgcaagtgccacgggctgtcgggcagctgtgaggtgaagacctgctggtgggcgcagcctgacttccgtgccatcggtgacttcctcaaggacaagtatgacagcgcctcggagatggtagtagagaagcaccgtgagtcccgaggctgggtggagaccctccgggccaagtactcgctcttcaagccacccacggagagggacctggtctactacgagaactcccccaacttttgtgagcccaacccagagacgggttcctttggcacaagggaccggacttgcaatgtcacctcccacggcatcgatggctgcgatctgctctgctgtggccggggccacaacacgaggacggagaagcggaaggaaaaatgccactgcatcttccactggtgctgctacgtcagctgccaggagtgtattcgcatctacgacgtgcacacctgcaagtagggcaccaggtagggctccgggaagcaggggggaggctgggagcctgggcgcagggaatggggttgtttgcccatctcgtcttcttgacgacccccttctgtttctaagctatccaagacacacaagttcccacagccaaaataggaagctaggatttttcaagcatccgtgggaatggtccttgggcagagacttggtggattgcacaaagcacagataaaaacccagtgttggccgggcgcggtggctcacgcctgtaatcccagcactttgggaggccgaggtggacggatcacctgaggtcaggagttcgagaccggcctggccaacatggtgaaacccgtctctactaaaactacaaaaattagccgggcgttgtggcaggtgcctgtaatcccagctgcttgggaggctgaggcaggaggattgcttgaacctgggcgacagaggttgcaatgaactgagattgcaccactggactccatccagcctgggcgacagagtgagactccatctcaaacaaacaaacaaacaaacaaaaaaaaacaaaattcagtgtgtgcacattaggtgccagcaattgattaacatttttacacaagttagttatgagccagatcaaatttttgcatagctgctagctgtcattcttgagcattatttggagatggggggctggaagctgggagacctgacgtctggtcctaactttgtcagtaacttcctgttctttcacttttctgggcctcagctttcttactataaagtggtgatggtggtgaagggcagggggcagtttaaatacctcaagcagcgagccaaaatgtctcctctacccctgaggcagagtcagtgtgcatccaccttgaacttagagggcaagttcctgcacaagcataaatcgtaccaacctcagggaggtgggtggggggaagcggcatataagcccatatcctgacagatctgaagcttgggtggagtggggagcactctcaccgagtttatggatgatgacggggagcaggagggattcaagttcagagtggctgggatgagtaatcgagggatcaaaggcgggtggattttgttcccaagcttcccagaggtggcctgcatgggaggcgctatgcactggccctgggttccacagcaccccgggataggtcagcatggatgaggagtggtcctggacccccggggtggaaggttttaaggctggggtgccctttcttccttttctgtcccctgagaaggagcctagtgtgtcgaggcatgagcatgggtgttggaattaggccctgccctgctccagctcctaccacttgccaaccgtgtgacccaagcaagaaattcttcatagacctggttcctcatctgtcatcctccccagagatgctgtgagggacaaatgaaaggacaccgaggacagggcttggttaattgggaagcacttccctgctgggtcattgttgtctggggtgctgctgggcgagagcagcctgtgaaagggtagagtgccccctcttcctgcagttccacagggcacctctgagctactggcacatgtctgtgccatagggagtaggggagggaagtggacgggcctctctgagatatgggaggtacttgacgtcatggagaagagctctggctgaggggcgactcactcagcccatctaggaagcccctcggtgtagctcaagttctgtcctggtggggacagtccagaaaggcagcaggtggcactacctttgtcggtatctgaacaaaagcagtgtggggagtgggagaggacgaaggtgaatccagcgcctccactcgtccactcagctgtctggcctgggagcgccagtttcctcctctgttcagtggtggtgacaatgggagcccagcagaactttttttttttttttgagactgagtctctctttgtcgcccaggctggagtgaagtgcgcaatctcggctcactgtaacctccgccacctgggttcaagcgattctcctgcc

SEQ ID NO: 15423 - DNA, 56702 bp, Human
agatgtctaaatgctagctccaggtgcagtaagcagactatttggagctggcacatagattctgaagcacaatgtattaatacaaatgaaagttttaggttcttggtctcctagagtaatggttcttaagcctggttcagtaccagaatcacctgtggtacttggtaaaactataaagaccctctaataggcctgttaaatcaaaatcccgtggggaatgggactgagcgcctgtatatctctgaaggctctggaggttattctgatatgcagccaagtatggctgtgttttcatttctgtatatattttctttttgtatggatttttcactgttcttactctctgtatgtattttttcttactcatgcctcatgagttaaaatggctatacagtgtcccttggtacagatgtgttctaatttacataactgatcccctcttggtagacattattaatatgcttcccatcttttttctaacaagttactttagtagtatatacttgtacatataactttgtacacatttgtgaatatatttaggggataaattactagaagtggacttgttcagaggatatatatatttgtgaatttgagagatgtgttttctttgattccaatttttaaaattgttttaaaatgcccataaaattgtccgggcgtggtggctcacgcctgtaatcccagcactttgagaggccgaggcgggtggtcacaaggtcaggagatcaagaccatcctagctaatatggtgaaaccctgtctctagtaaaaatacaaaaaattagccgggcgtggtggtgggcacctgtagtcccagctactcgggaggctgaggcaggagaatggcatgaacctgggaggtggagcttgcagcgtccgagatcgcgccactgcactccagcctgggggacagagtgagactccgtctcaaaaaaaaaaaaacaaaaaacagaaaaccataaaatttaccgtgtaaccattttaaatgtacaattcagtggcattaaatacattcttaatgttgtgcaaccatcactaccattcatctccagacctcttttcatcttgtaaaactaaaactccatacccataaacagtaactccccattccttcctctccctatcccctggcagccaccattttactttctgtctcttggatatcagctactccaggaacctcatataagtggattgtacagtatttgcttatttaacttagcatatggtcctcaaggttcgtcatgttgcaggatatcagaattttctttctttttaatgctgaataatattccattgtatgtacgtaacacattttgtttatccattcctctgtcaatggtcatatggatttcttccacattttagctattgtgggtaatgctgtcatgaacaaggctgtacagatatctcttcaagaccctgttttcagttctttgggggtatatacccagaagtggaattgctggatcatatgataattctatttttaattttatgaggaaccaccatatttttgttttccacagtgactcaaccattttacttatgttcccaccaacagtgcataagggttctgatttctccgcatcctcaccaacacttcttattttctgcatttttgtggtagtagccatcctaatgagtatgaagtgaaatctctttgtagtttggatttgcatttccctaatgattagtgaggttgaacatcttttcatgtgcttatttaaggccatttgtatatcttctttggagaaatgtttgtttaagttctttgcccattttttatttagttttttgttgttcaattttggcagttctctatgtattctggatattaatcccttatcacatatatggtttgcaaatatttcagatttttttatgtgtgaaaatatgcttttaaatcctcaagagttacgttcttaaattgaatatattcttaactattcttaaatcttggaagtccttacattttgtttttatctcttcttaggccagtactaaagtggaagtggacatggagaaagcagaaagcctgcaagtgacgagaggagacttccttgcttctttggagaatgatatcaaaccagtgagtatgcccattgagtgatatataggccaaaaagtaatgataataataactcaggcgaaaagtaagtgccatttactcagtattatggaaggttatagcatatgcagtttcataaaatgagaaaattttagtattggaaatgttcagtatgagaaacatctgtacaataatcctagtggctggtgatattatttactgaaatattttcatgataggaagcttaccatcttgtaaggcaggccattcaattttgagactttccagttattgttttactttatattgaactagaactaattttcttattggttcttatacaatcccaagctacagaaacctaacttcagtccatcttccatatgtcagttattaggatatttaaaattaactctcatatcctcctctgtctctctctctctctctctttctcttcctttcctcagcctcttccaaggcatccctttttcttgctcagtacatttagtttctctgactactatagtttctaagacttaaaaagtgtcagttttcttaaaacgcactcaaaatggtcatagttggagctttagaatacagtttaaggttattaacccattttcctataaaacaactactaacatttgagtaacttttgtttagagtcctgtgttaatacaaaaacaaattgtagaaagtcccagttcttaaagaagtgtgtgcttttctttcttaaatggacctcaggtccattaagattaatcttaatctttatgacacactgttattagtctgtattttcatggcatgtaaaataacatatggtatatgtagttttctgggacttgctatttattaaatattttattaccaagagtcatctatatcagggatccccaaccctcagtactggtccatggcccgttaggaactgggccacacagcaggaggtgagcagcaagtgagtgagcctcatctgtatttacagccactccctattgctcgtgttaccacctgagctccacctcctgtcagatctgtggtgacattagattctcatatgagtatgaaccctattgtgaactgcatatctgagggatctagattgcacactccttatgagaatctaatgcctgatgatctgtcactgtctcccatcacccccagatgggaccatatagttgcaggaaaacaagctcagggctcccactgatgctacattatggtgagttgtataattagttcattatatattacaatgtaataataatagaaataaagtgcacaataaatgtaatgtgcttgggctgggcatggtggctcgtgtctgtaatcctagcactttgggaggctgaggcgggcggatcacgaggtcaggagttcgagaccagcctgaccaacatggtgaaaccccatctctactaaaaatacaaaaattagctggatgtagtggtacgtgcctgtaatcccagctactcacgaggctgaggcaggagaatcgcttgaacccaggaggcagaggttgcagtgagccaagatcgcaccactgcactccagcctgggtgacagaacgagactctgtctcaaaaaaaaaaaaaatgtaacgcacttgaaacatcccgaaaccacctcctcccccaatggaaaaattatcttctataaaactggtccccgatgccacaaaggttggggactgctgatgtatatgatttcttgtagctagacatcattcattttcatgctgaatagcattccattgtgtgagtaccacaatttatctattttcctgtcaattgtgaatgttaccagttttttgttattaaaaaaagatttgtcgtaagaattcttgaatgaatttctcttatttaggaataaaattattaggttgttggatatatgaatgtcccgctttaaaaaaacatttcccagtggttgaaccaacactgcccccaatactgtgaaacatatcctcttgttctgtatcctctccaacacttggtattatcagatttattttttatttatttattttttttgagatggagtctcactctgtcgcccaggttggagtgcagtggtgtgatctcagctcactgcaacctccatctcccgggttcaagcaattatcctgcctcagcctcccgagtagctgggattacaggtgcttgccaccatgcttggccgatttttgtatttttagtagagacggggtttcaccatgttggctaggctggtctcgaactcctgacctcaggtgatctgcctgcctcggctttccaaagtactgggattacaggcgtgagccactgcacccagcctcagatttaatttttgccattcagttaggtgtaaaatgagatctcatttcagtcttgatttgcattttagttattagagaacttaagcatttctccatatgttaattgaccatatgcatgtattgtgtgaaatagtgtccaagtcttttgcctgtttttctgttgtactgcttatttgattgatacaagttctttatatactctttttttctcaattttgtattgtgttaaaatacatataaagtttaccattgtaatcattttcaaatgtatagttcagtggtattaagtatattcataatgttgtataatcatcaccaccatccatctctaaaactcttttcttcttcttgaactgaaactctatacccattaaataataactcttttttccctcccctacaacacctggcagccaccattctactgtccatctttatgaatttcagtaatcttaagtacccatgtaagtggaatcatagtatttgtctttttgtaactagcttatttgacgtagcataatgtcctcaagggtcaaccatcttgcagcatgtcagaattttcttcctttttaaggctggataatactccattatatgggccaggcgtggtggctcttgcctgtaatcccagcacttttggagattgaggtgggtgggtcacctgaagtcaggagttcaaaactagcctggccaacatagtgaaaccccatctctactaaaaaatacaaaaattagccaggagtggtggcacacacctgtaatcccagctactcgggaggctgagacatgagaatcatttggatccgggaggtggaggttgcagtgagccgagattgtgccactgcacgccagcctggtgacagagcaagaccctgtctcaaaaaaaaaaaaaaaaaaaatccatgatatgtacataccacatgttgttatccattcctctgtcaatggcagccaggcttctgccacgttttggctattttgagtaatgctgtcattagcatggctgtacagatatctcttcaagaccctgtttttagttctttcgggtatatactcagaagtggaattgctggatcatatagtaattctatttttaattttttgagggaccaccataccgttttccacggtggctgcaccattttacattcccaccagtggtgcacaaaaattctgacttctccacatgctcaccaacaaattattttctgtttttttggtagtagccatcctaatgaatatgaagtgacatctcattctagttttgatttgtattttcgtaatgattagtggtgataagtatcttttcatatgcttatcaaccatttgttacatatccttttttttttttttttttttgagacagtcttgctctgtcacccaggctggagtgcagtggcacaatctcggctcactgcaacctctgcctcccaggtttaagtgattctcctgcctcagcctccccagtagctgggattgtaggcacccatcaccatgcccggctaatttttttgtatttttagtggagacagggtttcaccatgttggccaggctggtttcaaactcctgacctcaagcgatccacctacctcagcctcccagtgtgctaggattatgggcatgagccactgcacttggccaccatttattttatatatatatatatatatatatttttttttttttttttttgagactgagtcttgctctgttgccaggctggagtgcagtggcgcaattttggcttactgcaacctccgcctcctgggttcaagtgattctcctgcctcagcttcctgagtagctaggactgcaggcttgcgccaccatgcccgactaatttttgtatttttagtagagacgaggtttcactttgttggccaggatggtctcaatctcctgacctcgtgatccacccaccttggcctcccaaagtgctgggattacaggcatgagccactgcacctggcctgttatatattcttaacaataattatttgttccaagtatctcctttaaagacaaaagccaatttggttagccctgtctttttattactattgtgacttttaaatataaaataatcattttcaaaagtaactccaagatttttttaacaacaagtaatttggccatgaggaagtgacaactaaaaacttaattttatttattccaagggtctggaggataaaaaaaaaatgaaattatgggatatgtaaggaagatatacacgttatatatcttgggagagtcactgttttatggttcaggcatcttaaagcttctgctgtgaggcttggagtatataactggaaaaattaaagacaaaagccagcctataatttttttttttttttaaatgagatggagtcttgctgtgtctcccaggctggagtgcagtggcgtgatctcggctcactgcaacctccgcctcccgggttcaagcaattctcctacctcagcctcccaagtagctgggattacaggcacacaccaccacacccagctaatttttgtatttttagtatagatggggtttcaccacgttggccaggttggtctggaactccatacctcaggtgatccacccgcctcagcctcccaaagtgctgggattataggcttgagtcactgcgcccggccatgaaaatttcttagaacagccatttagccagtttggattagtttcatcattactttttacactgctactgaatttgccatatctaggccaaagaatgagaaccttcctctgtattcaggaatcaaaggaccagtatatgcaaagagactacgtaaaaagtggtctgaaaaattattttgtggcaaagtaatagagatatgagatcactggatactgtttcaaagacagtattacaaaaacagctttatgtgaggtgcatgttctaaagaactattaaaactattccatacatcaggtaatcaaaagttgaattttgagggatgtgatgatctttaaaaaattgaaattctcaagatacatgatctttacatgtacatgatctttacatgtagtaggttatgttttcctatttattctgttaacctcatgaaaatccagttcaattgtaaatactaaagttattgactacttttggcagctgttttgatgggaggtataacctttgagattaaaagttgacaatgaagaagggtgcaatttaagctccaatatgtagtgaacacaaatagaattattatctgaaataattgcttttatatccttcttattacagctcctcatttctatctcatcctaaatcttatatttacacatataaacttaacattggtgccatttaactatgtcccctaccacaaagttgatgtgaacatgatcttctcattaccatttcgtattctcatgttaatccatagcacctgcagtcagtgttaaggtagcatatttgtctattgcgctgtttctaagtccataatctcttttttcctttgttcttaacagaacagcctcaaactgcatactgttgataaaaataagcacattggaacatattctttctctcaggaattatgagggtttgagtctggtggaatctcagcctagaatccattgtttttattccattaagtcacccaaagcagctttttttttcctattgggaaaaaagttaaatgagaaattatacaagttgttttgctttccaggctttttatattaatatgggatagtgatcaatacctttagcatgtacgaattataactcgtcttttatactgttagtttttaacactaaggctcaaaatgctttaaactcctttttcttaataggcctttggcacaaaccaagaagattatgcaagttacattatgaacggtatcatcaaatggggtgacccagttactcgagttctagatgatggggagctgctggtgcagcagactaagaacagtgaccgcacaccattggtcagcgtgcttctggaaggtgagaatgaatgaggagatggcattaaaagttaaaggaaaaaaagcagcattttttaaaagcccgtaagcacattctagaaaagtgaattctttttcgtttttaaccttgttcttgatctgaaaatagtaatccaatctatgtaccaatattgtgtacaaattaaaattttcttggggtagaatgttagtgaggaaagatagcaactagttttcttgtaggattatatctgtatttctgtggcacttaatacactgaatgatgccacttagcctcaattcaattaaataaatacttactgagtacttgtattttagtcattgaactagttgctggggatacaaagacattcaagtgttcattcagtctggtcatgaacaaagacagtgtaaagaaattcctgactacggtgtatgtgtgtaaaggtgtgtgtgaatacaagtcatttagcataggggtggtcagggaaaactagagatgctatttaatctaggccttgaaagaccagttaggattttattgagtagacagacaaaaggggaaggacattccattcacaaataattaatttacagttataattagtatgacggcagaaaagttcagtgaggccccatgacaagggaacctaactacctctaaaggtctgggggatgagagctccctgggagaaacatattaagccatgacttgaccaatgaggagactctggccagccaaagtcactggggaggatgtttgaggcagagcatgtgaaaaagtcctgggcaggaaggagcttgaaagagaaagggagattatcctgacatgagactgtagaagcagatagaagccagttcatataaaaccctgtaggccatattaaagatttaaactatcttaggggcaatgggaagccatttgtaggattttaagcagtgaagccacatcatcatcactgctttatgatggagaatggattggaggggcaaaaagatacagaagagactaatggttagaagcagttggattagtcttaatgagagtcgattgtggtttgaagtatgtggagtagtgtagatggagataagtagactaattagaaatatttagaagatagaataaaaatgacctcattattattgtcaatcataattatgctagcagtttttgagcccttgctatttgccagtcactctactagcactgtgcacatattatctatttaaaccccacttcagtcctccaagggtagatgctgctgttgtctctattttgtaggtggggaagctgaagcctagaaatatttgttagattggatgtgggcagaggtatcaaacatgaccccctgggttctggcatacatagcccgataaatggtgctgtttactaagattgggaacactaatggaaagcagatttctggaagaaagatgatgagttcagttttgaacatgttaaattcaagggtcatataggagaagtaaatcggaaatgttgagcagcctgttggatatgtgggtctggctagcagtagactcatgagttgccagtatatagactgtggttgaagccatgggagtgaacgaaatcacttacagtgagggtgtgggttgagacgaaaaggaggcctagaacttgtctctgaagcatgttaacacgtaaggactaaacagagcagaaaaattgacaaaagagactgagcaagagtaaccagagaggaaaggggaaagagagaatgtgtgttacagaagccaagaaaagaaacatattttaagaaagaggggaattatgaattgtatcaaatgctcctaagaggctgaaaaagataccaaaatgtttgttgggtttgatgacatggagatcatttgtgaccttgatgggagcctgttcagtgtaatggggatgggagccgtaagatttagtgaggatgggtgggaggtgaagaacaaaagcagccagtgtaaataattacataggcaagttccattttgaagggagaagaaggtgcagttttgaggggtatgatgttcagaaagagttttttgttgttatgtattaaactgtcagatagactagaacatgctaaaacacttttggaaaggcttcagggaagaggaagaagtcgaacatatgggagaaaggaacaatcagtaatgtcatgttcctgagaagatggaaaggaagatttgattggtttatggttgaacgagggacacagcttccaaaacagggaagggaaggcagggatgtctaaatgtaggtaagttcgtagatttgcttgcctttatgagaaggcctgagtctttagaattctaactttttacatcacatttgcttctaataaggcagttttcccctgcccccaatatcagctcttaagattgtctttttttgttagacaaatgatttgatagaactaacaacataagtactaatatgcatttgaatgcgttcttttaagaagcaaaacccttacactctgtatattttgccaaaagtttgaaagattaaggatatgtgagaatgtcaggaggcatgtatttcaccatacttttgagaaatgctaattagttcattaagtttagttgctaataaataagagaaaacatgtctgctgtgaaattgtgtcaggaaatgttaatgagcaactagtcgagacctcagtatgttctggataaaagtttaaacttgttttatttccctttgcttaggttggcttttttcccctgacttgctcatatctttatgcaggccctcctcacagtgggaagactgctttagctgcaaaaattgcagaggaatccaacttcccgttcatcaagatctgttctcctgataaaatgattggcttttctgaaacagccaaatgtcaggccatgaagaaggtatcaagattttactttcattttaatttcctatctcttaaatgtgtgtgtgtgtgcacatatatatgcctttgtacatgtatacatataaacccatagcaactatgttcttctcaagtggaaccaaattatcagcagaatatgggggaagcagtgactgttttagattttctaactttgtaatgtattttattgagtacctttaccttctaaattatgctttgtttaatacatattaagtttcattgcctagttttgtatcaatttgattaaaagagttatagttgaaagtgtttgaataaagtggacaaattcatttaggattttttaaagttctttcattattgtacaaagttgaactctttggggtcaattaagttgaggaagacagagatgtatcaatgggaaaatagtcccaggaatccctacaaaaggatagttttatattaggtaataatcagaatctgcttggtaacttaatgcagttctcatacatcttcctttctccaagtgccactcgtcaccttcttaattaacatggccactttctaccatcagtgaagttagaacagcatagaatagaatcctagagctgaaaagactgtaagaccatttggtccatctctcttacattcaagcaagtgccatgcaacaacaacaacaaaaatcaatgatgaagactctaaatggctgttccatcttacttgttagatcatgtttccattgctattctaattttgcatactgccagtcaagaaattattttttgtatccagctgaagtatttcttttatttaaattctttttttcatgcttgatcttttatagatatgaactgaccgtaagtccaagagatgtgggaaaatcagaatgaggtgaaagaatcttgagaattgaagtgctccctagtaaagacagctcagggttttcttttacattgctcttaggcattcgctttataaagatgtattgtagaattcttcggtgtttctttgggaaagagactgaagaagagaaatagatttaaaagatgactcccaaaaaatgtaagcttgagaagctagtctcttgtttgtgcaggtggcagaaaattgcacagggtacttcagatggatggaggaagccgaacttgtagcaggattccaggcatacacattgaagagtccagagaaatacataaaaatgtttgaaattgagtgtgaaaaggaaatattgccagatgcaaaaagaacttataatatcatagtttattctgtctctgaggtgaaaccaatagtatctgtccttcccaggaaaatctgaatagaataactgggaccagtgatttccctagagtaggtagggctgtttttctttgtttttcgttttccctctgatgggaacccttaacccacttcttctggtaaaaatttaaataacagcccttgaaatctgtagctgttgaatgtcccatttatttattgaatagctaattctatttgcattctcctaaatcatctattcctgtgctttttcaaaagtagtagtcatctttgcagatggtaaattactccattgctttccaccagctgccagcttctacctcagatgtactctgagatgtgggtggatggtcctagtttttctataaagtttttaaaaagtacttcaggcttctgcagatcaaagctactttgtaagtgtgagatattatcatttttattattttaatctcttgcaaattgacttgaagggggaaggtaatatgtgctgattttagaggcttaaatggttaaattaatggtttaataacttattatttaatcttcaaattgttgaagcctttcaaggtagagtttcagatgagtagaaagctagggagtataaaaataagtgtccatacaagcttattcaaaattgttttaattcatgattcactgtccggatcatccgtgcactcttaaaattataaaaattatttctgcttcagcagtataacaaatttatattagaatttttggttttccttgggggaaaaatattattctttgtcattaaagttcagaaaagagaaaggaatgaagcataggtttcttagaaatatattagaaatattacaaaatatttccctgcaaatagttttcacattgttacctaatgataggttgacaaaagcctgaggggtcaaaccagtctaaagatgctaagtcttccaggttgtttttgaaaatgaaatgtaaatgtcattctttagtataagttctagtctacctcccactactgttcttgcccctcctttttttttttttgagatggagtcttgctctgtcgcccaggctggagtacagtggcgtgatctcagctcactgcaagctccacctcccgggttcatgccattctcctgcctcagcctcccaagtagctgggactacaggcacccgccaccatgcctggctaatttttttgtatttttagtagagatggggtttcaccgtgttagccaggatggtcttgatctcctgacctcatgatccgcacgcctcagcctcccgaagtgctggaattacaggcatgagccaccgcgcccggcctgcacctccatttttagtgtgaggatggaaagaagatgttttaattttttttcagagcacaaataatttatagagttttataattctggagaaaacctttcttttgttgttgtaagtgcaaaaattaaggtagctttttctaattacagaaataatttagaaaatacaagaaagaacagaagaaaataacaataaattcatatttgtccttcaattctcttttctactcagacacatgtgtacacatgaacacatataccccctcccttatatattggggattacattgaaacatactgatgtaaacttgcttttttcacttaaaatattatgaacttttttcagtgtaactaaagctaatctgaacattattttaaattaatagctgtctaatatctgaacaatccctttttgttggacaattaggttgtttccaggtttttttcacaattataaataatatatatcaaagagttatctatactcccaagttcattgcagcagtattcacagtagtggaatggaatcaacctgaatgtccctcagtggatgaatggataaagaaaatgtgacacatatacactgtggactgtaacacagccatttaaaaagaatgaaatccttgtcatttgcaacaacatggatgaaggacctggaagacctcatgttaagtgaaagaagccaggcacagaaagtcaaatatcacatgtcctcattcatatatgggaactaaacaattgaactcagggaggtagagttagaatgatggttatcagaggctgggaagggtagtggtaacaaaaataccattaaatagaagtaataagatctagtgttggacagcacaataaattaactatacttaaaaatcatgggccaggcacagtggttcacgcctgtaatcccagcactttgggaggctgaggtggggggatcatgaggtcaggagttcgagaccagcctgactaacatggtgaaaccccgtctctactaaaaatacaaaaattagccaggcatgatggcatgtgccctgtaatgccagctactcaggaggctgaggcaggagaatcgcttgaacccgggaggcagaggttgcagtgagctgagagcacaccactgcactccagcctgggcgacagagcaagactccatctaaaaaataaaataaaataatgtgtcgttcggggagtgggcctggtggcagtggcggtggcagggaaagagttggagcagtgccagcggcaagcgaacaaggtgacggaaatcacgcttaacaactttgacaaggtcctggagcatgatggaaagctggccgaactggagcagcgttcagaccaactcctggatatgagctcagccttcagcaagacaacaaagaccctggcccagaagaagtgctgggagaacatccattgccagatctacttggggctagtggtgggtggtagcctgctcatcatcctgattgagcagctggccatctttctccctcagagtgacaccagtaatgccccacagacctaggatgcaggcaccacctcagggcctggggactgacagctggtcctgagggagaagccaaatggctgcactggctggttccggtctccagagaaccttggtgtttgctctcccctgacccaccccagtgagtgccaaagggcagccccaacacgtgcacccctgcatttcttgtcatgccacagactggccctcgagggcaccctgccatactggccatgccgggccagccccacctgaagctcagtgaaagctgattaaaaaaaaaaaattatgtatagatcaaaataactacaagagtggaaattgaatattcctaacaaaaagaaatgatacatgcttaatgagtttcacaactacccttatttgatcgttacatgttttatacttgtatcaaaatggtgcatgtactccataaatatgtataactattatgtagccataactaaaaatttaaaatttatataaaaacagtattccataggactaccaaactagggaaattactgcccccattttctcattagatttttcttcactagagtagtataacatgaccgagaatttgggcttgctcagctctccacactgaccggccgaatgaccttggatatgtcatttaacctataagccactgttttctcatctgtcaaatgaagataatattaatagctgcattatagggttatgagaattagatggtaatttctgtaaagtgtcacagtgcctgggatataatatgaaatcaatgaagtgtagtggttatttttacttattattatacatacattttttattatttccttatgacaaattctcagaagtgggattgctaaggtaaaaatattagtattgtaaagatttttgatacatagtgctatcaaaactcttaggtaaaaaatgctcttggttttataaagcctacgccttcagaatgttgtactaatttacacttgtagcttcaccatataagagtatgagtttcttgggattctcacccgtacttgatattattaaaatattttttgccagttggataagcagaaggttggcatttagttatttctttagctacatttcaatgactaaatgctcaaatttaagatttttcaaaatgttttgcaatgacaatagtctgtgaaactgaaaaatatgtaacacattaatttttgttaaagatgtgtggtctgaattagttaattcatagagcatctttacctaccactttattacttaaaccaacaggtaagagttttagtagagagggctgttaggcttgctttaatgagtacatgagattttattataattatactattgcctctttttcacaaatggatggtgctaaaatacgtgaaagtagtttattctcaattaatttaaaattcaccttgtacttctcttaatttgcttattagtgaatcctttctccatggataaactcctcaaaactgctgaagtatgtatgaggtattgtcctcacgttctggggggtataccatatgttccattaagatgtttgaagtattcacagaccttccccttctcccctattttacgtttgcttcccaaacttcattctatttttaaattttaattcctttatccatttttgcatcaatacttgtttaaaaatctattttactagttctattcgtgccattaaatgaacaaaagaagaaagcagaatttgattttaactaattacctaatcttgatgctttctgagtatacaatcagtagagatgaagtagaacaatcagatagaactaaattgtttgaacaaaattaagtaaaactaccagtgatttataaaactgtacccattaataacatgatatagtcttattttcaaaggattgaaaattaatggaagaaattttcctttccactagctttgcacgaaagaaataatcttctttgaatatcctcctgtaaatcccactgcaaattgtagtctgcacagaacagaatcgtgatgcctaatcctcctcttttcatggtttagtctatacaaagagcagagctggaaattggatcttttgacagcagttactaagcaacagaatttggatgtttttggttaacatcctaatatataatgtagctgatttgttgaagtttttgcatatattagctgagagaagtgggcactccggaagtgactacaggtccctgtatggctggggaggtgggcatttgttgttgttttgttcaatacactgtgtcttttggcatttgtatctctttggcgtagaaaggaggctggtgcagaactttcagaccttgtgactttttatattattaagaatacccttctctgtggctcacgatatgagaaaatgtaagattttttcctgaaaagcagggagaacaaataaaggattttaaggtcattccaggaagctttagagctttgccaaaagtttaggtccacttcctgaggcagtttcattagcagacagctaatgtttgcttggtctactcccaagttatttttagaaacgagattattactgatagcacccatttgaatttgctcatttacgtttttatatgctaccaaatatgattagagtatgcttttaactaatcgctgacagatttactgcattagggattttctaagctatgagattcctacagtcatcagatttctactaactaggtacttcacgccaagtacttcagaactgagatgaactctttcagctcccagaagaaccagagtgtttggctttgcttacctaagggcactaaggaggtcccagaggatggagggctgaatctcctgagagcatgcttgttgtggcttgtgatcccgaaaggctgggattaatggaactaatgctggtgtgctcccatttgcacttgtgtagactctggagcccgtagctgctgcccctgtcccacacacaggtggctccccagttgtctgaagatcccaggagtgggctctgggacttaagagcttgccgtgtccttgagcaccacattcagacctgcccctaatccctgcgtggcagagccccgcttctcctgtccctcagtgctcacggagtgcatgtggcacactcttgccttaagcccaggctccccacactctgggttgtctctcatacccctccagcctgtgtcgtacctccacctttgcatgcaagagaggttacagtttaatatgacaatctcattatgtgcacaggtggacataacgggcttctgtgttttctagagctgctcttccttcctttagagtagacttcccgttatttcatgagacacaggctgactgatgccactctttcccacattgtttccttcttcagttcttcctgttttttctttagccttctctttcagacttccctcctaactttaagaccctatatatgtatgttgataattttacctgttctacaggaaacttcataatagaactgggctgactatacattctttttctgtgtgtgtgtgaatatatactttttatttagccatttttgtttacaattgaaactctgggaattcaaaattaacatccttgcccgtgagcttcttatagacaccagaaaaagtttcaaccttgtgttccacattgttctgctgtgctttgtccaaatgaacctttatgagccggctgctatctagtttgacggggattctcttgcccacaatttcgcttgggaagaccaagtcctcaaggaaggcatcgtgcacagctgtcagagtacggctcctgggacacttttgcttattttttgtacggctttttcgagttggcttaggcagaattctcctctgagcgataaagacgacatgcttcccactgaactttttctccaattcgcgtactagccggacttggattttctggaaagatttcagttgaggaacgggaacaaagattatgatagctttccgaccaccaccaacttcagtttccttggctgccgtaatattcagctccctgagctgagccttgaggtccgagttcatctccagctccagaagagcctgggagatggccggactcgaactcgtccggcttctcgccattgggcttcacgatcttggcgctcgaactgaacatggctttctcctgggagaacttgcagcgcctgcttaggaagagacccaaatctcgcgagagcacgtcaaaatccctacattcttaagattaattttggggggagtctgtaagatacggttcttaccttcttacctccagcctcagtcctcctggcatcttctgtgttggggcatctttggatctagagcaagcactgtgtgacctgctgtgtgctataactcacggtgagtttggcacttcagttgtactagtctggctagggcagtttgtacaattttacttttctcgcatctttctttccagtacctctcctcctgctgggatttatctacctaaagttgtggtgcagcttcccggcttagtatgtaaatatctcacttggattttcctgtggcagctaacctcacgtacttgccagccaactctgagtatcttcttagtgagaattctgctggggcctgggccagaaagggtgaaagggactaagggactgaggagactaggcagaaatcgtggatcctgggaagagttatgagcacaggttacactagtgactagataaggaagaaaatgtacatgtgagaagagaaagggatgtgtgtgtatgtatgtatttaaattagagcagagtagctacccggaggagtttcagttgactggttacctgaaactagtcaagttacaactggaattgcacagccttcgtcatggtcggtgtgttaatagagcttgctgtgagtgcacctctccctctgatagtaattagcacagagaccgactgcaaaaaacaagaacgtcactacttgatattaagtgactgctgcaggtatttttcctctcaaatgttatgtgtaggccatgcagtcaactgtgaagtgatttggaatgctttgtgaattacagtgtctgagataagttggtgagactacataccatgtagcaagtcatcattagtttagacctaagcaatgtcctgagtaaggtccttgcagccatataagctgtacattgttttgagaaggaaaaacatagaactactgcaaccagccaggctgtggtgttccaggtccctgtggctctaatccatgatctcacagcctgatggtcagagttatatgctggcatcagagcttttagtagaattctgaaaaatgttttgaaaagcaaagcattattttcagtgattccttaaaattacctgagtttataagataccacattggctgcggttccatcttcaaaaaaagtagcaaagaaccgctgtagaactgcttctgagcttttcagttgtctcgaatgtaccaactcaaagccaaaaggaaccatcattgtgtatcaagagactgaaataaatatcctattctcattttctctttttctgtgtttggggaggagaagataaaaggcccttcccttcttgctctttaaatgtactcatgatccattttcaaaccagcttcacctctgtgttttatttcagttgccaaatcaggacagatccttgactccagttttctctttcatcaccacacccattcattcaccaagttctttcagttcctcctcctaaacatctctagattctgtccacttaccagcacacccactccctggccaccatcatttctcacctagaactccacaatctcaattaactattattcccctctaatgcttttctatacaatcaggaaaatgtttctaaaacataagcctgacatgtcagtccattgcttataaccctttagtggcttgttattgcctttacagtaaaattttaactcatgaaatttgtaagactctttacgtccaagttccttcatcacctcttctaattcatctcacctaccactccactgcattgacaccaacaccactttattttaattcttattgaccgttcctgcagtgttcctgaatgttcacatctctgtgtctcctaattttcagtatattctgcttagaacactttcttccaccctttccactggttaactgttgttcatgcttcaagtctcaggttaagtgtcacttcctaaatttaggaaactgtcctgactccctaagtccatttaagagtcaagataggctgagttatgctgcatgaaaggacaacccgaaaatctcagtggcttaacacaacaaagtttattttttatttacactactatatctccgtcatggctcagacagtgagttctgttcattatattttctcagagactcaagctaatagataatagaggccccgccttacatctgattccatgatagccaaggcagggaaaggagtatggtgaatcatgcagtgactcctaaggcttctttcagaaaggggtgtatttcccctcatatttcattaaccaaagcaagccccatagttatgcctaacttccaaggcactggggaaatactgcctaccctgtgcccccgtatcatcttgtatttcccctagcctaataatgtcatgctttgttataattacatgtgacttgcttccccaactctaacttttgtgaaagtaggattatttttgtcttatttattatcctctgcagtgccttcattaatgcttgatacataataagaattcaaaaatatttgttgagtgagtgaatgaataaggcagcactccaagactcaatccttaggcctttttttcttcttcttctgccatttcttcttgaagatggcttcctctgtcatggtttcagcagtcactgccctgagagtgatttccattccctgacttcaatcagatatctccaacttctcacttaatatttctacttgaatttaaaatgtgtaaatttattcttttagtaaatacttcttaattactctctaataaggcattatattaaatgatatgaggatacagaggtaattaagacagcacttgccatctgagggcttgcaatctagtataatacaaaaatagtacaatgaatcaataatatatatacgtaatatacaaaatcctgtgccaaaggagaagacaagtgatttatggcaagatggaattggaacttgtgttgtttcaaccattgaacctacagagcagacatcattactgaattctgttctgtgctgggcactacacataacatgaacagaataaagcttttatccacctcacagtccagtggggagacagatagcttaggacgaaaggatagatggggtttagacagagtgtgggagggtaattagggggtaaagggatggtgcataggaaaacgttttcaccagaggggttgacctgattaaatatctggagaaattgtcagtatttatgccaggaaagaggtaaggaaggaactgaatcaagatggtcacagtgagactctattatggtaacttaattgttaggaatactttaaaaaccaagtatacacaggttgtttttaaacctaacatgaaaaatggttaatatcatgagtttgactttatttctgtacctaattataagtcttcaatggttaaaagatacccaggaaggaatatatgccattccaagcaagatgttggtgcgggtggggatcgggtttactatcttggtgtgctgaggttggttaccaaccagagagagtgggctgggatgcagaaactaattcttactcatgacactgatgagatttcctgagccccacctgtagtctctggaatagtaccttcatttccaaaaaggctagtctcaaggccttgagtacttctattcaacttgcagataagctaattcttctatctgatttgaaattactacatccttgccaggctaaaaccgttccttcactgcttaatttcattctcattttcttgaccatcttaagacagtgcattcatatcttttgtctggttttatacgtacatctatctgatccttcatactcaacctttaattcttttgtaagctcttttaccattatggtctgatttgagttgacagaattctgatctttcagtgttacttttgcttaacagagccacaattcttatagataataaaatggcatctagttttattttacacatctcttgtggctccatctagctcttgagtcattacactaaagtcctgctcctgacacagataccagagaccagtgtgatagaagtgatgggatgtgtcagttgattaatgatcagctagtccccagcctgcccaggtgtgacacacacagctgttagtgctgaaaacagccttagcctgctctctgttcagcggtgatccagtgtgtcaattctaatttattgtagtccaaagtgttggtgttttcctgtgctttgtttagtattgctcaagaagtaactaaacttcttggaaattgtcgtaactgtggaggacagtgagataataaatgactttgttttctttcagatctttgatgatgcgtacaaatcccagctcagttgtgtggttgtggatgacattgagagattgcttggtgagtcctaacttctgctgttgtattatctttgccacattacagctaatatctcaaaagttacaagagaaaattaacaagtatttataaactgtaaagcaatagaaatacctttctttgtcttacaaggaaatataatgttctctcttaaatagctgacatcaatgatagtattcattttaatatgccctgtgactataacaccattataaactgctttcttgtaagggcccatgtctcattttgtatcttccagtgtgcccttgccatagtaaatgattagtaattttcattgatgagtatatctgttatttaggacctctgagctcagaaattcacttgtgaactttgacagaactaatgaaagaagggtttaggatcacagagaaatctgcaaattcactaaaacactaagggcagaagttgtaagctctctgcacctcagtttctgctcttacaaaacagagactataatccctctcttgcttatcccacagagtaattgtgaagacaaaaatgggataataaatcttgaaaaaattttgtaagttaaaagtgcagtatagtaatttttaaaatatgtattaaatatctcctgtgttgaagtgcactcctacagaatacaaacatgaagaagacttggtcctggcacttaactcataagaaataaactgcaaggaagggccagaaagttgttaattttatttcactgtaaaattaaatcagtctgacataaattcattacaacaatggctcaggaaggggtaatacactctattgaaatggaaacccacctggtgacttaataacatctgaaaatactacccagtgtctgaataatcccttcttctttaagctgtccataatggtgtagtcgtgatttcaagctaactgttcttactgcatttttcccatgattttcagacctgcttttggtcctctgttatttatttttttaagttttggcagtgtctgttataaagcaaagcaggtatatctgtgaggtctccataaattgatagtgggttttgggtctgctaggtttgatacatctcagcccagtttatgggatgatttctttaaaagcttttaggcacaaactcatagctctgtgtaaattcctttatcttaacacaattgaggtgtgtggtcatagcaacactaccatgtcaggaatgtgtgccctctgagtacatttcactggtatgaatagttatcatctgtgcatgcttgctcatttattcaataagcacttgctgagcccttcctcctctggtagaagtattagagtctcagaaaaagacgctgctgcctgtctttataacatatgttggcaaatgttaatgcaaagtagaatgtgccatgtattttggatattctgtttttttttttatttttattttccctcccactgttctcatcaggtggatagtctgaaaatggagggatcagttttgacctcagggggcctgcgagtagctctaagcccagggcagaggtgcatatgcagtatgcagagaaagctaagcaggtggcatttacgctgaatcttgaattattggtaaatgtttaacaggtcagatgttctcttagaaagttatctgttccttaccatctgagggccaatcttagtggttctgccattgtttccgttttattgaaattccttattttcccctttgcccattttctaacatcatgttttaatatcagtgtactgaatggccatggtttgcagtaacttcttagaaatgcttggtaaatacacctggaatttttttttccttccaaaataatcccagaaaaaacatctacatgaactcaaagtgaatatttagaagctttttcaaaaaatttatagagccgagtacagtgggattatggcaacctataatcccagctacctgggaggcttaggcaggagggttgcttgagcccaggagttcaagacaagcctgggcaacatagcaagaccctgtctcaaaaaaaaagttacagataagagttcttatattttaagcatttaggttattagagatattttttcttattataaatagttttatgactgttatttaagactgtttactctttaaattttttttttcttattctatacatattctgcttatgtagggactgtgtttacttttgatgcaaaaaaaaaaaacaaaaactgaatgtttggaatatgtacatgtgtatcaaatccctaaacataataatgtttcttttccagattacgtccctattggccctcgattttcaaatcttgtattacaggctcttctcgttttactgaaaaaggcacctcctcaggtaaaataatactactaataaggaatattttaacaaagagtttttcagtaaatcgcatataatgatacaatctttaaataagcaggttatcataaacataaaattctgttgttgaaaggattttgaaaggtcgtccagtcttgacttctgtttaaggtaaattattttatcaacagaatttttccattccttttctgaagaaatcaaaatcccacagtttctgtgtggaatacaacaattagcattgtattttgttgttttgtaagttttccaccatattacatatccctactacctccaactgccaagggagattatgatattaatagagaaggcattgaatatgttcccatatgtttcatttataatttcatgggttttcctaaaaatttgtttatggggatatttaagtttattttctttgggcagttaaaaaactatttttaacagatgatcttgagttatttttcttgggtcatgtggcacttttgaggagtgaatttatagccaggatcttgattcctgtgtttgcatttttactgatgtggctattagagacttgtgattttggtaggttaacaaatttaaaaccaacctatgaaggttggttaaatatgttaattatgtagaggctgccagagcatgtttggctgtgtcacaagacatgagttctcttgattgattctgcatgctgtaaccttgaaaaatgccaatcaaaggcaggtacaaagcagttaagcactgacttgaaaagcatcttaatgtctgtatgagaatctcatatttaaagttagagatagaaactaatctgtaaggaaaatatttactcttaaactggtgaatctaatttttaatttaacagttatatatgtgcgtgtattttgcacttaaaagtaaatgacttgtcttggtttttctggagtttttttttaacttctaaaataatgaaaagaaacataacctataatagtcttgaagatttgcaacatatgtgtactgtggaaggatttttaaatcagcttttcataaaccatcattcctagtaattggagtcttagcttatactaagggtgaagttagagaggtgagtgtattttccctttctctgattcctgcaatattttcttaagtaagtaaacgtatatatctaaagttgctgaaacagaaataattatctacatatatcatgattcctccaatgttttcataaataagtaaacgtatatatctaaagttgctgaaacagaaataattacccccaacatctacatatattatgcacacaaaaaaactttatgtcagcatattaattataaaaactattagaatgtgagactttttctaggcatttaaatttatctcttaaaatagttcttcttttttagctgaaaataatttatgctaaaagtcacttgggagaaggaagattaacttcagtgctatcttatacttcttgttctttacattgttaaatactatacacattgatttaaacagaggtacacccccttggctgagaagcatttgtgatccaaagtagatactaacagaaataaacagaaactattaacgaatgatctgccacactaagatttaagaataattgtttctgtgttgtaaaacttattgtaagatttttgagggaaggaacattatcttatgcttttaaatctcacagccaatggcatagaggcttatacgtacatgcttcacaaataccttatcaacaaaaaaaaatttttcagtgtcttttcattttagtgggctcaagtgttttcatattgctggagtttatatttagacaggatatgataagagtgaaaacattcaaaaataagtaaagttcaaatggccaacaagtataagaagaggtactcaacatcattagtcatcagagaaatgcaagtcagaaccaatagtgagataccactcattgcatacctgctagaatggctatcatcaaaaagtcaggtaatgacaagcgctggtgcagatgtggagaaattggaacctgtatgcactgctggtaagaatgttcctcaaagaggttaagcatagagttaccatataacccagctattccaccaagtatacacctacaagcaatgaaaaacatatgtccacatgaaagcttgtatgtgagtattcatagcagcattattcataactaaacatttatctgataaaatctagtatatccatataatggaatattactcagcaataaaaaaaagtagtaccattacatactacaacatgaatgaactttgaaaacatgctaagcaaaaggagccagtcaaaaagaccacatattggatgattccagttacatgaaatgtccaggactggcagatctataaagacagaaaatatatttgggatggcctagggctgggaggggagaatgagaagagtgagagggtcactgctaatgggtatggggtttctttttggggtgatagaaatgctctaaaattgattttggtggtgttgtgtatatctgtgaatatactaaaatactgaattgtacactttaaatgggtaaactgtgtgctctgtgaaccatatctcaagcgattacattttttagaagtggtttaggagctacttaaatgatgaaaggagacatagagttagaagtgaggggtgagcatccaaggtacgtggcccagcttgggagaaagaggaattggatcatttaaaaagaacatggagtgaatttatctaaggactgaagaggaagaatatagaaatatgtaagaagtaagagatgtggttgccttagtgattggaaatggcaggggttctctctgaagggaataccatctggtcattaatctgaatttggtgactctgacctggactgccagattacctgcagtatacatgaatcagtgacaggataaattaatatttgtagtatttctagttggcatgtatttaacaaaataaaaatgtgctttgtcataccaccttgctttttaaaatgtttatattctctcaagaaaataaggggaaattttcaggctgatccaagtgttaagaatattagtcattgtaaaatggaagcattcactttgtcaaaccattagcatatagttttttcagatgtttttaattaaatattaaaggtatattcagctaaatattgtagaaatgcatagagtgatagaaaaatatttattactggtaagaaaacaaaagttgtgagcatttttctttaaaaggaggaactatacttatatacactacagtaatcatatcagtcacagaatcctcaattttgcatttgttgtatttccagctttcacacagaaaaattgtgtgtgcatgtgtgcacgtgctcaaataaaagaatcccttcaggggcactatgttgttatgtatccagatattctcttttctccttccacccctcccccaccaccccctcccttcttgtaaattggcttattaaaactggttcccaagccctccttttttccctttgtgattgccttggtcttggattttcagtgtagaactaaaaattcaagtcagatttcagttactaggataattttctttgaattttaaatttttctaagtaaatgcatagatttttaatgaacctggtattcagtggatttgctttaaatttagctgcagagttaatttcatgattgatttattagccctttgaaagtataaaaagtggtatctgcagttcgtgaagagtgaaaaacatcatcacattttgtttagcatctttttaaaaccaattaaaagcttttctaaaatggattgaacaggagaaaataaaacatgttccctaggtctttatttcaatcaagtttccctgtgttctgcaggagaagagatcgagaggggatagaaaaattgaaaagggctgtcccagcagggagccaagccggaaaaaagggcttctctgagaactcagcagcagcagctaagaaagctcccagcctgcttcatctacatgcagagtcacacaaggcatgggggtgctcactgtcacacagaggtttcacatgtgcttccctgctgattcctgtgaaaagctaacaattggcttggagggtaaaagaccactgcagttcaccctccctgagctggacgtacaatttgtccagtgttaggaaatgtccggcttagcagtgagaggcttgaagacacccctccttccagtgagattcctaacgccgtctcttttacttgatgacactggggctcttttcaagttttgcagatttatggaagttgaggggaatgtgcttttcaagatcaggaggatgaaagccttggtcttaatgtcaaggaggaagcggtagtgagtggtaaggccaggtaactcttcctgcagcctgcaggaccagtggcttgatttttcctcatagatctcttctgccaccttcttttttttttctttttgggagacagagtgtctgaaaaggaactccttgggctgtaaaatgacatgattccccagtttcctcaacaagtgtgagagtagttaagcctattaacctcactgtttaatgctgggtttgacacttttgtgcatcaaattggaaaacctcatctgtatgtaacagggtagcctcgtaatttatggaggagcaatccttcctcagttcagtgcttcccaacctttttagattatggtgcatacaaaatgataacatctgatgatacacttgggtaagtggatgaggccactcacaactggccagggctctagccttcccaacagctggcaggaattgatatcttagtccaggtataactcatttgaagctcaacgattggaaaactctttggaaactttaaacttttacaaaagaagaattaccactccaacgtcatagcagtattactgaagtagaactcagacctaacagttattagtgttctggctaaattttatgatgttgttgagaatagtaacttcctcgctgctctgacacctaggaatattacctaataagagagaaatacagcttaaagcttggaggacctaaggtgtggaccaataagaaactgtcagcattctcaggatggggacttgggtagacacacttgtttctgcatgagttttgtttttaacatcagcagtctctagacaacattgctttcatgtagtccttacatgacatcttagcagtcttacttcagatatggttataggacatcttggtatcttgataatattaagcaactctttaggctttgggttgctttagtgaaataagcagataatggaagagactccaaatcatgcaggcctaaacatgagtatctctccatctatttgttcaaaattaactctggctaatgactatgatatgactcaataagatatataaccactttaggaaagaggcttagtcattttgccagacacattaattttaatccactgatgtggtgacttttgcattgggcttcatttcttttatctaaaaaaaaaaatgatgcttgacagtttagtggcctgcttagtaagtcagtgacattagatacctactatatttataatattctctttaggtatactttgcttagtatagtagattttcttggaaagtcctttgtagattgaacatgtgtgtgtgtatatatacatatctctgaggacaaaggaaatttccagagatctgtgttcttgttttctggacagaaagataatgtatagtgaatgtatagtgatcaactaagataatgcctagtgaagccctttgtaaacctgtggactacatagatagacagtattaaagaacatatatatatagtacatatatatgtagattaatttcaaatgtatcaaaaacagtgaaataggccagacattgtggctcacgcctgtaatcctagcactttgagaggccaaggcaggaagattgcttaaggccaggagttcgagaccagcctaggcaacatagtaagaccagtctttacaaaaaaaagttagtcgaatgtggtggtgagcatccgtagacccagctattcaggaggctgaggcaggaggatcgcttgagcccatgagttcaagaccgcaggaagctgattcttaccaccgcactctagcctgagtgatagagcaagactctgtctctaaaaacaaaaccaacaaaaaacagtgaagtaaattattttataaaacattgctacagatatctgctgaataaaatcaaattttcaaaatagggttttgttttggttttggtagagcacatctatagtagatattaataccagaataaattataagatatatatgccattttctgataactcaaaattaaatatctaaattttaatcatcagagaaatgctaatagtgttgagacgaaatattttttcattgctagaatgtattcttccagatccattgccttaaataagttactgtggcattacattagcttttgaaaggtggggattataacgtcgtagtagtccatgggtgccatgactctagttaagagcaccctttctgtagaacttactctttgtattgaacttgaggtttaaaaaaaaaaaaaagaaacctatgtcttagctcagatatcatctggcattatagccttgaacgtcccttaatttcttggtgtctatttcttcatctgtaaaatagagataattcctcatgtgttacctactctgttgagggtcagctaagataatgtgtagtgaagccctttgtaaactggtggactacatgagctgtccaggcgcagtggctcatgcctgtaatcccagcactttgggaggctgagacaggtggatcatttgaggtcaggagttcaaaaccagcatggccaacatagtgaaacccgatctctactaaaaatacaaaaattagctcgacgtggtggtgtgcacctgtaatcccagcgactcgggaagctgaggcaggagaattgcttgaacccaggaggcggagtttgcagtgagctgagattgtaccactgcactccatcctgggtggatggagtgagactctgtctcaaaaaaagaattgcctttggatagtccacagaaccttttcagcttgtaagataggaaaactgaagaacgtataataactgctatatagaggaagtttccataggaagtgagttcagagctcccactttggaatgcctgaacccaacttccctcatttgcagtactgggaaaagaaacctgcttccccatctctcattcactgaaatttagaagcttcctacatcctaagacaaatactcttgtctggggattagggattcctgttgtagaaagaagtaggaagtggagacaggaattgccaagatcagtaggccaccaccaggtcacacttgtcttcagcctccagggactggcccacctgcttcctttccctgccaccacctgttgcttgtggctgaagttccccttttctcctaactcatggtgcaacaaagtggtgcttcacagtttctttcctacctttctgtcccagaaacaagaatgcagatctttggagatttcctgtgtccttggggatctcacaatggccagaagccctggccctccctctactccttaccctgttaatcttggatggtaggattataggtgatttcttttttattttgctttattgtttcctgtactttatagattttctacaataagcatatgttactttgataatcaggaaaaaataaaaaatgtgtatacaattatttttaacttagcagtataactgtcaaaaattccttaattccattgctttggtactaatttgctgctaaccactagggttaaatgagactacctttgtatctaagcttgtctatgtataatatatttttaaccttgttctttttatgacttaagatttaattgaatatctgaaatatgctgtgggttttggagtaaaagtgtgcaagtgcctcctaactctcacagttgtcctgggaaacccacctggcacttggctcagtgccatgctccccatctaaacttaccatggttgaatgccagtgtgactaaagttgaccaaggtagatggtaacgattgtcttaagcttcattgaaaggagatcggaagtttctttttcaccaaaaatatttcttttgacatagaagtttaaaacatttctttaaggaacatctgcttttattagatgtacatttaagaaatccttctcagtatagagataaaaagatgaataagacattgtacctgccctcagatggctcatagtccaagaacactgttcaattgtgaagtttgtgcacaaggtgggcacaggtcaagtagcaaatgaaggttaacatccagcccacatgctgcccaccaaggagtccaccctggtttgggactgaatctgccctgagtaaggttaccagatttagcagataggaatataggatacttagttaaatttaaatttcagaaaaacatcacataattttttagcatcagcatatcccatattttggtcagacttatactcaggtatttctctagcaaccctaacgctgaacaagaggaagagggtgccttttagctcatacgaggtgctggggcttggggaaggaagcaagggtggccgcactcacccagatgattgcttttttctaatttgttcacctagggtgtgtgtgcgtgtgtgtgtgtgtgtgtgtgtgtgtgtgttttctgatccatgcagaagctaactggtgtccctgtcacaatccagggtgggagaaagatgtgaaaacatgatgcatagagttaggttttatatgttacgtggttccagtggaacataaaggaaagtgtggtccattttacctgagaagatgtgcaaatcattcacaaatagtagtttcggatcctggtcttgaaagatgagtaaaagggagatttagtcagggccattgtgccatgctaaggaattcaagcgctgcagcaatggagagagaaggtgaaggatttatgtatgctaaaattagcatattattattattattattattattattagagataggatcttgctgtgttgcccagggtggagtgcagtgacgcagtctcaatcactgcagcctttacctcctgggctcaattgatcctcccgcctcagcccctggagtagctgggacaacaggtgcacaccaccacacctgactaatctttatattttttgtatagacagggttttgccatgttacccaggctggtctcaaactcctgggctcaagcagtccacccacctcagcttcccagagtgctgggattacaggtgtgagccattacacccagcctaaatttttttaattaacgtacaatatgatacttgagaatttgaggatatgttctgtgtacttatcttaggcttcatatggcatagtttcactggagggaagaatagaaattcataagaaattataggcttcattttttctaagtgactgaagcttaacctctttaaatatcaattattatactttagccttttttaagaggaaaaaaattgctacatacattcttagtgtctgaagcaaagtataataaactctatgttaatgaataaggaccatcataacaaaccataattgatgggtcagtattttcatgggtgggactcagcaggaactgttggaatatacaggattccgtcctggtgcctgttaggtagatacggtgtgccctgtttgttgagttttttgtaccttttctttttttagtggttttgctatcagctgttacttgcagaatccaagtgagttgtgtcagctggcctgcctctgatgactcctttttccagtgtgctgctttcatctgctataaattaaggcaggcaaccaccaggattcatgagctgttcatacagtaagagaactaaactgtggttgggcgcagtggcttacgcctataatcccagcactttgggaggccaaggcaggaggatcacttgagtccaggacttctagaccagcctgggcaatatggcaaaaccccatctctactaaaaatacaaaaaagtccaggcacggtggctcacacccgtaatcccagcactttgggaggccaaggcaggaggatcgcttgagtccaggacttctagaccagcctgggcaatatggcaaaaccccatctctactaaaaatacaaaaaagtccaggcacggtggctcacacccgtaatcccagcactttgggaggccaaggtaggtggatcattcaaggtcaggagttcgagaccagcctggccagtatggtgaaacccccgcctctactaaaaatacaaaaattagccaggcatggtgacaggcgtctgtagtcccagctactcaggaggctgaggcaggagaatcgcttgaacccaggaggtggaggttgcagcgagccgagatcgcgccactgcactccagcctgggcaacagagcgagactctgtctcaaaaaaaaaaaaaaaaaaaaaaagccaagcatggtggtgcacacctgtaattccagctactcgggaggctgaagtgggagaatcacctgagcccaggaggtcgaggctgcagtgagtggagatcatgcaactgcactccagcctgggcaaccagagtgagaccttgtctcgaaaaaaacacaaaaacataaaactgggctgcagtgagagctggagaggccttccagagagcaaggccccattttgactcctgtgggccccttcctctactaaaaaaaaaaataaattttccacctgttggtacaaagctgaatatattactatattaatattttcttccaccaaaaagttctttttttctgatttttttttttccaggagtgcagtggcgcgatctcaactcactgcaacctctgcctcccgggttcaagcaattctcatgcctcagcctcccaagtagctgggactacaggcgcacaccaccacacccagataattttttgtatttttagcagagatgaggtttcaccatattggccagactggtctcaaactcctggcctcaagtgatccgccctcctcagcctcccaaagtgctgggattacaggcctggcctgattttaaaagaaattagaataatactttcatgggttcctcaaagtttcataggccctgggcactgtgtctagtgggtaagttgtccttgcctgtcagttttaaagttacttgaacctcacattgttttttcagtactaggagtgagaggatttttgcttatttctggttcttggctgtgctctggatagttgaaattgtttagcagattggcctccagataagtaaggcattattattggatatagtaaattcatgttctggaagtttggggcctaaaggagcaatgtgggctctgtagggttaaatgagggcagggtatggtgagaaggcaaattttgaaacattgtgaacataagagacaattgcaaattggcagaaaactggagaaagcattttaataaacaaatgctatggataaaaatcacagaggtaaaaattaaattagaaaggagaatattgacctgattagaacacaggggtcaatttagggtatatcaagctaaaagctgagataggtagggaaaatctactgtggatataagagtggggagtttggatttgctgattaatgtgtggtcatcttagttaagtttctaatgagagagcatgcacagaacccttcctttaaggtattaagaatactatggcatggtcagtacaactttatctttttctttttttttttttttggacaccaagttttgctcttgttgcctgggctggagtacaatggcacgatttcggctcactgcaacctccgcctcctgggttcaagtgattctcctacctcagccccacaagtagctgggattacaggcatgcaccaccacgtccagctaatttttgtatttttagtagagatggggttttaccatgttggccaggctggtcttgaaatcctgaccgttggtgatctgcccgtctcaatatcttcttaatttatttaaccttttctcctaagagcacagaggtcattatttctaggtaataaatctccctaactcaaattaagagatcagccattgctgatatggggcttgtgggggcaggggcaagagtggaccccaaatctagtttaaaattacacaaataaaaacagtagacagcaaagcatagtgaaaatagcaatgaggcctgaactgtagtttcagctccctcactggacatgagagcctcagacagatcactttacctctcaccccaggtttctcatctgcaaaatgagacagagaatgagggggtttgggggaatgaggtaatctttaagagctgctcccaatgtaaaatctgatgattcagtgtctttttcacaaattggaattagatatcctttaatatcatgaagtctgcttttgcctatagtattttaaattattaagggttcagtttctcgtttcatattcagtctgtatcatgaattcccccccttattgtcttctgtcctgcttgcagcaccatgaggatggttacaaagaagtagactaagaatttgcttcagggtaaaatctaatggagagtttaagtgtagttgcctgcctagttgtggcatgatttatttgaaacatccttcctttggtattcagcttaaacatttaactgcaaaaaaaaaagaaaagaaaaagttacaggcatttaaacaagagaaatcagaaatgcatgcaaagaggcccaattcctctcccttcacttgtctctggttgcttttaatggtagtcgatcttttcccttggtttggggaaaccaagagttgtaggagatgttaatagtacttggtttttgtttttgttgttgttgttgttttgagatgttttgctcttgttgcccaggctggagtgcagtggcgccatctcggctcactgcaacctccgcctcccaggttcaagcgttctcctgcctcagcctccttagtagctgggattacaggcatgtgccaccacgcctggctaatttagtagagacagcatttcaccatgttggtcaggctagtctccaactcctgacctcgtgatccacccgcctcggcctcccaaagtgttgagattataggtgtgagccactgcactggccaatagtacttgttatctcactagcttaggttaatgacagctaatgaatcttatctttcctctgctagagaagtctgtgttatccagtcaatagctaatcaattgattaaaagagataagccagactttggcacgaagcatacatgccgttcattctagattattttctttaaaatttgttgctatcaacacttggggctcagaggtgtagactctgaaatgatagttactttccttttggacacttaatataatgtgcatttttctaggaccagaaagtaataatgaaggagtgatctgctacccttgaaagctatactgggattatcattcattcagtgcatatttattaactttgtactttgtacaaggcagtatgctagccctggaaacatcagtaaagccaaaccgacttaagtcctgtcctgatgaaggagaactagcaagaaatacagtaaatatagtaagtatatagtatgtaaaaggcgatccaaactggaggagggaaagggcaggataagggttggggagttgcagttttaaatggaggtatgtggggattgagttggcctgtggaaaagctgacattcaggcaggtccttgacttggagggaaaggcctgtgtggctatggaagggaagagcattccaggcagaggaatcctctctgtgtgccaggcatgccatgctgagtactgcaagggcacagatggatgatacgtggtttctaccatcggggagttgacaggctagaaacaagattcaggcttgaagataaatgcagagaagcactatggcaaggtagaatttttctaagggtctctgttgaataatacaagctaagaaaatatgaaaaattattcctatttcaagaatgaagccaggttaagtgatagaccaaaggacctctaccaggaaagcttcttactcttggctctgagccaatttcctcctcagaagttgctgcctctccctgaggccccacgctgccatgagtccttctgactctctgtgagtcaccccactgccatgactccttcggagggggtgtctgacctcttgcttcaggcctcttctgggcctcacagtaacccttgtgaagctgaagatgggagctctcatcttccctaacccagagccaaccttggcctctctgcgtcatttgctgccagtgccctgtgtttgtttttgggaagagagggattttcaggcatcccgtccctcacccacctgacctaaccgtatggattcctgacaccacaggcagaggactattcttcaggttcctctgaagcccacctgttcagatgcttgcttcttttccttcttgcctgttctgactgtgatgacagagaccccgcctcaggaatctccacctcacactctattctcataagtaggtagaattttctcatcgcatatttatggttgaggaggagatagatgctgagaagttaaataatctaccccaaatcacacagctgtgagtgatggggcctctacttctgttgcaccaagctacctgtccatcaggggacttgcctcaccattgctttctgccagccctgggcttgccttaaaaaggacatcatatgcataagacactggttaaaaggtgcagcatggtccctggagatgctcactcttacaactggcctgtccttggggcagcagctcctcacaggcccctaagaggtagacctcctgcctgtggctgccagaaccctcttctccatcacaggtcttcctcctcaagagccttctctggtttcctgttgctttttatattaaatatttcccttagtttagcatcccgagtctgccttttgctgattgttccctccctgtgtctgcagacaacttcgttttcagccttggtgctctgtctcagctgcttctaccacacacataggatttaggcgcattcaggacctgtcccttcttttcaagggccttgccagtgcctacttgttgtcattgtctttgcagtactacggataaccttcctagataacccccctccaggaaactgtccccataaaccgggtgccctccgccatgattagtttgtatttgcgagtgtgttacttggttgtgttccctgaatatttatttggttttcccagctaagttgtaacttatttgaaggcacaaaccaaatctcataattctattaagtacctaaaaggagtaaattattgttaatgctccaattggctaatgtctatttcatattttacttaccagatttacaaatgcttaatattctgaaatatttcactctcatttacaaaaacatcagattctactaagcagaaaataaagtttaatgcccccagcacatagcagttttgagttgcacttttaaactcacttcttaatccatttcagggttttcaattgttcacagttaattcttcttaccaagggtgtattacacttgctcagcattgaatgatatggaaagaatggcctttctttcctgcataactgactttacttttgttcataggttgaaatcagcccttccatttcactgcagtattatattagtggcatttttatttagggaaaaaaaaaagctttcttccacttgaacttttgttacaaatcagtttattgggtccaatcaatgggcaagacctatgaaagggtgtggattatctggttggtcctttgtgtggcaaaaggcttagatgctgcttagtactcgctcattcttcatcatgtaaagaagtgttttttttgaaggatcaacacctgactgagccctgcctttttcatggaaatgttttcacctgagttgctgcttatggtactaagaattagttaactaatacttatttaaccttggaacaatgtttatcataatccgattggcagatagtcattttacttaggctttttctttatagcatcaggactagcaaatctcagtaaagagtatgctgggagcaatttcttttttcccaaataggttatcactctgtgctttttttttgctttccgtcaaggggcatgtttgggcactgtggacattaagactggtggccacacattaggaaggtggaggtcccctcttgggttgagcaccacttttgtttttaaagctgcatccccatttcatgctgctggcagtgtttcccttcagacgaatcccatgcaatgtatcactttaatatattcggagctgtttttcatgataaagcttccttatgagcactaccactaattaatacacaaaatggcccagcacaatttaataatttggtaatgtttttcaatgttttcttaaagatgacgctttacaagtcaagacccaaacttgcctgggtcatgacctctttgcagtttttggagtcttgttaaacaagaaggaaagcaaaacataaattagcgtctccagtatggttgctctacatttcccaatctttcaacactttgaagagcatagtcactgttaatgtaagagaacatctcatgaggaaactggcagcgattttaaaagtccggctttctggaatgagtaagaagcttcttcctcagtgccactgttctagggccaacattgtcctttgtgagagaggagcaagatgaggaagtttgcattatggactatggaacattaaaaagctaaaaaagagaagtaacagttacctttaatcatactgaggatgtatcagcatgtgtggcctttggcatctgttagcctttagggctatgttcccaagtttgccattagaatttagtgttaaaaaatactttaaatataacagcaccactttttgttatagtaaaaatgtatgtctttactcgattgtaattacctcaacacccagcttttgttgttattttgcccttggacttaggtatttctgttcctctggcttagaatgtccttccccttcatcttcctaatcaacctactcattccttacgactcaactcatgtatcatctcctccagaaaaagctttctctgccacgtgtttcttccctctacctgacatccttgtgcgtaatacctccacctttccatattgtactataattatctattttgcatctgtctttctgtggaaggtctgttgcatattcatctaggaacttggtaaatgtctgatgataagcatttgattttttcctagttgattcctcaaataataataatgattaccctttaatctgaatgctcacaggtgtacttctatctcatattctatgcgcagtcatctgttaagctaatggctaattgtaccagagggtctcaactttgtttctttgatctgcattggtttatggtggtaccttgcccattcttggcacagcaggtggataaaaacaatgagtaacattgagaaaggctaatgtgtcttattgacagtagtggtataatgtttaccaaacccaaattgaaattattttggtttcttaaaatcttttcccgatagcccatttattttaatgttctgaatttccaagatctgtgtataggttcaatgattagtctttactgaagacttatctatggactgagtgtgtattataaatctagtgacataagtttaaaacttattcctttttcattttccaagtaaacttttttagtaatgtgtttttctttgtaaagacaggcagtatatgatttaggtctggatctggtttccagtcttggctccatcatgtattggttatttggccttgaacacaaatgacttgccttgaacacaaatgacttatatctgtgagattcaatagcttcatcagtaaaatggggatagtagtagtactgaattttcatgattataatgaaaattaattgagagactgatctggagaggtgccatactacaaagaggattaagtggaggtgtccctattaaatggcgagatacccagaaacattaccctgttgactccagtatgctggcaacgaggctttatagtctttgggaaggagactggaagattcttctctgggaaaaatgtacacatactgacctttgaaggacccccagtaatcagccaggtcttacctgatcatcctatagtgaagccccccgacacagtatttccattcatagtttagctcttaaatgtgaattagctatccagcaatcaccagacacttgaggaaagcctccagaaaacaaattggaaaaaggggcaagtcataggaaacagacaaaacaaggaacagaagaaaacatcatttttgcaatctataatattcacaagtttgttttttgagacagagtctcactttgtcacccaggcaggagtgcagtggtgccatctcggctcactccagcctcaaactccttggctcaagcgatctgctcacctcaggctcccaggtacctgggacgacaggcatttgccaccacacccggctaattttggtatttttgttgagatgaggtttcgccatgttacctagacaagtctcaaactcctgggctcaagtgatctgtccatctcagcctcccaaagtgctgggattacaggtgtgagccaccggcctcagagatctaaaacaagatattgtattttaattgcacaggatgcaattaaaaaagaaaacattcagaaaacaagaagagctcttagaactgaaaaataagttagtgtaaaggttggaagataaaattgatactaacctgaaaagtattagaaagagaaagaaataaaaactaagagtaaataagaaaattagaagattagtcctagagaatcagtatccaactaagaggttcccagtgggtgatacagagaaaatgaatgggaggaaatctcaaggaaatgtatttcctagaactgaatgattggaatttccagtttagaaagaaggaatctagtgccagcaaaatgagtatagaaagaaccatcttaggatatgtagttttcaaattgcagaacataggaatgaagaaaagattctgaaagttttgtattaaaaaggttagaaacaaaagatcaaagatcagatagcatttgtcttttagccttcagtgccttcaaaattgtgagaaaaaaattatttctaacctttttatttatttatttatttttttgagatggagtttcgctcttgttgcccaggctggagtgcaatggcgtgatcttggctcggctcactgcaacttctgactcttgggttcaagcattctcctacctcaacctcccaagtagctgggattacaggcacgtgtcaccatgcccagctaattttgtatttttagtagagatggggtttcgccatgttggtcaggctggtctcaaactcctgaacctcaggtgatccacctgcctcggcctcccacagcactggaattataggcatgagccaccacacctggcctctaaccttattttttacaactagccaaactattaagacaaaggatacaatagtaaggctagaataaaggtatttccagacatgcaaggtctttaaaattttacctccctcactctttctgaggaagcttttgggtacatgcagcatagacaggggaatagatgaggaaaaggaaggctgggatacagggaatctaacagaagagagaggaaagctccagaactacagctgtgccccaggcctagagagtcaccgcttcagattgaactgtgaacacacaggactcctggaggggaatttcttcaagaacacaactttaaactatgtaatgtgtttgaacatactgaaaggagacttgtgattgttttagagacaaacttgtgataagtacctggtaaactaagcaaaggggaaaaaggcaattaactccagtaaaacaaaatgttgtccaagaaaggaaattgaatagtactctgcatggcctagctgtaaaccacatttgtataaacataataaatactgaatatagatttaactaaagactgtgaaataactgtatcggaaggatgtaaaaaggggcatgtggtgggggaaggggggtagtgcaaaattaataataaatccccatcttccatggtaggaagttagtaaatcatatttaaagctgaaaacaaaaatctaaaaccagtaatgtaacattattatttgaagataaggaagtaaatataagaagaaaagccaagagaattgaaaatggttgcctttgaagaaagggaactgagaatggtagcataagcctggcatagtttttaaactttttttaaaaaaatattttggggttaaaagtaaaaatgaaaaatattaaatgtgacaattatggaaagcactttagcccatgccttttacagttcagtgttgcataaatataaactcttattaccctgctccttctaaaaagtgtactaaagccttgtaaagccagcgccacatactttctattcatttcatcttttttccccaattcccaccatacatgtgccatgttggctctgaggaaggaattacatacatacacgtcagtatctttccatttgtttgtgtatcttcttgatttactaatccattgttttattgatgtgaatgagaaggagctgttcacatgttgccactttctgaatcatgtggttggtaccttttttcaggattttcaggaaaatcctgaattgttttcttctgttttgcctaatcatttgcatcggcaagattaaataaaagtcttttgcaaattgtgttcaagcttactgtagtttcctaattagtcttattatgtacattttaacacattttctccctatgatcagggccgcaagcttcttatcattgggaccactagccgcaaagatgtccttcaggagatggaaatgcttaacgctttcagcaccaccatccacgtgcccaacattgccacaggagagcagctgttggaagctttggaggtaaaaatgagtcaatggattgcacactgtttataagaaaggaattgaggctgaaataagtagtaccacattatacctggtgtttggtttttatgctaatctggaacatgggacccggggatattacaggttgtatataccttatccaaaatgcctgggactaggccaggcacggtggcttatgcctgtaatcccagcactttgggaggacggggcaggtggatcacttgaggtcaggagttcgagaccagcctggccaacatggtgaaaccctgtctctactaaaaatacaaaaattagctgggcatggtggtgggcacctgtagttccagctactcaggaggctgaagcaggagaatctcttgaacccaggaggcggaggttgcagtgagccaagattgtgccactgcactccagtctgggtgagggagcaaaactctaacaacaacaaaaaatgcctaggaccagaagtgtttcagatttcagattttttcagattttggaatattgcattatatttaggttgagcatctctaatctggaaatctgaaatgcttcagtgagcatttcctttgaatgtcatgttggcactcagaaagtttccaattttggagcattttagatttcagacttttggattagggatactcaacctgtacctccagttgttttcaggaattagagaagaaagatgaatatacatgacagtgagttaatttcccattcctcaatgtaggcagctacaaactgccaggaattaattgctctgtatccagcatgagtgatgtatatagattacttggaccagaaacttgaatgggtggtggtgtgggggtaaggtaatcactgtatagaaaaattaaccattcatagtggcttttagcacatttccttgcatttaataagttggaacaatgattaaagccttagaaatgtcaaaaaaaaaaaagctacagaagtaaaaggaactttattaacaagtttagaaatagaaatgttttcttaattttttgaaaatgacagtcatttttaaaaaagaacgttcttcatttaacttttaatatcaatattcacaagtaacttggtgagctctattggaaaatattatctactgagttgttcagcagtggtggagtcagtaaagcttcttaaagtcctcaaggcccccaacaaaattgaaatttatctatatgataaatgttttcaggttacccatgtagacagcttttgtgcagaagctgggtaagagaattaaaggagtttgctttgacacatacagattgttcctagaaaagaatgttaaaaattttaacttatatttattatggattggagctatttttttccccagaaaatataagttacatagcggtccataagaaaacagggtttaagataccagttttcactttcatgattgcacctaatgggtttaggatggtgaaggtcagactggattttaaagtaggagagaattctatcaacttgaacagttaggtagttcttatcactcttcttttaaaggtaaatagaattaaccaatgttgatgtgttcactgtaaaagtgctttgattattgtttattgtttttgtagcttttgggcaacttcaaggataaggaacgcaccacaattgcacagcaagtcaaagggaagaaggtctggataggaatcaagaagttactaatgctgatcgagatgtccctacaggtaaggtacttcgttctccgtatgactcagacagaacaaagcttcaggacacaccaagagggttcagtatttcctttgccaaggttttaattaatttaagttttgattttcttatattatttccaaacttaatttggtattagtagcctgcttctgagattgatcacttaacaatactttttaacttcttaaaattcaaaaatggaaggaaagattataaagttagttttcatttagggagccactaggtcttagaactagaaaagacttcaaagagcagtcgttcttctgccccctcattttggagatgaggatactatgtgagccacaggctgtcagtgaattatccaagatcacatcaccaggttattgatggagaagggatggtgttgcacctcaagtcagtaagcgactgcacatataccaaacggtgtctgggagactgctttaagggacaagttaattaagttgtgcagtctagacttgggatctgtatatttgtccctggctgggctcctagaaatttcatgcaaactactgtagggttgaagcatccagaatcacatagaaaactgagccccagggtgctgcctgggcaaagacagatgaaacttctttgggactttctcatatctcctggcaacttacctttcttcattttagaactccacccttccatgtgcccatgctgtgtcttcttgtccttatctgacatactaggtagctgataaatacctccctatcaagccctatgagttcagagaccttggctcttactattgagtccacagcccctggaacagagccaacacatatgaaggtgctcagtaaacttttattattattattattattttgagacagggtctcgctctgtctcccaggccggaatgcagtgccatgatcatggcttactgcagttttgacctcgcaggctcaggcgttcctcccgtctcagcctcccaagtagctgggactaccagcgtgtgctaccacactcaactaatttttgtattttttgtagaaacatggtttcactatgttgcccaggctggtcttgaactcccgagctcaagtaatccgtctgcctcagcctcccagagtgctgggattacaggcatgcaccactatgcctggccctcggtaactttttttctttttttttcttttgagacggagtctcgctctgttgcccaggcttgagtagtggcatgatctcggctcactgcagcttccacctcccgggttcaagggattctcctgcctcggcctcctgagtagctgggattacaggcgcccacccaccatgcctggctaattttttgtatttttagtagagatggggtttcaccatgttggccaagccggtctcgatctactgacctcaggtgatctgcccgcctcggcctcccaaaatgttgggattacaggcgtgagccactgcgcccggccagtaaacttctgttggatgaataactgtaaattcattttacagttaggtaaatggacagagtggctgtattctaggcatcatgtgttactaggtgttactaggtccatctaggtggacagagtggctgtattctaggcatcatgtgttacttactgatggtcctgcattctgctagtgtgggcagtgagcggcagaggtgaagtttctgtttcacagttacatctgaaataggctcttggaccaataacaaattggaaacgtgaagtgaatgctttttaatcttttctggtaaatttatctgaaaataaaatttttttgactttcagaaatctaatttaatctactgagctttcagatggactatttttaagtcaattaatttattttccattatgagccataaattaaagtcacagactaaccactttgtttagacttattcttggtaaaagtgcaaatacaggtgtattggctctttccttgaaaaaaagataaatctgtcagattgtcagcttctttttttttaagtttcagtataattttttttcaataattgcatagaagaaactatgtggattttttccccaaccctcatccctttcccttcctttgatgcctgcaggtcagtgatcaagttaatgcttcttatgcatgtgggatagagagtgagagtggggcactcaggcctgatcttcagcgactgacatttcataggcctctgagtttgaaccccttcatgtcaaatggatttcgtgcagctgagtgaattctctttagatctgccttagagaggctgaacctaagtgaagaggcatgtagttttgcagaatataagtcgtggtacctctctgttcactacatgctattctgttaaaacttgcacagagctgaggatctgctctgactggatgtcacctgagggaataaagtcatttatctagattacttttttcctccctttctcctgacttttaattccatagctacaggcaagtcagtaagttgttgctcacacatattaaatatatttaatgggcaaagaactgcaagtaccaactacaactgcgctccagccagttcttttttttttttttttttttaagaacttgacaattgattcatatgtaattctattcccaaaaaggaaaaatgtttcttttgttagctattcacactttttcttagtcctttgtagtctgacctcttacctttgatacatttgaaacttctgttcagtgtttttctgggatagaagaaatcttaaaaaaaaaagaaagaaaagaaaaaaaaatccgtggttggagtgggagtccaattgcacatctccccacagctgcactgagcatttgaaagttattcctggagggcagggagttccctcttgggaaacagactcctgctctgaaacatattttaaaagttaggtgtgtttcttacaataaaaattcatcttcaggaactaaagatgtttttaacgattgttttctagataacttcatatctcctgtgggcctacgagaataaagtacatttaacgagttagtataaatatgaatagaaaatgaaaaccagtcgagatagctaataataacgacctgaacgaagcacctgaaacaaagttgcgccatcttttcttagactcatgacacattcgcagtcacaggagacccagattcatctggagatgatttcaggaatcagcagtactcttcatttttttagttttagcacaactttgttactacaaagaagaaactatatgacggatactgaggctaagaaaagctacatggttggttatgtagagttaataagctattttttagttgttgaattaacctcaacttggtatcttctactttgctgtgactttagtagccttttacaccttcaacaggtgaattggttgtcatttgaactctgatgaatggccctgtccagtctcacagcgatgcctcacaggcatcagcacagggcacgcctggcccaagtgcctatgatggccagcgggcttgggtcttttggaacccagtgtacatagttctggaaaaccccattcacttcctccaaatgatgtgatctgctttgttttgtgtgagaatgctggtcaaggagcaggtaacacattcagtgacctagcagagcattgatgaagtgtgaaaccgaacactgccttctcatgaagcaagtgcagagttgttagaaggtaccattaacccatcttcatttcttctgatgtatttagatggatcctgaataccgtgtgagaaaattcttggccctcttaagagaagaaggagcgtaagtacatacaacatttaatgaccatcaaccaaacttaccaccctgttaaatccctgtgcctattctaagagttgctttcctagataagtttgtttccatttatttgaattcttcgctgtgttgtaggtccgagagaccaagcaaggaagttggttgtactgttggtttgctctccctgtcctgcttcgcaaaacttccttgtcacaatgcaggaaaaacttaatggtacatatttattggaacctgcttttacatgcatggagctgtgaccattttcttttgtgaagtgctcatctaatagcaaatgcatagtgggaaatgtaggataaccattaagaagcttttagtgatttttttttttttttttttgatgaatagttttttacggaccctcatctgtttttttgtgttttggtatttcttttgcagtagcccccttgattttgattgaaaatgaactatttgaaacacacagtgaccaagggaagtgaccaaggtgaagatggcctaggatcttcactgtcttactcaagatactggactaagtggaacgttctctaccttcaacatgtgctcgctctgcatgattagtgcaataaaactcccttccttatgcatactgagatagcttagtgtctcgtggaaggtgtcaatttggtttagaatgctgcgcttaccttcccatgcaggctaaagtgattccttcttgctcagtccctctgggtgggaaccatccagtacttgtggacactacacgtttcaacctctctactagcaccatcacccttgaaaactctcagtcagtgtcatgaatgttgcatgacaacagttggccgattagaaggcagactttctacatgcaaatctggcttagtaaatcgaggtgtgggccagagatcctctgacagctgtcctgagctaacactaaaagtcactgggtatttggttaaaggtctcccacaagactggtattctctttgcctgaagaaacaaggcattgaatctctaaaatgctgttctcaatcattgtcagagatgttttcaagttgcagtcagaagatctttcttaatagaaagtcagatgactaccgtgttggttgtgacttccccttaagtataactaatttgctctgtggtaagagatatgctcattattaccacttagaagatgttgttaaaaacatgtgaaagataggtatggaaaaagcatacacccccaaacagaaaggagttattaaagtaatttacaaacctctcagcactaattagtgtccaactccaagtgggtcaattccttagtataatattaaggcttactagtatcactgctttttccttagcttaatgacttacttagaatttatcctttattttaaatgatctgtactatctagtgtctaaaacactattctccagaaaaatcaatcattttctagccctctccctcagtcctttattgtccattccaatacattgaacacatttcctttaccctccacacacttcttccaaaaggaagcacccgttgagtccttttgagggtgatttgtcttacaactgactgacttagcaggaatttaattaggtcatatttggtgatgagacttatggagtgtgcctctctctcccaactgctgcttaaaatgcaaggacaagcaattagaagccatcctaaggtgcttacctcacacgccacccatgaggcttgtggccacagtggcacttgggtgtggctcctctgttatttgtcctcatgtgagaaagcagatcatctccaaatcttgccatttgtatacttttggtggagacttggatgtcatatcttctttgttttgggttttcttccctagcttattttgtggcttttaaagaagtggattgtattgtgagatcctgtgattcctggtggccagtatcctggattcctctaagatcttgcctctttcctcctcatgaaagcagcacacattgtgttaacttatgtctcttgttaaatgagcttaatgtctttgtgttttgtccaaaactgtattgaaaaaatattgtttaatgcaaatgaaggaatgcaataaagagtaaatatacttgaaaatgttctgtagaccagtgtttcatatagaacgacatgaacagctgataggaatggaggaagaaggagggggctcaggaaagaaacctctccgtgttttgttacaagtagcataacatgagggatgatttttattttaaaaatctcttatttagaaagtatagttatttaaaaacatcattagagtatcagaaaaagttaatatacaaccatctttatgctttatacttattttatcttactaaaaaaaaaaaatgcctggcacggtggctcatgcctgtaatccgagagggaggctgaggtgggtggatcacttgaggtcagtagttcaaaaccagcctggccaacatggtgaaaccctgtctctactaaaaatgcaaaaaacagccgggtgtggtggcacatgcctataatcccagctactcaggaggctgaggcaggagaattgcttgaacctgggaggcagaggttgcagtgagccaggatcacgccacttgcactcagcctgggcaacagagcaatactttgtctcagaaaaagaaaaaaaaaaaatcaactcaggtacctaagccacaaacaaggttagtaataaaccagaaaggagggttgccactcaattagaattactcctttctgtgaaatgtacaaaccaaggaacttcaaggctctcagtgagattgcttcacatggttcacttttgtatcctccatagttttttacatttttctgagctatcagatctcttaacctcctaaaccttgatccttagcattggctcagtttaggacaggaggcagctcagaaagtccacaaggccctgtggggaagaggccagcttcaagaacttccacaacgggagttcctgggaggaggaccctgaggccgacctggtccctgcatagccttgagaaggtgggttcttgaagctgcccaaatattcttcaaagccagtgctgtacagcagagcgtatgagattacagaacggcctgtgaagaagcaaaggaggctccagctagctgctgccttaggtttcttcatctataggcgaattgttaaccggctatttttttgtcataagatgtttttgagatcaaaacctcaaaagaggaggttattttatcctttctaaatttgtacatcttcactgggacactttttttcaatgtcacacagaaaaattgcataattgtggttaaagtcagaaatatgtttttactttaaggctgtcttttcatatcctaaaaattgcagcctcccctttaaaagtttcagcaacaagtcacaaaatcatggagtagattgaagtgtgtacaataatcaaatcctgatcaacagacttgttgaaacagtgagtcagctataaacaaacaccccagcccaaacacagaaggtgaaagcaggatttcattttccttgcctgacaacttggtccatagcctctttaaagaagtgactgggggcagccgggcgcagtagctcacacttgtaatcccagagctttgggaggctgaggcgggcaatcacctgaggtcaggagttcgacgccagcctgaccaacgtggtgaaacaccgtctctactaaaaatacacaattagccgggcatggtggcacatgcctgtaatctcagctacttgggaggatgaggcaggagaattgcttgaacctgggaggcagaggttgcagtgagccaagatcacaccactgcactccagcctgggcaacgagcaaaactcttgtctcgaaaaataaaataagtgactggggaagggtgtgtatgagagttcaagaaagcaggtaagttgcagaatttattgcaaaatgatgtagagtttctcatcagctggcaagccgtactgagactgggtcctggagacgagcccacaagggtgtgtgctggacgggcaccatggcataaagatgcgggagatagcgcctgtgattggcaagcatcccaagtgggtgaagacaaaatatccaaggagggatcatgtttgaaattttccca

SEQ ID NO: 15424 - DNA, 27132 bp, Human
aatgcattggcacttttttttaagcagaactgtagcactctgtctagtcaaacagactgctcatttgcaagttgtctatatgcaaagcattctgcccctgggagcctaaaatctccttagaaagtcatctgaaatttgagaagagctttgttctgaacctgctttctgctcccttcacttttcttccctgcttccagcactgtgagcaaaaagcctaagtatggatcacacctggccaacccagaagcagccatggcccaaaacaggaggcctgccctgggaaacccatttgagttcaaaggagggtgtctaaatatgcttgtcttgagccctgtgcattgggccttgcactgcagccttccaactttaagagaaatttcagaatccaaatccttcccgcctgcagggctcaaattttcctttgcagatcagacctggtgaagaggctatttgccgttcaatcctaggctagctttctgcctttcacctaatgtttgaggttaagagaaatcagaaaagagagaccgtaaactgatcaccactgcatgggcatctgcctcacccacctttgggagttgggggaagagccagccacaggtgctcaggtgcaggtgcccaggtgtgagcggctaggtgcagatgctcaggtgtggcagcagggagtgcacttggctcatctgccctggggagggccagctcccgacagaagtaggccagaggtcagtcccaggaaatgcttggagcagccagcagggtagggccaagtcatgatacacctaggagtgggaggggaggcctctttggatattacctggtttatcatttagctgttggggtggggaaggaggtgggaaagacagaaggctctcccaggaattggcaggcagccaggtcagggacaatggcagcccccacttgtgctagaaaggcaggcaggacgtgaccactcagatagccacatcaacaagtacaaatcacggttgccctggaaggaaatggctcaggtttttcccagtagctcaatgcctaggcacccccacctgtggtttgggcatttcactctattagctcttctgctcagtggcccattctgctagccacagctcacatttactccagttatgaaaaaggttaattttcccatattgagtttctctgcaaaagctgctttcagttgtgaccggtaagttccgttgtcaccaatatgggtacaactgttgtcactctgctattctgaagccatgatactaaaagtgtgaccccagatcagtgtcatcgccatcaactacaagcttgctagaaagaaaactctccctagacttccagaatcagaatttgcattttaacaaggcccccaggggaatcctgttcacactgagttttgagaagctctgttctaagatattactccaatccccagcaagccaaaccgaccactttcttcacataatcagaacgctcggttccagtatttccagataccagccataggaaaacacgttgttctctcatttccctttaaccttatctaaagcactcaatttcctcaacccttaagtcgtcatctgtaaaatgggagtgctaatcctacttaatttaagatgattaagttgaataataaattagaatttgtcctacaaattgtgaatcatgatcggaatattcaattttattattactctgtgtcctaactcaataactgggttataaactcctgaaaacaggacaatctcttctctacctctttctttatcttccctgtatactgaaatacagcgttctgcccagcatgaggtcgactatttgacatttacaaaaatctctcttggaatccccctgccaaaaaaaaaaaaatcgaatttcaatttatgactccaagcacaaagagatcctgtcactttgacctaattctctgaggttcatccctctaaataattgtattgtctccatctataaagtactctgttactatgacaacgcacacataattgcatgtgtaagtagttgagggtggctgtgcaagtcagactcctttccaccaggaaacacagaaaacattctatcttcccaaatgttactctctcagatttgcaccaagaccctagaagtttcttaaatttccatatactttatggacactacaaagcaattccaggaaacactgatacagtagcaaaactactgggagtggaaattggatggagatctgggtcccagttcagagtctgacacctgatttgcaacataattaggcacagggcactcaactattcagggccctaaacccttctattgaaagggaaatgggagaacaatatgtgttcctatggctcagtccctataagattctgtactattcagagttgattttaagtgtcacttaactgaaattatccaacaaaccttcatggcatgaaacattaacacagctctttttatatggcatggttcctatggctcaatccctataagattctgtactattcagagttgattttaaaagtcacttaactgaaattatccaacaaaccctcgaggacattaaacattaacgtggctctttttatatggcatggttcattatcatgccaataaatgattaatcgtaactctctgtcttgaccaataattttgctggacttttgtgattcacaacgtgctctgtgttgtaatgctacctcttgaaactgacatcctagctttattgttttttattacttccctaaggtggctttcaaaagagacaccaagtgacatatttttaggaggggtttaaaagtttgatggggtagaagtaaacgttgcttaactcaaccagcagcagagccagggcccagggaccagcgcttctgtggacttggcctttccagcagcagacccagcaatgaatgatccgaacagctgtgtggacaatgcaacagtttgctctggtgcatcctgtgtggtacctgagagcaatttcaataacatcctaagtgtggtcctaagtacggtgctgaccatcctgttggccttggtgatgttctccatgggatgcaacgtggaaatcaagaaatttctagggcacataaagcggccgtggggcatttgtgttggcttcctctgtcagtttggaatcatgcccctcacaggattcatcctgtcggtggcctttgacatcctcccgctccaggccgtagtggtgctcattataggatgctgccctggaggaactgcctccaatatcttggcctattgggtcgatggcgacatggacctgaggtaagattatctatacctctaactactgcaatcaccttggagtaatccttccagaagcctatggcattctgaatgtccaactgatttgccacgcatctaaagtatgactaaggaatcaaacaggagagaataaatgcattcccgtgccttctagcacagctgcttagctattggaattgggggatttatattttgtgtttgtgtttttaaatctaactcagttaacagggagttgcataattgctgttgatctctaggaaaagattcaaagcttttttaaaaaagtaatcttttccaaaccacaagctgcagctgaggaggtttatcctgttggtagcaggaaaaaaaaagcaaaatacactttctttgtaatgatgaggagctctgggtgcaatcataaaataaaactgtttgtcaaacattagaacctgtagtgagacagtggtcaactccatcaaatatagccagttctttgggcaaacattttcctggtataaaacctaaggaagaatttgtaaatttgcttcacctctactggcattaaaagtgggggaaaaagcctatagcagcttttttaaaattatgcttaccttactacaaaataaacagaaaacgttttctccacttcctacagagtaatctaaattgcaatgtttgcccatttcatcccgtgccagtctgaactagcactggaaaaaaaaactaatagaaataagatgaagcattaatgtgactagattgagaaatttaatgctaaaagttgaatagacaaatgtctttttccttagctcacaattcctcatttcccttgaaaggtatgcatttccttctgcaaaccatccaggtgctaatgcaacgtgtgcttattaaatactgtacagtaggcaattagctctgttcatccccagctactattggcagaggagagaagcacaaagtgtagaattgtaaacactggattgatagagtacccagtgatcaattaggaacctgctgtctcatttcaactggtgctggtttctccagaagctttagaaaagtcatacaaaccctataccttcatatggtttagtctttcacataagaaaacacatgatatccaccttgcaattgctttttttttttaaggaaagccctataaaacaacataggatggcaagtgctattcaggtttagttaatctgtgaaccacgatatagcaataaggtctttttagacctcaatttagtttgacctggacacaggtacacagaagtgagaattctaaatgccagcacctgttacactgagaaaagtgaactacttggaacattgggccttgacccccaataaacagctttctcataatatttgtaacttttagtgcagaggagttttgtacctcaatgtaataccacatatggaacccttttataagacagaaaaaaaacgtgtgtggtactggactattaggttgttgaaatgaattctcttctgtgagctaaaaacagtaagatctaacctaaaagctccaagttacatttttctgtggttttaaggaaatcttatttctcttgaaacaggagatgattatgtaatcctgtccacctagcataacaattcctataaattattttttttaataagaactaaaagtagaatatgaagctttggtagaaacctccagctaaatccgtgcaaatgaatccttccagcaagtcaaaataagccctgtaacgcaacatggagcaacctcacctatccagagctcaacaagacccaataaaagacactgcacacccaaaataaatttcacttaatctcataaatgctcctcatgcgggaccgacttaactatttttattttaaagttctgttgtgctatttcccagaaataagaagcggggaaggaagcagagtgttaggaagggcaaaagagaagatcaaatgcctgcaaagcaaagcagacactgacaacacacagccatctctctatcatttatcctctatcacttattctctctatcacatattctctcttaattatcaattattctctctggtttctgtagcacttattccagtctctggtctctgtatcacttactcttctacaaacacaagaagatgtcacggtattttagaacaaccgataatcatgtttatcatgatcggtcttaatcattgagaagaggttaaattatactgctatgtaagatgatgacattatgcattgtgtgttaggaaaacaatattccaatatttctttaatacaaattaattaaaagggtaaaacctgagctattgcgtaacagttttccaaaactttttattcttctggattaagaactggataactaaagtctcctgataatttacttagatacaatcctatctaacatttatatttccagttgtgtacacttagaattttaccttctccatctccacttgaactccagcaatggcatgaagacatgactgtttatgttaacaggcagctacactaattgagctaatgccacacaatgccagcaaaaccattccacctggttttaactctcttggttatggttcttgggagaagaaaccaaaacatttctctctcactctgtcatctcttatgaacctggaaagccaccgcattttgcaatctctagtgactttgaaaaacaaaaaaaaaatagacaatagtccttgatcattggaatccagcaagtactatttcagctccttctctgaccactcccagcctggagtttgtgaatctgattggtgcacatatattttcacctaagttgcagctgtgccatggacatcacatgcacaaaaagcatcagggagaagagatggtgacttttcaggtgaatctgcttgtggccaaaacccatagttgagaggacacagaaacatcctatctcctttgtgtctgctctctccccagacacaggcaaatatccggtgtcttcatccttcttaatggcctcagcgacaccatgcaaggacttctcatttcctttctttggcttcctctttggggaatccattcttatgcatccttctcccagttgcccccagttccttccctgccacctactttctacattcctttttattattttacagactttcctaccacatcctttgttctttgggcaaatgctgttagatttttcagcttccagtgcagcattcattgatattttagatattcaagaaatctcaccctgtagcttaccacaaattcacagcaatcaatccttcctatgtcaaccccataaatgtccttctcttctctactctgggagacctaacccaaaaccattcggctttttcctttattctccctaaaagtaaccaaacattgtttctctccagtagcactgattttactagctaatatttattaaacactagtatatgccatgcacagtgctaagtactcaaaataagttggtatatttcatcctcccaagaatcctctaaagttagtactattattttctgcatttggcagataatgaagttaagattcataaccttgaccaaggtcattgagtcaatgtatgcctgagtcagaattggaatcacccaggtctacccactaccactttgcaggctcataagctttctctacactgcttctatcacttttcacttctccagtttctagcactgcctatatacgctacgttagagccttcaaacttggtattttacttctaatatgattacaatcttttacattgcttaacactgatttcactgaattcctcaacattcactaaatttacatttattctttcttttatttccatacacacaaaagaaaatctccctggcagttaatagagctgaagtcaaaattaagaccaagattttttttttatttttcttatacttgactcttttctgtcagtctaatataaattcaaggcagtgtatgtattttttatatacatgccttttatagaacttcagattttttcgtgtaagataatattttcttttgctaatttaggctcctatattatttcttaaaattcgttatctgtgaattgttttaaatctcattttgagtggtttgattttgttcttacattcattcaaatagcatcaacttccagctacctattcgtctgttcatctgcaaggtctcttcgtcagtgctgctcacaagtctaaacctttccttctccaaaccctcttttgtccctcatcacgatccttaagaaactgctctcaccaaactcaaaattatgatacaacgtcatagattgtcttagcaatattcagaattaaaggttttgcaaggatctttgaaaaaaaaacaaagacagaaaaagacttccttcttaaacattttctcacattttaaaacaaaaattctcagacttctcttcactggaacccagttaataaatcctcctcacttccccaccagattcccaccacactctagaaaaaaatattggatgcacagaaaaaaaaagtgattttattatagggacaactttaaatccattctaatatattttttaaaataaaataaaaaaaaagagaacactgaaagaagagaggaaggaacagagaaaaaaattaccttcaaactccagtactttcattataagtaggacaaagtactattaataacaaattaacttgtttgtctggtgtacaattctgccttagcatctatttcatgcctaaatttacctataaccagaatagattgaactgcttaaagttttaaatacatccacattatttgttactgttgtaatattttagctctactaaaacaagtatttttatctaaattatttaagcctattttaaatgaggtcattctggttaaaaataaatatattattagagaagttaagctctctgatgaactttgtcccaccctgtattttgccaaactgtgcaaatttaactgtgccttgaaacaaaatttctcattgttagctcctttcttagtatagtgtgttgttgttgttgttgttttggggggcaggtaatataaatatttaacattttctttcaagtacacccataatacccttaagaaattactactcttgacaacctcaatgacgacctgttgagagaagggcctttcagagaaatttctcatttctctaagtttcccgattctatttggtggaacacaagatacaaaaacatggtaacataaatgatcacagcagagagatgcagggtgcggtggctcccgcctgtaatcccagcactttggaaggcctaggcgagcggatcacctgagcccaggagtttgagaccagcctggacaacatggtgaaaccccatctctacaaaaaatttaaaaattagcctggcatggtggctcatgcctgtattcccagctactcgggaggctgaggtgcaaagatcacttgagcccaggcttcagtgagccaagttggtgaccctgtactctggcctgggtgacagagagagaccctatttaaaaaaaaaaaaaaaaaaaaatggtagtagcaaccagctcttaatagagtgctttgcattggtctaagtgccggacaccattggctcattctatccttacagccattttagataaggaaactggtaaagagaagtcaactaaattactcaaattaacacactaagtggcaccgcctgctttcagcccagacagtgtgtggctttagagctcaggctttaaaggcagagaatgtacgctgtgtacagatccctttgaagaggacccggaagactcactccccaaaaatctttctttgacccactgtcctagtactagagatagcatcatttggcattaatgtctccatgtagatagcctactcagccagaccctcttattaaaatgcaaacactctgagcagggatgataccagacactagttcttctgaacacacatttgccaaattgccaataacttactcagtgctaagaatttatgtctaccctgccgcttgcatgctttcttttgatttttaagtcagcttccgcttcttgtcccaagctagggtcacttgggcagtaatttttctgctttatggcaacacagcgaggcctcctccctcggacatgcattctattccaggggcccagggaggcccattccatctcagcatggtcagacacatgcagccttggtggtgtcagctgctttaaatgtgtttgctgttctttgattgaatgtttgaaggatggcacacccagcgaaccttatacattatttaatgatgactttaacccatcgtttaatactgtttctgacccttaagaataaaaggggagggaaggacggcacaaggcaaagtggaaagacaccaaatatggcccattttgctcaaggccaggccctgaatacactcaggcacataggcacatgtatattactgttcatcacaccagacgatgctacaggttgagacagattcttgcaggactttcttatcatgaatcgaaaataaaaattttctcccattcgggaggttgtttgtctactctgcttatagtttcctttgctgtgcagaagctctttagtttaattagattccaagaaaacaatgaacaaacccattaaaaagtgggcaaatgacatgaacggatgcttctcaaaagaagtcacacatgcagccaacaatcatatgaaaaaaagttcaacatcactgatcattagagaaatgcaaatcaaaaccacaatgaaatgccatatcacatcagtcagaatggctattattaaaaaggcaaaaattaacagatgctggcgaggttacagagaaaaaggaatacttatcttctgttggtgggagtgtaaattagttcatccattgcggaaagcagtgtggcaattcctcaaagacctaaaaacagaaatacactcaacccatcaatcccattactgggtatatacccaaaagaatacaaatcgttctattataaagacacatgcacacatatgtccaccgcagcactatttacaatggcatacatatggaatcaacctaattgcccatcaatgatagactggataaagaaaatgtggtacatacacaccatggaatactatgcagccataaaaatggactagatcaagtcttttgcaggaacatggatggagctggaggccattatccttagcaaagtaacacaaggacagaaaaccaaatactgcatgttctcacttataagtgggagctaaatgatgagaacgcatggacacatagaggggaacacagacactggggcctattagagggtggagggtgggaggaaagagaggatcaggaaacataactaatgggtactaggcttaatacctaggcaatgaaataatctgtacaacaaacccccatgacacaagttgacctatataacaaacatgcacatatacccctaaacttaaaataaaagttaaattaaaaaataaaaataaaacagcatcttccctagaacaccacaggtggatgtatcaatctgcccattgcctttcagcgtcagcatgaccacatgctccacactgcttgccctcggaatgatgccgctgtgcctccttatctataccaaaatgtgggtcgactctgggagcatcgtaattccctatgataacataggtaagtcatccatctgtaagactgttgactgttaccctcaaactctctgcttaccccctgctaggctctcagaccaggctcacacctgaccgttattgccctagtaggagtttttgcctgatttcattataaagtcacccctgcgtttggagagtgatggcagaatgtaaattccaaaccttgaccttatgggagaacctgtcttttcttcaatttgaatcaccagggaaaggagccccctccccagccctcagtctggactgaggaggcttaagctttggggacatgggagcttgcacctattccttaacccagagtgtcactagttaatggtcataggattttgcatccagacacttgaattgaagaaattttttttttttttgagatggagtctcactctgccacccagcctggagtgcaggggcgtgatctcggctcactgcaaatttcaccccctgggttcaagcaattctcctgcctcagcctccctagtagctggaattacaagcatgcactaccacgcctggctaatttttgtatttttaatagggacggggtttctccatgttggtcaggctggtctcaaactcctgacctcaagtgatctgccggcctcagcctcccaaagtgggataacatgcatgagccaccacgcccagcctgaagaaattttttaaaatcacataatggtttcaaaatagagcactgagtaagcaatccagagtgttacaacagaaaactgctagacgaaacacactgtttctaacactcgactgtgagccacaccttgacccaaaagttgatttaatggcaaagtcatgctccaggagtcaaatttactagtaatgactctgtctcatttcaccctcatcccaaaaaccttattttctgtttctggggaaacaaattatagtgggagattaagttattgttgtaacttagggatgagggtcaaaggaagaacaagagagttcctggtataccaggaataggcatttcccacagaactatcacgaacaaaagacaagatgtgggcaaaatagtaaatcagtaacaatcaccaggtacactatatgccccaaatacctgggtttttttccccactgaccttggaaaaaaatcccaatgagctgcctcagaaaggtgtgggtttcccattgaagaaagcatccaagcaaaggctaaatgataagccacctggatgcttgtaaaagggactcctattgggataggaagctgggctgaaatgccttccatttctgagaaagactgcttctgtgatttagggtgattgagggaatatacaactgaattagaataaactttgtgaatactaattggggatgatctgtattacaatgtttgtagcctcttctctctctcctactcttaccattaccattagaccaaaaaaaaaattgtcctccttgacatgccctattcagtatgggcttttgatatacaagattcttcagactccaggagagaaccttaatatcatatataacctcctgacaagagactttagggtgaccctccactaccacctgcttttgccttcatgctgcttgactctctggctgctctgtcagcggacgccttccatagagctaaaaaccatagtttacgtgagtggtgaccattatatccctctcaaagaacctgtctgctgagtgaggaattttgattccacaatactcactgtaataatttaataatttaagccataaaatattctccttttgatatacattcccttctgagaaatgactcatggaaatactgaataattctaactgcagtgtgaatgacttataccatattctgtgatgtgaataaattttgaaataaggagaaaatgaaaaatcaattagcacttcaatggaggaaaaggtcatcataagaggtcaagagtgaaaagaaaagaaaaataggaaaagagaaaagaaaacggaaaaagagagaagtttgaaaaacaaagatattgttatatgtaaaatatttattcagaaacagaatacttgttcctcagtaccacaaggaaaaatgagcattcagacaaaaagttttctcagcaaggcaattttactttctgcagaaagagtgctcctcacagatggcacaatggtgacagcacacctgaacaatggagggaagtaattcgtatcccttatgcagcttgtccctgctactgtgtcctgtctccattggctggagccagacatcacaatctaagctaaaacctgactggctaataatttaaaacttttctaaataggtataggcaatagacaacaaaggaaaagaggacgttgcttgtgaaaggacttagaaaagtaataatatttccaaataaggaaggggcataggctgcaagctggaatgtacctgtgagcatgttcagcataaatatcttggttaaagtacaaggacatagaatgtacttattcctttatatctaacagctacatagaatagggcttaacaaagagttactagcacaaagtaagggggcttgaagaaagttagtctttaaaagaaattattatttctaatgtttattattattattattttcctttaacaacaagggacactttgaagaggaaactttttactttctacagatattaaccctgctcaccatgtttgcccaggcctccaagctcacctttttgctgttggtttttctagttctttaacatagaaaataaatgaactgactgcttcacaagatgttatcactgctttctaaattgtggctcagggtgattatttgcccaaggtcaccaggaagctggaatagcccacagtctattctctacacagctctatgggcagacgtgtttggtacaacttcatgctccagtgattcagtaaacacctgtgagccccctcagatgctgacatctggatcgagaggaggcagaccatgcagctggtaccactaaaataaaaccactgctgcaaattgttgtacttactcctctctaccccacatttttaagtgtcttgtgccaagaagtttatagccatttcatcatttaattctcacaacagcactgtaaggcagacataactccacccattttacaaatgaggaaacaaaagctcagaggggttcaatgatttgcacagttcccacagtttgggaatacagaaaggttcagttccaaatctatctggctcccagtcccaccacatgaatccattcaccaccactctctttcattctcattcttctttctacctttctttcctctgatatctactgtgtaaacttgattaaagaccaagttatggattcaatgtgtaaccatgagtggatgctttttcatctacatagacaggcactttacagagagaacatgggcatatgaggcatacgtaaaacaaacagagcatggggaaagaaaagagcaagatcaccagcccactggagaccaaagttacaacatccacctctacaagcagaagccacacactgtgggtgtaaagaaagacagagtccctttcccagtcaaccccaggtccctgaaaaacttcatctggcctcatctggtcaggaaagaaaagcaattctgccatggatttcagcaggtggtgctgcttatgtgttatcccgttggcttgggctgcctcaaaaagatgaatactcttagcaggaggggccaaacagattcagcacattaaaatataggaccaaaacctaaccacactaacattccaagcacaggacttgcagctagatttaagctaccacatcacaaacaagtcatatatccagatggttttaagacctacaaacttcaaaaacttaggcaatggtctaaagacccaggagagggagtttccttcttgtattcatctgttctctcattgctataaagaattacctgagactggataatttataaagaaaagaagtttagttggctcacagttccacagactgtacaggaagcatggcaggggaggcctcaggaaacgtacaatcatggcagaaggggaaggggaagcaggcagcttctacatggctggagcagaggaagagagcaaagaaggaggtgtgcacacttatagacaaccagatcacatgagaactcactatcacaagaacaacaagggggaagtctgccccccacaattcaatcacctcccaccaggcccctcctccaacagacccgtcctttagttgtaatcctccaactggggattataattcaacatgagatatgggtggggacagagagccaaaccatatcactcccaaaacagcaggatgcaaggatacccaaggggggtttttctggggcatctcagcagtacgtgtgtcaacgccactctttcacatctttttttccattattccctccttactccccctcatttatctttttttttcctactcttagtacccttagtcattatttaattctgctaagtaatttctgggcaaaagtcatcactgacccttatattgccaggagggctagaagactacaaggaaattatgttttcatcattattgcattcactttaaattaatatctatagccttggattccagaatctgttttctagtcctagttcaatctacctagttaatcaatactaagcaacatccactctcagaatttcaccgttcaatatcactttcttatactgctttaaaaggatgtttgaaaaagaaacaacctatgaaaagttagaagttgttggtgctaaattatatgaaatcagctattggacaaatgagtgttaaataacatggagaaacaaaccacatgtcgcaaaaacagcagtaaatttaacatggtgaaattgaagtatgactcttttatctggccaggtgagcatgttactgcaaagaactataattacatgagagttcgtcaaatatattatctcatggaaaatttaaagcacgctttctcaacttttgttctcacctctctgctgtaaatttgaatagctaaagctagttttaaccaaaagtcagatgtcagaatacctggtgatcttgagctaattttggacattttctttcattttaaaatattttaaaattattttttatttctactaccatgaactagcagacaaatgtaaaatgtcatctttgtatgccatacacacacacacacacacacacacacacacacacacacacacaccttggtgagctatttttcctagagatataaagatccaaagactaaagaagccaagattctgacaaattaaaactaatgtatgctggcaaaataagaaactctaaaaaattaatgcagaatttagtgaaagaatttacagcattgatattatcaattatctaccaataatattaaattatttactggagtgggtgaagaagttgagtgagtgtgtgtgtgcatgtgtgtgtgtgtaattctgtattctgttttgtgtattcaagaaggaagactgaaataccacctaatctttcttcaggctgcttgttcttctgtttttctctttcctgtgtcacctgttctgctgatcacattgcccttctgtcatctttaggtacatctctggttgctctcgttgttcctgtttccattggaatgtttgttaatcacaaatggccccaaaaagcaaagatcatacttaaagtaagtatcccagttcacaccattaaatattccactgtgacaatcaaaaccatagggttttccatccatgaaatggtttcattctcattatatgattactgttgagtgggggcctgaagtcattagccatgcagtcttctcctttagaatgtccttctttatatgtgtgtagagagagagaggtgggatctcactatgttgctaatgctgttcttgaactcctgtgctcaagtgatccttccaaagtgctgggattacaggtatgagacactgcgcccagcctagcatgcccttctttattgcagtcacaggaaaaatttctacccattctttaagacactccactgaactatcacctcttggttttactctattctgtcctcagggcatattactgttatctctgttatgtgagtttgtgttatacaatatatctaaatggctttcttagaaaatagaacatatctttcttatgtctgtatgcatatggccatttcattgcctggcaatcccattcactaactatattctagctagatgatctggatatgtatgtagataatatagatagattctgctgctcggggcaaagtaagtccattgtattccttgcttctcttgacaaaaaatgtttataatctccaaattttgttttaaatgtgaaaaggagaaaaaaataacaacagtggttttcatttgcttataccttttttaaagttgtatagagttctatacccattttctcattatcgtaacaatcataaagggaagctggggcgacattttatccccaattacaaataaagaaactacagttcagaaagttcctgatttactgaaggaaacagaataggagtagttgaatccggaagccaaatcttccaggctgtcattgaaatgggttgtctttttgttctgacaaggataattttcaagtcagaaaatcttcagactaattgcaaatggttgctacatgtcctattgtgttcttaaagcttaaagcatgggacaagcgtcagtatttccagtgggctgattgcagcctcctggcttggagtacatagaaagacaactttatcatcacttcccccagggacaaggagactgctgaggttttgtctctgacaaacatacttggatttgctttgactcatgattgctgggttcacttattcctttttttttcagattgggtccatcgcgggcgccatcctcattgtgctcatagctgtggttggaggaatattgtaccaaagcgcctggatcattgctcccaaactgtggattataggaacaatatttcctgtggcgggttactccctggggtttcttctggctagaattgctggtctaccctggtacaggtatggcatttagtaaatcacattgggaattttaatctgtaatatctgttgtattcctttgctagaggtgccataagacagaaccacaaactgagtggcttaaacaacagacacttattgtctcatggtttcagagactagaagtgaaaatgaaggtgtcactgaattgattctttctaagggctatgatggagggatcccttactggccttcctcgtggcttgcagacatccatcttcttcctgtgtctttcctcagtgcacctctctgtggcctggctccccttttgataaggacaccagtcattggataagggcctcctctaatgaactcatcttaactaattatatctgcaatgaccctgttcccacataatgtcacatcctgaggtgcggagtgttaggacttcaacatatgaatttgggggaaagggagacataatcaatccataacagctgcaaacactgaagacaggatcaaaatccttagcccttcatcaatcacattcatcctatttctgaatatgtcattctaaataggcccattcattctgaagtcatgcaagtccccagaaagaaaatactgactgcctcttttttgctcaaagtcttctggaccattcggcttacaaggcagatggggctcttccattgctaagtattcttattctctgagtggaatgacattaatgaaagcagttgggctgccttggaatagacaagcgttcctccagctggcagcagggtgagctcatcctccaaaggcgccgaatattaaaatgggtttcacacttctggatttggtaccgggcaaaaacaattctttttgactaatccatcgaatccacaggcagagagaacacaggtgtagggacagatgcatgtatgaagttgggaaagagaggagtgggtatgggcagcaagaagagcgcagtgtttgagtcaggcagacctgggcttgccttccaatccgaccacacactgcccgggggacctcaggcccagcattcactctttctctgagttttatcatctgtagaatggggacaataatttctaccttatagactttctgtcaagatttaaacacaacaattttttatttttatgagacagggtctcattctgtcgcccaggctggagtccagtggcacaatcatagctcactgaagccttggctcaagtgatcctcctgccttagcctcccgaggagctgggactacaagcccacaccaccttgcctggctaatttttttgttttgttttgttgttttagaaacagggtctcattatgtggcccagtctggtcttgaactcctggacacctgggctcaagaaatcctcccacttcagcctcccaaagtgctgagattactggtgtgagccacctgtttagcccagcctaaacaaaacaaattaaacaataaaacagcgacaacaaataccatatcttgagcattttctgagctgctgccctgtgctctacactgttaccaaaatcataattgaaaagggtgaaatgaaccctcttggccacttacctaacactgtggtaaatgagccaactcttcatatgcacatattaaatatatttatttatattatatacaataggtgagatgatgtataatatacattaataagtattacacttattccatagaaagttatatattgaataagcctatcttaaatacatgcattaaaagcagagacataatgcatatatatgtacttattattatatctgcttttcatgtttcacaataacaaaactactaaaacatgtgctctcttaacatcttctttaggtgccgaacggttgcttttgaaacggggatgcagaacacgcagctatgttccaccatcgttcagctctccttcactcctgaggagctcaatgtcgtattcaccttcccgctcatctacagcattttccagctcgcctttgccgcaatattcttaggatgtaaggaatcatgccaatcccatttcatgataatctttgaaaaatcctggagttgctaaaacaacatttttttaaaactccccgttcctggtggtgaattgtacaaatatatgagaggaaaaagccaccgtcatattatcatgactttccaattgctgatgaaaagatggtagttttaccaaaagattctagcaaagattatttttgagtgaaaagtaatggaggccgattctctccaatgactttcttttcctcagtaataaggaaggcagaggaacctgttgggaccattttattgtgcgccttctggcattcgcccaggaactcaggatttggtgatctttttcaaaacattgtcttgatatgctttataaatataggatatttatcagaaaactggtatacaaagaaaatttaccaggctaacttacaaggaagatgtgtgtgtgcatatgtgtatatgcatgtatatatatattttaaatacccatataattgaagtggttgaagcaaaaatgttccttatgtaaagtactaggtgtagtttaagtaattcttacttctcctgtcctgtggcatgaagctcccagcgtttcccatcaggccccaccgcccactggccttcacctagttgaaaattctttctacattttcctttccaagggctgataatatttaacctctatttttacattctattttttttaataaaaaagctagtttttaaagcctcatgacattgtaatgaggaatataaagtgaaggcacgcaacaaaactaatgtaaatgttaggtcacaaaatgtccagagatatagtttggttttgtttggttttgcttttctctctctctctcttttctttttttcttttcttttctttttttttcttttttttttgagacagcccctcactctgtcgtccaggcaggattgcagtggtgtgatctctgctcactgcaagctctgcctcctgggttcacgccattctcccacctcagcctcccaagtagctgggactacaggtgcccgccaccacgacaggctaattttgtttttgtatttttagtagagacggggttccgaggcgggcagatcatgaggtcaggagatcgagaccatcctggctaacacggtgaaaccccatctctactaaaaatatggttttgctttacttttctgcttagcttcatcagctcttcaacttgccctgtgatgctgatctcctctgcactactgtcttgaatgtcattctcaaagcagaggcttcctttccagaacagaatactctgaatccactgaaaacattccatggatttatcactgctccaggaagcaggagtccaggcctaattaccttgttttctgtataataacgttgtttgatctgcccaatttggcacacagtgggatttttccaaataattacttaatgatgtctactagataagccagagaaagtggactggttgatagaacaattaagtaatgcactagttgaacactaaccccaaagaggttgattaataaaaaattaagttgaaggaatgaggaaaagggagcactcaactcggtcttgaaatttcccagttacatcagtatgtataaaaataagggaggaatctttgttaagtgtatacaatacctggaaacatattttggtggtaaggctaggattctaaatttttttttggaaaaaggagaggaggggaagaaagaaaaagggaaaaaaggaaggatgggggagggagagagggagggagggagggaggaaggcagggagagaagggagggaaagaaaaagggataaacaagaggtatagtttggttaaatgaaatcattggcataagtttaagctgagggactctcagctcaaaacagtttataataagtggcggatcttcaaattgaccacaagctcaattaaattcaatagtgtggttcagtggctttgaaaataatatatgactagaagttcagggaccaatctaaaggaaatattgatcttgagttaataagatctttgaagcaagtcattatctctctcagctgtgtatcataatgaacgttaacatttattgagcatttactattcttcacagaccatgttaggcatttaattttatctcatttaatgttcacaattgccctatgaggtagctaatattattatggccattttatatgtgaggtattagaattcgaggggtcctataaggagtattttctgtcctcctcttgcctttgtgaccaattgagaagtagaagaaaaatcagatattcagataacagaatagcactttaactatggataaaacttaattggaaaacatgacttgaatctgcaaccaaatgggcttgttgaaaccaccctttcctccactgcctcacacatgtgcagacatgtactcacacatgcatagacactgcaggtcttgcctcgcagggcagagcctaccctgatgagctgacattaaaaataagctgagaaatgcttgctatcagagaccagcagctccacagaaaagaggaattctgatcacccatcagccgagtctcttctctccgggggaaagattgaatgaaggcagggagggaatgggaacgttgttctagttcaagtccttctacagaggaccatcaaacccatgtcctggaggttgcactgcaccatgtgtatatttattaagaactagcacattaactgggatatggcggtacagaataaatcctccctattgttcttatcattgttgagtaccacgtgcagggctgaatgcctgaagaagcttgtggctgccctgagcaaatgtctcctaaagatttatgctaggtcttcctgaagtgcagtcatccctctcgccatgagtagccatagaactaagaatggtgatttctttctctaagcagcctccagtctacagaaaatgtgatctgccatgtgaatcataggttataatctctatgcaaagtaattttgcagtttattattataaaatttacttaactatctgtgtattgttttctagtttatgtggcatacaagaaatgtcatggaaaaaacaaggcagaaattccagagagcaaagaaaatggaacggagccagagtcatcgttttataaggcaaatggaggatttcaacctgacgaaaagtagacatcaagtggacaaaacagacgagttccaaattacgttcttaaaccgtaactatatttaattatttgttttggtaggacagttggcagaaaagagttaaagtgaaaattggaatttcattggaattcatgtattggtttcagtaccaagtgactggtggcccaattctttaatgggacaaatattgtttcctatatatatgtatatgttttatatatgtatgtatactcatatagatatattgtcattgaaatattcccccaaaatattctcagactaaacctgacatagggaacaccgagaatgaaaacatcgttaacaccaaaactgaattcttatgcagaatttcctagcccatagatgacaacctgactttctgtatgttaaagtagatgtaatgaattattattattacagtggtcacgattttcttcagtgtttatgattataaaaattgacatgaacatctttcactgacattttaatcattattttaaaagctttgcaacctatatatttatataactttgtaatataacatgggcaaatatctgacttctgtatttttaaaaagttgccttctccagtggcagtccaaaagcagaaatgagaggaaattattacaaaatagaattcaataaccatattggatgcaggctcttaactcagcagggatatcgtacatctattgctctacctcaggggtccagtgatacccactagatcttccaaggaaaaacataattctttcaaacggtgtgtatttggcaaagagctcttcaaatctgggagagggacttcctcaaggttttcctgtgtgcagtggatccacatagctaatatgacagctagtcagttgacagggaccacccacagtaagcaccatggtcagggaggtggcaggaggtgcaaagacagaagtattgagagaaacaccaagactctagtggaggaattaattcaatgggagatagtataaaatacatagaaaacacaagtaacagaaacctggttgaaatgcttaactagagtcaattagatgtgcaggagtaagtagtataagaagaatcaagtccgagagtgatcaggaaatgagtattaaacagtatttgaaacagagaacgtgtcccagggcccaaaagtcagaagggccccaccagccaggaaagttgtttcaatgctgtaagtaggtgtagccaagggaagccaggactatctgatatacggtagcaggggtttacggctgccaggggaaaataactcatcaagtgttggactttcaattataagatcgaatttaatttcctttccctcattctgcagcaatcagaatacacaatcttaaccactcggtccttagtggttttgttccattttgcattgggtattttcactgcctcatagagtctatttcaagtgttttggctgaaagggctttttgcatttgcatgttctgagttcagattctgctggtgcacccaagcattatgggaacaggaactcaacttagctcttccagtagaggggtgagggattctgcttttcaaattcataacattgatctttttatgcaagatttccatttacagttgaataagtacttcatatttttccatcattagacaaatacaaaatggactaaataattttaagagatagtggaggagagggggtacagacttccttcttagagagtgtcagagaatatgctcccaatggtggaaaggaagatttacagtctagcggctaagtacctcctacacatttcccatcaatcagaaaatagacaggtacactaaagggaccctgagaactcctcttgtaatttcaacacacccaaaatcaagggcctggatgccagcagctgcagcaagcaggtttttcctccctgttgagcaagacaggtgagcaagataggacttggctttcttacatgatgcggtaacttgtgacttgagtctttttccctaatttgctagtgggaagaaaaatagctgagctttctaaaatgatagctctctatttttaaatgaatttgaaaagtcgattaaattatgtattttattgcctctgagtatcatattaaatgaatattttattttaaaggcttaaataaatgaaaatgatttttgtaatgtttggtctagttgaatctttgtgacttgtgtcaagattttctcactgctcagttctagagatacaaataaggtggagtttctcagatattaaattgttctttgaaaggtgcctgaaagaaactcttaattaaacactctcataattcggtctcccactgatactgactgggattttcctccagaaaatcatacagggggaacattaattaaatactcttaaaaatagtttgacaatgatagctgatttaaaataataatgaaagtatttcatgaacttacaaatgaagccaccatcttctacgaaatggtgatgtatatacatatatatacacgtgtgtgtatatttacacacatacacaatgatagcctatttaaaataataaaagtatttcacgaacttacaaataaagctttcacctcctacaaaatggtgataaatgatatatgtatattatacatatgacatatatataatattatatatgtcacatatattatacatatgacatatattatatatatgtcatatgtataatatacacatacacacacaaagaattatggagctcttgcattaaaatctctcataaatgagacttgaagaaattcaggtcatcaacctcatttgactcctcctcaaagacatcattctcttttcaatctaggaaactctcactctcttccagtaggaaacaatttatctccttggaatatttggtatcccattgcttctcaatccttcaccttttcaaaaaccacataagtttagaacaaccgtcttcaaactgtggtgtggttacccctgggagttcatgaaattgttcaaagggtatgcaggcatggttagggagtaagtttccatttcttcaacttccagatgtataccttccccaaactgccctgcctgaaatgcccagtgtttgagttgtcctgggttctccatgtccacctcctctctcatggtcaggccttattctcaggcctaatcttactatggtacattggtcaagggtaggaacactttttaacaccaagcaaacaattcaaaatattggtatctgagaaaagcttatctttcccaatcgtatagatatgtatttaatgatttagaaatgaagtatgtgggcccatgttggaatatttgtataggtatgtatttcatgatttagaaatgaagtatttgggcttgtgttggaacattttgaatatataaatattataaagtggtctaggggagaagacaattttccattaacatgccagcacttccatcccaatatttacccacaaaagccatcacccttgagagtaaaactgtgagagcaaacaaaggagcactggttagagacattgaaagaggacacagggttttttttcctccaagagataccaaactataacaaatgtctgagccttatctatctttcttaagttggaattcagatgtgaaatggtcaacacagaggcccatgtcgctatattgttaagattgaaaagagaagtcaaaaaaatttttctgacaaaaagtctgatgtaattgactggtttctctgctaattaagaaatataaaagacatttcttgtaaattacatgagctcgatctgcagctctaaggtttaaaaaatatatttaaaacatatgaaaagcacattataaaataattgatctaaaatatataaagaactcttgaaactcaataataagaagtcaaggaacccaactgaaaaataagcagaagaatttgaatagacacttcagcaaaaaatggtactaaaagcaaataagcacatggcaatgggaggtacattcatgagaagatactcaacacgacaatattagataaatccaaattaaaaccacaataaggtaccactgcatgctcaataaaataactaaaaagaaaaaagtgctgacaataacaagtgttgacaagaatgtagattgctaagcggtacaaccaccttcgaaaacgtgttgcagcttctcataaacct

SEQ ID NO: 15425 - DNA, 197875 bp, Human
  misc_feature (1)...(197875): n = A,T,C or G
aaggtgcccagcctccctgtaatctgctgcacttccccccagttgcctggtggcgagtactctactgcctattcctgagacaaagagaaagtgtgttttggttgagaactgctcccagggctgcctgcgtagtgtgcttgccctctttccagctctaaagcagtcactggagaagaaggttgttgcaagtctcttgattaccaagtgagccatctctcccccttgcttcacactgaatttccagaagtctagttcgagcatttctttctctttagctgcctgagctgataggcaaagcagtgtaaagggaagaggagaaaagtaagaagcccggagccagagctgcacttggttctgccactctggtgtatcctagaaaccacggaactgtgttcatccaagcatgaagtgtttctctcccaacctccccccggctttttgtttttttcgggtgccctccactgccgccctttctcttggaccttcacattttcaggtatccaggagggaaccgctgtcgggacacagacagaaaatcaagggggaggagacgccggctgttgtatttgaatttcagacacagttcagatggctttgctccctgacagagcttctttgcccagggacaccagaagatgacagctcaaattggagtgtcctgtctggctgcttttcactgtccctggaatagtgtgacaccctcctctgccccttatatttctgccctgacttcttcaacattctcctgggcgtttatcctacccagctgctgttctgtagcagctactgcggctgtcatctcctcctcccagggctggggagcatatttgggagtggggtctttctatctcgcttaatcacaccttctctctttccattccctcctttttgctccgtgtagcctttcaaaatgacaaacctacccttcctgcagcagaagggagggtcctgcaagtttgggtggactaggtgaggagtggaggctcctccctccaacccggggttgggggtggcgacgggggggcgttggtgctggagggattagcagggagggcggaaaccacctcgccctccaaccgctgctgagagtttcagtgcaccggtaaccacgttaagaccgagaagccccaaccaagccgcggaaggctcgggaaccagcgagttgcatctaagaaaaagcgccccgatgttccttcaattccacctgctttggctcggcctcttagcaccccatccctgcaatccatcttagctttctttcttattatttttaaatcattattacctatacgttttgtttctttctgaagaggtacatcaggagggggaccacataggtggagggggtgtagtggggtgggaacggagcgtttgattagagatctcaggggagaagattggtctctccagatgctgatttccaaagcacttgacaatcaccggcagaagccgagagcgggcggcgccggcggcggcaccggcccgcgggcagctggagcccggcgctgagtcctgcccagcgcgacccggaccgacggacgcgcagagaccctgccgggacccgccctccagccggcgcccggggagccgccggccggctctacctcccgcccgggagccgggcagggcgagaaggcagcgcgagtggcggtggcgacccccgccggggttcctgcgacgagcggtgaccagcagcgcccgcagccgcggtcccgctctccactcggacgtggccaagcggcggcggccacgacctccggcttcccgggatcgtccggctgcgccctgggcgcatctgcgcgcctggccccgcgccccgcggagagggcgatgggtcccggtcaggactgagcgccccttcccctctccccagtcccgcctggcaccctctcctctgccccgagggcgagccacggtctgcgccgccgccttcccctccggtgcccccggctcgccgtcctcccgcgccctccctccccggacccgttcccggggccaccatggccgcggccatcgctagcggcttgatccgccagaagcggcaggcgcgggagcagcactgggaccggccgtctgccagcaggaggcggagcagccccagcaagaaccgcgggctctgcaacggcaacctggtggatatcttctccaaagtgcgcatcttcggcctcaagaagcgcaggttgcggcgccaaggtctgtgggggtcatggtcgggagatgcgccccgggtcgccccctccccgcctaaacggagcttctccaggctccttccctccctcggttttcccggcccaccccggccccggcctcccttctgagcactctgggtgccgtcgcggggaccctggagtccgctgtcgggcaacctgtagccgccgagaagtgcagccgccagagatggcaagttggctgctcctcgccggcggctcctgccctccgcgtccctgcaggctgggctctgggaaacctgttccccctgagtctcggcttcccgggaggatagggactggcactggctctggaacgcggggcaccccttcctgccacacccggggtcgagccaccgctcgcagtctgatctgagctggtgggggtttccatggggtgggcctggcctcacttggtctctggggtctcctagaaacctcccgggttcccagaccttggacaaatgtggatatcctggcggtgcccccagcgggagctgctgtagaaggagtggagggtgtgtgaactatggcccagtccgctgaggttcagcagaaggctgcttagcgcgcagccctgggctctgcagcccttcagtcaaatcctgggatggggacagaggctcagggagtctaaagaaagaatccgaattgcggggagcggggggcagaagtaaaaatccctaatatgtgtcagttttaattgaaaaactggcgaattgcctgagatacaagccgttactatataaaggtgactagaatagttaccttactacaggtatttctttgagaaactagtacctaggatgaccttctttcactgcctttgaaatgccagggtctgagaaggcatcctattcaggagccaggcgcttttgtctctctctctgcctgtctctgcatccagttgctaaggctggttgttttgcgagcatgtggtgtgttctgtgggggaaatgggcattgctggcttttcataaccgagtggggttggtaggaaacattgaagaatctatttacgttaatgggagtatatgtttgcccagcacattacattgtcggctcccagctgtatttgttttaaatgccctgttgttccaaagacgggggatagaagcataagctatacatgtgtttctcaaagagtgagtgcgtgtccttacatttgcaaattgatgaccaaaagttttgatgctttttttttaaaggctaatgctgaatattttaaaaggacaatttcttgttgtcacatttaagaaattggagattacttgctcttactatcaagcttcaaaggcaaagataggaagaaaatcagagtggaagttctgttagagaaataaaattatataagtaaaataagaacttcttgttggagaatttgggatcaatcatattttcagaccagtgtaggagccattaagaaaaaaatggattttaattttccacattagcctagagccttattcagcccacctttgtgtaatgagaccaactcgactgccttaatcaccgttgatagacggaggatcaatctattatgacttaaattgtgcttatcctcttatgtcatcaaacagactatcttttagaatacagttttcaccacatacagctccaaattggctgtctacataaagtaaattaacatactatctactaaataagcttattttaatataaacaatgattaaaacttgtgtgtatttcttaagaatatagccagtagattattttataaatatgaacaataaatgttttgtgccatattgggtggcgaaggaggatttgctttacacttaatgaattttaagttgggtgtttacttttttgtcagtatagaaagctgtctgagttttctaatggtccgtttctccattttcaaccctgactgctctgttggtattcctgattttgaaatgataagcaatcttcaatgttctgtaagaaaaatatatttgaggtcacttttctaccttactttggacaggaaaatagaagggaagatacgttataaggaaattgtatgagaattttttattcttcttatatttcttatataaaagtatatatattcttcagaggagaaaaatacagatatatctcttgagtatcagaaaaggattaatttattagtatcactaattttaagcaaaacaaatattaagactttatgttatgtaaattatatatcgacatataatagtatgcttttatattattatatataacaatataattattcatttaattaagtcttattgtcgaacatattttcaagcatatttaccttcttattacacactctttacatagggaattgccctcagaaaattttaaaaaatcatatttattaaagatacaacctttaagtctgatggttttatatgtctttatagctgaaaataatataacaattattgaatctttacaatctgttaggctctgtagcaggtattatatatacatacagcagtgaatagaagagttgaagttcctgccatcatggagctcacaaacatggggtagagagtcattgcctatggaaaggaacaaattaataagaaataataaaattcaaagtcctataaagcatgaagagagctgggataaagaattatggaggagagaggggtggggagagggatctaattagataaagtagtcagggtgggcaacactgggatccacaggttgagagatgacaggtaagaaggatgcagagattttaagagcaggtagaaaaagcaatgtgtgtgcagagaccttgaggtggaaaaaatattgtcccattgggagaaaaaaaagaggcatagaaattttaagcacattgtcaagtagaatatagtgtgatatgcttgaaaacagaataaagaatagctccacattttgtgttttggggaagggtaatacacatttttgaaatgtagggttttaaaaaaatcctttattaagtagtaatttatttaatgtaaagattattgagttggagccctacacccacactctttcctatctccatcacccctacccctatagaagagtgatgtttataccagttgacttactcttgtgaaggacagaaatttgcaagatggctattaatggtgtggtaggcagcatgactgcaacccacctttccagattcagctccatctaccctccaccgacctccacagatttcaaacacaatacaatgccacacaccccgcaaattagtcatatgctttcaaatccttatccttttgtttgtgctttactgtgtgtctagcatcttctcctcacttctacattcacctgttgaaattatgaaattattctcattttgaaaagctgagagaaaatgccatctcctctgagaagccttcatttattggatacaattaaaaataattctcctgtggtatttcatacgtcactgttgttgtttatatatacctgataataattaattaagtatacatattcagctgattgtagggaagaagcaaagtctgtgttttctgcatcttcataggctctcaaatcttgagagtgtttgccatacactgggttctcctcattgcccttggattggagtgaaataaggaaggttaataggcccaagctaaaaaagaaagtatccttgaaccagagtgatctaactagataattttagacataaaaatacttttcaaattttataccttttttactttccctaaataaatataattatatctttttttaagagaattagagggattacatatttgtgggttatttataagaatgcaagaacataaacaacctcattttaaagcttaactaatatatgaacaaagatatttacatatattgatttagccaaagaaaggggaatttacaaggaaatcaacagtttgcaaatagttttattatttggaatcttaacaaaaatgaaaactaaagtagccactgactacaatggtgtataatgaacattgtatccccaaaagtgttatgtttttattatgaatttttcaatcaaacaagaaccataattgttcacaggataataacctttctaaatctttggcatggctgctaatgcagttgtttcttgagatttacttttttggggctgtgatcatgagagctatggtattatgtgccatgtatgcttaatcagcaggtgcctgggcttcttactaacattttaactaaaataaattacagtatgtataaggaatggaaagtgaggtacttaaaatgtgttttcaagttaatgcataatataaaaagcagaaatgcatgtacacctatagaaataaactgctttgctccagtgtgatagtgaaatccatcagttattctaagaaaagtgtccttccttcttacaaggtgctatgtaaggaaacaagtgtctaccgtctcagaaaataatccacagcaaatagtcatcaaaaaaaaaaaaaaacactgtttttgtgcgctactgttttagtgtcattaccatgtgctcatacaaagaccacatgcttgtttgttttggctgttttggctaaactaaaacaagggaacatttttcttcaaagcactttttattttttggaagatattttctctttggtgttggttttctaaggccatacccattggagtcttactacatattaatacctgttgctaactttttgataattataattttattatttgttagttgtattaaggttagatcaaattatggtcttctaaattaaaatgttgagttttgttttgttttgtttttaacaagggacatactataaatgcaatttctaagcagggaatcttatgagaatattaccagattggtcaatgaaataatgttagagacaaaaaaggcattcattgtttatgcattttcctcctgtggcttaattgttatgatttcacagtccatatttgctataggtttctgaaaatgtttaatacctcagtagttcaataagtaaagtgtaaaatagtgtaacagattaggtataatgtaattaaacataaagaagatggtttgctttgggtttagttatatccatagattgagttgagtttacatatattaataatctatggccaactgtctggtgaagaaatcctgtgacctttcctaacaagatttcagatacacaaaaccttctgtcccaaagttaccgtaatcaattacgggcttcacttcacattttgaatttgaatacttttacatttagccccaaacttgtgatttttgttagtaattccattctctatgatgttactgtgagaacaagtattttcaaacccaacaagaacctcccttctctttggtgtaaagttacgtcttctaaattttatttatttaaatttttttaaatggtagaaatttaaaaggaaaggtttctaaatatgatttatccacttagttatggaattctatatttttcttagatataatttatattaatgtctccccaaatgttgagaaactttagccaaagaggactatgatatttagataatacaaatgttatataatatttcaaatattgttttagcacccaacaactaaaacacacacacacacacacacacacacacacacacacacacacacacacacacacgaatccaaatctctaagagaccatttcagagacgtcaatgcaatttaaagccagttacagtgtttgcattagaaaacaactaatttcatagttttggtctataatggtccagcattcaatttaagaaactcagatcacatgaaaatgtcaccatttgctgtttactggggtgacagtataccagtaggcatgcgtagaaatgcagacacagtgtctacaccattttatgataggtactactttgtcattcagaaaaatgtctcctttcataaaattaaattttgtaatttattttgtggaatgtatgtttctccctatgattttatggtttttgatattgggattgataggaacccatacggcatcaccatagggaagggccacttcaaagtcattgtctcaccagtgcctggcatacagctaacacttcagaagtatttgttgagtgaatgaaacataccacatttgtcaggacatatatgcagcagaagcatagaatacaattgagataaatgaacgcatagcaatggctataattggataattattattattattattttggtctgatttactttttattttatttatttttttatactttatgttttagggtacatgtgcacaaagcgcaggtttgttacatatgtatacatgtgccgtgttggtgtgctgcacccagtaactcgtcatttaacattaggtatatctcctaatgctatccctcccccctacccccaccccacaacaggccctcgtgtgtgatgttccccttcctgtgtccatgtgttctccttgttcaattcccacctatgagtgagaacgtgcggtgtttggttttttgtcctggtgatagtttgctgagaatgatggtttccagcttcatccatgtccctacaaaggacattaactcatcattttttatggctgcattgtattccatggtgtatatgtgccacattttcttaacccagtctatcattgttggacatttgggttggttccaagtctttgctattgtgaatagtgccgcaagaaacatatgtgtgcgtgtgtctttacagaagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctctatcacctgttgtttcctgactttttaatgatcgcctttctaactggtgtgagatggtatctcattgtggttttgatttgcatttctctgatggccagtgatgatgagcattttttcacgtgtcttttggctgcataaatgtcttcttttgagaagtgtctgttcatatccttcacccactttatgatggggttgtttgtttttttcttgcaaatttgtctgagttcattgtagattctggatattagccctttgtcagatgagtagattgcaaaaattttctcccattctgtaggttgcctgttcactctgatggtggtttcttttgctgtgcagaagctctttagtttaattagatcccatttgtcaattttggcttttgttgccattgcttttggtgtttcagacatgaagtcctcgcacatgcctatgtcctgaatggtattgcctaggtttacttctagggtttttatggttttaggtctaaagtttaagtctttaatccatcttgaattaatttttgtgtaaggtgtaaggaagggatccagtttcagctttctacttatggctagccagttttcccagcaccctttattaaacagggaatcctttccccatttcttgtttttgtcaggtttgtcaaagatcagatagttgtggatatgtggcattatttctgagggctctgttctgttccattcatctatatctctgttttggtaccagtaccatgctgttttggttactgtagccttgtagtatagtttgaagtcaggtagcatgatgcctccagctttgttcttttgttttaggattgacttagcaatgcgggctcttttttggttccacatgaactttaaagtagttttttccaattctgtgaagaaagtcattggtagcttgatggggatggcattgaatctataaatgaccttgggcagtatggccattttcatgatattgattcttcctacccatgagcatggaatgttcttccatttgtttgtatcctcttttatttcattgagcagtggtttgtagttctctttgaagaggtccaataattggataattattaatgtatttaacaactacctgcatgacactctgtgtctattgagtactatttaatcttcacaacaaacccatgtggtaggtacactacattatccattcattaatacactaaattatccagtaatcgataatacactaatattatccattcattcattttacagatgaggaatcggaaacaaaaataaaaagcttgcatagctttgaagagtggggctgggattaggagaagatctgctaactgtttagcccatctgcctgcctactatttgcctgcacttacaaggctgaatttggctgaagaaaaatacgcagacacattggtcctactttaaattcacagtcaataacctcagggggccccttggtacatttcttttttaaaatccattttcacttaactggatcatatttcttaccttacttcccttcaaacctcttatgtctcctctcccatttctactctcagctatatccttacttctatttgtctgagaaagtagaaataataagaaataaatgttcacatactccacaactgcttttataagtctatctgcagatctatccatttactcctctttttatttttttactgaacttggggataaactcctagtgctgtaatctaagttcaagacctcatcaaatttagcattagaccatctctcctactcagggaaatcaatccaataattttcttctcttctgcatcatcctactgtgttatcccacatcctcctgtattatccttaacagtatttaaatatgctctaatatttagaacatcttaaataattaccccatgttaaaaaagaatcccctcttggttatgcatttctctctagctattgaattaattgtctgttactggcaaaactctttgaaagagaaattgcaactatccttctcccattctctcttggaccctttctaaacaggtgtttgtccccagtaacaaactgttcttgtcacggtcacccatgacctgcaagtgatcaaactcaagattctgttttcagtccttatcctacccgtatagtatttggcattcaaattttcataataaatttgtattttttactacaaagtggtaaagttagcatcgaaatactttaaacctaccatttacccaaccagtaccctttatgcgatcatctttttatagtgacgatatatttgggtttctaattgagagtattaatacgttaactattccatgtgatttgatgttcagccaaacactaatagtactcagttggtattcgggtaccattagaaggcaatgcttggtgtttccttacttgggaagaatattcctttcatcacatgtatttgtgtttggacagagtggcttgtctctataaaacagaagaagatgaatggtctttctgagaattagtctttgtatttaaatataatagatttgtgattaagcaacggctgcttttcagactccttaattactatcatagcaaataatcattggcaaactaaaatattagtttgcttaatgataaatatcactcaagtttaagcattatgtagaaagaaatagtcataaactttggaagggccgtttatcatagttcattttctctatgtggaacgttttcatggatagatttgttccttatttttacacctaagggtttcaagtattgataatatgttctacctcttctttacctacctattacacagacatgattaaggtaatgtttctacatttgtgtttttagtttttctatgttaattttttgtcaaaatgacaaacagcttttaaggtataagcaaatggcaaagagctggcaattagagtagatgaacaaatttatagacatgataatattatctcttccattgagattttccggggtaacatgtaactacttggctcaacaacgagacatgaatgcagtgtcttttctcaggaaactcttcaatgatggatgggtatttacttgtttgttttcttcagaatccaacaattctctttcttttgaaaaagcctttaaaatagtgcgattctcattgcttaatgtctttttattacaccacatgcctcattttatctctttgaatttctgtaaataattcctgcttatccttggatacaacatgccctttaaatatttgttcatggcttttttattcctcttaccatttggccaacttacaattgtttaaccctattaatctttctgcataagtaaatgccaccagcaccttaatcatttctgtggcttagattgttcaataattacctcatccttattccagcaaatgagatgactgctgttttcatgaagagaatttcatgctgaggccaaacttggggtagagaagactgaatgcatttgctgtcttgcttctctctggggtgggatctgatctgaatacagggataaggatattgtacaaatctatgctaggtagaagcagtcttcttggtttcatacctgatgaattaaaggaaagtgtagggaaagtaaccagacatcttcactgcatctgctcagatgagaagtgttgcataccacatctcatacttctcccaacaacagggtgttgttggtattattttcatttcatggatgagaggaagtgaaggaatttttccaggaactcatagtggtcaggggtagtatttgaacacaagtctgacaaatatggggtacagttttagaattaactcaatgaatccttaatcataataaaagtcagcattatactctagtgtcttcctggatgtacccatagaacaggctagaatgtcaaccacaagattccctctgttcattcctataatttattattattattatactttaagttccggggtacatgtgcagaatgtgcagttttgttacataggtatacatgtgccatggtggtttgctgcactcatcaacctgtcatctacattaggtattcctcctaatgctatccctcccctagctccccacctcccaacaggccccagcgtgtgatgtccccctccccatgtccatgtgttctcattgtccaactcccacttatgagtgagaacacgcgatgtttggttttctattcttgtgttagtttgctgagaatgatggtttccagcttcatccatgtccctgcaaaggacatgaactcatccttttttatgtctgcatagtatcccatggcgtatatgtgccacattttctttatccaatctatcattgatggacatttgggtaggttccaagtctttgctgttgtgaatagtgctgcaataaacatacatgtgcgtgtgtctttatagtagaataatttataatcctctgagagaacatgatgcagaaactgctgggacagtaatgttacaaatgatggccaccctgcagaaaagagccttctccagatctgcctccactcctttctgttcaatgcatgggacaatagttttaaaagttatacaggacagcagagttcagacacgtctgttccatcatctcttagactttccttttggagtaagccactaaagagggtgaagcaagattgaagttttcctacaagatttcaagtatttcatgtttgaccaacttttgttttctgcatcccaatgcctttgcattttggaaaattgtaaaagttgcaaaagtttgctaaagtttcaagaatatggcactcatgagcaaaggtttcctgttcccatgctactgctgctgaactgacacattttttatcattagaaatgcccttagtgtccaaacactcccataaatgttatcatttttactttctgcatggttgtatagtcaagtgaaactgagatgcatattacactgttaagtactttttgcaactttctatactaacaaatcaggctaacctaaaggtaaaggtacaatgtttgtgtctttgtgagttttgcttttgccctatggtagtagttataatgaattctccagcagaatctccccaggaacattcgtttacaagctaagtctttctatttgttcactttttaaaaaaggaaacagcactttgcaatatccattttttagcaataactggtgtcatcataattgactagcctcacactgctattccttctcttttttaaattttctgcaacattctcattggcatctccagagataggcctgttgattttttttttcttaaaacctgaatataagaaaataccccaaatttcacctgcattttgtctcacacatttccatcagtattatttaccactatccttactagagcccaaaggtccacaaaaaactgccactcttcatggtgtggtcggtgctggtaaagccctggaggtagacacactgggccttgtgctcccacaaactggctggaaaacttgggcaggtctgttaacacgcagagacctctatgcaatgaacccattgaacaagacaatttgatagatgcctctcagctttcagttcttcttttgcacgctgtgtagagtccctcatgaattagatcttagaacattgagacagtagtgtattcctttgccagaggaattatatgttacattagaaggccacctacattgtggttttaatttgtaggatggatacttaaggtatccatgacttcaacactatgcaatctatgcctgtaacaaaattgcacctgtactccgtacactcatacaaacaagcaaacaaacacaaaaggccctctggagaacaggactgtcctctagatgctgacagtctatgttcagtgcctgtctccctgtctctgccttaccccctttctttagggttggcttagactccatgcttcctgttagctgctcattaaatgcagcctgaaaatagttggttaatcatctttgtatattctatagattctgtatatttgtggcacacagccctccctccttccctatagtcaccctgctctatatttaggcatataaaagctacaattctcctgtattcacagatttgaatatagagacaggaaaaaaaaagcctacccaagtctccactaaaagtctgtttaatgcctcccagtatttatagaactcgattcttccagacacttttatttgttttatcttaacaagtctcattattttcttctagggttcgaatctgtacagaattatttttaaaaattacagcttgtgtacataacagcagtcacactaggtgcaaagttaaaacccatttaaagagaataaagcttcaatgaggaaatatggaaataatgacaagcctaggaaaagaggtctaactaacatgaatgaccacacacacacacacacacacaccacaattagagtctccacaactctgatctgtaacttaaatgaatgtcaaattgcctcacaggaatttcagatcttcagtctgaagttctggtagataatattgaacatattcctcagcaacagcatgcatgcttctaaatagccactagaattcattggaaaagagcaatatacaaacaaacaaaaaaccccagaaaactggcaagctgatctagatggcaacattggatgaactagaaaactgagaccactggatactaaccagtttgagataacagtatcagctggctttctttggaagagagagagaagcactaaataagtgaggttctcaattttaataagttgcattattcaaacatagaactaaagctattagatttttattaaaagtgcctcctttgaaagaaggctagactaatgtgtttctgattagcagtcagccagtgaaatttcagattctcaaaaccatgacaggattttgagcaggaaagacatcccttgataaaactctcagtaaatagtaattttgcaagtgaagaaaataattataagtcaagagaattgctttatggcttcaggaagttagttattctgcacttactggcgcttgcatttaaggtgatttcatttagattgtattacacacagatggtttgattaaacatatgagttaatagtggcttggtatcaatattggctgcatcactattggctgcaagcatcttgtttcatgaggaaaaatggggtgggctgtaaactgcatatattggcatggtatttaaagttccaattaagaaactatataacacacacaaatattgggtatttgtctcttgggtttgttgttaagaaacgtatgagcctctttcatttaaatacctctggacactgtaaagaaccttagatagacacaagaaaagccaagaagcttaaaaaaagaaagagaaagagcataaggacagaaaataataatataataaaaaaaagggagcgataaacctctaaaatgtaggtgccagaattcttgggatgggggaccttgcctactcttgtatatattctcatctcagagtggctctaagtatatggtcctctttaagcactttttgttttgaataatctaagaatgttgctaaattgataaaactgagatattcctatggtttcaagtaaaaataaagcaaccaatatcttagctcatcaaacttcatcattatctgcattgaacttcacaaaaactttgatgtggtgatggtatcacaagtatatgaatatgtccaaactcatcaaaatgaattgcatttttgtatgttaattatgtctcagtaaagcttaaaaaaccctttaaagtagataatattctctttatttttcaaacgaaagaatggaaactgacagatgttaagtaatttttcctgggtcatataatctatggtagtagtagtacttttctatttcttctgcacaaactcctcgcgtatctgtttgtttgattagttgggttttttgggttgtttatttgtttgttttttgagacagagtcttgctctgtcccccaggctggagtgcagtggtgcgatctcggctcactgcaacctccacttctggggttcaagtaattctcccacctcagcctcctgtgcagctggggttacaggtgcacaccataacctctagctgatttttgtatttttagtacagacagagtttcaccatgttgtccaggctggtcttgaactcctgacctcaggtgacccacccgccccggcctcccaaagtactgggattgcaggcatgagccaccgcatcccatctgaattccccattttgatatgactccctcttcacttggggtctctttgataacaaataagaaaaatggacagagggctagttgcaagaaatcagatttggaagtcactacttgggaagtgggagggagacatcaagaattatggctttagttcatcttctcccatccctttctcgcaaatgttgctatttcaataataggaattccaccatattttttttttcagaaagactttctttatattttcttgtttcataaaatttgaaacaccataaaatccaggagacaacctaacagaataaatgttcttcccaacctgtgggaaaaattataatcctctttctgtccattcctagcttttatttctcctctaaaaggcatttcttttattttgatgagaaaatcctttcagtatttctcaagcaagactaaagttgaagatacacaaaattcctagagtagagcacttgggcagatttattaaataacctatatattgaagatgatatggaggtcatttaattctatttcataaatatagcagtttttacattcaaaatgctctttcactttcaaaataaatattattgagatataacatgcacattaaaagaagtccacaaatcatacacaacttaattaatttttacagagtgaataaatacacttgtgtgaagaccatgcggatcaagaatagagcactacccggcccccaagaaacgctcctcatgtgcttttccaatcaatgaaaactaaaagcagccactctcttgacttctaacacaatatattagtcttgcctacttgaaaaaactatatatcaatgatgttatgcagcatgtactttattgtgtctggcttcttttacctaatattgtatttgcaggttcattcatgttatctctgctagtagttcataaaatctgtagtgaagtccccctttttttgagattgacgacttgtaccttttctcttttatctcatgcagtttcgtttgggtgtattaaattttatttagtctttttcaaagaagtgacttttggcttagctgatttttcctattgtaatttttttgtattaaaatttcttcttaattttattatttgtttttaattcctttaggttaaatttgcgttcttttaactttgtgcaagtataaattgtaagcttgttgattttaagccattgaagaatttaaacattcatggaaaatggtaaatttacctgtagtcatggctttagctacactaaaaagtagctctctgttatattttaattttcacttagtaaaatattttcttattctgtgatttctttcacttaggattatttagaagtgcttgtttaatttcaaaatatttaacaattgtctggttatctttttataacaaaaaattactaaatttctagactaaatctaccataatcagagaacaaataaaatagcaaattgaaaacaaaatgtatgttttattttgtagccaggtgcaatattctctgtatgacaattacattaagtctactgattttgtagttcaaatttttattttttaatttactttcttttctccatttttatcagttactgaagcaaactgcattaaatatctcccattatgattgtgaatttttctatatttcctccagacctgtcagtttttgccttcattctttataggctaatataacattattatatcttactggtagatatatccttatatcagaatatattgcttttcactttcatgtttactttttatttgctatagtataataacaccagctttctttggtctttatcataatgtcccacatgtttttactcccttttttagattttatacattttttatgttctttgctttagggtggctattttcaattaaaacattttaaaattatttattcttctcttgctattgaactcatccattgaatttacctttccagtattatatttttttccagttttaaaacttccatttgattaattcagttctttggttatatctccatcatttacttgattttcttaaatatattaattatagttattttaaaatctgtgtctgttaactcctatatgtatttatttttttaattgttccctttggtatctttggcaatttcagtagttttaattgagtgttggacattttagaaagaaaactatagaagctatgattttatcgtctttgaggaggattttttttctttttattacagttggggcagaagattccagtttactgtagtatgaaatatatttgaaattggctttcacatgtatgtgtgtgctagcttgtctatttctagtttgatttttggctaacgtatagtttataggggctccaactgaaaacctggatgtttaccaaggctactctttattggcaagccttgaactctaatttttgtctccttagcattgtggattgccaaaagctttgctctgattctcagctttttgccttcctccacttttgaagcagcaaattcttgagagaaagagtaatgtacaacacagtgctcatctccatatgttttcctttcttccaaaatgttggccccttaactcctggttgccttggaagctctccagtgccatcaaccaattttctttcttttctcttcttgtttttaaaaatatctagctttcacatatggtaggagtgttggtcttatgcttgatagttggttataactagaagtgaaaattttaagtcataattcttagagaaactggctattaggaaatattatttccattttgggtccctacttcttaaatatagaaagactatcaaatatcttgacaaaaatagagaggatgtttttcttatataaagctcatgaccaagtcttcagcaccaaatttgtatgtaaattctttgaattttttggaagaaaaatattgactagctttttatttgatttgatctttcagaacattacccactgagtaaatccatattccactctaagttttaataaaatctgtgacagagatgggtatttctgtcaatactcatttctggggatatgtgtgtgtgtgtgtgtgtgtgtgtgtgtgtgtgtgtgtgttgtatgtttcatgcctttatacaggttgagtatctcttgtgtgaaatgcttaggaccaaaagtgtttcagatttcagatttttaaaatatttttgaatatttgcactattcttactgtttgaagatccctcatctaaaaatagaaaactcaaggtgccatggctcatgcctgtaatcccaatattttgggaggctgaggcaggtggatcacttgaggtcaggagttcaataccagcctggccaacatgatgaaaacttgtctctactaaaaatacaaacattagctggacgtggtggcacacacctgtggtcccaagctactaaggaggctgagatgggaggatcacttgaacccgggaggcagagtttgcagtaagccgagactgcaccactgcactccagcctgggcaacagagtaagactctgtctccaaaaaataaaaaataaaataaattaaaaatcctaaaggcttcaatgaacatttactttgagcataaccattgaacatcatgtcagtgttcaagaagtttcagattttggagcattttttatttcagatttttaaattaggaatgctcaacctatgctactaatactactagtatttttgttgtaaaaattgggttattctttcactttccaagtttatttcctggcagcaacaaagttgtagattatcaaaccaccttccagaatgttaaaaacctatgagcttacctgaaaaagtctctaataaagatttgtgtgggatctaattatgacttagctcttaaagttcacaagagaggttggaaacagcatatctcttactccaggctgctataactctgggcaacaggtgtattcttactcataagcaccctgcaaagactggagtagccctgacaagaaatctgagtattcttctctgaagcctgtggttcattgtgatgctgctgccagctttggccacaccccaaatagacctctatttgcagagctcttccacattagacctgtgtgcttttgaataagtgactcggctgctctaatcttaatatccttatttctcaactaagtttataattctatctattctgcttaactcacaagtaaaacttgaatgagataatgcatgtgagagcatttgtgagttgtcacactctaggcacatatggtgagcggggcaaacccaggacctaggtaaatctttccacatgtctatggatcagaacccttttcttctcctgtacacataataatatatatcctagcataccatgtttctaatttcatttccaggaataatgatataaatcagtttggaaatgtgaattgggagaaaaagatagaagttatttgttacttacttccatctttcttatccttatttgtctctagtatattttcttatgtcttgcctagaagcagtttcaatgattatcagttcagtcatcttattttatagataaagttaccccaaaacatagataaggcccaaaactgtgaaatcccctattatggtctcatggtgagtcattgtcagagcctgatgagaaataactctcctaattggttttattgattactgttgatgcagcattgcatcattgtagataaagcacacacacagatatacatgtctgcctgcgtgcgtgtaggtacacatatgccctccaaaaaattgcttatctgaggctgtaggaaaggatctattatatttttcaactcttccttcatccctaagtgacaggaaagaagggatttcctttccactcagattccccgctgttaaaagcattaatgttttctttttggagccttttgctgcctctcattatgtttttctccattgcggagttggagtcacactatgagaaaatctgaatattagaacacaaagtctgcggatatgacccataggcttgctgaggagtgatctaatagccagggagtgatggtaggtgagaggtgaaatgtacagagtggggggcatagaagagggagctatggagttcaggcaaacgcaatgcaaaagccacagcaccttagtgtgagtgccatcatctgaaactgtccttggtggtatgggaagcgttgatttggggcaagaaaaaggcaagatatttatttgatactgacttgatgatatgaacacaaaatgagaaaaatattcaggcactgctattgccccaccttaatagtaaaaagaaagggaagggaggtttctgctagctagcaaactttgcaaatgggtatgaatacccttggagaaccaagcagtacatgggtatgagaacccataggtatatctttgtgcagtatcaattttaattatggttaagtaatttaaaatacttgatatcaaaccaaacaggtatttagtagattataattgttaggatattcaagtagaatacaagattccaaagaaattcctgattaccagatgctttgagactccatccctcaggctcaccaggaaacgtgaccatttactttcctctaccattgaaagtacttacgtaaaaaaaatacgtgagaatcactggagcatttttgttatagaatatttctaggcactccatataactctcacaaatctctcctttcatttttgtctctaaatagcaaacaacagatgttccctttttaacttcctaatgcaaagtatagaaagttgattcattgcaaattgatgcattcttttcttacgttttacctttttaaagttacttctctcgggcaggtatgtttgcacttcagtgacccttctgatgagagtaatcatctttcacttggtttttaaaggtcttaagattttgagtgattctttacttagtgtgagacaacatgttacattcatgtctagaataagaacaagtatttttattgtgcaaaattaactttgaatgaatgaacagaagtaggaagtaactggaggaatggagatgaaatacataaagtatttctttatgctttgcctggatttatatactgaaattgacatccttactttatacttataaaggactaaaggcatttgtaagaaaattacattatcaaacttcagaaactgttgaaaatccaatgatttctttaaaaatgttacttaatataccttgtaaaatgatctttcccaaacagtcattaggaatttaatgacttaggtaagatctctgaagcatatacccacattaacatgacaagaaaaggatgtacacttagacctttatttaaggaagtccagagatggatattaatattaacagaatttcaaaagttgaattactgaggatatattcagcaaataatttaagagttccagatttaatgatttgaaacatgtctccatattggatgaactaatattctttatgtgattcttaaatgagggcaaaaaatgttttcatctattttattttgttgtctaaggttacagtagaattaatattttttttctttttccatgctatgcttctcgatgcaaatgcaaattgtgctggaaaggcaaagttgaaggtgactaataaagagcaacaatatctttgtcagtttcaattactgacaccattgctactaagtagatttctcctcaccttccctcctttttttctttaatcttacagtaaaggaaaatcttattatatgtcccaaaccatgataggaagctagagaagctcagtttcacatctaatgctcactctacattagttaccaatgaaatctgtcagtgggtatatgttaagcaatataacatgctataaagagcctcttggcagaaatagtaggttaaaatgggagcggaaatttctttgtcaacttcgcagctgtagcgctgggtgtggggcaggactttgtgtttctgagactgcttctttgtacttaggacaaggataagtctcagtcagttgccctgactgggggagttcattggactaatagataattcctgagatgctatctactgctaatattttatgtctatggcctatacaggtggtgtttcttcaattagaagcaccagcaagctaaataaagtatcatgacaataatcacacaaaggtgaatttaaagctttaccttttctctcacctaaccattttcatttttctatcttctcttccatatttgtatatttgtaagttattttaatcataatgtagatacaatccaatcttagcaggagttgttaaatctcaaatgagttaaggtatatgaaatcacctttaaaactctaaagggctattccaaatgcaaaagaagcctgatattattgtcactctttcttaaatatctttccatatctctgcaagataaaaagtgtgaaaaaaaaaaaagccaggaaaggttgggttgagctgttgtgtttagtgaaagcactttcactaacacagaggacctgccttatgatgcctctgggagtcaaagaaaacacagaccctccccatgagatgctaagaatcttgtcaggtgtattggtttctcactgctgtaacaataagtcattacaaacttaatggcttgaaagaacataaactgattatcttatagttctgtgggctaaaattctgacgtggatctcgccaggctaaaattgacttgtcagtagggctctgatcctttttggaagctgtagaaaagaatccatttctttgccttcttccatttctagaggccatctacattccttatcacgtggcactttccttgaacttcaaggtcaacaatgttgcatttttctgataattacttaatagtcacctctgccttccactctccttttaaggaccctgttattacactggacacacccaaataatccaggataatctcaccatgccacagtccctaacttaatcttgtatgcaaaggcccttttgccatgtcatgtaacacagtcacacacttcaggtataagaatgtaggtgctttcagggagccattgttctctccaccacagcaaagcaatcacatggacacataatcacaatacatcatggttaatgccatagcagcacttggctgcagaatattgtgatggtacaacccaggctgacttcatgcagctcaaggtgcaggagcaggaaaaacctgccagaggcaatcatggacagagaggtgatgacagggtgaataggaactagccatttgaaaagatgcagagactggctttcaatagcaggcagcccacgcagagaacaagcctctattaaaatcctaccatcctgcctcccacattactctcacaattaagtccttgtcactgtccagcctctgagaaaggatctggcatctactgcagggtcatgggtatggcatcttaactgcatgcatcatacccaacatccagtgaccagagtgatagttcacctgtctacgtatgatcttgccactgcctgctttaatctactgacctcaaatattcttaggatgcaattcattttttgtataattaacagacctcccaagatttggacacttggccatcttttccatcctcattccgtggtgatgctactttcttatctaaaataacatttgagattcatacagcatcctgtgctgttatttggccagatatggttatgtccacctttcagagaaattcaagaggctatgacttacattaaaccacatagctaattggcaactgaaccccactgttttcccagcacactatggggagaccagcctactgtcaaatgttagattttgttcctggagattttaggatgaatatgggacaaactacctccttgttttctgcaaattcattttccctttagccatataacactgggtttggggtattttggggacgtggtagtgagtcataacaagcttaattccttttacttcacatgttcaatggcccatgtaattacaaggcccagggatttcctctctgctgttaaaagaattatcaagttaagaatgttttgatcttaattagcttttactaggcctttctgatgcccaaataatatatgtggctaaatggtaaacaataaggatgaggcctatttttttgcttgtttctaaaacacttttcaaagaatgtacagtgggaacctacatggaaatcttcataacaaaaattttttaggtaatataaggcacttttccttaggggaaaattaagagtttagataagggacacatttttaaataatcaaaaaaaattgaaaagatgcttcttttgcatctttggattgtgttgtgttcaattccctattattttattttccttgctatgcaaactctagacatcttgaaaattagctattggtaatcttatcagttctcctgtaagtctgccaagtaattggatagcttttcttgttttttgctatgtcacatcttcgtacctctaacatgcacactctcattctctgtatttatttatagagctctcacctctcaacttctttctctatttctgatattctccatctgaagcatgtatcagaagttctctctgtgattggtggaataaattaaaactgtgtgattatttactactacattcagcagcttggatcaaaaacctagatttacaactttctaactgtgtgaacattgttaaatttctgattgggttaagtttctaattttatatgtatatttatatatgtgtgtgtatacatatgtatatttgtatatgtatgtatgtatatatatagaaatacatatatagatttgtgtatttacataaataaaattagtgcattaataatagatttgcatggttttcaaaggatgatgtcaattaatgtttataaaattcttagtagtgtgtttgacacagtgaataatggctaaatgatggctgtcattcttattactgttgttattacaaccagcatggtgactgcatatgggaagatacagagcagactatgaggaccagaaagagaaggatgcattcttgtattactactaggcattaggttgctttttgcaaggtggtggctataaagtattctgggatggcactatctgaacgctgagagcaaagggcccatctccagagggcacatctggaattgggttatattcctcacaactggagacagggaaggccaatgtgatgtgagggcccaggcatttggagcaaggtaactagactacaggggctattatagaagaagaggtacaaagcaaagggtagtgggtctcctcacacaaaatactcacctctctgtattatggttgccagtttcacaaaagatgtgaattatgaattcaaacttaatttcctgtaaaaggtacagtgaaaataaatagcaaaagaagaaaaagttttaacctcggcttagcctgtactaagggccagataacagttctgaaaccaccatccactggatcttggtgatcctaccttgatggggtagacattattccccttgtcttcttatcaataagaaaaaaaaaaggctcttgaaaggtaaggcaccttatccaactcagggagctggtgagagggtaactggctccacctttgcccctacttcaagttctttcctcctccacccccaatcccgtcttatccggagtcagtgctgcagatgtctgagcaaggcaggcagaagtacatgtggctctgggcctggacatcttgctgtgtgtggcatcaccaaggtaatgcgcagctacaggaccccttgacctgtctgcttccatgaacgtacagaagcgtaaattctgctccttgactgggaaacattttgttcccacatggaggttgtgtgagagtagagcattgtggatacaccccatattgttgtaacctattttctgctgttcttgccgagatctgaggatttttatttaaagttctgcctttctgggatgaccttaggagctatagatttcattttcctggagggacttagaggaacagaggtccccaaatggttctccctggcacactgcagagcaaagcagacagaaaggtttttacaagtcctgggcagtcagcgttagtccgttttccaagaacaatgtgttttttttttcaggtaagacaggaaatgcttttcacttattaaacttagaggtgtgctacaggtgtggactgcttaagaaagaaagaaagtcatgagacaaaagcacccaaacctcctcagcaaggctctgaaatatgcagaaaagcagttgttcctatctagtactgaagccctcgcataagttaaaaattatatcagaactgaactattacactttttagtctaaaggagctatgtcttttgttttgttttgttttgtttttgcttttgtattgtttaaaggaactgaattttagaactcagcaaagatggtttggtacaatatcataattagggaacacaaagactggttcttgacaggagagattagaaactatttcataaatggggatatttaagctaagccttgatatagggcagtgttttgacaggtgtagagtcataggaaatcatttgaataaagatgaatatgataaaaatgcatgagcataggctaagtagcactgcaaagcactctcagagcctgaaacatgtagaggttggaatcaactctctctcattaaccagacaatactaagcagatgatgcacgttctcagatgcagattttcttcatgtattgcatggggtaggtttcagatggaaataatgtatgttagaagtttctgggttaaaaagtacatcgtgaagttcccttgctctttcttttatctgacaaaacatcagcttgacgttttgcttgatgagtggtttgcagtctatttcccaatgtggagatggatggatttcttcagacgtgggtttataaatatgtctggttattttttttcatttatttatatttcacatgagtaaaatcagggccataaaatagctctacaattccattaaacttaaaaatctagaaaacatatcatagtacttaaatgttgagacagaaagtgaatatcaaattcctttcttcaaatactttagtgaatgagaaaaggcaaaaactatcctgggagccgggtgctacaactcagatttttctcatagttagctacatagtcctctgaagtgaaggcggttttgtctctaaatcggtgaacgtggcagttgaactttattttttttaaatggcaattcctctattagtctgctggggctaccttaacaaagtatcacagacttggtggcttcaataacagaaatgtgtttctcacagttctgaaagctgcaaggtcaagatcaaggcactggcatgcttgatttctcctgaggcctctctccttggcttgtagatgctgtcttcgccctgggtctacctgtggtcttttacctgtagttgtctgaggtcctaatctcctcttccataaggataccagacctattggactaaggcccaacctaatgacctcattttaacttaattatgtctttaagggctctgtctgcaaatgtagttcattctggttaagacttcaacatatgagttttagggggacacaattcatttaataatactccctttgatgctttcacaccattagacacaagtaagaagaactatatctttgaagaagtgttttgttgtgctctatatcagaaggtaatcttgaagacatgtggtcctttacagttgtctgcctttgagttgatcagggagatgctcatttatttaactgcatgaacacatttcagaaaaatgttgacagggatttaaagctttgctattgtctactaatgatcttgttatatatcctccatcataaggcaacagagtaagcttgattaaaaattatttaaattaaccccctgtggaaatgtcagtaggaatcatattgaattacctaaagtcacataattttttaaaaagcctcccaattcttgagcacaagctttaaattttacacacacacacacattcatgtatatatttatgtgtatgtatatgcacacagaaaatgctaccattctccacagaaaagcttaacatttcagaattagaaatttagaaatacagtccagtactttttcaggttaaaattttaacatttattttaccaatcatctattgagtgaagaataggttaccgctaccagcagttcccagtgttctctaaaatgtgactccgatgggtcacttcttgagaaaaagctgagaaaatatgtttactatttctctgatgttcagtgtgcagacttttagcttgagtttcatgcgtgcccagagctgcctgcagactgccatcagcctcacctactgttatccccaaagcctccaaacccatctgtcttcaaaaaatactttggacttcctcccaggaggacatctccttacctgaaaaaggtacttcattccatcatccacatcttggccatctctgactcaatttcatctcactttctctccaaagctttccactaaccacctggattaaaatgaccagatgttaacaatttgtatctatagcaagcatttttattgttaattttttgatacataaagattgtgcatatttctggggcatgtgatatttagatacataactacaatgtgtaatgatcaaatcagggtaactaggatatccattgcctcaaacatttatcatttctttgtgtggggaacattccaaatctttcttcctactattttgaaatgtacaataaattattgctaactatagtcaccctaatgtgctatcaaatactggaccttattccttctatttaactgtatttttgtgcccattaaacaacctttcttcattatttacccctactccttcccagcccctgcaaaccaccattctgctatctccgtgagatcaactattttagctcccacaagaatatgagatatctgtctttctgtgccttatttcacttaacataaggtcctccagttccatccatgttgctgcaaatgaagggatttcactcatttgtatggctgaataatatttcattgtatattatataaattccattatatatgtgcatgtgtgtatgtgtgtgtgtgtgtatatatatatatatatacacacatatatatgaaatatatttacatcacattttctttgtccattcatccattgatggacattgacccccatattctggcaattgtgaagagtgatacaacaaacatgagagcacagacttttttttcatatacccagcagtgggattgctggatcatatgatagttcccttttttattttttgagaaacctccatactgttttccatagtggctgtactaatttactttcccaccaaaaagcatatgagggttcccctttctctgcatcctccccggcatatgttattttcctcattttgattatagccatgtcaactggggtgagatagtatctcattgtggctttgatttgcatttttctggtgattagtgatgctgaacattttaaaaatataactgttggctatttgtatgtcttctttcaagaatgtctattcagatctttgtccatttttaaatggggtttgttattttgttgttgttgaattgttcaagtttcttatatattctggttattaatcccttgttagatagatagttggcaaatattttctcattctgtaggttgtgtctccattctgttggtggcttcctctgctgtgcaaaagtttgtcagcttgatataatcccatttatctatatttgcttttcttgcttacacttttgaggtcttaaccccaaaattcttgctcagaccaatgtcctgagaaattctttaatgatttcttctggtagttttaaagtttcaggtcttacgtattacatttaaatctttaatacattttcagttgattttttaatatagtgagagatggggatctatggttttgcatatggatatccagtcttcctagcactgcttattaaagaaagtgtccttttccccaagtgttttcttggtgcctttgtcaaaaatgagtttgtgaacaaaaatgtgtggattcatttctgggctctctattctgttccattggtctatgtgtctgtttttatgccagtatcatgcagtgttagttactatggctttgtagtatattttgaagtcaggcagtgtgatgcctctagcttgttcttcatagcaagcatttttatagttacttctaaaggatgatcatcttccttggccagtgacatcatataaattactataaagtgttttttgatgctgagctgttttccatataatccaacctgatggccacataaagctgtaaatgttttaaggaagaaaataccttaaacttcctagtagatttggatcttaacactgtcttttcatagagctgaaattaaaggaggagtttttgtttggttttcacaaacatgtcctgaagcattaacctgaaattttaaaactggtttgaaatattaggttttctatcccctgcaaagctgtactataaaattaaaggaaaccaaaaacaggcatgggaatatgatagttaggtggtgttcctgagtgtggtattttaaagttttgactttcagtttcctcatggcattcacttgaaacctggttcattgagggctagctgcaaaccttccagatcttgtccttctttgcagctccaggtttctctggcctatggttctccaggaccctgcagttttttttttttttttcagaggcctgtgccacatcagttacacacacaaaaaaaggcttttgggtaaagggaaacttcatgtactgagcaagaagcatgaatgtaaaaatatagaacccctagggataaggaattcagtggctacctatgccattcgaaaggagtgtgccaaaatgtgcgctgagtagtgcctttcccagcattttctttttttagaaattaaaagtatggctctgatgccaaagctacaaaccataaatccaattaaagtgaaggacttaaatgtacatttgggagagtcgggggaaagtggaaagaggatctgtttctgaatcacctcgcctctttctcttcctccctcccaccctccaccctgaaaacatgtccacacagtgggattgcttgttaaattaggacactatgactatgtaactatatttgtgaaatagagtcaaattaaaattgaaagaaaacaactgaaatgcaaaaaatatgaaaagaaagttgaatccatgctctagtgcaaatgttcttccagctcaaactacctctaaaatagccctggactgcgtgcaactccacatctcacagtttgctttatgaagtatcaaaacattctcaaacttttgactgcaataggtttccatgtttttaaacttttgctctaataagcaaggtctgtctgttttcttttaacaattttataagaaactgtttccttttctcctctccattccttcactcatgtccacccttcctcacttactaattattcatagtcaagcccctaagaagaaaggggcagcgtttgccatactttactctgtgtgtgtgtgtgtgtgtgtgtgtatgtatgtgtctgtgtgtgtgtttggtcaagattaggcagggagacagggatcctaaactagtgctttttaaatgataatacatttccaccgtttaaataaggtatgctttttttctcaagatttttttcaaagcagcaattcccttcccagttcctgtagcaaatgaccatccaactgcttgaacactttcagcgacagggaatgcattactttgtgggagagttgattcttacacaggatagctaggagtattggacatttcattgtccttttggatgtatttattcatatattaatgatgtatttattgagcacctactatatgacaggctctgttctaggcacctggaatctagcagtgaccaaagggacagcaaccactgcccttatttatgttccatcttggtgtcactctacttatttgtcctaattctgtcttctgaggcaaaactaaatcattccattccctgtttttgtgacagccccacaaattgttgaaaatgacatgtcatcatcttcagattaaacattttcttacacggttttccccaggcccaccctgtctgtcactctcctctcatctgtcagtgccccttcactgtgtgtttgtatcaggggtggtctgagaacactgggatgtccacctagagcacagctgagtggtacctgggcagcgtgagaggccagatcacagaggctttcacattcacgccatcatttcctttttgtgttgctcttgcacacatcatatagtgactctctgcctccatttccttgtctttttttttttttttttttttttttttttttttttttgagatggagtcttactctgttgcccaggctggagtgcagtggtgcgatctgggctcactgcaacctccgcctcccaggttcaattgattctcctgcttcagcctccagagtagctgggattacaggcacatgccaccacacccggctaatttttgcatttatagtagagatggagtttcaccatgtaggccaagctggtgttgaactcctgacctcaggtgatccgccagcctctgcctcccaaagtgctgggattacaggtgtgagccaccatacctggcctcattttcttatctttaaagtgaggataataatgctacctagctcaaaaagtcgctatgcatattaaatgagttagtatttttaaaaagagcacttagagtcgtttctggcccaaagtgtatgctcaggaaatgatagctattattcttactattgttatcattagcgctggatattacctttctgtttatacagcctcattgttttaggactcacatcatgctattggtttaatgatgatgtggacaattgacagcaatctgctgtggttgtaaattcctctcagctcctaacaaaacgcttggaacaaagtagattcacaataaatgcctcctaaaggagcaagttaaatatcttggcatttgaaaacatgcttaaacaaaacatagaaaggatttctcctcctgttttccaatgtaaaatgttgtatttctgtggctgtgttgcagaattctagagatagatgtgtctgtaagattgattaagggtgatgttatgaattgcctttctaaaattttaagccttaataaataaaaatggtcaagaggcatcacttcctggtgataaaataaggagaaactttgggttttagagatgcatataactggttgcaactgaattcaagagcaaatgctacagtatccttcatgaaattttcacactgatttccaggagtattcttttctttctttctgtacataacatctggtttaaatgtttttcctgtctggttaaaagtgtagatgtctacttggattcataggtatcgtatctctgaatgccgcctcttttcttctccttcccttgctgtttgggagattctgtagagaggattattaataaaaaaaaaattttatcactcccatctcctcccagaagcagctagaagacaaatgtctggaaaagaaactcagaagggaacagagctcagatgtttgcacctttctttaaatggaagtagctttaaagtgtttatcactatcatttccaactatctacccattagatggaggtctctaaatagttctagatatgaacagacaagatgagtgatattcttgctccaaaatgttacttcttaaatatatgagcctcaactctggaggatgaatagatcagtccttgccatgtgcagttattttcttaaattcacccactgcttatttttttaacataaaacatttaaagaattgcttcctggctctaaagcaaatgtataaaaaaaaaaaacagaaaatatatttttttcagacaaagttcccagtttactgctctactatttatctgaagaaatagataaaactgcacatctggtgtaattcttgttttcatggttaatgcaatatcctgatgcaatataactttccctgaaaggcttttgattctgaattttgttacataaaaatgcatttttttttcgacagatgtctttggttctttaacatctactttttgtcatgctaattctgtatttcagacaatgtaatggcagctgaagaacaaattaatacggtctgctataggtttaactggctgtggaaaattctgtgaatgaatcaagcagcagtttttcttcagattctttaaatttagggaatcctatttctagtttccgaaaggagaagtgaatcattcttcgtagtgttttagctgaatatgttaaatctgtgtattaaatttaacataatactgtatctacagttaaaaaaagaatagtatttagataacaattaaactgaattatctcatatttccctctttagatgacaatagcatttaagaacttacataaaatcctctttgcttcataatctgggacatatgtactctctcagctggcagtgtagtccttactaatgtttatgttaatagaaggatacataaaagttcctgaaagtaccataagtgtcttttagtgtttggtgtcattgacatattaacaaggagtctgaagatgagtaacacacccacatctgtcagtgccacagccggcacttgagcgacacaccagcacctcagacagagcatacagcttctttgctggtgcgcttgtgttctgggaaggagcaaatgaaatcattcacaaatcaggaattcctggcacaatatagaatcaggaaagctttttctagatgtgattgtaatgatggattgacttggatcccaaatgttatcaccaaaagatacatgcttttctttcttttcttacttaaatatgcacaagaattttgctgattgtattttgcaattacataattgatatttaggatttaatttggaaaatatgtaattacaacttaaaaataataaattagtaggccaaagcacacgatgttttatcatacaattattcatctttgtatgtgatgaataaataaggtgggacaatagatttgatattttggccattttattgtccatttctggattgtgtgggccatgagagctccaatgtgtttctaatatgttagaactttgcaatgagaaaatttcattagaaaatagtgttggaaagagtgcttttctgagttccaaagatttccttccttctgtagtttatatacactggatattcaaaaagctagtgagagttcaaccctgggctaggaatcccaagatactcctgttaagtctgttccttggagataagggtcaagtattaagcaggattcttacagtctcccttccctttaatgatctcttcaaacattttcccctagaaaaagtctttgcccatagtcattctcttaatatactttacctagaggaaatgttttagctacagtagttaaaaagcttaaaattatttgtgtttccgtttcaaaacccacatttatctttagctcaagcatgcttttctccaactcttaaatacaatataaaaaattcattttgcctcaaaaaccatttatagatatatagccactttaaaaacaaaacagaaagtgaattcggttcaataaatactatttgagcatctgttctgtggcaagcaccgtggtaggttattttgagtaatatgcaaattatcaagggatttatcatttatttgcagagcagaaagacatgcaaacccgctaatttaacacatggctgattgatataaagccatattatagtttctttcctctcctcaataaacagcaaactctttgagggcaagagctgtttgggtttttcatttgtttatttttgttgttgttagtttgtttttgagatggagttttgctcttgttgcccgggctagagtgcaatggtgcgctcagctcaccacaatctctgcctcccgggttcaagcgattctcatgcctcagcctccagaatagctgggattacaagcgtgtgccaccatgcccggctaattttgtatttttagtagagatggggtttctccatgttggtcaggctggtctcgaactcctgaactcaggtgatctgcccacctcagcctcccaaagtgctgggattacaggcgtgagccactgtgcctggcctgtttgttgttaatgccagatgctatctctagtgcctgcagacataggattctgataggcagagaagtggtggagagctattctagcctgtgggagaagtgttaaaatttaacacacataatagtacattggaatgggaccgtgagttgggtaatcactctgaagtaactggaaccaggttcctagagggaaggggttctcgaggtagcattgggtcaatccataaaggaaattcaatgtaatcttaagggataaacaaagatagcaaattttcccatgcctttaattttatctatcattttccttagtgtccctatcccacctttattttctcagtcctttggaaaagttcctggacacagtttatttttgtggttggattatatgataatatatatctttaagcaaattattcaaatactattttctgctactgggagtgccaaaatctaattagatctgccacatttttttctgcaaaaatgtacattacaaaagttgtttttaccctataaaaatgtgtgattttttccatagctaatagaagagaacttacgtttaagaacctatactgataaccaattagtactgagatttatgtgtatataaacatagttcgtatgatgtatatacattaatgtatttgctacagaaaaacatatgtcatagtgtacatttttccatttaaatcataatttaaaataagtacaccatttgattggttatcctgattcttctttcgccagtcttcccattgcatgaaaaccatttatgacggtgtttaatttaattgaactcatttctaagagaatgagtgttttaattaaaaatgttgtgtatttttcccctgaatctgaaggcagtcggactgatttgcatttctttcagttctgagtgttgagggtaatatattatgaaacatctttttttcttgatatgtatgcacattagttttcattatttctattttaatatcacagatcattgttagcacagagttttgtgcaaggagtatcttcaaaacgtttttagtaaaattatcaggcacactaaatagaaaataaaagacaaaactggaggaaaaggggaattaagacaggcaaagaagagattctaagtttttatattttcttaagcagagtaggtattctgaacacgaatgtttcagaagagaataaagaactaataattttatgagttaaaaagtattttgcatttttgcatggctagctaaaatataggtgtaggactttagatatttatttttcaattattcattgggaatctgtattgtaagactttgggatacatcagtatttaaaacaaaaatacttgttcttgtaggccttgtatttaacgtttactagaaaaatatcatgcaagccttcttattctatcagtttattgaaaaaaatgagcatttttttacatattacatgtatttttacatattacattaatacatgtttgtcttacacatgtaatatttccacacttttatatctgaaggtatgtgcatttaggatgaagtttcattttttatcctagtaactatatttcagattgtctttacattttcaaactcttttggctaatttcatgttagatttcaatagatcatcatttgtttttgttactagtttctatacttgtttttaaccacaaaatccatgtaaaagaaaaatctcatctttgttatttgttttgtgtttattttagcttattttattcgtatcacctctaatccttattctctctatgggatttttccccctaaactattctaactttaggtaaactagataatataacttataaatctacttaaccaggaacacataaattgctacacattcacctatgataccataaaattaccataaaattgtccaaaggaagaatttgatgtcatctgaagtttcaggaaagtgctcttgaggaaatggacgtgttgatagaaccagagtggggaggaggaaaaggaggcagctctgcaaaggtgtgtgcatgtgggtgcatgcctacacagatgtgcaaaggggcattttaatgcaggtggccatatttgagacagataaggttaagggaacaggatagatgtgggaaattatggaatatttataggtaacccacagtgacccaggtgaggctacttgcaggggatggataagggctatagtgagcagagccatcagataagatagggccttactgcggtaaggtgcatacgtaactcagtggatggtgaagagtcactgcatatttccagacatgaaggatttgaaaaggaaaactgcaggtgggaagaccacctaagagaggtaatgaggggctggcagtgaaaatagaaaaaaagaaaaagagcgagagatgcggaagatgcatcaaaaggaattgagcaacccatttgttttaaacttatagtactgaactagcaattttggtaaggttttaatggggcagagatgtattggaaatgtggccaatggaaaagtgagatggatctgagaagaggtttttcaagatctttgatcctttctaacctttgcgttactgctttgtaatcacaaattcagctctggctagcaggatttgggtttagacacagtggcagttaatcttcaaaatacaagttggttttggttttttaaacagatttgatttgcattttatttttagtgttgaagacattttagttcaattattccgcttgtacaggctgcattaggtagcagttaagtgggcagggtccagagctgagtgatcagattccagctgttaacttactggttatgtaccctttgtcatattattactacttaattgctctgtgtctcgatttcttcatcctccaagtgggcttctattaagtaaggtaatggtgaggatccaagagttaataatagaatgtgcttctaataatgcctggcacctgagaagaatagaatcaatggcgttatgatttctaaaaaggaaaaacgtcaaacaatatgtaaccagatgaatcaaaatcaatttggttgtattttctcgaagttaaaggagaaaaacataattttacattttatttgtgctccctcacccaaaatgaggcataatcccaaatctctctgtataagcatgagggcgcgtgtgagtgggtgggtaggtggcttctcactgcctcgcctgatctagttaattcaactccagaagacagagtagctcaaataggagactgcttaggaataagtgatgtcagaacataaaagttttacagaaaaattgtaaatcactaatattctcattttttttcttgacaagagaataataaaaaattctctttttcatgtttttaactctttttgcttttattcgcttcttttccatgctacatattttcagtgaagagcataaataaaatacagcaaaactaaggaagaagtctttagtacttagcccagtcaggtcttccaggtgatgggcagacttaggcacaatagtattttttttccactagtgcatatcttagaattatgtgatttgggaagttatatactacagaataaggaacatatgtaacgcaatgcaataatcacttagatatttatttttaaaatcctactcttttaaaagctttcatattctaatacagctagtcacactgatgttgtgatgatctgctgttcgtgcattattttccaaaaggatttttccaatattataccatctatgaagcaagtctaggtacaatggagtcacgtctcaaatgatcagttttaaatgatgtgcatagaaatagatactgaaattctttgtaatttcttcaggactaataaagagcttaaggatagctctcaaaaaaatttttttgtcttcacctatttgcaagaccacaatttttctattgattataaggtgctaggtttcattactcagtaacgtccgactgtttcgacagcggattgcattagcatggcccattcagctgttgtggagagatgccagttgccatggtgaagattatgatgtcccacatccaatctatccctgagatggggatggcttttgcaaaaccacatgcaaatatttgttttcaaaggtacaactgactctttgtgaagcactggattactagagtggatgtcttttcaatgaatcatcaaatgaggatctattaccacatgatttccctttttgtttaaataaacttccactgccctctatctcaatgcccgttgacaaagaatcagatttcatattgtataacttgactgtcctttttagttatacaagttaatgagtttagcagtttaatttgtctaatttctctatttgattgcctcagagctgacctcatatgcgtgggtttgctgtgtttcccctgagctcacaagtagagttttccgttttcctgtgaatatgtctaagcagcacagatacttccatggaagtaacaatgacccttcacacatccaggggttttctccaaattggggcttttcctaagaatatgtatcatatgttagtatgaatgtttttaaaatataggtattttttgttttgtttgtttttaattttgggaatacttgtcaacttaagtaaaaggagaactccattaaaaaaccttttaataaaatttctgagagtcaccagtttgcaaaattcttgtcctgccatcatgaatgataatattgtttataataattcgtttatagtttaaactaataattaaactgacagcttaattagtttaatagttttaattaataatttaaatatgcatataccagttttataaaacagcctgtttctgtggcttactactgcatttcctttaccttctataaatagaatactgcaggtttgataaaacacagaagaatctgagagacaaaataaaatatgctacttgtataaaatgtcctcttctgaaaaaagaaagagaaacagaaaagataaaggaaactatggtgacacattgtgaggcttatgataactatgtttgcctttcagatccccagctcaagggtatagtgaccaggttatattgcaggcaaggctactacttgcaaatgcaccccgatggagctctcgatggaaccaaggatgacagcactaattctagtaagtgacaacctcaggccaccagttacatagttggtagaagatacactgctacttaaatgactttttaagattcatttgcaaatgtttggtcgtgttggttcatctttacaaatgttacacactaggatgccatttacaattttatttaaactacgtggatgaaaatattaatggagtaaccaaagaaacctatggtttaaagatgattatgttactatttttgttttttattcagacagttatcatacccagaaaattactgttacttttaatcttattattgtaaaagttaagtaagtacactagtgtatttaggtaaaaattaattacatgttttctttggatgtattattttatcaggctctgaggttcttaacgatgcctgtggaaactcaaaagctacaaggaatagttttgttttgtttttttacataatagaaatataatttaaaattctttgcatttaacaaaaaaaactttcttatagaaaaaaacataaaggttgtgtactttgaaattcattgtgcaaagtgtttgcagaattgcatctgtgatcatttttaattaaaaagctacacatcttccactgtataaatgtctgtgttctttttcctatttctttatgtataacatttctccgtctggtgcctctccttactcaactgtctgtgttttgctctcccattttctgtttatattggcatctgattcatttttaatttagcatattagttccaaaataagcacactttttactgtttgggggagttagtgaaaagcaaaactatttttattagaaatacttaatcataagaaacattatcggtggatcaaaaatagatatgaattttttcattaatgtatgtcttattcttcacatataaacatcattccatgaaaagaagtgagggtttgaataatacacataatcaaatcagaaggcacttccttttttatttttattttatttatttttatcagctcaatttaaaattcagcacttccttttttaaattccagtgatcaaattgccagtaacactgattctggcagtagttagcgatacaaaataggttatttttacatgtcgttttgccatgtgaaatatcattatttttccagccatcgtgttcactttttgtattttgtgcattgcttcactttttattttttcttcaattcctttttaattgttgtgtatatctacattgtcctccgtgtcaatttctaatctctttactctctttgtgtctcatatcactcttttttatttttaaatttttcctttttatgtttgtttattggtttatttttagtttatttcctttttgatataggaaaagagaaggtaaaacaattcagctacagaagaaagaggaggcgttttatgccaaacatgtacttttgcagcttttgttattagtttgaactttcaaagattattggtagttgacaatctttgaccaacaaaagatgtcagtttcttatggttcaggctaatacatgtatctctgctcagtttcttttccccttaaactctttacccatttgttgacaaaaaccatttcctttctcttacgtgttactgttgtgtaggtcacaaagtttagcgattcataatttctgatgtcttcagtgttctctcattttgtttggcctgggaggattagaacgtaataactagtttcccataactctgatcactaggtgagctatgacactctgaaagattcatcaggctaaagactgatgccatccattttatgacaaaagttttcaagacaggacatacaccatagcttcataaatatattgctttattggactacgtgaaaaataatttcactcaaacaaaggttttatgtgttttttctctagcattttttctttgtgtaatttttgcagagccaacaaaattggttacctttaatgataggaatcaatattattttgagaagtgtctattagacattgccttttaaaagcatactgcttcagaattgaataagcactttctaaatatggaagtgcagatttattatgtgcacacatacaggtctggttatctgaataattttaaagactaaactggaaagctgagatactaaaaaacactccaccttctgttctgtaaatatatgttttttttttttcttctgtatctgcagtagaaggagcaaaaactcagaacgaatcttgaaatttcttctgacactctaaatgctagtgagacacagtcctgagaagaaagatgaaacaggatcccctttgtaaaagcaaatcagaagaaaatcataatgcccacactcgaggggctcaaattcctgtgcaaagttctggtccacagcttttctgagacattatattgcatttcaagtgcactgtaagccagttagtttagttttgttactatttcaacatttgcaaagaaataaagaaaaacagtgggtaaaatcaatattccctcctcaaaaggttctacaaattatatgactataaaatttaatacaattggcagaatcgtagcagatttataaaagtaatggaaattactaattaacttcatttttatgtcctctggcctatgcaaattgcaaaacggtgtttcttaggatgaatttaaagacattttcttttctctagttcatttcaatagtctcatgaatcttatgaaaaatgtaagcactgaaaaattctttaaaaataggaatgtgctttagaaaggctgtcaggtcctacttagagtacagctcttttgttgtgaggacagaggtgatgtaataatcatatagtttcctagttatgaataaccaacccatggtttgtattcagggagttataaaaaatggaaacatgtttatgaataatcattcataaacatactgaacataaacattatgagggatgctttaagagtcgactgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatctttcacaaaaggaagtgagcacctaggtaacctcattaccactctcatttaaagttcttctaaatgtcagcatccccatgaactacggtactttattagtgggtgagttttctttccccccactttgcttttggggatgccatggattttttctgtgctcttaaacttcattgttcctactgacagacaatagctactacaagcagaataggactctacagatatcaatacactattaactatggtaatgttaaaacctcaaaagtccctctcaccttagaaatgctcaacctggtaacttgatgtgtaaaatatttcgatcactcagtggccaccaccccacaggatttaggacggcagttctcaccgtccttagttgtatattagggttatttgaggagcttttcaaaaaaattccttatgtcctaaacccgttcccaaagattgtgatttaataggtatggggttgagcctggccattctatgttatgaacacagctagttttaacgtgcggccagagttgaaaatcactgttatatgaagaactagaatgttccatgaatgaacaaagtcacaaaaacatctccattattcttactcccctaggctttgtgacattgccttataattatgtaagaagcaaagagagtggagaaataaaattatatctcaattaatgtgggtatctgtgtttttaactagtaccggttccatcatggccagctctgaatggttctccacattttagtgtacataagcattcactttccactatcattctgtaaattataataccttgttttatgtatgtatgtatgtatgtatgtatgtatttatttatttatttatttatttttgagatggagtttcgctcattgcccaggctaaagtgcagtggcgtgatctaggctcactgcaaccttcacctcccaggttcaagcaattctcctgcctcagcctcctgagtagctgggattacaggcatgccccaccacgcctggctaattttgtatttttagtagagacgaggtttcaccatgttggtcaggctggtctcgaactcctgacctcaggtgatccacccgcctcggcttcccgaagtgctgggataacaccacgcccggccaataccttgtattttataattcaggtcccaaccaaaacacaagggaaaaacactagtattttttcagtatgatcattttaaactatcttatataatttttatgtttcccataaccacatcattttggtgaattcatgatctatttgttttctaaaattatactacctggcctatataaaatatgtggcacctacaaatatcattctgagtgtgtgaaagttagaagaggaaagttagaataattaaatttgaattgattaagttagtgtaccttgcgtggacagtcatatgattatggttttccctccaaaattttgtgtataaatcaggaattattctatggtgcccattctttcaagatgtaaggggagatggtacagttcaggtgttctaaacaagagtgaatatagccatctcccaccaagaaggaatactgagagtcgccaaatggcacaggtagctgtactcaacaactccacatctatatttaatattaaataatggaaatgaggaaaaaaaactaattctttcataagaataacataatcccctaaaatcctatagcagaaaatctgatattagtttacgtagtgaaactaatatccaactaaccatagatgcccctgagtatttttccagggataatattcatggctctggcctgaggttttccttttatatttgtgtagcacagacatcttgggatcttgaaaacagtagcttgtaataatcagaagagagggtgtaattttcttcaacctattaggaggaaacatgtccctgagaattaaatataacacaatttgtaaagtttgtttttaattatgtactacttagacccttggaatgaagtccaaattgcccacatttttcaaatgacttggttttgtgcaatacagttgagagcctgagtttggatactgtacttacacttacatcactattttagtgctttcatttcctgttctgtcctgcttagaattagacttagttaagaaggacttgagtagcagcagataacctcactgtaaataattaatagttctcttacaaatgtatctataataaaatctccaaaatcatcaagcagttatctctaagactgatgcaagaaaacctactaaacattcaacatgcagcactgccatggaaatacattaaagggatgttaagtttttttaatgttataacgttgctatctgcactatgcaaaaatatataaaatgcttttaacattttatcaacagagaagaaacaaaacatggaaacataaatgagtagcctctctgacatttgcatgccattcagttttgattagttctttctaaatttagctccttggcaggtgcacatcttttcctggcttcgctggcgtatcatattggttctaccaccgtcatttagttttggaatcacctgtttaacttctggcctgacctcattgcaatgacaaatcacaccttctgtgcgaagggtcagaataaacactcgacttggacttttaaaattctgctctttgagagacttcacagttgatttcttttggtatctaatggtgtcagagacagtgtttctagaggcacgattacaggcttggttctgtttattgtcgcatcagcccttcagaatgctgtcagcaagactgctcacatttaaaggttgaagctgaagtactcattttacccatagcagaaacttcttacttataaagcaaaatataagttatttaattggaatttctagaaagtattggcaaagatgatgtttcttaaataaaataaatcagaaagaaaaaattacactctgccctgcttcttcctgcccattcatgatagacaatgtttatcttcacagcactcttcaacctcataccagtgggactacgtgttgttgccatccagggagtgaaaacagggttgtatatagccatgaatggagaaggttacctctacccatcagtaagtaagacgccaaagatctcggccattcgttcaatgcatgtaaaataacaatggcagcaacaacaaaaagaaagttctatgtctgttgtttctgccagtttttgccttagtatttgatctttgcgagaatgcttagaagctgtttattattcaccagtgtttagtaatatgagtttatctaaaggaagtgtaatactatgtcttaaatagtgcttttgccatattttaaaaaataacctagtatacacgtgaatctaatcttttgtatttctagttagaaatgcacttatcttagagagtttcttataatgtttttaaaagaaacaatatgaattctaaaaaaagagaaaagtaaaaggagagtattttctaaagtaagaattcaaattgtgtggatattttactgaaaaaataactacttataatattgaaatgtgtatttcttgcaagcctctgtgttttgtggtaatatttattggaagctgagcacttttctagccatatgacctcttctgaaatattttctatttacaaccgatttgcactcagatatgctgtattcatgcatataatgtagttagaatttatttctgccacaggtttaagcagtaaagacttaaaggtgcttttttctattatcccttgagcaaaaattgataaagtcttaaatgcattaaaatatgctcttacatgtcatcctcatgtaaattcgttgaaactctgtcattgttaaatatcaccaccaacaaaactatagataaatatacacatattgtgtgtgtgcgcgtgtgtgtgtgtgtgtgtgtgtgtgtgtgtgtgtgtgtgtgtgtgtgtcttaaacagaaacattctccagggggcctcccagaaaatgtaatctattttcttcagtcaatttgggaaatcctgtcacagggaaatgaagtctgcgctgtggattcccttcatgctgagctcaaaagtgctggctcttcttattctgagttccctgaagggtgttcccacacagagaactgggtcccacattatgcaaattgtgttctctcgcacaagacgaatatgcagcatgttgccagcaggatcaagctagaattccctatgctccctttagaaaaaattaaatacgaaaaggattactttctagagatgctttattttcagatacagctcaatctttttgatttggaacttgctctgttatttttgtttctttatcttcttcccaagtaatattttaggggcctaaacatcattagatgcagtgtctactgtagcttctagttctatctttctgttagtaattgtatcacattgctgtactctgatacatatgttgatgacagggaaattgaaatatttgttttatctttgtgctgctgagagagttgctttttatttatttattttttgtcatgtggttgtaaatgtatgccattcttttttaaaggtagggtatatcattttgagtatgtgtcttagcctaaaataaaagtattgattatgcttggtgcaggctaagcagtaggaatagaaacaagaaatgtgttaactgccaagtccagtcccctgcattttaaatatggtttccgcatgcagaaatcagatctcatgagggtcactgcgtgcaatagcatttgcccagggtgagtcccgggaacaatttaaggcttgttactgggtacgttgttctctcctctcccttcttccttctgattctccagttgcttggcttccaggcctcccctttggtggctttattctctgacttacagatgttggtgttctcctcttcccatccttgactctttgttctgaacccaaagtctggtaagagacacagttcactcagcccctaccctaagggatctcctgtgcctaggccaggccactgtatgtcttagccatctttggaaagaggacttggataaaaaccaaaagcgattatgaatctatatcagtacctcctaattaaactgctctgtttatttcaatgtaaaaaaatttgaacttcaaatatttcagtacaaataattatctgcaagtatttattccataatttgttactgagagcctactaaaatagtaatatagagcacaatatagcaattattatcctataaaataatagctatatctatacaataacaatagtgatgatatttgtacaatccactctgtctagcactgttctaagcactttacctgtattagctcatttaattatcccaataaccttttataagcaaatattattaaaataaggacactgatatacagagagtttaagaatctgcccaaagtcactcaggtggtagatagaaaagataagattggagcatagttagtatgactcattagcttacatttttaactgttttattatcactgcttttatgtgccagacattttttcataatatggtctgacaccttttctaacaagaagttataaacacattatgatgtaatgaaaaacttttagggaattgttacctaggaaataaactgtatttcagtgcaattattgagaagtataatttcaaacataatctgtttcctttaaagatttttgagttaaaattaaaataatagaaaatttgtcaagaaaaagtttgatattatattatgggtattaattttttttatatttattacatttaacatttaagctttaagttttaaaagccatgacaaacgttgttaacccaactaagaagttttgaactaagatgagtaaatttttgaaaaaatgacagctccagtcaagctcagatttaaagaaagaagttaatggagatttaaatcagacaaatgaagtcatccattctaagtttatcctaattttttaaaaagttaatttaatttttgtgcagtgtaaactagagtctaatatgaaattgatttttttgaagatccataggtttagaagtagtcaataaaatactcaggtcatctaatttgaattctggtaaacgaatatcacaacggtgatttgacttgaggtgtatcttcctctatttttatttcaggaagtaactttcatactcctttgctatccaaataagatacttaatgtgtcagataattccaccttctggagacagataaaaggtacttgactgagatgtaagttcccatttccaatgctaaaggcacctgttctctgggggatcttttcttcaatatgatgatagttatttcttttgtggtcctaatgattgcaatatggtacttgatattgtgctacaagagatttaatgtcggatacaagccatttgattgaaggtacagtgtgggctacaaggacgcagaatagaaactgtcagagtaataattctgccaaaaaattagacagtttaaaatgatgtttatgaacaaaaatgtactttaaccacttatcactatttctagtgctgagagaagcagtcaagttttttgtttgcttgtttgttttccaagcctgtgactttgaaagactaagaaaatcttccgtagaaagctaaggtttggaatgtaaattgtaaacaataaggaaaaactggtaatgaaaggaaaatgtcattcatcatcagggcagggataaaggatagttgaagtgagaatgtgtttctggcataagaaagatggagaagaaaaagaaggacgtaaaagagactgatgatacaatgagtaaatctctgggctttattcagaacacctgggtcctggatctgacaaccaatacctgtgttaaaacttcctaatctctcctagtctgccccctcatctgtcagattacatgatttctcttgaatccttcaagttaattatggggtttacaattctggttttagtatgattgatttttctgaatgataaggtaatcttacataaaatgcatagagattccttattggtattttatcacaggctggcatttatgagaatattattttcctcctggtgccatcagtgcttccatgttctaggtgcaggcatcttcgcggtcgtaagtgccagtgttctcctgaaattagcatctcatctgaatctgttaaccagattgtataagtggagagaaatataatcctttttcatgttgattttaaaaataaaccaggaaaattcaaggttaccatgttttgcaaatattagggctcacgcgaatcacctggaaagccaagaaaagtacagattccttggatcaccatctagatattttagttcagtgggtctaatgggaggcccgagaatcaacagtttgtaagggtcaccctccctcacttctgccggttattctaaagttactatttcaactgtggacaatcacacaacaagcattgctgcaatggtatctgggggagacggtgataacgttagaccaaggtgatggtaacagagttggtgaaaatcagtaaatggactactcaggcattgaaactaaatatttggattttctaactgttctaccactaagctgaagtttacagaagtttgaaagcagaccagcatacttcttcacttaagcaacaactcagaacttctggaatagggactggtcatctctgtgggctggcatcacctctcctacctatccatacaggataaatatgtatatatgaaagttctttaatcaaggaaagaaagataaatgctatgtattcctcagtaagcattttcaagatcatcaaagtcttatccactctacataagatagtgttctgatatcatatctttcaggagcattttcaaatgagcctcttctacaaaggtggtttcacctgccctcctctgtgccagcaggcttctcttattgatgtgtcctgagttgtgtttccgtctgtccttagctttccaagagcacccaggcataaaagcatccgagcaacccacctcatgcttccatgaactgttcatcttcttgcaggatctataattctagcaaaacaaggtggaacaatgttattttcctcttgaaatttattcctctcttcgttgctcaagtttagggtatagaaatacaactgctctgttttatcagtatggtacctatcatccttcagagtctttctaatcttccctaagagtaacacacccaaagacatacatgtccctcacctgtaagtacacactcatggagtattgcgtgaattcattgcccatccctagcacctgtcctgtctctgagtaacacctttacatgccgattctcataaaaatgttcactatttactcagacattggcagggcttcctattcctcctcccccaggttttatgtttatttgttttgttgttgtttgctaccaggcagtgcatgtgcttaatcaaataaactgagctctagtggccatcactggccatcaacatccattgcaggcagaccaagggccttggcagcatttgagggttgctcatcctggggaagagcctttcattctccctgggagcactaaggcaaagctataccaagttcatctagttacacacaggtgcccctttaagaatggaaattattttattctttatcttttattcttcatctctctgaacaggttggtttctttatcataaaaagtatattaaacttgagatgattattaatgtctccaattattataacaatctatgacactatgcatgtttttctgcacaaacaatatctaacactttttggggatatatatacacatagacacacatatataattctcatatgtatgtgtatgtttcattggaattatgcattctcctcaaattatatatacatttatcccacgattatgagtgtttctgtttatattaataaaatgttaaataacagttttacatttgcacatactttaaagctttacttgtcatgctttaacaatatttctttttttaatcaagcttttctgtgacttctttcacattagagttcagttggatatatctgccaggttgaaatggctattatcctttcttggtatcttggccaagataatttatagtattaataaagcaagtatgatacttcagctaattttccccctaatgctaatttcaacatccagcattcgtgtaattcccatgacattgaatattgatgcacagaatgtaattggttatgtccaagaatgccattatctacttagggtcactaactggaaaggaaaagaatttgagaaacaaatacagctagtaaactgcatttaactagttataaatcatcttttggacaacagaaattatggaatatccaatttttttatttgttaggttgaagctagataacagaaataaattactttgatactatccagattccagtgacattttatggaatataaagagagacattggagtggatagtgaaaaagatactgagagcctaagaaaaagaagaggaaaaaaaataaatataaaggaaagaagataatagaacagcagtagtcagatgctttggcagcattgtggaaagaaaagagaaaagaagagaaaggagagaggatgggaggatgaaaaaggaaggaaatgaagaaaacccatcacaagaagagaaagggagaccttgttttctgcctactccaccatgttcctggaatccacctgactcctgattctaactttctacgtggtgtagaaaaacaaaaccatccctcttaaagctcagcccagtttcctaccataccaaaattaccttatctgctctagccccttggacacattcacctatttccccttcccaaaagtcctcttctagagtgatggctgtgtttgcttcatgtgaatttcaggcaaaacaaagaacaaacaaacaagaaaaccgctatgatcatagttaacttccagaggatttcactggtgacagtgagaatgagtggaaagggatgtcagcagtgtctaaaatctaccgcagttatccgaatgaggatactgaaaacttgaattaagaaagaaagctaaataaggcttgaaaactacgaaacatttgtcattgcgttttcttggcttgtttttggataatgtgcgtgtgtgtatgtgtgctgtgggggcaggggttctgtgtgatctgaatgcctttaggtgaggcatgcactccactactgtggccacatggtaaccactccttaattttagaaaggaagacacaacacacacaggctccctttgtttctgtacatatgttgactttgtttatgtgccttgcagacactagtgtctgcaacttctgaattaaaggggtggaaaaaatcagagatatttaaaagtgttttctgaggaactgtggaaagaacttcatggttgtctgggtatggagacagcagagtcacagctcatctggtaagactggcttagaactaggtaagctgtgatgcttttcactaagaaaataaagcccagaagcaggacagggtgggtggatggagtaagatgctgcatttggttagggacctgcttagtttgcccacaggacatccaagtggattatagtcatggaatgactattggatgatgatgaagctcattgatcctagaaggatcacatctcagggctgtcttgggaaagctgtgcagatagaatcaattctgtgacagatggtaattgtttttctattcttcctgcatgtgagacaaagatgaatatgctgggtcagtgacatcagcataaagttagatattacaaagaagtttattaaataacatgaggtcttgagaaatctttctcacatattttgattcataagtatatagaatctacatgctcaattttggatactggataatagagcagaatactagctgaattaaattcaaaacttgtgtttctacaaaattgatgctaataatatatgaagggaatatcagggcttcagatcctctcatagtggttcacaaacatcaatatttataagacttattgaaatgattttgaaaatgacctgatctcagatattaacaaaacagaatccaagactccaattaagtggtttcaacatgcctcaagaatcataattttgagggctaggcacagtggctcatgcctataatcccagtgctttgggaggctgagatggggagataacttgagcccaggagttccaggctgcagtgagttgcgatcacaccactgcactccagcctgggcaacagagtgagactccatttctaaaaaacaaaaaaggaatcataattttgaatatatatcccaggcatgtctagtgctggtgaccaaggtctaaactactttcccacaaatcagacttttcaactgcctgcttttatatctaccattgattattgtcattactattattataatttataaattcctagttcagggcttgaactaggagtaagcagaatgacatgaccatacatagagctcaccttttccattaaccagatgagttggcctttggggagtgcatagagaaaacttctggttgtggtcactcctcttagtctgtgggaagaaaaggacaagaaatgtctcctcgagcaccaagatggtatagagaaagacaagacttctgctgagacttcagaaaatgaaataagaaatgatagaaacaaagcaagacattaaattttcaaccaataatggctggtttgcaatcttgaaaaagagatgtagtctgcaccacgtaaagctcaaaggagaaatcagcctgagaccatcgacaacagggctggcaggcgcctgctgagttgaagggcatgacaagagcatcctattggagcaggttgtcaatgtcaaccaacctggattgtttcagaggtggttgctttttagattaaaaaaaaacaataaaaatagataaaactgtatttaataaatcgcttcctttccctagccttctgttttctctgaagcttcattttgtctgtatctaagcagagatttccagacaagttccatttctgggttagaggagatgtccttctccttccagaggtgatcagcagttacatcaaggtgctcagtatgagacagaagtggctcgtcctccatgtccagtgtggacagtgggttgttcccatatgggcccatcataacacgtatttcctaactacaaccaaaaccatacgacctacttaacaaatatcaaacacacaaactactaacaaaagggtttgcaagaaatatgtggaaaaccattcaactcaatattcataacttaaatatatgctgaggagtagagctcttggtatcaaagtgtatattaatgaattcatttatttgctctttcagcaaatatttattgtactccttccattgtcagctattgtacaacatgtgcgaagacttcaaagataagttaaaaattgtggtttaaaattgaaaaagaaaaaataacaaaaacctgaaagtccaatagacaacagttaagttaaccattgaaggacattttgactagatgaattctaagagttctatcttttctcagaatctgtgattccatgaaaatatttgtcccatttcctcaagtagtgacagctatgtagggagtttttaatctgtacttcttgattaattattgttaaggtgaaaccaattttcacagtacattttattaatttatttctcgagtggcttcatgttcatgaaatgtactgtgcacatcacttgtcttttttccccactgaaaaaattcagtgtcagcaaagaagatatgtcaatttctcaagttaaaattgcagaaaagtacttatttacacgctgctttgctgaaagagcatgataaatccacagacacagaggcagatgttcaacggctgcattctaatatggccatatttgcattaatgaagtgagtggtaatgtcgtctttaacttaagagagaatctcaggggagaaaaaataaaaccctaatttttagtaaatgttgccaccacttaaacttgaacgttttaaagcaagagcattaataattataattagaaaaagagctttgctatttctacatgttcataaaatgacacaaaatactttggttttatattttctttcagcgtcaaagaagaaagtcataaacatcactgcagtttgcatttttatcctgatttcctctgggggttaaaaactatataaactactgtaaatagtaacaacatttatattgatcaaaatgtttcaaattttggttagctatatttgtgaatggtacatggtaggtggtagatggtgaaaataatttttatatgtaaggagtttcaaagatgatactaaaacatgcaggcctaaaacaatagatgaaacactatttcaaaatgtattctctctttgttttcactctcccatgttacaaaaatggcaacaaattacgtaaatgccaaggaagccaatatatcatatggtaaatgacaaatcaactgtaacattgaaacaacaattaatagctattatagctattaaaatttgaagcaaaattgtgcatctttaaaaattatacacacatgtgagaggactcatgactgaaatctcaatataccatctatccaagttgagttattttcctttttttttttttttaagataattattcttcttcctacttctgggagggacagtgtatgggaggtacctgtcaggcactgtgagaaccctgggctctgaacagatatggggtatttctctcagtatcctcaatgcagctccaataactaatcccatttcttaatcactttggaattaataagaaaaataatttattttagaaattcacaaaaatatgtaaaacaacttttttctttttttccagaggaataactaaaacaattcttattgaaaagccaaactatacatttttcttcacaagttgtatactaaaaattggcaaaataactccctcagtgataactttcattgttttttcttttttatgttgtttgtttctatggattttatatagttttaaagctataagctattgaaacaatagtgtgcatttatttgactgaaaatattggccacatttttatggtaatatgacctgtccaccagaattgatctaacacattctagagcttagagaaaaatagtgatgacaaagatagacgcagatgcagtcttgtgggacctaagagtttctacagatgtgagttccatgcgcactacattttaagtttgacttcactacattatggaaagacatattgtgctctgtgctatttagggtttcactaaatgttggttgttggtgttcagataactcatccagcctggaaggcaatttcattgaaagggtgcacaatgttcttttcagcagaaacatattagatctctgaggggttttgtccagggttagaccttggttttaagatttgaccactccactatattaaataaagagagatgagtcacatgttaataagcatgtcccagcccatacaaaagcaccataattggttgctatttgctgttctaattgaggtagagactgaatgggaataacgtattttttgtgaggcttaggaataactagatttttgttctctgacaaggtggaggtattttatttgggcattcatcctggctcctatctattatttagcagaaatcattatgtgggcaaaaaagaaacatcattctactttactattaagctgacactagtgtctaatggtactaacccaataaattggtgaatattggtttattccatgagaaaagcatctgttgatgttatgaaataaattaactgtgtgtgcccttcatgaggaaaccaatgacaaagagttgatacttaatgactccccgttaatgtaaacatctccaatgaactcatctgcctttccactatggaccttttataatactgtttctattacctataccgtagaccacgtgcaaaagagatgcctgtcacagcaaattattttctatggtgggcaatactgtgttatggttcaaaagtatcggattcctagctgtatttcagacatagctttgaagaaatcaatgtctttcttgcttataggtaatatagaataaaattgtaacatgatgatatattacctttgagagttgtatagttattgtgttataagaaacaactgttttattagaagtcagaagcatagaaggtaaaatgcttacaatgcaaagatgcaaatttatttgcaagtgccttctttgtaatcaaaatgtgctcatattcttacggttgtgttaaatggtaaaataatggtaacaaaattatgcaactctggaagaagtcatagcctcgaccacattattatttaaatattgccatttaacatttcacttcctgttttataatcataaattgttatcaacagaggtaatataatttttgtattaaaattatcagtagtaattattgaataaaattcttcctcttggtatatagtaatagatattgccagtcgaataactctacctcccatttaatggtagccactatgcctaaattctacactatttttcaaaaatatcaattagaaatctatatttctagcaatattaataacagaaatcaacttttaaaccattcaaaagttgtctagacaatttttacctagagaggaagtaagaggcattcttttaatgtccatggagaaataaactctaacttgaaatcttgtattaaaataataaaaattattaagaaattttttccacagatgccataaatggtttagctattttcctaatgtagtttgagtcatttgaaagatggttttacagagttagcaaagccaaatggatactcaggagaagtagcagtgagactttatttaatttaaaattacattgtacaagaaggcttgcacactgaagtggatagacagaagaattgggcaagagttcccctgtgttcttaaaaaaaaaaaaaaaacttgtaggaatttgaatgcagacaaaggtatgattaatttttatgcatcatccatgcaataacaacaacaaccataaaaagaaaaccatgtcagcaatatgcggttgtttaaatgcaaagtatgttaaattacactctggttctctgagccacgaaagccagtctttattttactttatgcttcatggtcagttcttcaagccaattaaaaatccctcagacttttcaaaccatgaactatcaggtccaaaatatgatgcaattttaacttttttataaataataacttcattatgtttctaatagtgattaggaaatactgttgaatatggcacatagcaggacttaatttcaattatcagatattccagccattttctgaacaagaaagagactggcccaggggtctgctgaaacttttcatatctggcaaataattagtgtatactaatttatacagtggtagaatgttaaaatgaacttaaccattctgttcaatgtctaattacattttctattgatgtcagtgttttacctagaagcatttggtactttaaaatagttttgacatttaaaaagtgatatatttcattcttgattatgtgaaatggtgacagtaagaacagcaagttgaagatgaagacacataaagcccaggttgtgcaaaagtaggaaacccaaagcccagagtcactgttaatgtattaagaaattattatcattaatgtcacgtcaaagtgagtttgttaaggataagtctataacctgaagggttgaatgcagaatgcgtgggtgtgataccactagagaaaagtaaaatgagtttcttaaatgtgttgtgtgtgtgtgtgcatttgtgtacaattattatataatcatgaactaataagacaaagtctttcctacacaatgggaagggtacacacataaaatttggtattctgatatgtactcataggtatttttctctttgttatagttaagggattttcctgcacactcatttgtggaggctatgaaaataaaatccatccttagggctattgtgtaagatctataattcacaacttctgatatttttaactcttcaaaggcaaatgacttctggaattcatttcttaggttacagagtaggattgataggtggacaggtatcatgggaggagaaaatgcccagctcaaaagattgaatgagagttggcaataggaccagcacttatttaagcatatgggcctctgagtgaccttgagaattctgaatgactttttacaacatgatgatgacatttgaaatgctttccaagaaatgcataaaacactccattatgtttcgtttaatcttcagatattgtgattacattttgacagaatggtggcaattaattatactaggtcagcaaacatcaccatgtccatcatatacacatgaggaacaagtcagaatttcaacagctctgcagtaagcctggtgtgtttagtgtgagcagcagtattctcctctctctgacagttcttctaataccatagagcaatctcagtgatgaaacatcagtttagtagggaatgaatgagtgttgtttctattctcttatatactttgggatcactcttagaaatcttaggaagactaaaattatgataacagcaataagcatttatatttatgcataaatgcatatacatacttgttataatctcaaataaagaaaagattccatcaaaacacatgattcttctaaattgtacgcacacagtttgagtacctgtaagatatctgcaaatggagttaaatgtaataatttctaatattgtgtttgcctgcgttaggaacatatctcaacagtactgcaatgtagaatagatagtttaaatgagcatttttatctcatcatataatagtgattcagcaaatatgatggttgtgcagagatgtttgagactgaaatcaaaatagagccgtcaatgcatgtaataattttgaggtcacataatgaatttgaaataaaattaatagagaatccttttcttttgatgaggagttaaaatatatataatgaatacttgagtatcagtctgtaattttttttattccccaaagtgattagtagtgagggctataatgtgtgggaatattcaaaatatttatatggccatgcatggtggctcacacctgtaatcccagtgctttgggaggccgaggcaggaggatcatttgaggacaggagcttcagatcagcctcggcaatatagtgagaccctgtctctacaaaaaataaaattttaaaatattatccaggtgtggtagtgtgcacctgtagtcctagctatttgggaggctgaggaggatcataggagcacagcacttggaggtgacaatgagccatgatcatgccactgcaccccagtctgggagacatagcaaggccctgtctctaactaaaaaaattgaaaataaaaataaataaataatacactgaagtatttttgtgcagatttatcagatatgtatattattattgctttcactatgaagagagaatttgttggtaataggttagtgtcaaagttgcttctttcagtgactgtcagtccctttccttgccactcccaaaggggtgatgaggtcagatacttccccatgaaccagaatagacagtggggtgacagaaaggttgtcttggaaatagaataagagaaacaaggtggcgggccaagattgggtatcctacatacctcccatagttattttgatctttttatgtgatcattctacacacactcaggtgatcacaagactgggcaaccatctctctcattgtgtctcttatacacctgcatcaagcaaggtgttcctaagtccttaatattctaaataaatagcactttccaagtatctgcctatttctgtaggattccctcaaggaaattattaatttccttaccatagtcattaattcagcagacattgatttagggtggaatttgcttcaattgctggtatttaaatagtgacctaaatgaaattgttagttttctgtgaatataatcaaggacaccaagttctctggcatttaaaatatttcaattattatccactaagcaagacatctatttgcatatcgtgttgggaaacataggtatctggtatcatgggtccttgtcctgggaaaggtggatcaggtagggaaagaataaggagttttgacatcaagtattcttcttatgtgtcattaggtctgttgtggatctctgagtcctgattttctgtcctgacaaagacatttcctttaagagagtgtcataaaactttaaagaaaggatgtatttaaaagcacttaccccaaaatccacactcaagtgttatgactgtgcagacagccccacatacgcaaatggtgttactgtttcacactgtcttgtcattgacttttgtcagcaagtaacttgggattgtttttttcctccttcaagaaaaggataaaatagtgttatgtataagaaaaaccccatattcttcagtatagaaggttgtttgaaaattctaccattagaaatattgtcatgcttgtgggtaattaggaattatgatatgtattaatgtcttattggaaggattacaatgatatgaataaagttgaagtacatagacccacgttttcttgacgtcagcttttctttgaacactcatgtgtttcggtggctggcatttcagaattgcagtgatattgatagatatggcaaccagcctgtgatgtaattattttagtaaaataaaaacacctcagtagcataagtgtaatttcaaatgttactttatttttgcttctaatcttccactgggaaagtcttttctacgctagcagattatccaaagaaaagcagaatctgttccttgagagccccagccctaggcacggctgacctgactgagcctctgattccaccacctacaagctgtgtgaccataggaggctacttcccttagtggatagtaattgaaatatttgaaatgccagagggcttggtgtccttgattatattcataggcaactaacaatttcatttaggtcactatttaaataccagcaaatgccttggttttctttggttttaaatgatggcttttcaattgtgactattgaatgagttaaaagattaaagtactcagaatgatgccttacacttagcaagggctcttaaaatgttagtagtgatgaagacgacgaggaggaggagagaaaggcgagctaggaaaggggatgagaagaagccagaggcataggttgaagtccctcgcttttgaatcgccttgtttaaacctcccttaaatccattgcagtagaatattacttgataattttatattatttccttgtccagattgtacattgcttaaatgcaagtgactggttgtaggagtttgctaggactgcggtaacaaagtaccgcaaacctggtggcgtaaccaacagaaatggatcatctcagttgtcaaggtcagaagcccgagatcgaggtgtcagcactcttggttccttctgagggctcagggggagaaatctgacccatacttctcccatgctgagtttgctggcaatcttaggcatcccttgactggtagaagcaccatcctgaccttgctgtcatgatcacatggcagatcccacagaactaggtaaatccgcctgtgtgcctgtctctgtctctgtgttcattgtccctctttataaagacaccagacatattggattagggcccactctaatagctcattttaacttaattaaaatgagtgctaagtgtcaagcacggctctgagtactgtcatgtttcaactcactttaaagactctacctctgaacatagttacattcattcatagctactagcagttaggagtttgatgtcttttggggaaacacagttcaatccataatgcgcatcttatttaacttcctatccctcataaatgatatgtaacaccttctgcatctcagagactcaaaaacatgttgaaagaaatgactgaataaatgaaactgttttggttagaaagttgcaagtaaaatatgaagaaaggaaaattattctcatgacttctagcatttcagattgagcaaaaatctattgggcaatagttctggatatagaatatatatacacactctatatatcttctctctatatatatgtattatatgtatattctatatatattctatatatattctattctctatatagaatatatagagaatgtatatatccatttctatatatatagaatatatatgctatatatagaattatataatatataattctagaattctatatatagaatatataattctatatatatagcatatatatatatatatatatatatatatatatatatatatattgcctttagagacagagtctcgccctgtttcccaggctggagtgtagtggcacgatctcagctcactgcaacctccacctcctaggttagaatgattctcctatctcagcctcccgaggagctgggacaacaggcgcctgccactatgcccggctatttttttttttttttttttttttttgtatttttagtagaggcagggtttcaccatgttggccaggctggtctcgaactcctgacctcaagtgatccacccaccttagcctcccaaagtgctgggattataggtgtgagccagcgtgcctggccagaacacttaaatattatatccacttgagttagaatttattttgcttacattgcatttggataatggattatttgacccttcctcttcttcctgccttcctctccctctctcatatttgcttcttataaatctcatactttttttctttattaaggaaccacatttataaaaaattctaacttgtgtgtttaatttggaatggcctacagatctcagagctttggtggtagccttgtcccacatcttcctttcatgatggtggatatcccagaggagctgaatgagtctcccaagttcactcagttaattagggggagagctggagtttgacctggtgctcatgactcccaggaggaacattttcaggaacttaattgcctctcaacaatgcaggatcaggcatggagttctataccatccataaaggaaagcttggccaaaatacacctaaactatgctcagccatgtatctctctctcatccatttcttttttggatctaggtttatcttgtttaataatcatgtttcctcatatttgtctagatttggtcgcatacgtaagtcatacattttatgtaaatatcattaacgtattcattgaaagatagtatggattctaagtataaacatccggcatcttctacatcagtgcccctgtgcctagagaaggaaagtgtggagaagcttgagttggagaccttcctactttttgtgcacaagcggctgcccatgtttatgaaaattaatggtagacaactagggagttaatgtagtaaaacaaaaatgttcctccatttaaataaaattgtaagcaaacacctcctgattttgttatttgtaagcatttggtttccggtcgcttacggtgattttgtgtcccttccagtcctcagaaaacccccttttcccactctaaatgctgaacatatgtcaggagtcagcagaaactactcaaagctgcaatttgttaaaagtatagatgtgtgaatagatttttccacacacagagacagaaaaattctaactagtggcacatgtcacattcaaataatcagcactacaaaaatgtcctagtttaaaatacaggctggaagaactgagcaaggaaggaagagaggaaaggaggtcagaagatacaaaaaatgagcgagaaagtaaaagaaaaatacaagtccaatacactttttttcatttataccaacattttaattttttcaggtttgcaaagtaaagaaactattaacattcagaagattttttttgtatgagtttctttaaattccaaacagacttttatttttttatttttatatatcttcaaacttacagaaaagttgtaaaaatactgagaataacttctatacccttcatcaagggtcagtaattgtttaatgttttgccacgtttacaaatacttttctctccttgtcttcccctctctctttgggtttatattagtactattttctcaaaccatttgagaattagtttgactattattccagcccagagtgactttcatggttatagtctctctttttctgttatccggtggctggaaaaattacctatagttcctggatttaccaatcatctctaaaacatataacaaatctaaacctcattctcgctgaaggaatgtgtctcccttggcagtcactcatttcttttgcctcctcctttctcttgtttttgatactaaattattacattacacttttttaggtttttggagcttgacattttattaaatagaaatgcaatggaaagacaactggagtaggagtctatagagttatgttgtaattctgatggtatataagattactcttatgttctaattttttttatttcctctttgttcaacctttgggtctctaagaatccatgtattcagtagtatgaaaggtaaaatgcatatcttgacagggttgatgaaaagataaaatggcataatataaatttatgcatattaaatatgcttcatttccttgatttttaaaaaaatataatcctaagcctttcaagaggtataaaatggttgcctccttaaatgaaatatgttaagtttagaatattaatgtagttttctaactgtctaaaccattttaaaatttcttcataaagatgagagttccctgcttgcgttgacaaatagacctgctttcctaccacatttaatactggttgtttccattactctactaaatgcaaggtagactacattttaatcataattttctttctctcagatgtttgtactttacatgctctgttaaacgtttcctgtgattggaaaatgtcttaatgtttttaataggctttaaatttcattggatttcttcagtctgagatcaactgtattctgctttttattatatgggactacattaaagagattcttcttaaggcaaagcctatgatattcttcaataactgtagatttgaagatgtattaacaagaattggagtttctctgaaagggttaaatgtttatttcattcatttcacagagtatggtatgaagtcttcaacagaaacttgatttccatcaatcaccccaatacttggctaattatcatgtttttgtctatacagacatgcttaatcacaaacatgcacacgatcatgttcataacaaaaagaaagatgcagttgtcttatatttaacattcactagtttactgtctattacatttgttcccatttctgattcagagataaaagagctaagttatacttaatgttagcacctaaaattatcctatagctcatataagagaggcagacagagttgacacagattgagagtctcagtgggctatagctaggagggtgttgataggcattcagctgccttcaatcagaggcagtgatcactgacagtgaccccaggcatataaaactacagtttctttgtaaagatctccagagacagggatagttttactaactttctccacccagatgagtgtttcttctttatttctaacctaaattctagtactgttttctagggaggtcattttcttttgttctgtctcaaagttggctaggtagaagtgttgaattttagaatggaaaggaacatcataggtcgaatgttttaacttcttcaattgaggtatgaaaaatctgagggttagaaaggatgaggaatttatcgaggacccgcttgaaaaggcagaagagaattcagatttattttccattatactgcatgacttcttctcccaattaattgactatgaaaaatccatctgccagacttggctcctctaagcccttctgtcttcccacataattcttttgtaatgctaattttcattctccactgaatgaactcaatttcgcatacacttttaaagccatgaacttacacttacctggaggcctttagagaggacttggccaggactaaaaacattgatataataaattctgaaacagccactctggctatcttagtatgtagacgtaagttatcatgtagtcatcccatcagggagaaatctgaattttaagatcaacgttggctgtgctgaggtcatcctatgtgcccactcttttcattctccatcttagccacagcatcactgaagaaatcaaggagattaaatttcaacagagaagaggggaacatttaagagtcggcaaaaatgcagtgaaatgagggtgtagtcaatatagactgcacacattccattccagagagtcagtttatgtaactggaaaatgtctgcatttttagtagctcttaatatgctgacatgctaccaagtaattcacaaatttttctggttttctgagtttcataaaggctgatgattttttttttaaaaaaagatggagtaatttttttaatgtagtattccagttaacaaagtgatatgcccataggaaaaaatcacctggagctttgtggtcaaaacatgttttcttttccttttttaaaagatgtttaactccgttcatttcattgatagacattagtatttctttatctgaagcctccactaattattactagttttaaaacttaaactacaatgttaggtatcatggtagcactattaataaattgtatacatttggcaaatacgttagactcaatttctatgaaagtaactgtccactggactttgagtgaacaatgtggcaaaatattggaaatatatagttgcatgttggccagattattggcacttcgaccagatatgttcactatacatatgactatagttatatgcactgagccctgccaccacctaccccctgcaaaggaaagtcatgactcttttctctggaattcaaagctttctgtcaacataatctatgaagccattcattccagtcccactgcccctaatcccactgcatctcaacacaaagaatgacttttcctgttcttgaaacactcctagcatgttacagtacctcatttacgcctctggtgccattctttatttgcttataagcatttgtttacaagtctaagattatctcctgactacccttttatctagtcaccttctctttctgtctcatacttcattttattgtttctgtctctctcagcatgccttcactgtcatatctctgtgttttcctgtctccatgttgtgctttcaccaatagtcccaagtcataatcagtttctgccattgggtattttcaagttaatcattcacctttacatttgcctttgtaaatggccatattagaagtctgttcttttccatgccagcagaaattctccctacccagctgttataattagaggaattgctccccgagttttcatatcagatcagaactgttatttgttgttttgcaaggtctgcacacataaagagtttttaagcaaaacatttatggtctaggattagaaatgcttcgacatgcaaacgtagactgtgatagctgttgtgacaatttttgaaaaacagcaaatttctaaatatcacctaaaatttaatttttcaggaaattttgcttcaccgatgaaggcgtactgtattattgtctattttctgagttgctgacattacctgacgtttgcaaagtactaacaagggcatggcatggtgatttgtatcttgtaggacaagtccttccaggctgagagttcacatctaaaacagatcttgggaatttattattattctaccaagtaccagagacagtcagctgaaatgaaacattttctggacttaaacccgtccctgtaaattcctacgatgtcaggggacacgggagtgttagttgctggcatttgcagtgtagtcttctagactctgcaccataactctttgctcctagttaaatgttttggatttgccaaggtatgcgtgttcaagcacacacaggtacccccacagaaatttttcctaagcaaatagctgtatgtgatatagggagattatatttttcctgaacgtcaatggaaatgtacactatgtatgtaatgattatattttatcactgaatatttgggaaatataaaatgggaaaagtgcactgcccatgctaagtccagagtatcatatattataaaatcggtggttctgttctgcaagggatgagagggtaaaaagaaaataaaaagaagctcagccatactgtaagagagctgtaaaatagaattaaatatggttaaataaaatgctaaattctgtaattatatggttattatgataaacgggctttaaatatatgttcttcattagccagggcttcaaagctgaaagatttctatggaaggtgatgctcttatgcacagtcttgaagtcagtttcaaggaatggtgtcttgtgaggttgagagtgcaacaaacatgttttcaaacagtgatctctgtataagtagtataatctcaaaaatcactgattatactacttttccatgtatctggtcttcctggttttagtaaatcccccaattgttagcaatacaaagatgtatttttcatgattttaagactgttgcattttagaggcttcagtttgtgtcctgatatttgtggcaataaatagaagacacacacacaaaaaggctttttgtagttgaaagggcttatatctttgaaactaactctgtcctttaacacatttcatttaaataatcactttctatcttgtccacagaaggtctttacaatatgacactatggattaattttaggtctcctattagggttctttctttctcacaacaatttaaaaatgaaagatatagataactaacagtatttgttctatttgtaggtctcatgttcttactgtaaatcccacagagtttgacagagctctctttacatgcatttcactgtctttcaatatgctcacctccctgtctccccaagccacaattcatggattcactgtcaggaaaatttctattcattgaccatagattaggagaaagtccacgttcactgatccccctgaagcagatgtagttattatttcttcctagtccctatatctagttacgtaatccttgtgttccttatgatatcataaggatttgtttatgttgccatctttttcctataactagagttaactactcaagttaagtatatatttcaattttgaaagtagcatcatattatgcataagttactcaaagtcaaccatacatatggacttgaaatacttacgaataaatggtggcagaacatctgagcatgtgcccagagtgagcatcaatgggaggcattggcctgccccccactgtcagactcagctctgtggatcccttatgctataagcatctctacacagtgactacactttgctgtacagtagatgtagcaatatgaaattgtaatacacatcgccccctaaatgcatgtctcctacttcttctgaaatacagtgaggtaggggcaggggttgattggtttaatgctagaggaaaaactagatctgttacctgtgttaaaatgatacattaatcttcaaaaaattcataggtttaagaagtgctcaagaatacttttgatacatttaacttctgccttgcttgctaattttagaactcggtcacccctaattagagatgcaactgtattatacacccagccacactacaggtgcttaatacatatttgttgttgaaagcctcaatcgtgtgtatgtttccgtatagacgaacagtcgttaggatgatcgtttgtccgagtttggccaggacacttctgcttcacacaagttgttccagtgtaaatattaatagcaccctcttttatcctcaaaggtgtcccagcttggaggataaattatatagtcaccctagttatagtgatatttgaagtaatttttgtaagtaatttggggattggcatgcatgatgtaatagaaacaaacaatgcttcaggcaaaagactaaaaccatgatgaaacatgcttagtgatgctccttgctctccgagtcatgctggtcagatctgctggcctcacgtctgttctctccctctcctcaactgtcttctttcctgttactattactatttgcactaaaataagactctttctacagtccttttgttttctcagagtagtttgaacattcctacccaggcgtccagtagcacataccctttggcttcctgaacatagtcctcacatgtattcaccaatcctcttccttttctgggtctgaatttgacctgttgaagccataagcactcctgcccttgtgggcttctgtgttgaagaggatctttatttttccatttgccatttgtaaaactaatattgtacaggtaataacaccgacaagtgaagcttgaccttataaaaaggactgctaatgtgctgaagggaggaaagtcctagatgggttattaaggtaaagagagcagaggaaaagagaagaggcacaaagatgaaatgaggatgtgatagcaacctctgacgcctgttttctgagggcagagaagaatactggaaaaaggacaaaagaaatttggcaccatatggagcttaattgctttttttctattacctgtatctaaaatacttcagcaaagattagctataagcctaaaaccacaccaaatgagcaataaattctatagctcagtgaccatgaatagatcataacgttgccaaagaaaatttaaaatattttaaaactgaatacatttaattatatgcaaatgagtcatatcctgcagggtaattaggtggttcacataaatgattatactgagtgagtattcttttcacgtgcagaaaaggtgagctcctggggactgctatagaaaaggtgggaggggtgaggaatgctgaaagaagcagaaagtcttgcatttgtaattcagggacacagatgatcaaaacactgggccagcagaaaatctgaggcatgattcaaagagaacactgacaacaagacagtttgtgtgtcctacagaaagacgagtcctaggaacctggccaccaagcaactactataaggtcaagcattgatttcctagtgactgttaccattccgatgttcaatcaatgctggcaactgctttctacctctgaacacttttcttgctagtcttaggttttatgacttctgagatatgagactgaatttgtttgagtttactataatgggattttgcattatgtatgctcagtagtaaataatatgtatgcttaatagtaaattattttgggaaaatgtctattattgctacaatttaacttaggctaactcaaagtttctttgacttgctaagcagtttagatactggaaaaaaaatcagcacagatctttgacctggaacccagtataagagtatatagagattacttttttcagttcaatcggtggccagttgggtgatttcctggtaaaccactatccccttatgccatgtttacagtgtattcggggtggataacataatgcaatgagaaaaaaataataaagtaaggaatttaaatagctttttaatttttatctccttattgtatatgccacttaagttttttttaaatcaaaggagaactactaccattgaaagaagtattaattttcatcccaaataccaaggggacaccaaacttggacttccctgatttcataggttccttacaggaaaacataattaatccattatatttaccaaggaggacttttccacttaagctccacacttgagattgtaaatttcccacacttgacagcgtaaactcctcattacaaggagacctagaggataattgccccgataatggcatctttgtaccagtttatgtagacataaaacgtttaaaactactgaactcagttagactatttattatccattgtaaaaacacatattcttgattttctctaaatataaataggtttgaatagttaagattatgataagaaaaaagcatgccattttaggggaaagggctctgttatgtgtgcatgctgacctatgtgttgcaacaatttggttgatatacatgcacaaaatagtacatttacaacactgcatgaatgatttaaatgtaggtagcaatgcctttgacttcaatccatgatttcttacagtattatttcaataccattcttctgaataccttttaactatcaatttataaatatgagtcttgtagctatcaaagttatataatagagccagtcaaatttctataaattatatattaataattatattagtgaataagagttattgtatatgcatcactgagggaaataaaataacagacactaaatatatctgttttaagtaactgagaaataagaaaaagttgtcttcaaataataaaataagctatgagaaattagggattggtttttcataacgtattttaaatggggggaaataacaaatataaaatggccacaataatttctgtgaatttcatagaagaatagggcagaataactgaaaactagtttataatttaaaacaaatttagaatccttttaaaataaacatactcagtattttctttataacagcatatttgaaatatcatcaggtgtccactttacattggaattaattgaactggtatttacatttccaagtagttatttctcatttgccaagaagagattgaggcttggttttccttcaataatatcttcattgggcattaaatcacaagtatttattaaactgctggagttaaagggacacaaaaacagatcagccattcttcccgagtgaaattgattttattttctcctagctcggttctcctagctcagagagtaggttctagccttatttctgcaggcagaaagatccttggagtgaagatagacttctaatttggttttcaaagcatagagcatacattacattttcttcattttgagtctgtacacatgatgtgatgatcgtcaaaatgatgtaccgttaacctatggctttctttaatattccattaactataattcaatttcagcaacaaaaagagcagttgggaaaacaccatagacataatcaataaggaaactctgtatttgaattacgatacctcattttccatgatgtggttataatgcattgcatgcctgtatcaaaacatctcctgtactccataaatatatacatctactatttacccacaaaaattacaaatcaaaaaatacatatatatgttttctgaggctatcctaaacctcccttccagttttctgtggcctgtattaagccaggagcactggtattactttttcatgagagtcataattggcccaaacccaatctgtctttctatttctaaatgtcgccttcaagtactaaattctatttttccttaaagttaaaatccaagacttttctcaggatcacatttgtatgtctataaattagacttcacatgggccatgattgctagaaggaatcaaagagaccctaactttgcattcaacttaaaattaataaaaggttttgaatagagtatattaaaattgcatgtttcatcagacatggaacagtgcggtgaaatgggtgttaaaattattaggttctagaaattagtagagacacaccatttgtattatcacatctttcatgttaatttaaagaaggagagttcagccttgactacaccttgggtgacttttaaattatattgatgcctatgaatctaatataatggtttgggaaagggtctgggcatctgtgtcaataattttgaaacctcgcttgatatttgtaagagataccctggcttcctctacttatagctctaaaagcagacaaaaacgtgtctgaaaagaagtggaaaatacaagcttctgcctcattgattactgctgtccattggaatttttgcttggcacaaattgtttatcaactttttcattatttaggagttttaattaggtataacttatttgcattagttgcttctcttgaagaacctttgttttttcctgagttagctgcctagttcaaggtcatattacagcaatgtttatttacatgaggattttgttttcggtctacttgacacagtgccagaacttcttgcttatttatgttagatccttataagaacaggagggtaaaaagtacatttactttagaagagttcttatgaaggttatgtgattaccaagtgaccaaaattccttgcataagcactcatttctaccagcaattctctttcaaatataaattttaatatttggatagtgactcccatgcatattttggctttaggatgaatcactgtgcctggagcaaaatctttgtcaaggatggagccaagcatcccaaagagtggctgggaatcacaggggagcccgctgtctccatgtcacctcttaggggaataacaggacatcacagaacgaaaccgagggctgcaggaagttgcagggtcacagatgagactttttaaaaatatatatatatgaacagggttaagaagaagtccctattgaggactgtatatgtcaaggttctctagagggataaaactaataggacaggtgtatacataaaggggagtttagaaatattaagcaatattgactcatatgatcacaaggtgaggtcccacaataggccttctgcaagctgaggagcaaggaagccagtccgaatcccaaagctgaagaacttggagtccgatattctagggcaggaagcatccagcaccatgggagaaggacacaggccggaagactaagccagtctagtctctccacgttcttctgcctgcttttattctggctgcactggccactgattagatagtgcccacccagattgagggtgggtctgcattcccagtccactgactcaaatgttaatctcttttggcaacaccctcacagacacacccaggagcactactttgcatccttcaatccaatcaagttgacacaatattaaccatcgcaaggacaatcagaatatatttcaggataaattgaaaattgtgaaagtgattatcgttagattattttaaggaagtttgacttaggagtttgttagccatggccccaggtatataggttgagggacctcagagtttataaagttgtctttcttaaaagaagaatttctcaaagatcaatataaaagcctttaaaacatcattgttgttagatatacgtttcatatacaaatgccctaagggcatttgtgatgatagccatcatttattcagcacattacgcaacaagcttgattgtaaggttttccacacattctctcattttattctcacaacaaaccttatcttttcaagagtctgagacttaaggtagcaattccctagagttcacacaagtaataactggcatagcagagctcacatttaaactcagatacacctacatttttttagttaggccagaagtggcaaatcggacagataatgagaaaataactagagaatattaaaatgtagatagccattctaacaaaacatgaccaagatggcacacaaatacacacacacaaacacacatacacacacacacacatatagtaccagctcagtcacacttgaaaaattcaaaataaaaatattagcaactaactccagtgtttcattagataatgaacacgacatgcctaagtaggatttattcttcacgtagtttagcccaacattatactaaaaacatgaaggagaaagttcctctcattatattcatagatgctaaaagaaagtctaataaacttcagctatcaattctaattaaaaaattgtgggtgaattgaaatatgagctctataaacatgaactatttatacaaaaatcatcattacatattacattaactataaaatgcaaattccagtggcatcaaaatggtgaactaattaggcatgatttctcttctgccagctctcaaaaatctcttgctggttctacttaatgcaataggacaataaaataaaataatcataaatactagaaattaaagttttaattgtatatgatactgtcatacacttggaaaagatcaaatccttaacaataactaggaactaataaggtatatgaatacaagataaatacgtgcaaaatatgtattttttataatttagtttgccaaacaagttagatatacgaggatgaatttataaatcagccttattattcttcttctactccacttccagttggctctacaaactaattactgactccttcggttgttacctcaggtaggtcctcactttttgtgcttgttcagtcacaaaaacttcctgacatttaaaattctggtccagtatagcactaaattccaaattcttattgcaactaaaacatctttatttatctaatttgggcctatctagttattgctgagaaacctgtaataactagttgctattttggagggaggaaaatgagagcatacagtcaggtagaatcttatttgtcttagagcagtcataagagccttttgttcttggcagatgcacatttaccagcttgttctcttgttctctccagttccctcactggagacttcaaattgctcagtcttttacaagcaaagtgctaataccacagtcatgttctgacttactgtcagtcacctcagattagagtaattactgcctgttttagaaacatatcactgcaccaggtcactattctgctgcttatcactattatggattctgcatctggtctatgcaaaccccccatttttaaaagtacaactggctcccaacacagccctctctctcttttgcattgtacttccaggcagcctgtagcctttagatttcttccagcaacagtcagaccccattgctgtggctgtttaatatccaggaacatatcttaagctttctcaagttttcttgaaatcttgtttcctgcttgactttaaagtaagggaggcacatccacttattcccatgatggcaggagtgggtagccgcaagcacagtgccctaaccattctctccagagacctccatcttgccagtgtctccactttactcacagagcttattgtgtatttgagcagagctggtttctcagaccctccacatgtcctgtttaggggggttagcactgcacgttaggacttgggaccacgctgtgcctattttacccttgatattcggctacagctaaaatcatatcaaaaaaagtcatatcgattaccctgctatattggcaataacaagatatagtcgaccaataaaattggaaaaatataagagcaagacactgcaaacggcatataaacatattcagggaaaagaaaactaaaacaacaataagataacttgatttttgtccttgaggtaggcaaaaattagcaattgaaaaaatgtgcaactgtccagtttcatcaagtttgtgagaaattggatattgaaaaagggaaatataaatcaatctctctctttccctctctctctctctatttcagtctctctctcacacacacacccacatacacaaccttgaaaggctgtgcagaagcagcactattactttatcttcaaaggttatttccaactccaatgtatcaatctaaagagtaaatttgaaaccttgttttgaaataataagagaagttgaatgtagatttatcataaatgattttaaatgcagtgctatcctttgtcatgatttacaaattctttctcttatttccagatatccataggccatcatagttaacctctgtttctccctgtgaaccaacaacaaatatgttatgtctagtccatgtgtggcctgtaaatataagtaatatttacagaatttgctttgacttggttaagattagtaagaaacttatggtaccagaacatcttaaccagaatacttaggaccctaacactgtattcctcatttataactcttgtgctggttaaatatgaactctcattcatatacatttatttgttgtttatcaccattgacatctaggaggttttgagtgactaagtaccttcaccaatctgtttcccaacctttttttctggattgttctgtaacggaaaggaagaattatgtcccaaatgattgtcctgttgagaatggagatttaaatgtattcagttctttttccaggtctccctttgaaatcctgttttagaatgatactcagccttcttatttcctgttgaaaataataacacatactacctgccacttagcacatataagtgggtgtttggaagaatcttttgactgaatttaatgaaactgctgaattaagtaaaagcttgtatctttttctcaggtagtgactctctgtagctatggaccaccacatatttgccatccctttgctgatggtttgatttggaatgtgtcatttcgtttgtgaaatgagacatagtcaaggtacccatgtgctcaagtgcttagattacaacaatgttttgatgcaaatgtgcaaagtactcagagatcaacactatggtctaataacaggccatagcaaaatagagcaaatgaatcctgtgaaatcagagagaatgcatcaaataaagatgtactacctaaagtgcaaaatctactaggagcactttgacatttcagttcaagttctacagtgtttcacattttttcaatctctattgtagtctcacttggaggtgattgcttgatcactagaggaatatgatattattcgtttcagaaatgaagcagctatggtgttctcttgtgaatagcactagatatgaattaggattatgatcttgtttgtgtagaatgtttcattacatttcagatatttgtgtcaggatataacaaagtgcattcatcagcttaggaggtttgctaacttcagcattcaacgtaagtttagttgccccaagtctacaattaaacagcaagacacaacgacaggctttgaattttaatggaaattggcaagatgctgaatagcaatgaaaccagtggggatgaagaattacttgcaaatttgaactgtgtgcaaactagccaacatcaagcaaatagtctttatgatttctatatatgtatgtacatacatatatacacacatatgcatatgtatacacacacctatctgtctgtatatatgtatatacacacagagcagtatttctatatagtcctttaaaaaatgtaggcatcttgtgtctttgcacaacttgaaagggattgtcttctcattgtctagttataaattaaacttgtagaccttatttttttgtctgaagaacaagaaccctatttcctcaactccgtatccccaagcattgaatagtttatgcccataacaactattcagtcaacgctgttgaaaatatgtcttaactgagaatccactccttttccttcacaagctcaaaagcacatacaaaagagcaatgaggctgataaatctgacttttcagaggcatttatcagacagaaacttcccattctgaaaagtatttgtgtatcagaatagttcagactcatggctacactgatcctttaaaagcaaataagctcttaatgccatacctgtttagaaaggtgcagaatggggtatgcactgcatggagagaccctacctcctacccaccctggcctgacatgagtgataggaaaaagtggaaaccttctcagccctgggctacccatgctagacctctgattccagggcggtgaactactgcttttcctcgtgtgtggtttctttctggtgtgatgtcaaagagatccggcaaacaaaagtaaattcatttacagacaattgactagaatttgtgagaaaaccacagaagaatggcaaccctggtagttctttttaaacatatagattccaaactctttcatgaataactcaattgcttctttttatcttaattttgtgatataaactcatcccacactactcctaaaacctttctcgagaattcttatgtctttctatctcattactcttcatttaaaagttcatgtccttttcactcttcaatatcattatcatggagcagtggtcccactgccagggtacatgaaagcggggtagggagggataatttcagtctcagctgctaccttcattctacttgcttttacttccactccgttcttgggttctctcaattcttggggttgaaaatgccaaccatgctgcaggtcatcgtgtcttgtctcctcctctatcaagtccagctgatctctacaatttcttcagaagtgaccaactcaagcttcttcttcctagatttaatgacgttccttccctttaaatatctgagttccccaccttttcaatacttccagtgtgagtttcctgtggctgcggtaaccaattaccacaaaattcatggcttaaaacagcagacactgatgctcacacattgatgcttctccaggccagaggtcagagatcagtttcagtctgttcaaatcaagctgctagctgggccgtgctctctctggagcacttagagaataatctcttcctttcctttcctggtttccggtggtttccagcatcccttggcctgtggacacatcactcaatctctgcctctgtggtcacagtgccttctcttctgcgtatatcggatctccctctgcctttcttacgaggagacatatgtgatggaacttaatctttacccagatgataaaggataatctcccaatgccaagatccttaacttaattgtatctgcaaaacttttttttctaataacgtaatctttactggttccagggattaagacctgatatatttggtggccattattcattctactttaaatcccaatcacacactatcacgcccaatattggcagcttatttctaccaatccttctccatcagcactgacatgctctctgtttctctgcaaccttagattttactctagcacagaacagttgtgcctatttgagcttgacagcagaatgcattgataattggtcttattttaagccaggaattgatctatcaactttctagctcattgacaggtgaattgaggcaaagatctatgcagagtctggtacagtagaaaagtaaatgcttactaaatgagtgaataatgaattctcaaatttagaaaattcttgagacaacaaagccattttgtctctcctggggaaattcactttccaatggtctaggattgcaattcggtctcagagctacagaatcttcctgaatgtatgttgcagtgtttttgaatccagagttactgctagtgcctgggttttccacaacaggaaatattcatgaagcgtatgatagaagatgaaattgaatggaatatcctataactctctgatgaaaattcaatagtaactaacaggttgggtatggtggctcatgcctataatttcagcactttgggaggccaaggtgggaggattgtttgaggccaggagtgcaagaccagcctggccaacgtaaataaataaataaataaataaataaataaatagtaactaacatatgtaatacttattagacgtctggtacttttctaagtgcctgacatgtttcatttcattctcaaaaaatcatatgggatggtagggtaggcaaaataatgtctcccaccaaaatgttcacattggaaaggcaaaatgtaccctattactgttaccttacatggcaaaagagatacagcatatgtaattaaattaacgaccttgagatgagattagcctgaattatgcaggtggaccagatataatcacaagattacttaaaagtagaagagagaagcagaagaggatcggagtgatgaaatggtatttggctgccatttctggctttagagatgaagagaggagccacaagccaaggaatgcaggcagcctctagagctggaaaggtgaaaaggtagattctctccctagagccaccaaaatggaacataagtctgccaacaccttgattttagccagtgagacccttgatagacttctcatctgcaaaactgtaagatgaaattgtgttgctttaggcccctaagcttatgttacaatgctaacaggagttaatataggaaaaatttgaaaatttagaaatttcctaaaaattaggaaaatgagtcacagagagagaaagtgacttacttaggatcaaagggctagaaggtggtagaagcagagttcaaatacacgaaattcgcctcttgaggtaatgttctcaacctcacgttaatttgcatctcagcccatgtacaaccggtaactaaatttatttcctgaatttagtccttcttgtctcatactggaaacatttgctgcagctgtaaaattccagcctgccagggacctgtacttcccagggcacttggcaaatgatagaacatctggtgctgctgacataaactctgtgcttttccttctttctatccttcatcacaacaatttctctattatcactgcctcctctcccaggcccaggataactgtaagagcctcttccaagatgatgatgatgacgtggagaaaaaaatcaaatggttgctactagacttctctagagctacaagtatgctttcccaggtttctgctgcagccactgtttcatttaaagcactgcaactctattcagtaggcagggatggttcctgttacatacattttacatgcaagataactaatacttcaggagattcagtcgcctgcctaaggtctcccagggagtaagtggtgggaataatggccatccctattctcacccagtgcctgtgccacaatgaaaaggacaaaggttttgaagcctatgattctaagtcataatacccagaaacatcacttaaaaattgtgagcctcattttcagaacctgaaaaatggaggtgaagagcccacctcatatatttgctatgaggactaaacagaatagtgggctgaaaagtttgcctcactgtgaaaattactggaatgctaatagagttttgaaatcttaacccctagtgaatcaagagtctactgtgagtccctgatggggtcattcaaccaaggcagttatttctgaaattcttccaactctggcagatcctggtatttactttagccctgggtcatcagttttcctaatgaaccacattttttttttatgatgacgatgctggaaatgggttttaaatagggtaaattcttatttgttctcaatacctccggaatagctgaagagtgaacactttaaagactgattggcaatgctgactggctagtgtattcttaggtggtacaaaagcagtataattcactactttttaaccactattaaaactcctgttttcaggctttcaatgtttgtgatttatacaatttttattctcttattatggttgcttcttctttgtaaattaaactcaggagaaacctgtaataacacattatgatactgcacagaactgatttcacacagattcaaagctaatattaccctgctctttgacatctgcatctttaaaggtgcttcttccacagggatgtctaataaccagaatagctgtgagctagctggtttctttcccaactttatgtatgctttctgtaaagacttttggatgagaataatattattccttgactttgctttttctttattcctggatgtcagtgcttacctgcaattagatctatctcccagcccagggataaatagcaaaaacttgaatttggaaacaccggaaacacagcagttacagaccccgaggggcagaaaccacaaatgaatttccctgacctttactttgtttgctatcagcagtctctaacacctagtatgatattggtaatgagtttctagtgagaagacaggaaaggtgtgagggaactacggtggaactagttctctttgccttccattcctgagtacatatataaaaataaatgcaaccgcagcacatcagtagacttttaaaaatacatgtcccttcttttttaaagcaagagatatttttatctcaacccagcatggataatcggaataaaattagagcatgtatggaattgaattaacctgtggattaaactcatccatttgggagatcatggttattactgatttaatctaaacatcagtgctagccgtgtgcatatgtggaactcagtgctgtatgaatgggaagaatacaggatgccttttcagtcttcaatttggaaacttcatcatgataacactgattatcaggtaaactcaaacagtacaagacatgctttctctcatcttgcaaaaaaaaaaaaaagtcttttatttttaaagtatttgaaatagttctatcaattgtttgacaattaatgattatcatgtggtcatagaaacagttaccagggacgagtatgttcattttaagtgacttggaggcaggatccagtgtgcatattcaattctcgatgagcagtcttacagaaatgattttcctgcactttgcttgacttagtcatgtagacaaaacttattggcattttggacatattggcgtctgcagattgacttgtaataggtagttcaactattgcattacaagaactgcaaatcatctattcgtggctgttgttctttttaaaagagtcagaacaatatctgtatgtgatatatgtgtgtgtgtatgcatatttaagatatatatgtgtgttttatttgtaatgtataaattatttatttgaatgacttgggagattaaagtagtagatttcataataattcagacatgattttgaaatttatatcctgacatgcctaaagtgagcataccagtataccacacttttttctttctttttttttttttttagatattagccacatttgatttgaagacgatttgcttaaattcacctctaatgatttaggttaatgactctgagtacttgaagatgtcttatggtaataaagatctatgttggcatgattcaattaatgaaactaaagtgaaactctgtgctttggttttacttaagttagcagtaattattaatgtaatgtttcataattgtggtttccatgaatagtctgaatctcatagacaatctgggttataaaaaaagcctaggttaaaaaatgttgttttcattgtcaaatatttctttataataaaccacaaaaataattgaagtaatgaattttagcacatactttcacaggtattttatatatatcttatgaatagccttactctttcttgaagtaaataagtataaaaagcatttataaagaaatttataaaaaataaatcttagatggttttaaataaggatgatacactatactttaaaatacaaatataaaaactcacatttattttggaataccaaacaactggaacagttggaggttgatataacattttattatccttacactacttaacaagttaatatttggcaatatactacctctggtaactattttgtcaataacaccaagctatgtgcattgtaaatataaagaaggttatttacaccaagctatctgcattttaaatgtaaaggttattttctagtgctatacaaaatccattttaaaattatgacatctactgtctaaacattaactctctaaaagtttgcatttaaaaatgaaatttctatgtatgattatattatgtattaacaaaaatagaaatttctttctcttctagctggaagctgtcatgttcttaagaatgtaaattaccataaaagtgtatccttttatttcctacaaagtaagatttactgttttaataaatgttcacaagattatgttacctctgtacctatagtgtctttatctagtagttattgctgtgactaccgaggcaattggttatttcataagctaaatattttgaagtcctacatgtcagaaaagccacagtgagcactactctgcattgctcaattcaattctcaatacattagaattatacatattgtaaaaatatttgcagacgtctgttaaataaaaattccatacttaatttttaaatgtaagctaaatttagagtaatttaaaatttttagtgatatcaattatccagctcatttatctggcatcaaattatgtacaccattttaggtacaactactaattaatagattttactatataagaatataagacatttctatttattttaattagaaacaaatctaagatggtgctgtgtactttccattccacatactacatttttacgaaaagcaaattgagagctttgggatatgggaagtttgaggtgatgaattctctgaagtcaatattaattgaccaatacaatttgagatttaactgggatagctatttcattggttatttgtgtctgatcggtctactcaaaatttgattaatgtcaatgtgggtatttagtgataggttgagacaagtgaatcaaattatcctcagactcataaatttctgtagaatgtgcctcaggataaagctttattgctaggtgtttctgtgtatcggggacggggggaggttagtgaaatggtatttaaatatggaaacattgagagaatggtagaaaaaagactaaaagatgaatatatttatggctgcatgttttaacggtgagaaagaaaattctcgtttttgaaatgcataatttctattctacttcccttccaaaggcaatagaggcttaaaatgatagataaaagttacacagatatgcatttgtatataaactgaattataatttggtaaacaggatgtgtcttacaaatatatgataaaaacattgcataacagattgacatggtcttataaaccaatgttagaggactccttgtattatcttttagggatatatgtgatttgattcttattttcaaaaactttatatcaggaaatatcaaattcaacccccttacaatcctcatgggatacttctaatgttatttatgtcttgggtggaactgtctcaagttaagtgcatgaccaccttacaaatagcttgagacacttgaatctcaatgtattttaatagcccctgccccatctactttaggttttgtaaataatggataaatatttatttagattttattttttatttgatacataatgcattctaatgatatttacacctcaaaatctgattcagtatgcatgctttatatctgagtggacttttctgtaacgctaactatagtgatgagtattataccatactatctggtaagataggaggtatcacagtctattctagatttcttaataatcggcaaagattgaaaatgtagagataaaattaatggtattttcttatagccctcctatttcaagaatagcactttagtaaaagttacagactcaggattgtgttgaaatccatgagtaataggaagaaacaaaccatttcttctcttagtatactctcaagaatctttacttctgatgccagatgtgattttcttcacacacttcaactctccattggataccaacgggagtcctatgattcaattcaattcagacactatctgcctggagttagtgtcagatctcacaggttaagggttcagtcccacaagactccctcccactttagatgctaattggaagtcctggcctctggaactgctgaccgaccagctgtaaattgtggcttcccacctcttcctcaggttccatcagttgctagagtggtttacagaactcagggaaatgctttactaccaatggccgatttattacaaaggacatatgaaaggatacaaatgaaagccaaatgaagagatacataaggtgaggttcagaaggcatccaagtgcaggagcttctgtccctgtggagctggggcagctaccctcctggcaaggggatgtatttagcaacccggaagctctccaaaccttgtccttttaagttttcatggaggcttcatttagtaggcatgattgattaaaattattggtgatcaacttaaccttcagcccctctcctcagttggaggttaggaatgaggccgaaagctggaatcctcaaatcacgtggtcggttcctctggcaaccagctcccatcctaagactattcaggaggtttcagccatcagtcatctcaaatgcacataaaaagacattattttgtagatttcaagggttttaggagctgtgtgccaggaagcctggactaagaccaaatattttttaatcaaaaatcatatctcaattcttcattttagttttaataccaaatatttatttaccttagatgaaaatggcatagtaatttaaaaaatcaaacaaaaatagagacatcatctcaagaaaggagagaaaacgaagaagtaatcagtgcagagtctatggctgagcaagctggtgaaaaaacttacagaagaagtgtgattaacaagctcagagaaccccaagaatggtaagcgtgcacgcgcgcacacacacaaagtaaatataagcccatcatattcaaacggttgaaaaccaagcaaataacaatgtctaaaggcagccaaaaaattgcaaggaatgaacaataaaatttaagctgaccttctagtagaaagtatgaatcctgaagaaaaaaagaaagtaatcattaaagtgttaaaaaaaagaagtcagtctataattctataacaagcaaaagcatccctcacaatttaattttaagtactttggacaaataatatctgagtgaattcttcactagcaactcactacaaggtatactattaggaaattgttcaaaataaaataaattcatcatcaaatgtaagcatataacagaacatagaattatgtagaataccagatattttaaatgtgtgcataaatattataattgattattgattaagaaaaataacagtaacaatgccatataggatttttaatatatttctgaaaattatatatactaaatatagatactattttatatatataaaagatatatgtacatataatatgtatctttatagatactatacatagtatatcttgtataagatatctttataaatatataatgataggctgggtgcagtggctcacgcctgtaatcccagcagtttgggaggccgaggcaggtggatcacctcaggtcgggagttcgagaccagcctgaccaacatggagaaaccccgtctctactaaaaatacaaagttagctgggcatagtggtgcatgcctgtaatcccagctactggggaggctgaggcaggagaatcgcttgaacctgggaggcggtggttgtggtgagccgagatcgcgccattgcactccagcctgggcaacaagagcaaaactccatctcaaaacaaacaaatatataaagatatatgtgtatatatgaatatatacaaaatatatattatatatacaaaacatgtatttataatatatataaaatatactattttttgtatgtatatacatatacagagagagagagagtagaataatagcacgaagaacagctcctttgaaaacaatctgtcaattcctcaattaaacatagaattgccatatgacccagcaattcaactcctagacttttacccaaagaaatgcaaacataaatccacacaaatacttgtattcaaacgtttatagcagctttactcataatagccaaaaggtaaaaacaacacaaatatccatgaaaggatgaatgtatacacaaaattagcatattcatacaatggaatatcatctagccataaaaaggaatgaaattttggcatatgctacattatactaagtgaaataatcctgcacagaaacccaaatatcatatgttgtcacacatgtgtgggagcttaaaaaaaaatctaatgtgggtggaaagtagaatgatggttaccagtggctgggaaagatagttgtggacagaaggatgaagagagattagttaatagatacaaaaatgtagttaagtagtgggatttagacctagttttcagtatcacaatatggtgactatacttaaaataatttattgtatactttaaaataactagaagagtggatttgaaatgttcccaacacaaagaaatgatgaatgtttgaggtcatgaatattccaattggccctgatttgatcgttacacaatgcatgctcatatcaaaatatcatatgtactccataaatatgtacaaacatgccatagtcatgaattggaagactcaatactgttaagatgttatatctcttcaaattaatctaaagatttattaggatccatgtcaaaatcccagcaggtttttttttttttggtagaaatttacaagctgattttaaaatttatatggaaatgtcaatgttattgaagaaacaatttgaagtactcacactaacagatctcaagatttactaagagccgatgtcacaataagacagtttgtgcttttggtacaagtataggaaaatttaatattggaatagactagtatattttcctgaattatggtaaagtctccactgcaattcagtgggtgtggaatggccttttccataaaaaggtgcttaatcaatagcatatctatttcagaaagaagggagtgggagccataatccctaccacctattatatgtacatacagatttgaagtaggaacttaaatgcaaaaagtaaggcaaagaaaaggtttctaaaagacaacacaaatgactatctcaatgatcagagagtagacacagttttcctacagtatgttaaaagcactattcacttaaaaaaataagtgatcaactgaactttcttaaaattcagaactgttccttacaagacagcattatgagagtgaaaagatgatatctgcagttcttatatctgacaaagaactcatgcccagaatatttaaagtattcttatgaaacaagaaacaagactgacaaattacttaaaaatgggcaaataaattgaaacagcacttcacaaaagaagatacacagatagccaagaaatttatgaaaaggtgctcagcatcattactcattaaaataccacaaactgataccattagactcccaccagaattgctaaaattaacatggctgagaatactgaatgctggtagtgttgtagaacagaaagaactctcatatacggctattggcatgtcagttgctataaccatttgggaaaacattttggcaaaatctactaacgttaaacatatttacacattcaaacatagcatgtccactcctgggtatatagtcaagagagacaaatgtttctactaaaagttcatgtacaaataatcttaataacagcattatgaataatggcccccaaaccggaacaaatgaaatttccatcagtagtagaatggataaataaattacaacatattcataacacagaatactacacagcagtgaaagtaacacactattgatacacacaagaactcagatggatctcacagacataaaaaggagaaaaagaaaccagacacaaaagaataaatgctgcacgatcaatatgtgtgaaatttttaaaaagagcaaaatttgggccgggcgcagtggctcacgcctgtaatcccagcactttgggaggccgaggcgggtggatcacgaggtcaggagatcgagaacatcctggctgacacggtgaaaccctgtctctactaaaaatacaaaaaattagcccggcgtggtggcgggcgcctgtagtcccagctacttgggaggctgaggcaggagaatggcgtgaaccccggggggcggagcctgcagtgagccgagatcgcgccactgcactccagcctgggcgacagcgagactctgtctcaaaaaaaaaaaaagcaaaatctaatcttctatgatagaagtcagaatagtagttacctctcgggggagactgtggactaaaaagcacaagtgaatctccagtgctaaaaatgttctatttattgatctggtatctgtgtgtgtggtgtgtgtgtgtgtgtggtgtgtgtgtgtgtgtggtgtgtgtgtgtactgtagctgtagctataagcttaatacttgggcagtttaatatgtgtaagttatacttcactaaagcagaaaaaagggggtataatcatagcctaagaaagcactttcaaagtagcttttcacaattccccttgcatagccatagatactatctacataaatgaatatatatgtaattgtattttgataagcttttatatgagaaacatgatattgctttaattcaaattaactttccttcttaaatgttaattatgactttgctgcacacgttcaacccagaaacacaacctgaatgtaaaggctagtcttcatcttggatatgttcattttagtctgatttcacaattttaattttgttatcagccaacgtttattttattttaatctgttttccatgattcttaattgcaaaattattaaaattatataggactaatctgttcactattggtgatatgcataaagaaatcttgctttaagtagcatatctgctgaaaaactgtttttttttctttatacaatctcattacagaacacagcatcatttattgccataatatgttttgtcaaacatcagaaacatttggttcattgatatattgctgccactgtttctctgacattttatatcctttggggccaatgagcaagtcccataggcttgtcccttgataactttatatcggtgtaattaattctcatcttaaatctttttacctgctgtcagccaagaaatagctaggaaagctgattttccaaaagcttgtggatcttagatgagaaaaatgatgagtataatgttgaggctcatgtaccatccttttttctaattacacagcctgttctctgaaatatctttccgtcgcatccatcagggatgccctcaacatcagagggagaagtgcatggctgtgcaaaagtgaggatttaaagtcccaagacagaagacaccaggacatgttttctctcttatcataagacatgtacttgatttatcatgtatcttcaaaactattctaaaattccatattataataactttgggaatgaatgagtatcattgctagaaaataggagataccttcttgtctgatgctggaaataaaactaagctgacgattgctgatgcagttattttgaagtaacttgaaagattcaatttcacatcctcaaattttaagtacaaaattacgccatataattcatttttatttacttgtaatttaagtttacttttacatcactgataggtagaatataatggaagatagctatccccttactaaagtgcccatttctctcctattcacattgagtctgtgaacccaattttggggcaagatgccccactgctaaccgggttatcacaggatctctggattaattcatgccacattctgggactttcagttgagtatattttatttttcataagagaaataactgtcttatgaagaaaataatcttggctgtttttctctcctttcccttcttttcttgctgcccttctttagatgatttaatttgtcacaaattaatttttaagacctcagttaatttaagtgttctgaggtattagtgacttctctaagctccctgagctttagtttactctactgtaaatttgggataaacaatccctaccttgtaagcttgttacaatgattgactgggtacaaagcactgggtatacagtaaatgctcaataagtggctgctgtcagttttgcctttttaaatttgtaactgctcaagaggacccagattgtaacctggggggtaagcttcacaataagggaacagaagaaataatgaaaggggtaatttttgaccaggagtaatggatgagtggggtggctttagagtcgactgaaagggcttttaagtcttgaactnnnnnnnnnnnnnnnnnnnnctgctgtcagtttttgcctttttaaatttgtaactgctccaagaggacccagattgtaacctggggggtaagcttcacaataagggaacagaagaaataatgaaaggggtaatttttgaccaggagtaatggatgagtaatgcatagatgaacgaatgttgggaaaaataggaaaactggaaatcctattactaaaatcattttaggtgggcttagctctgcatagggattattgccattttaaaggttcacgttctgcttcctttggtgaaatagacctttgtttatcttaagttagttaagttgtgttactctctgaaagcttataaaccattttggtatcattagaaagataatttattgggaaacattactggcaggttgtaattctgcttaagatacctattaatatctattaatagagttctccgaaccatccaaatgctaaagcatatagttgtattaccccccaaaaccacaagaatttctaatttatgttatggttgtgcaggtaatccccattggtttcagtctggcttcagttgactatagcacatatatacctatttttcaatggtctttcacaattataagaaagctggagaattagcagaagctaggagggaggatgctacccaaaatatcctacatggcacagggaggacctgttttggcagcatccaagctcaagtcctttggaagggccaaaactgatagcaaaatgtatagtatggttgataatgatttctttatcagaatttctgagtttgagtttggtctagaaatattcccacctaaagaagtttcaagaaaataacaagagaagcaaaaatgaatctttcactcctgacagtatgacacagaatattcttagtggattcaagcttcactgagcttctgaaggtttcacgtgtctgcaggtatttctccctctgttagaacatctccaagtcatggtttgtgtcttagtcaccttgaccttccaagagtcttgcatacagtttcagatgtatagtaagcacttagatgcatcttgactgactgaataactgagagagtgaagaaaaatgagatggcatacaatttgtttagattgcttctgttgtacacaatcgtacgtggtaactaatatttttacaatctctatttttctcttgttttcatcatcagaaccatacttgacaatcctctatgagacaaaagggtagaaatgtttctcagactgttactaatgctaggaaaatttcattcattttctctgttttgtataaactcatgcagcagccagatcctagtggcaccctgagtgctgttgaggtccggagaagaaaggcagtgtcacttagcagagcgccttcacccagaacaccagaggctgaatgtaacctctttatttctccaacttttcaccagttaaagggaaaaagtgaattaaagtgaaaaataaaagattagttgaagtaccttttcaaagactatattgcaaaaccaagtaatagcattagagatgatgaaattgtgtacctgcaggtatattggacagaaaggaaaaaatgcaatttgactgtgctttgcttttctgaataatctgccacctttttttaaatttgaagataagtctcaaaaaagtaatcagtgtttacattttagagcaaattttgtatttaaggtttatccagggttttattttatgctgtttcaggtatttaaagattctttgttaattaattgtaagacaaacttcacatgtttgtattaaagagaaaaaaaaaggaaaaagagggaatcatttcttaagcaatgattatataaaataaagaagatgtagcctgagctttgctagtattctgatgctcactgagaaaccaggccccgtgatcctgggagatgataacagtagattcacttatgtacctttttggaaattacttaagttctcagaacaatccaacaagtgtgctctgttagtcctttcacaaaattatttaaagaggagaggaagaggcaggtgaggtgtggcctgaaaagtttcttttgaaagaagaaaaaattattttacttagctttcaaaacctgcctgaaatgaataaaaaattaatcaaaattgaattttttaaacttgggcttagcaaagtaacaagtatgcttaacattacaatagagaaaatttcccactggtaacagtgataatccttctgctgtagaaataaagtgataattattttaaaatttactttcatatggttttattttctgataaaaataaatattatgaacaatattttagatatctccttcagttaacctagaattttataatcagatacctatatgatagaattaaacttatgcatgagggcataagagctttaataaagatttagaatagcatattttttattaaaatatgcaaaagtcatgataagatgagctgaactttttgtatccagtccaagtaaattactgcttaagatgtataattttttcagatctctgtagctgtagggcttttcatataattttgttttattaaatcacagatcaaaacagtgacccaggtaattatatttcagggaataagttgctattttcttatttgttagccaattgtataatttcacttttaggtgaatttttaatccttctctttcaccatgttggcgggggagggagagcaagaagttccaaaagtcagagagataaacattaaataatacatttaaccctgatatctccctttagatttcgggtaagccaaattttttttttttttttgagacggagtctctctctgttccccaggttggagtgcagtggcgcgatctcggctcactgcaagctccgcctcccaggttcatgccattctcctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcaagttttaatttgactgttaattcagatgaaattccccatgtctctagctaagagggcttattccttctcttgcttatacccatcacccacctgtcagcactacactcctcagtttcttccttatatcacttcttgacttttgcctaatcaggcactcagaaccaccgagtttcttcttgataaagtgcttaggagaaatctacatggggtgggggggtattatctcaatgggctacaccatcctcttccagctgcaactagttagcaccttgggtgagctaaggaggagatcccttttaagtcattgaagggagtcaccactagtgctggtgactgtgataagatacgatgaagccctcacttagcttcatttatattgccttttgccaaagtaactccaatccgcccttctcccttctcttgttttcagtgcttcttaaaatataaggtttagggcagcctgaagtacctggtagctgcagcttcatgaaagaattccaggcaggcatcagtgacctgttggagggtctctgtgattagccctttggaggtgccatattgcccaggtgataagcattctttaaagacccaatacttgaccactctgagtaagcctttcatcttaacattacctctttcgtgcctttcctcctctgcctgtcatttgtttcccaggcttaatcactcactccaccctccacttcactcctcccacaccagtccagttatggtaatttaccaaaaacatggatgcttactgtagactcccatcttttctttctttccaccagctcagatatcagtatccagttctagtaggaacgtcattcttcctctaaccctcttgtggaattgcagaacaacattctttcttccacttgatagcatgaggctccctctgcgcatgcatagatacccaccttgttggtacacatgttgccagaatgaccatcaggggtactaataagtctctttgagtcttttattgttattgtttggttttattttatttacaggttacttgtaaatctgactgccaattaatacttttcaaaactatcgtggaaatagaaagacttatatgaaaatgtttatggctctattattcatagtaagcccaacactggaaacaacccaaatagccatcacttgatgaatggataaataaaatgtggcatatctgtagaataaaatgcttactcactgatccctgtaggtttacctcaaaaacattatgctgggtgaaagaagccaagcatgaaacactaaatattatatgattccatttatatgaagtttccacaaaagacacaattacagactcagaaaccatgtcagcagtcacttgggggtagggatgaaagtgaggattggctacaaagaggcaaaagggaatttttaagaatgatgaaagtgttctaaaactgaattgtggttatgattgcatgattgtctaactttattaaaactcattgaattttacccttaaaaggtaaattttatggcgtaaaattagaaagctgttaaatattgtgaagatacatttttaaggtcacataactgcttttgcataattttatttcacatgtttttcagttacattctctttcttcctacagtctttcacccccatgccaacattttttttcagctccagtgttctttggacaaggtttcttaaacctgaatgtgcacgtgaatcacctggggatctagttaaaatgggattctgattcagtagttgtgggatgggaactgagattctgcatttctaaccaactctcaggtgatgcagatgcttctgttctggaaaccatgctttttgtagcaaatatttagttgtctgtctacttgctgagcctgtaagaataacttgatttcccctctaaataagtggaaacatccataacttcatccaacagcttacaacatggaaataaactgtttaatgaatgaattctttagttatgtcaatactaggtcctttgccctttaaaatgtttgttgctgctttctaccactttcagtggtcatttacattaagcctgatgattgttttggttcctcgaatcccctgtcaaaggtatgctgttattatggttttaggaacaagtatctctgcgaacagagtgttctgaagaaggagtttacctacattaacttccattagaggtaatgcaattcaaatacctgatgcctttattttaattttaaatacatctgtttctggaacactttgtactgggccaatttgaaatactatttattcctgctcatacactgtttgaggttcaaatagcaagggcattgtaaatggtgactgtctgcatctgtttgtgctactataacaaaatacctgagactggataatagatgaagaacggaaatttactttttgccattctaggggctgggaagttcaagatcaagccactggcatttggtgtctggtgaaggcttcttgctgcatcatctaatggtagagtgggtcaaaagtgccaaacagacaaacgctgtgttctcacatggcagaagagtggggagagccaacccacccgctcaagcccttttactagagccccatttctatccatgagggctcagtcctcagtaacctcctcctaaagcccccaccttttaaaactatcacattggtcattaagtttcaacatgggaactttggaggacacactcagaccatagcagtgagttggagagaaggcatggcctggtggaaaggacactcgtttaaaattcaggagatctggatgcaggtaagggttctttgggtacctccatgtgctaccataaggatgtcaccaactctcaccacctgtacacaaggaatggttttgccatgaacttcacctctttggcagtctgcttaagtctttgacttcaacatttaaagaaagcattttgaaatgcacaaaagtataggattgctaaggaaagcaattatattgaaagagagttttagctgggcatggtggctcacgcctctaatcccagcactttgggaggctgaggcaggtggatcacctgaggtcaggagttcgagaccaccctggccaacatggtgaaaccccatctctaccaaaaatgcaaaaagtagctgggtgtggtggcatgtgcctgtaatcccagctactcaggaggctgaggcaggagaattgcttgaaccaggctgggaggcagaggttgcagtgggctgagatagcgccattgcactccaaccttggtgacaacagcaaaactccgtaaaaaaaaaaaaaaaaaaaaaaaaaaaaatatatatatatatatatatatatatatatatatatatatatagttttaaaaatataaaaaaatagtgatatatgtgctttttgaaattaacacattaaataaaatctagtggccaatctaagtggtgatgatcataaatattttgagatctctgcaacaactaaatataaaagatctataaagtttatggataacaaaatgttaggttttgacaatatcactgtcatttgctgcttatgtctatagttgaaagaaatgctgaggtttaatatgatattagagaacatgaagatgtattatttaccaccttagtttgcatttcctctgtaccctattcattcacaacttgggagtctatggtcctcagaacatctgcaccaaaaattctctaaagtctaaaatttatcaattaactgatgattcgagtaacaaaatttccaatcctgtaatatctttaaataatttagaatgctatcacatagcttcctgtgaatgactctaatggggaagaatgacatcttttcatctcttttttaatagatgaatgaacttagatataatttgaagtgcttagcagaagtcttctaactgttcagtgataaatcttttgaaatcagatatgacagtttctgggagtctttttcacatcatccttcaatttagggaattaaataataaaatttacttgttcatctttcactgtgtaatttaagctttacaaaattacttgttagagaccttccaactttatacatacaagataaacttaaatatttaggctagtcctttcctgttagagatgaaccagtgaggctcattcaaacagcagtttgctaccactacacacctattagagtggtcaaaatctaggacactgttaatgtcaaacgctggggagcaacaggaaccctcagtcattgctggttgggatgtaaaattttacagcaatttgaaagacagcttggcagtttctttcaaaactagacataatcttgccacacaatcaatccagcaatcatgtcccttggcctctatgcaaaggaattgaaaacatatgtgtacacataaaaaatgcacacagatgtttatagcagctttattcataattcccaaaacatggaagcaaccaacatgcactttagtatgagcatagataaataactggcacacccaaacaatggggtattattcagcactaaaaggaagtgagttatcaagccacaaaaagacatggaagaatgttagaagtctcttactaattgaaataagccaatctgaaaaggctacatactgtatgatttcactatatgacattctggaaagagcacaatgatagagacaggaaaaagatccatggttgccaggggttatgaggagggagaaataaattggtggagcacagaggatttttcacttcagtgaaaatattctgtgtgatagtataatagtggatatatgtcattatacattttcccaaacccatggaatgtgcagcaccaagagtgaaccctaatgtaagggatagactttggctgattataatttgtcagtgcagtttcatagattgtagcaaacgcaccactccaatggggaatgtcgataatgcgggggccggggggggcggatatgtgtgttttggagcaggatgcatatggaaaatcttcatacctttctctcagtttggctgtgacctaaaactgctctaaaaattaagtgtgtgtttttttaaataagtgaaaccagtaaagattaagtgtcatacccaagttaggacccatgcttttccatttttttccctacagcatcttacggaaaggacaggaatccgaaatttctttgaaaatccaagacagtcagaaatatttgaaaaagcagaatattttggaaactaaataaaggccttcctgtctgtagaaatggattgtgaatcagcctaaagaaagagctcccttgagggttggttattgatgtcaaaaatgtcctatcaggtttagaatgcaaagatgaggctgtaagacagagactgcacaaaggcaagataagagagggcttaagtgatgtggaagactggcaaggacagggtcatccagtcctgcatgtcagcgaagcaggaggtctctaagcagcatgacatgtagcagtgatatggtcgtcagcattagattgcccactaagcaggcttcatctaatgcatcaaatagagtataatgtgaattatggtattatcctcatgatgtaaatggtgggaaggatggaactatgactattctattatttttaatttaaactttattttaactgtaagtaaattcaaacaaaccgttataaaacagaatactatgcacagttgcctgcatagatcataaaaataaatacataaataaataaaaaccagaatgctgagtgagtactggtggtgaaaactgcagggctaaaacttgctcaacagcgaactagaaaacactatggcttaatgaacatggcccacccctcctactaatggttttgtcaacttttggacctagaaattctaatatgtacatttgggtagtaatgatgaagtgggagttttgacattatgtcttagtacaattgtatacaactgactaaaagctactaatctgtaaatactataggaacacacagatgattaagctgtggattctgttttcaagatcttaagtagttaggtcaaaatcttgattcaaatccagactcttccagttcactagctaattatctagttgtgtgaccttggggggtctcttcctctataagatgtgaattataatggaaaaaaaaccttatagggtggttgtgagaataaaattaatttattggatagctggctctgtttgctgggttgacatctatcaatcaaccccataacccatttagacatgagttaatctacacagcattcagaaactgcaaaatttaggagtcctatacaaccccatttcatgctctgttatattataatcctttaatcagttatgcactctaactagatcttttgccctagatccagagtgggaaaatgtgatgagcttgttgttgcttttctatatgtctctttacctgtttaagtctgccagcttgtgtcctctcaattggtaatagtccactgtgcacatttgtaggataattaatacaactgtttactgaagcagcaaaatggagtcccatttaactattgtgagttttgctgtttttagattttatgataaactcttcatagcctgcacctgggagagcctggcagtgtgatagcatctacagataggacatgagactattgactgtcaccatagttattggccattggtaaaaaggcataaggttaaagatttttaatcatgtgttctgaaaacaaaaataatattctagaatccaagttaagttctttttctctacataaagtaatttttctgagtatgtacatgtttatcaacttatctttacatattatgttattgtaaaacataaaacgggaaaatttttgcttgaattgtgaaaaaataagttttgctgtcacactcttaatataggacacatattaaagtgagatagtactggatcaattccccaatttatcaaaagccaagaactcccggagatttgaaagcatgcattcaaatgttgtctgcatcctgggaactaattagagtggaagagagtaaaatgaattcaacagcggtgtatccaggagctgcacacgaggacttatatttcccacatgatataggaagttgtaaattacattatgcactaaattactatattttatgattgttttctatattaatagtaaagtatttcaaagtaacataatttacagatatttctgttttatatctagacactgccaacctcattcaatatatgcttaaagtctttacctgaaaaaaatgtctgaagtaataggttagctcaatctcttatcttctgggactcctatctctcagtattcacttccaataaatagcaggtgtgttgtagaatcatggctatccaacaagagaggccaagttatagctaccacgtcatattttcattactaatagctcattttagttttgttagcaaaagctgttttgtcattccttggattgaaggtgaagacagtatttcttataatttatttaaaaatcacaaattcactattgtaatttttaaagatatgacaaacattaattcagttttaaaattgagcataatataatttgtattagattgaaattaattaatgcacatttcatttctaaataatgattagcaaatggagaatggtataggtaaagaagcacagaaagaagatgggagaaagaaaagaaaagatgaaaaggataacagaaggaatagggatgagagatagagaaagctatctctcagaaggatatttagtagattcacagatgcatgtaagttacaataaatgggtttatcttctttaattaacactgcaaatcacttgagctatgagtttctatttgctacttttttggaaatattcattagttttctcattccataaacatatattgtacctcctggacacaaaccacagagctaaactctgtgtgggataacaatatatagtatatttcttgcttattagctattatttgcatctcttcaactgctccaacctttcaaccattgcattatccactcagacacaaataatttctggtgtctaccagtattatgcagaataatatcatttctgtactatataaaacccttttgagggcctgagaatccagcattcttcttacttcaatgacatgttattatagaagttattaaatgtaaaattgtaagctcaaatcattaaaatatctctttgacgtggcagcatgtaacagtcttcccaaccatcctctatttaaatctgcacttccagccacctcctttccactcactcctttgtttcgaagtgatatagattaagtatacctttcctgttatagaaattggatatactcagtaattattttccctggcctaagggtcagggaattgtacctacctagagcatatatatattttattctttccaaattataaaatgctaggtgagaaaaatgatgctttaattaagagctcaacacagcaaaatgcacatataatccaaaaaagagtccacttaatagaaggacgtaaatgaatacatatatcatattgctttgataccttttagctttcagagagaatatttaaggtgagtagtcttcatccaattccaggaaacattataatgttatggggccattgagccctttctactttagtagaaaattctactcagcagaattagcagcttgaggagcattgatgagtttgtggatttgctcaagaaataagttaaagtactgatgcaactctaattcttttcagtgatcaaaatgggaatgagtagtgattatgtccagaaactgatagataaaagaatataatttatgctcagcattggtggctagtccactaagagtgatgtgctgtctggagtgaactaaaagaataaggttatagtcaatacttttcttcattgtattcttgttttctttcttgcaccatccctgccccttttctttttcttataatcttctccgcttccttttgtttttaaatttagtgtgctatgttatgctggatagaagtccgcagtgaaagttataaggagattttattccagagaaatgaaaaaaagtcactctgagtaggtattaaatctagttatgttgaattcggaagctctatcactgtgagggaaccccaggattcttttcaggaacaatagtctttactccccaaacatgacatcattaggtcccttttatttcaagttgggcctaaatttggtgatgctattaataatactgttaatgttagaaagaaaaatccagctagttttatttttaatactttgatacaggcaaattaaataacattttcaggatactatagcacaatttcataaagtactgtgctccagtacctaaatgattctattaaactagattattttaaagctgtgtccctttttcataaaatataatttgtcattgactcttacatttatcaaatatttcaatgcctaataaatcccagatgctaagatgattttttaattactttttgttcatattttggaatgaaaacaaaaaaaaaatttttctcaatgtacatatacatatatttttcttccttttttttttttttttcttcttagacggagtcttgctctgtcacccaggctggtgtggagtgacacaatcttggctcactgtaacctccaccttccagattcaagcaattctcctgcttcagcctcctgagtagctgggattacaggcacacatcaccatgccttgttaattttgtatttttagtagagactgggtttcatcacgttggccaggctggtcttgaactcctgaccttgtgatccacccacctagggttcccaaagtgctgggattacaggagtgagccactgctcccggccatatttttcattaatgcttttacatattaaatatttacataccaatgtgacacatgaattttatatgtatatacattatatattttcatatacatatattacgtatatgtatgttccatatacaataatgaaactgataaatatatgtatatgtatatacatttttatacatatctatacatttatatacctaaattgaatatacatatgtcatataatatgcactaataaaaactgatgaatttgccttgtttcaggaaaattttttagaactccatttgggcttttgttttttgatatatttttattgaagtgttttttgacttgggtggtattgaagttggcatcatacatagtaacagcttcatagaataacattgaagttaacctgcttgtgggaaggggggtggtcagaatgttatatttattgtacactggttgtctgtgcaattttgataatgttagtcactcaaaattgttcttaaaaagaatattatatagccatatttcagattagcagagactggaagctattgcttgcatacaaatctttaacttctctgtaggaaaacgccactacatgtttggtgcccttaatggcctttcattggcccccagaattaactgtctgaatttgtgtgtctgacattggataaaatgtttatatttcttacctgggagaagctcagaaacacagcaataaaagtgaatttcaaagcctttggaaccaaattacagctgtctatagcttttatatttcttatattttaaaaatacaaaccaccattaatagaaatttctataacattttagacataatgatttacctatgataaatatctttgtagacctccacacagtttcttttgtattttcaaccttgttttcaagatcttctcaacaaggcaaccactaagagagctgtttttacttactgtagctgagtgtttctcaaccctatcaggcttcaaatacactttatacagcaaacatttgagactgtccctttgctaatttcacatgaaattcatagataatatcacctgcttatagtcataagttttaaactgtaatgtaataccttactataatataaagaaaatattgtaggagatactgtcaaatttaaaatatatgtatttcagcatgtgacttctcaagcatatccatacaacaaggcacaatgatgccgtatgcttgcatcttaggtagaatcattatgaatccaacagttacaaatgcagtttgatgtaggtgtgttgcattgggtatccaggcaccattaatgagggaaccatcaaagatataattttcttaaatgcgaaacaattcttggtaactgtcaagtaaaacaaaagataatctttctttggtttacatggtagttgcatttttgtaagagctagtatatggaatatacattagtgtatgtatatatgtatgtgtgtgtgtatatatatatatatgtattttgtatgtataaaatacagttacaacttaaatctagataatttaaatgtgccttcccacatcagcatatgtgtgtatgtgtgcttgtgtatgtctaatggagttgtgatttaagtgcagatgcttataagtaggtttttcatctacctgagtgtcccatgaggcatggaaaatctgtgcagcatgcaggataactcccttcttgtgtgggggactatcttcttgtgtgtaggagtgtctgtgagttttgtatgctaaataccagcagtacttacctttacacaccaacaaatttccagaattcctttgggatgcattgtgatccctcttcattaccattgctgtagtttttttgtttctccatttcattccatcactttctatctactctgggacccactttaatgtggtgtccactctccttacacatccagcccaaactaaaagaactgtattgaaaccgttctcactaaggtctctaagtactgcaagttgttaaatgctcatcgcatctaactttgaagtaaccgtagacatagattccccatctggaccacctcagtgatctccatggtaacacatccttcccatgctccttcttattctctggctttttttttttctaagtaatctttaaatattgtggttccttcgaacttgatcttatgccctttccagcctcacacacctattcctatgcctaaaattttcaactaaatgcaaatagcttctatatatttccagcttaaattcctcttccgagctccaaacttgtatattaattcaactgcctactcagaagttccataaccatgtctcacatgcatctgaaatgcaatatgtctgagattgaattcgtgtccttccgcccaaaacctggcttcctccagtgtttgctggctcaataaatgcagcaacatctgtccaattcctcatgccagaagcctaggtgccatccaggacacatctacaggatcatatagtcaatctgttactaagttctatatagtctaccatttattttttaaaatgcattactgcttatttaactttactgtttattaacttcagcattctaaacatacaattactgtttattaacttcagcattctaaacatacaaaaaaacaatattgccaattatgtttaagcacagaggttcttgaactttgattgatgcagtggctcttccctttgctgacaatgaacagttctgcagtttgtttaagaccaaagtttcagctgggtatgatagcttatgcctgtaatcccagcactttgggaggctaaggcaggaggattgcttgaacctgggagttcaagacaagccttggcaacatagtgagacccccaattccataattttttttttaattagctgagtgtagtgacgtgcagctgtggtcccagttgcttgggaggctgaggtggaatgatcccttgatcctgggaggttgaggctgcaatgaactgtgatcatgctcctgcactccagcctgggtgacagagaaggaccttgtctcaaaaaaaaaaaaaaaaaagtttcaaaatgacagcacttaactaaaaaaaatccaaacaattttcacgccagctgaccccctttgtccagagcaaagaatggcagcagaatgctatctgactatatacagaaacaagacaactaaagctaaatgggggcccattgcagtggcagcaggtccagcctcacagtgcatgcactgagctccagtttctccaaaaggcctcttctcccacagcctcaacacgaagccaggggcctcaaaagtttgtctctattttgttctttttacaaaagatatgtatgtacacctgacacctcaggatttctagcccatagccaaatagtaaacatcaccttacacatgtttttaaatgccagaaacatcttttaaatgccttatcatgcaaacagcaaagtgcacagtgtgaagaaaacacaagattgcctttttatttttaaaaatgtttggaaatacatataattttgatacagtttcaggatgctccagacacccatggccacttgacataaaccactgacaatttctagaccactttgaaaaactacaatatgattctgatcagattttgtcattaaacctagtgagggcagtagacacttctcaaatagatgtgtcagttacagcactctcctcctctaaagtattcacaaagagacagataaaacagtttttttttcatcctcctcctccccttcctctttgtcctccatgttttcttcatcttcctcttccacctttttccaggcaactttagtggggtgctttgagccatcaaactctcctttacacttactgtcagcaacgtccttctcatacctctctttcagcttctctgccttagtgatgtcagtctgctttgtcctgtcacttaagttattccacatctcacccagctttttgccacggatgccaggatttgcagatttgaccttgaagtggacttctgaacagaacggaaagaattcagatggtggccttcttgggacatcttctcgcctccctgagctggtcataatcgttcatttccccatccgaacctactttttctgcctttgccattttatcagatttatacttatctttcctagacactgtctttcacctgtcggagcacatcttgaaaaattctgctaaattgacagggacctctgggtttttctttttatgttcttctctgcacatctgcacaaagagagcacaagcagacatcttaccctttggtttcttggtgtcacctttagccatcctgactgtactgttttgctaatctgggcagtgtagggcatgatgccttggcttagtgctctccagcattgagctagctgcctccctgagaggcccctctctaccaattaaatagctcttacgtccatcagatattctccatttccatttcaccatcaacactgaactctgccaaagtcatcctcagttcttgctggagcttgtgtttcaaactaattcttaaccaacctgttttctcagatgctcccacttctttctattaccacttctaaatagatcagtcagaactagcttctgaaaaccctcaaatctcagcacatgggtctgcaagaaatgatccctgggccaaatctgaacaatcacctatttctgtaaataaagttttattagagcacagctgcacactttttaaagtaatattttctatggctgctttcacattacaacagcagagtgaggagttgcaagagacttgatactccaaagcccaaaatctatactgtctctttagaaaaaaaaaaaaaattgtcaacatctgcattgagcatatactgaatatgcagtaaatatataattaattgttttagatcatattttccaaacgcagcatagctctccttatagaccctaagactctatatggttcctcatagctttccttgtagacaaagaccttgtgttttcagaacttgtgttctgttcaggtttcaatcacgtgaagaaaagaattattcatttagcatcaataacagcagatgccaaaatagcgatttgagatagctttcaagtttgtgctctttgagagccagcttcgaggtagctgtccctcactcagacacctgcttgcgggcacccagttttgatattccttttaaagagaatgtctgagcattatctcacgttttctaaaacagtttaacagtccctcctccaggcagattcattattaagtgcataatgatatgaaggttcaggatggcctgaaatctggacgatcacctatttctgtaaataaagttctgttagagcacagctgcacactttttaaagtaatattttctatgacttttgattatggttgtgaaagtttccctgctaaggtgtgaactctgtatccaaaactccctagaacaaggtgaaaatgttctccgtaaagctgagctgcacttcctcagactgtcttgccatctgtctccttcaacaaaatatgccaatcaaaagtgtctggacacacagaacataggaattgttgatacatttaatttcaatttttgaagtagatacctattttatagatggaaacttttattgcattatagttagaagaagcattatgatcggttgctgtttttgaataattgaggacaagatttttagattcgtgcaaacagcaaatggataagtcccttttggtttgacacacttcatgtttattataatatccactgttattactattattttatatgaatattatcacattattacacatgtaacttatgactatcatattttgcagttaaatttgaagaatagatgtcaattctcatttgtttttatattttatatttccgtatcatttgtaaggacatgaaatagtctttgaaatataaattactttaggtaacttgaggttaccctgttctaaaaccatttaagtgacaaaggggagggtagtcccacaggaaagtgaaataaattttcagctgacacacaacccataatgattttcagatactcaatttttattcgagacactctttctgtctgcaaattctaaaatgctaactcattaaaataaagggccattttttttatgtctctatggagacgtgtctgtggagaagtaggtagggaacattccttaaaaatcgacattccttctatgtaaagtttacttaaaaggcaattcatttgtctgcactaagtctgataaaatccatatacaatcttctatacatgttatcatgcaaccctccttgtaatttccatgaaatcattactgtggacaattctgaagactatttttcggtgtccttttccccttgagttgttcattttgagcatttttataaagtccttagttcctaatgttcatttgtatcactgtccttccattgatctttttgctttgggtagtcttccaattatcctaagaatagtagactttgggaaggaagtgggaagggtctgccgggtagagcagaatcaacgatcttcaatccagacagtgagaaacagtaatgactattgcagactaatacgtgcatactatatatttatcaatttcccccaaatgatcggctgctcactgtttctgtcattgccacgcattatttaaattgacctaacgccatgttttgctgccttaaatcctttatttccagcactaaactatgcaaagagatcttctgctgtggcaaatcacctcagcagggcacttgcctacactgcttgcaggctcccctctgcttaccaagagaacagcagctgagtctggaaaagagtgaagacaggcttctgagatatcacatcaatgtcacacgaaggcactgatgtgacttctctatcctttgggctcatatatcctatgaaacttcaggtttgaaagacaaaatgagtatcagagagaacagcatgaatttgaaataagaaagatcagacagggagaaaaaaagtctccaacctcccattcccaaatggacttcaggtaaagaaaaagccaaattatgctgagacttgagtagatgttgaacaattgtgtacactcatgttgcataaaaaattcgctggaagtcattcgtatgcagcaaatagttattttgtgtttaccgtatatgtatgaggcaatctttaccttagattaactcattgagaaatgattaatgctctaattatttatacatctgccgagtagcagaatactgtatagttttaggaaacaacactttaaaactgcagttagctcagaattttgcaaatgtcatgccaaggtcgttgatgaagctgactttctcactgcttacgccagcctgcacagtcataagtttagtgtatacacacaaacactcacaaatacacatttcacttccttaatcctacatttcagtgacttaaataagcacatatctaaacagccttcccttagacacaggcaaatgcaacccatgattccacacagcccttaaaatggcaactcgcaagatgtacacaattttaaaattgtattagcctattcatagcaagattcttcattaacctatgtgcatattcaatgttgaccacatgccccccaaccccacccaccaaaagaccagttagagatctgagatgtggaagagtgctattcagtttagatatttttttctcatctattactttctagatgaactgtcatgagttaaaatgtcaataaggacacctgtttatgatcaacataattgagctattttaatctcaaactacttcatcgttaagatagttttcagctcagaggctgagataaagacccagccagttttctaggacacacatcattaattagacaacaaattcttacctccttgcttgttggttttacttacaggacaggaaacatctctatggaattaaattgctcactacatgctcctaatatgttttgtttttatgcttactccagggaaaactgtgagacatgttgagaccaggatttgttgttttcttttgatagaaaaacatagcaattcaagtcagcttttttcttttattagaatgcaaagttccttaagatcaaatacaaaaaaacagagtcatttaaaagtactgaaaggatataaaagggaagacattttaaactacagcttatcgaagaacagcgagtaacgttagcaagtactttcgtaactttcaaatcttaccatttactgataaatatcatgagttttccaaattctttgttgttgtctttatgtctttgaacaaaagactgctttttgaaacaacttcaagacaatgattattgaacaaatgattatttggttttttgaaggttcctaatttccaagctaacattttcttattgactctaaccatctctgtttctactgaggttgaacacacacacgcacacacacacacacacacacacacacacacacacacatatcaattcatgacattctctttagttagtgcctaaggttgcaaatcttcattttctttggtcagataatacattttcataatgaacaaatggagtgcaactctcaaagccagtacctaacactggaaagcaaaggctgaaatcaaagcttggtcagcctgctaatatgatgcgctctctgtcgactaatcaccttccaataaatatttgttctgttaacttctactgtggctcctccctcatgcccaaccctaccatttatatactgtagatattttatgagaaaattgacccctgtttatgtgcgtcattccagtcacccacaaacacacctttataaaggacgcacaattacatgtgacaaattaattggtcatttcattttgtgtccagaaagtactctttgaggaaccatagggcaagagctgtcctagccaccctgtctataaagataaataaacttaacccgtatactccagcatcctgctacctagaaggaaaaaccagaagcataaacaattaaaagtgatgtagcatagaatatgttgtaattcaagaaaaatgcattcagtaagtttacaaagaaacaacaactgtgtttgcacacacactgtctcatgttgtaaggtgggtattataattctaattttaaatatgagaaaaagaagacttgcgagaatatttcccaagctgataggcagtggagttgggtgctgggtctggcttttgtaattccagccccaagccctgcaccacagagaagatagttatcccgtggaggtcaggatttggaaatacttggccaaggaggccctgattaatctggacatagaaagtagagcaatagcttgaatgaccttgcaggaggggacagcaatcaggatatttttgtctgctagggctgccgtaacaatgtactaccaaccggggggcttaaagcacagaaatgtatttttttcacagttttggaggctggaattctgaaatcaaggtgccggcaggattgtttcttctgaggcctctctccttcactcatagctggctgtcatctcttgtgtcttttcatagtcattcctctctgaatgcctatgtacaaatctcctctttttataaggataccaatactattggattagggcctatcttcatgatcgtatttgtctttaattgcccctttaagaccctgtcttcaaatacagttgtactctgaagtggtaggggtatggacttcaatatatgaatttggggggaatataatttatcccataactgatggtaagaggccacaaaaacaaaatatgggggcataaggaccccccagtgcatgctcaggctcaacattatagcaaagtagacacagaacagtatggaaggtgagcaccaagatataaagggtcaggggaggcaggatcagagtggagagatctggaaggctacagcaaggtgttttatcgaaggcgttattgcaggttcttgctagagtgatcattgagaatttaaagaaatgaattttagtaatgggtttagtatatattaaatcatgttcatataacttaaaaatattaattttaagctatttactgaagaaaaacatgaccactcagtggaactttatattttacgatttctaaaaatattataggttatttttctaggaactgctgttaattttggccattactgccatatactttggacatatataaagtgttttttggtaagtatctgagattacatttaatatctacatgtagcacactttacacaagctaaattctatcgtatttggcattttttcctcaattcagctgtattttcagagaaaacacacaagattacagagctatttctatgcttaatagaatactgtctaatgatttctgcatgtagcaaaatccaactttttggattaacatggctacatggtaatcacccactaaatatttacaacatgaatttatctgtgactcacttgatgtaccgtgattgtgtgcgcatcctaagacgtgattcctgtactatggttgagtaattgtcatggcaggtttgcccctctagtgttggcttctcgttttgctttgtgctgcttttctctgctatccaggctgccattgctatttttattttctacttctgatggttcaggaacatgaaggcaagataaaaagaaagtatgtgttgccttactgccactattctatgatatgagtcaggggtatggaaaagctgaatttttaaggagacagcaaacctcacagattcaggggatttaatttcccctcctcatatcccagaaggtctaagttactagttacgttaaacaaaagaaataattaaacaatggagaagatgctatagaaaagtttcccttttcttttctttttaaatatacttcttatatgcagtcctaaaaggactttctctcttcttatagcttaacaatcaaacaacagcttagggcagcatttggcaaactgtaactgctggttaaatctggcctgtcccctatttctataaataaagctttattggaatgcagccacactcattcatgtgaatgcatattgtctgtgactgctttggcaaaatagtggtggagttgagtaattaatacaagcgcttttcagccttagagcctaaattatttactatctggccaactcactttttggtttaaggtaatgaaattttaatttgcacacaataatgtacatgttttaatatgtgacaataaaggttttgctgcatttatgcagtacatttttgaaattaaaaataaacttgtaatagaaatatagttctaaagagtttcaccatcttgtagatttttcaataattttttcatataaagtcaatacatctttatagaataaaatattttagaatctagtttataggaaatagcataaacatctgtttcgataaacttcccctaataaagacataccttgaacacgagctattgttttgcatttgccaacttttccatttcataattgtattaaattgctagagatggctttgtaatcaaagacattagaatattcagttgaatatagcatgggtttcagggacacatttttgttgttgtagtggtttttgtttttaattctctgctgctaggtagcactaaatccccaagggactcaaagatgagaaacaggaaaaaaatttccagctgtgaactgctgctaaagcagagaagccctgtctgtgatattagttcgtgtatcaaaatgcttgcgatttggccctagaaaaagggaccgctggcagtgttgtacataagtggtcctgcttggtttgcccatgtggtatttatctcagtcccttctgatcagggccagaaagtctacccaacaggaatattctatattgagtagcacctgactactgaccaaatcagatgttttcctttggtagatttaataaccgtagagaaagagagctgactgcaaagtgctaggaatgactagagactgagagagagcacagatgcttacagagagcctcagtagttactggcgggaaagagaaccgggggagagagacagtgagcaagaaaaggaggagagacaaagatggagaggaaataaagtaaaaacagatgaagcaaaaaaagaaattgagtcagaagaatgacagaatgaatatggtcagaagccaactgcacccatttatgaggacataactgcttgaattgctgatgtgacattggaagtttgtgtgtgtgtgatgcagtggcattccaattctccctgaaggtatttacctatctcccatatatttccatgtatctgcaagaagccttatcacctatgacagagctacaaacatcagagtctcactaatatatatatagctaattgattattttcaaaataaaatgtgaagggaataaatcacacaacagccctatttatggtttagcaaatgatctcaaactcacatatttagggggtcaggtgcgtcaatgagtgaatcagtttgggtgtaggaagtgatgggtcaggttgagggacagaagaggctgtgcactgctggtgggactgtgaattagtgctgccattatggaaaattgtatggaggttcctcaaataactaaaaatagaattgccatatgatccagcaatcccttttctgggtatttacctaaaagattcgaaatcattatgtccaagagatgtctgcactcccatgttgattgtggcactatgtgcaatagccaacttatggaatcagtcgaagtgtccatcaacacataaatagataaagacaatgtggtacatacatatacacaatgaaatactattcagccttacaaagggaagaagttctgtcatttgcaataacatgaatggaattggagaacattatgctaagtgaaataagccaaacacagacaaataccacacattctcatacagaaaagttttccttttcttataacttatatgtggaatgtaaaacacttttattctcacttatatgtggaatgtaaaacaattgcactcatgaaaacagagggtagatggtggttaccagaggctggggggtggaaggaatggggaaatgataatcaaaggatacaaagcctcagttagataggataaataattttgagtattttttatagatctgttgcacagtgtagtgaatacagctaataactgagtaatgtacatctccatatcactaagagagtaaatctgaaatgtttttgttgcaagaaaatgtcaaatatttgaggtgatggataagttaattagcttgatttaataattccacattgtattcagaaatcataacattgctttgtacttcatatatatatataactataatttgtcagtatacaaaaaaagccaatcaaattttttaaaaaatgaaaataggcaggttctactcagctccaactgattgttccatcaaggactatagggccccttgctaaatcttctgatttttcaagagaagctagaaatcacagctttatgtgaattctcctcatttttaaatgtagagttaattggttaaaacaacaaaaatgatggcatgaggggcaaagaaaatacttgtgcacaagatttgttttatgatgttggatttacaactaacaacaatttatatttttcacagccctcttgcaatggcagtctatttggggcataaatcaataacccttttctatgatttttttcctccacgaaaatggccttgattctagttcatcttgtgaaatgagatttcactgtgttgttcagagttttcatttttgctggaggcttgcaaggcccataccctcaagataggcagtgatgagttgtgacatgtatcctgtgcatcagttgtcaacctgagtgacactaaaatgaagagctgtcattttgtaccagaaatgtcttagctttatttcctgttgtttcagcaatccaaagcaatggtggtgtttgggtgtggaccacggctcttttcctcaaatctaaggatttcatctgaaaataggaaaatagctacagttcactgtagttgttaatctttataccactcttgccaattttgtttttctttcttcacttattctacttgcattttccttaaactctacactgttaagaaggtagtctcttgtttggatattatttcctgttaacaattataggtctttttattgtaatcatttagatttacatatattttctcacttgtcacaaaggccaaataaggcttcagtaataatttctatttatgttcattgggtagtacatttcattgcatcattctctagggaaagttagtactgtgttaatttcaggttctaatgccaatatataaacacatccagcttgtcatttgatatccagggaacattacttttcaagtgggttctccaaatgaatgggtttgactcagtcatctcatttccttaatgctcacaaatttttagacacatttttacactgtgggtttcagtgaacatttgcacattttactcaaagttggtcagaagagttaaaattaacaataatgggtggaaatggggtaggaaggtcaaaggtcatcttgagtgatcttggtttttagaaatctgccagtctgctgtgccttagcagttgcagaaggccatgattgactctctccctaataataatctccttgcttgtaaggaagtattggagaaaggagttgaaagtaatattagcaagaagcctttactaatgagtaggtatgcttgtaaagtccttcacttgaaacatttgtcaaatgactgtcctttgtcgactactatattttgagaaattccagaggaaataaggtgagacttcagaacttacaaaaaaatgtaatgtaaaggttaggagtggtgagtgtagaaatgggagaataaaactgtcagctcattaaggctagaaaatccagcatacaatgcttcacaccccaaaatattcatgccgcctatatttcatgccggttacagcaccttacagtacattttcatttgagcctcacaacaaccctttgaagtaggaagtgccatccgcagagtatactcagaagggacacacatttgagaggttttgtgtttattcaaggccacccagctgtaaaggggaagagacagagcacaggacttccttgcccaccaagtgttcctttacagccacttacaaaaagagctaatgcttgcgtgttagcaaatatgtttcatcaacattttgcaaattctttacttcatctgacttattgatagaacaaaagaaaacacagcatgcactttcaaatgcaagcacctatatctttggcacaaatatcgataccaaattcacgttatagttggtacatataaaaacaaatataatgaattgcaaggttctgcagatttacggctaattactcttttctacttcttcatctatatttatcataatgtgatccaagatcaagttgcatcaaaatcaccaggatccttacataaaatactcattctccaacataagcccagaactatttaaccaatacctttatggtggactcaggtataaggcattaaaaattttccaaaaagggacaatgaggcatgctgaagtgtgaagaatgcacctagctttatggaaattggtgtttaacgtctaggtggtgtatttattttaacaatgtacacttaatgatgggacacacatagatagttaaaagcaaataaatagtacccaatgggtagttttttgcctttgcaccttccctccttcccatcacacaatatacccatgtaacaaacctgcacatgtacccactgaatctaaacaaaagttaaaaaaaaaaaaagaaaatgaatagagccagctagtaaatctaccccaatcctagttctcttcactcaaatgtagttgactatgctctagacattattaggaacagcttagttcttaaatgtttacggcagttactcttattggatataattacataaaagatggaatgccttgattactaattttaaaaaaggtagagtggataaaagagagtaaaaagaagttactattttaaaaaataaagcttggtaaaaatgagatttgggagaaattaatagaaaatgaaaaaaaaaaccaaaatactagaattagaacctcacctagggaacaaactgaaatgattataagatttgatgatagagatgggacccagaggtagaatctgaagtcttaatatcagaaaggcattgaacatctggttgaagaccaaaagcaaggagaagaagcctctttcagtatacattatttgcaatgaagaaaaaaataagaataatgtaagggcattattattaataataatatgaataataatgtaaagtcatttaaatattaagaggagattctgaaaattgaggcataatagaagctttttaataaaaagtccttattaatatatataaatgttattggaatttttaatttaatatacttttttatcttagaaaactaatactatctataaaaagtttcatatatttgttttaaaattcgtcttctcaccccagtttacctcgggtagtcctgagatcctttgaattttactggaaccttttaaagttggagaacacatgaacctcaggtgcatgacagcttacgctttacattttgaagtgatccaaatgattagagaagaatttagaaacttacatgaatcaactttatgatggtcagagaatctgtgaaatatgtttcaaaaagaggatctaatttagcagagcgtaaggggcatgattttccaggtgagtcacaaattatgttttgggctgggaaatgaagaccaaatctcacaggactaacctggagatcagaaactggggcatgaaggcacctatgaatctctgaaaagttgataatattaggtacttgctgacctgttgaggaagaaagaacccctaatggttccagaatcacaagcctggagacacaaaagagaatataagtggtgggaagcatggaaatagggaaaatgatgtcttaagaaagagagctccattccagacattaattctagatactgaaaaatttgaatggaaaagttcttacacatgttcaagtacaccacagtgaaagagaaatagaagctctaaaatcagagacatctgtgagtcaccctggctaataaatccctgaagaaagatttggaaaaccaaatcatgggtcgttctgttgaaggaaagaagataatcttataataaatgtacagagtatagactatttatctatctctgtctctctctctctctctctctgtctctctctctctctctctctctctctctctctctctctatatatatatatatatatatatatatatatatatatagtcaaaaaaggcacaaataacattaaagaattaggatttctcttaaatcaggaagaatcctgggaaaaaagggcaaagaaatatccaaaatcctaacaagtagggctgttgatgcttccagaactgaaaagaaaattcttctggttaatatcacaaacacaaactagagaattgcatagaaaatacactttgagaaatccagttaaatgcctgtctctcctcccccttgtatctagttttgaacttgatcacattcaaagtaagcaaggaaggcaagcatgtaatgtccaagtcacattaaaggaatcgaatttgtctctcttacaacaacatgcttccggttcataataaattaatccagcattctatctcaaaactgcctctttttattatactagcagatatttcagggttttcctcagtgcttacacacatgtataagtttcccatagggaggatgctaattacagtccccagaattaattttcctatgtacagtcctcattatcatttaattgctctaatctgacagagacagcctggacagggaaatcagaaagcagacatttcaacaatctcaaagtagctgggtggttatcccatatcactgggtcaccctgccctggactacctgcactctataccatgctagcagaactgccctatgatttcaggaaaaaaaaagtggaggagggggcagggggcaggggtggtggctcacgcctgtcatcccagactttgggaggctgaggcaggtggatcacctgctgtcaggactttgagaccagcctgaccaacatggcaaaaccctgtctctactaaaaaatacaaaaattagctgggcgtagtgccacaagcctgtaatcccagctactcgggaggctgaggccggagaatcacttgaacctgggaggcggaggttgcagtgaggtgaaatcctgccactgcaccctagcctgggcaataagagctaaactctgtctcaaaataaatacataaattaaaaggtaattgaaaacagcctggcatttctgtgtggtttaagcttttcagtggacagagatgagtaacaaggtgaaaagaaacaccaaacccaagcacagtcccacacattgctggggtaacagcagaagagactggaaagatgcttacataccactatggatgggtgggggcttggaggcaccgggtaggaggacagaaaagaagacaggatgcttgctacccagaaagaaatgcagctgacatgctctgaggagaggcagtcagtcatcagaaagcacagggagtttctcctgagaaccatgtagggttatgcgttgaggaaactgagctgcttgcagacacaatcctttttttccaggggtttgtaactcagtggaaaaacagatcagtaaagttagatttaaaatacagtataaggaacactctaataaaggtaagtggagagagttatgcgatccataggaatggaaactagctggttttaaaggataaaacagcggttcatccattcattcatatgacaataatcataaaaatggacagtgacagctattcaatatgctagatggtactttacagctttcaaaacacattcattagagcttaactttattacaacactatttgaaatcagggaaagtattattggcttagctttatgatatactcttggacagtgtgttgaaggatacattattgtgacatggatgatgtcacattttctgaattatagcctagtgtttttttcacattgcttattatatattttgaatgagcacctggaaataaagagcagaattagccttggattctgcattttagataatacatagcaaagtggaattgggaagacaagacagattgtatgttagaaggtgggacaggattaaatagcgacatgatgtgagtcatcagtgttgacctccctggcttgtgtgttcagaaaatccagtgtggagacagttggttcttttcaagtttcttaaaaggcacaacaccatccaacttccaccagcctatataaatgctatgtggcttaattgtcagcaacaataagagaatacacaagaatcagatgaactggaaaaagaaaagctttatgggttgaattctgcctccttcccccaaatttttgagggtatgttggagtcctaacccccaatatgattgcctttgaagataaggcttttaaggaggtaatgaaatcaaaatgatgtaattagggtgggccctaatccaatttgattggtgtccttacacaaagaggaaattaggacacagacatgtacagagggaagacctgtgaggatacaggggaggatggccaagaagaagaggagaaggcttaggagggaacaaccttgccaacacttagacttccgtagaccttagactttcttagaccttagacttttttagactgtgaggaaatacatttctgttgtttaactccccgtcctccacccctccaaccatggtattttgttatggcagccctagaaaactaatacaaaaagtattttctcttcatcatcaagaatcatcagaaatctctaagcaaataattaagtctttccctatgtaaaaattcctgttctcagagaaatgggagaaaacaaaacataataggtagttcatgatgacagacagacttagtgaagatgagttctcttagaattctgggaggtgaggttgaaggtgtggtctaatctgtgagctggtgtcttactgccaacacatcagaccagcagtgggcactttggtggtggttgtgagcagccagcgctgtttgttggttatagagaaagggtgacatccagtggctggttctatcagccaagctcctggacactgactcagggtgcatgccagatggcagagaagggtcttcaggaacatggatgaatcttatgtccagttcagttcctggcaggtgacaatgaaacttgggcaaaatgcagtgatcactctatgtcctaaaacatagggagtggggtccatgcattgttattaaaacattgagaatacactgatagcaaagagaagcactataaattaacttaatcttcaatacaccttacacttgattctctctatcccgtagaaaagactcaaaaatgatttatgaaaggaggaaaaaaaccctctgaacacatataatactatagagccagctactttgataatagaatacggttacaatatataaggtatcctactttaaagatagatattgataatagataatagataaatagatagataggtgatagacagataatgtagtttagtttaaacttaaagtttaacttgtagtacccagttagtaatatcaagaatggcttaaaatgacacagctgcaaaccctacatacatcaagttgcccagctcttagataatattgttttactttatattatctactttaatattgtttttctttatttattaatatagaaaataatattgttttctaatagcttttgctttgttttggtttgggtttttttttttttaatctttgggagaagctaggctttgaaactgtggatatttaaatagagtctgtcatgatcagctggggttgctaaccctcaccgcaaatattctttacaaagcagaagggatgctccctgcctttgaataatttacatatctatatataatttttaaaatattaaaactaaagatataccaatgtcacatccatgtatgcattatatgtacatttggaagacatgtgcttttttgtggcagatgtaatgactgcacttctcattctactcaaatagagtacctaggagacaatgtgagaccctgaacacattttagcagatctggggttggttgtttcctcttcatgtggaacagtataaataaagctagaagtgatcctgagaactatgcatgaaatagatgtctggggcccctttcatgacctcactagcctattgttaaagccaccttagcatctgatacttcccccttgccacacttgatcccatagattgcgtatgcagtgatatgagtgctgcaccaaagcaaagatcaagtctaattcattcaacagtgtatgtctattgtcttaaacagttcaagacacacagcaggtgtttaataaacacatgctgaccctggaaagccatgagtaaaattgacaagtgggacaagagaaagattagataagaatgggaaaatagctgggaaatgggaagattatattcattatatgttaccattcaaacattgaaaaggttaaataatcttcagaatgacatcaattaaactttacataagactaaagtctaaagggaagaaagggtaatattagaaagtaaacaagaaatttgctccctggagcacaaatatgttaatggtttctcctggaattgagcaatgtggcaacccaatcagaaatggcttcatgaaggtgggtcataagtggagccttgtgggatctgaataaattgagagaagaagaaactatattccccaaaatgatcagaatgtagaaaattttctggcagcaaaaatgagtagggcatatttaaaagacttctctgaactagaggatattaaagaataatagaagttaagatcagaaggtctattgggaccacattgtagatagctacttctaagctatgatgttcaaactttgaactgtgagcagtgacttgttgaaagaactttaaggaatatcaatttggcactaatgtacaggataagttagaggaatcaggaaacaaagagatcaatcaagaagctgctgcagggctacagtaaccaaaacagcatggctttggtacaaaaacagacacacagaccgatggaacaaaatagtgaactcagaaataagactgcacacttacaactatctgatctttgacaaacctaacaacaacaacaaaaaagcaatggggaaaggattcattccctagtcagtcaatggtgctgggataactcactagccatatgcagaagattaaaactgggcccttttcttgcaccatatacaaaaattaactcaagatggattaaggacttaaatgtaaaatgcaaaactgtgaaaaccaaagaagacaacctaggcaacaccatttagggcaatgtcaacaaaggcaaagattttcatgacaaagatgccaaaagcagttgcaacaaaagcaaagattgacaaataggatctaattaaacttaagagcttctgcacagcaaaagaaactattaacagagtaaacaggcaacctagacaatgggagataatttttgtaaactatacattcaacagaggtctaatatctagcagctataaggaacttaaaaaatttaccaaaaaaaaacctcaacgccattaaaaagtgggcaaaggatatggacagatactttttttttttttttgagacagagtctcgctctgtcaccaggctggagtgcagtggtgcaatctcagctcactgcaatctccgcctcctgggttcaagcgattctcctgcctcaacctcctgagtagctgggattatgggcatgtgccaccacacccagctaatttttgtatttttagtagaaacagggttttcccatgttgtccaggatggtcttgatctcctgaccttgtgatccacccgcctcagcctcccaaagtgctaggattacaggcttgagccaccgcgcccggccaacacttttaaaaagaaggcatacatgcaccaacaatcatatgaaaaaaaggctcaacatcactgatcattagagaaatgcaaatcaaaaccacaatgagataccatctaataccagtcagagtggctattactaaaaagtaaaaaataacagatgctggcaaggttgtggagaaaaaggaatgcttatacactgttggtgggagtgtaaattagttcaatcattgtggaagacagagtgacaattcctcaaagacctaaagacagaaatgccatttgactcagcaatcccattaccacagggattacaaattgttctactataaagacacatgcaggtgtatattcattgcagcactattcacaatagcaaagacatggaatcaacctaaatgcccatctatgatagactggttaaagaaatatggtacatatacaccatagaataccatgcagccataaaaaagaatgagatcatgtcctttgcaggaacatggatggagctggaggccattatcctcagcaaactaatacaggaaaggaaaaccaaataccacatgttctcacttattaagtagttgccaaatgatgagaactcatggacacacagaggggaagaacggacactgaggtctttcagagggtgaagggtaggaggagggagaggatcaggaaaaataattaatgggtactaggcttaattaatacctggtgatgaaataatccgtgcaacaaatccccatgatacaggtgacctatgtaacaaacctgcacatgtacctgtgaactcaaaagtaaaatacaaaataaaaccacaaaaaagcagctattgtagcaatcgaggtgtgaatgcacatggatttgaaatatgatattggcagtgaaaatagtaaatttgatgtaagtgcaatatatagacataatttaaggaagaatgaataggatataacaattatttggctaagtaattaaatatggctaacgcttagtgtctgggaaggaaaatttaggacaaggagccagttggggacatagagtaatactgactttgaggacataacgaaaaaaactcaaagtgagaatattcagtagacattaggagacaggactggaattcaaactgaaggtcagtcatagaaatgcaaaattaaggttatgaagtcatcaaaaagaatgagatctccatagaccaaaaagaacatgtactgaattttaagggatacctttattcaagggaagttggaaaggagagccagagaaaaatgaaagcatagtaggctttattgattcaattgctggtttggctctttgcttatataaacattcatttaattatttatcttatcccagctgctgaatcaattacctagtaatattaaccacttaactaaaaatcaacaagtctgtaaactctctaagcttctttaaaaactattttacatctgtgttatgtggagacaaaagtatcaaatttggaatctaaaacccagggcttaaatgctggcagtcacttcctaagtgtatatctttagattggacaagtttagattgggcaatttaaattctaaaatcagaggcttcagctctaaaatgagaatgaaagatactccatattttttaataattaaatgagataatacagttaaaggaactacgtcagccctctgctatataccatgctagtccctgactctttcctgcttttttagaaaatgcaacaattgaaagtctactattcgatatatgtatgacactcatgtattcatttagtctttgagtttctatcgtgatcaggcacagctctgatgctgagaatacggtagaaaaaaagacaacatccagtcttcctgaggccagagactagtggaacaaagcctagtggaagaaacagtgaactgaaaatacatagaaattcaggcagtgataaactctttgaagtaaaatagagcagaataagagaatggcaagatcagtttgggaaggctctatttcagatgtagcactcaagggacatacaacttaactgaaatgagtgagtgagagagagagagagacaaagacaaagagagagcagggggagcatgctatggcaagacgcttggggagggaaagcatgtggggtggacagcaagtgtaagaaccgtgaggtggccatgagtagcaagcgcgaggatcattaggaagatggacatgtgtggctgatgaggcacgcgcacgaaatagaggcagagttgtcagcagtgggaaggccatgcaggtgcatgggctgtgggaagacactggagctcttagagcaaggagccgtctgcttcggaggaacgttagagttcctaaattcagttaatgaaatgcttgttaaacccctgcattgtgcttctccgtgcccctgatctccccttccccatagcctgtgtatcagtgctgtgtgatgagttctgttctgggtgaactgcacaaagacccttcaaagtttgaagggagtgggaaaaatcagttttaaaggtttaataagggtttcttaaagaaaaataataaagacatgtcaagtgcaccacccctttccccacctgacttcaaacaaagagaaaatcccaccatgtgtcattatacactgtcatttagacaaagacactgaccatgacaagtcaacagtggagatttggacttcatgttgaagaataaaagtagcaaagactttaagttgtagattggcatctttagattgacattggcatagtgacttcattttttaaatgctgccagaatttcttagaaaaaaaagttagagcatatggtgattcacaagtgcctggtggaaaattataaaatcagcagcagtatttctggctgctgagatcctgtgaaccacaactaccttcaaaagatagagggtagcaaaggaagcaagggtgcctttctaactccacacagtttgtagtattttacaacttgtttccctttagcaagtactggcagttctatcaatccaacaagtggggaaccttattaataattatttattttagccatatctcaactttaaatagtaaatattgtaccaccaccagtgtatcctttccagatacccaaactgatgctcagggatattaagtgaattgcccagtgccagtcagttaagaagtagctgaatcaaaatccgaatgtgcgaccatcaggtttcagagtctatgcccttgatactttaccatagaaccacagagaagggaggtttttcaaggcatgatacttgctgaaaataaaaagatacaactttaaatttgtccaagaaaaaattactaaagaaacacatagcccatgcagtttctctaagagattctacatgacattattgtttgctagaaagtagggtgctagttgttgcttttgtaaatataatagtcaaatcatgttaccattaggacacattaaaaatgtcgaattaccttgggaccttatatgaacatattaagataataatgatagtgttcagtgcaatattcagatcaatagtttaaacccaaaatatttataccttcagattagatgtatgcaaatgcattgattcatgtgtcttttatctgttgtttacatttggagaaatatttgagaaatatttcaaaatggaatttatataaatttaaacacataatggttttatgtaaaaatattgctaaattacattttccccttaattcttatttcttggaaacgtgccttagtcgctgaaatattcatacattaacacaatgaaagaagtgaaccttactaggctttgactatcaggtttgctgttggtttttgactattgtgaaactatagcctgatttctaaatcaggaagaaacgtgtattgttgttaatatggacacatgacatatttgtctgcctgacttttgatcccagctacaacctctggccttttcaaatgattctttaatatcacataaagggaggtgagataactaaagggggtgattccggactaggaggcaagggagggcagataacatggtgctttgaaatcttctgtgacttttcagtcacttatttcattaagtgatatatctcactagaagtgaggtagaacataacaaatccatgtttgctgggcatatgttatgacaacagagaaattcacagactggtcttacccggcaggggagatggcatgatcatgaaaatggtttttcccagggtgagcttacccattgcattctgatgtgctgatttccgtgatttccccaaatgtgggaaactcactcggctgcataattggtggtagtgggggctgtgttatgctctctccttgatgtcagttttttttttttctaaaagcaaacaaaaacaattggcttcagacattttgaacaaaacaagtagaagctgttttctttaagaaattacaagcagtgtctatctatagatacatacatagtcacacatgctcataaaaacacacaaccacagcaaaattcatgctgtaatctataaacactttttagaaacggggagaggttgtgtgggcctaaagagccaggtggggcagaacctaaaaggaccttgagaatgacaaacatttgaccatgggaagcaggacaggagaaggatgttacagccagtgaccatagcataggtaaaagcaaaacaggtaccaaggagcacactgtacagaccattcagcaaggagcccagcctgactgccaggaagaggctgcctgcaggaatggtgtggaagaccatcagctgcagactgaggcaaggcgatggaggtttaggcttgcttcaataggtgagctacttacacaaggagaaccatgatgaaccatgatggaagtggtgttgcaacattcacatggtgtgggttgtactgggaagagatggacaatagggtggcttagcgatggcaacgggcatctttagatgagaagaatgtacgtgagatttcgaaaaaaatgatcaacagaattgaactgtattgagcactaagctagtataggcagacagttccaactgggtaaaataacattataaccacttcttaagtaaataatttggcagccggactttcctttgcctcattgactgaagcaagcatcccagacatttgatttaccaggcactctcacgaagtacctcaaggatgtgcttccgagcatatgttttatcacagtttcattacagtgtgcatatagattcttcccctctgggttttattttattttattttgagatggagtcttgctcttgtcacccaggctggagtgcaatggtgcgatctcggctcactgcaacctccacctcctgggttcaagcgattctcctaccctagcctcccgactagctggaattacaggtgcctctcaccatgcccaactaattttttcgcatttttaatagagatggggtttcaccatgttggtcaggctggtctcaaactcctgacctcgggtgatccacccgcctcggcattttggggtttaaaggaagtttaaaatctctctctaaccttgagattaaattaatgttattttagattcaaaactttctcctgcacatagcagataattaatgtaattgaaagagatttgattcccagatgttgatgcatctgtgatcccaaaggcttccctcggggagtcattctcatttgcagttagagacacaatggaaggacagcctcaaagcaggcaaacagtgtcagttaaattcagatgtcaaacctgggttttggtgacagccctggaactctcacatcagcttctgaattttgcaaattatgatattaccaagactgctcaacaaaggctggcatcttaataaaaggccattcttaattgctcttcctccgttactcactagtgacagaatacaaccttcttataacaaaagaagtttgcactgactcccatccagagaaatctaggtagaataggggctacaaaacaatggtactcagggccaggaatttagaagttagatgaaaagttaagacaaatactaaatacctgccaaaggccccactgtctaataccatcccctttgagatgactatttcaacatatgaattttgggggaataaagcagtcagatgatagtactatacaaagcttgaaaaggtacaacacttcgccttttgaaacatctataactagaagccaaataacaaaggtctttgggagttgattaggtcatgagggtgacacctgcatgaatgggattaacaacttcattttaaaaaaggcctgagagacaacccttgccctttccaccctgtgaagacacaaaaagaaggcattgactatgaaatggaaaccctcaccaaaaactgaatttgccagggccttgaacttgaacttcccagcctccagaactgtgagaaataaatttctgttgtttagaagccacccagttcatggtattttgaatgtacaaagaataccgaatgtactaagacagtattgcacataaattaccaggagacacagaagagtagctatagaacatgcttcatgcgaccagatctcagcaatgagatgtgctgtggaagaaccatgggttttgttctgcagctgggattttcttatgctcttcttgcctttcagtgactctagctggagctgtggtcttctccattttgaaggagacaccctcgaaggctgccttttgccagctgagatctgacactgatttgtataaattgagaggggatttagtctattgtcccagaactgaggatggagtccctgaatggcaagcttcagatgaaaatacagtctgatgattatccatgtgtgccctgtacgctgccttgagaaatgcatcctaatgatgatggcttcaagttaaggtggtcatcataacaccaggtaattttcattttggcgtttcacggaacatctacctttccagaggacagttctaaattttaatagcttcacgttctggctgattagctgacaaatgaagttaaataaccagctttcactcagagagatgatgcagaaagaaagctgccctctgatatccccactgataataatgtgaagtgtggaaggcctcagatgtcttttctggatacctatgtgtaattttcatctatattaatggaactcgtaagcgcaccacgtgaataagaaaatgaatctgtagaaggtagtccctgttgactaggctggttttgaatttcagaaagttgtgtaacgcttccatgaatttttctttatcttggaaaaacattgccatgcaatgtattttataattactttcagaaatacagcgtttctaattgagaagtttgtgaacgtggcctgaacattctagctcatgtgcgtaattgatagcaatgaattattttacaaggtaaagatgtttcccccttggctcaataactattaatatcaaatgaaagcacacactggcatcagggggaacacagcctcctcacccttccaatttcatttcacattacctgccaacttccaggaaatcctttaggcatcattacactttttccctaggccccctatcctcccttaagacctccactctgctatactaacctgcacagggacagggaaataactctaagtgcatctcttttctttcctaagatatgttgcttaaatgtaagggaaagctacttggcaactctaacacacacacacacactcaccccagaaattctcggctcttcacaagagtgtgttttctccttatggaagagttgatgtggttccatttataaaaatagcagctatttaaatgggaaaagctttttctcatatcatctgtgggccaaatgtttttctaaaaacatacattctctttttctagcagagaagacaaattctaaatggattcaaggttcatcaaattgctaagttttctttgggttaatgcatttgacaaccaagttcacagaagtgccaaaatgaaaataagtaaattaagaactgttctatctaatttctttattagaacacacatttttgtgtgtttttcatgtgtgtgcattatatttataaactgatgtgattaatatataaactgtgttaatctgcaattatttttatttcctacatagaattttatatggtgatttttaggaagttggaacacatagtccatataaattgtttcttaagctctgctttctctacttcagggaagcaaaaagagaagttcatatctcttctttccaatccttttttttttttttttttgagatggagtttcattcgtgttgcccaggctggagggcaatggcacaatctcggctcactggctaatttttgtatttttagtagagacacggtttcaccatgttggccagtctggttttgaactcctgacctcatgtgatcctcctgcctcagcctcccaaagtgctgggattacaggcatgagccaccgtgcctggccctttccaatcctttttaagctcatgtattcatcaccaccttcataagttccaatttctctagcttatattcagctgaatatgaccttgaaattcaaagattcactctttatccaatgcaagattctgtctatcatgcatattcactgctgtttaaacatttccactagtgatgacatcagactatgcaggggatggggtggtgtaggggttgtggtaggcagggcttctaaaccagcaagactaccttcattcctctggccgtattaaatacctataagagctaacgaaagcattgagattgctatggatgaattggttcaagattagttcattatccctgtccgcctctagcaccaaggctgctctaggctttaagcctcccagtgaaagactctggatctcgactggtttccaagggtagagagaaaattacaggatacattctaattattaatattacagatgttgtccttacattgagacacatctgcctggacagtggtcaccatctgctcctctggaactacatacaaaaatgggtccaatcccttaaataaaatagttcttcaaatatttggagacagctctgttctgctaatcttagctttttcagactgagttgtatcaaattctctaagtattattggtagcatttctcaatgacagtagcaattgcttatgttaccacagcactttggagtttccaaaacactttcacaactgtaggttcttaattttataaatgagaaaactggggctcagagaggataagttacattaccttaataattgatttaacaagtactaatggagtgtctactgtatgcttggcacagcgcaaaatcctaggatataggagataatacatcaagaatggtgccccccttctagctcttatgatctagtatgggaggaatacatttttaaaaattacagatgatacccagataatactcacacctggttgggactttagcccaagtcttctgtctctaaaccaaattaacagaccattaacttcagtacagcagacactgcacttggattcatgaaacccacttaagctagtctttctgcaactagctgtcctggtacaagctcttcttaagatgtaccttcttcattccataactaaatgtgtgaggagtctgtgcatgtgtggttaactcagaggagaactctacactgatttctataaaattgtattttgccattttctttctacctctctaagttgccaaccttcttttgaactcttattttatcatttctcacacattagatcttcctctcagtttctgtccatctgcaagttttatgaaattgtgttcacctatatcactgacaagaaaaaaaaaatgcccacaagtgcttggtgtgaaagaaagagcacacatttgtcattagtcgcagattagatttcctattagctaagtgaccttgggcagataacatcctctcccagagcaactgattactcatctgtgaaatgaggaaatcaggctggagaatttctgagggatttccctgcattaaaagttttataattcaatatgttttaaaatgcgaggctgagttttaaaattctttccttctgagtgtggagagaagaaaatgcagaatatgtctactgatatttactgataggcatcacctcctgcttcactaaaggaaggaaatacatcagcaaacattggtgcaaaattcatacaacaggggccacttaagcagaatagctaccacacctttccttaatcaaaaacaatggcttcatgaagtccctgatagtccatttgctatctatatattttttatgtttagaaatcaacagagtaaattgattataaataactaagccaaataaatgattaaaaatagttcataatttggagtcttcagtgagtcctctttttctgctctgtgtaggaaaattatctttgattctataagtggtagccttcaaatgcttcttccaaacatttgcctaataaaagagaatccttattttctaaccttaacagaacgccagaaattattttagtctttgaacttgaagaatttgtgggatcttctttcttaacattgcttcattgccacataatgtatctgtttaattcagccttatttgggttgcaatatgtgctataatttattcctgtcgttttaaacttaccaattagagtgaattcaaatttaattaatagaaaatttcgcccacatttaactagagataaatgagaagtaattatagaaaccaaagcttttctagcctgagagaaaagaaaataaagagagcacccaacccaagacataattaatcatctcttctacatggaaagtctgtcctgatactatagtttaaagacagactgtctaaaatgcatgtctatgtaaaggcatgttgcaactattttatttttccattcagagacgatttgctattaattatatgaaaccccgtggtggcttaattagcaggcaacaatggattggcttttagattgtgcagttagaaaattctggcacttttcagcttttaactttaaagctagaatttatttttgtctttgaacttgagttatttgtgggttcttcttttttaatattgcttcattgtcacataatgtatatgtgacataacataactatagccaaattttctctggtctaggaagcctccccaatgtcctcctgaacacaataattcatgtcttatttcaacaatgccttttctttcctgtgaatgtgaatggctgttgtatttgaatatattacttatgtattttattgaaatgtatcaagagcagacagaaaataacatctgtttgacaacattgttttatacatgtatatgggctggaaaggtggtacaagtacttaacttgagagtttgtctaaactctcaaatttaagagaaaaattttaatccctctcctttaaagtatgtatatttttatttcaaaaatcattaaaatgtgtttcaaaaaaaaggaatctaaaaccaagtatgcagaatccctagaattccacacaactcaagttgaaaaaacttcggaaagttttacctaaaaatgttttcagcccatttcctgaattcatagatcagaaaatcaggctgtaatttatctatgggccagattaatattcaatattacaacaaccctgattgagtaagcatccagatgtgtatttgcctgaagtctaaaatttactacaagtataattttattgaagctgtcaatgccatatttaaagtgttcattttagttgtgtgcacagacttactactcaacaaaattgggccacatgagtgataataatctactaatgctttaatcctgatttttagcctagccataatgaggagaaatcttttctcaggtcaatacttgggtgggggggcatttttcacattgacgattaaagccttgtaacatgttaaattaacctttcatcatgtgtctcattagcctcaatgtatttgccaaagctttcttctactctctttgtggatgtagagatagaatgctaccacactgctaatgaaatacggtgccaagtggagctaacactgtaggggcttgaatctttccatgggaaagaatatgaagatccatgctgatttgcaccaaacatccttctgcactacagcccccatgctaagatatttaagcattaagcatcctctacaatatcttagatcaattaactcaacattgattttactagattgaaaatattcacacagttttaatttaatttagtatagtttaatataatttaatatagtttaatataattttaaatctgtgtgttttgtttgtttaatatagttttaaatctgtgcattttgttactatttgttgtatatttcctcaataagttagttccttgatagttctatgtcattctttgatttaaataatgttcctagaacactgcagtagatatttgagtactatcgattaggttgtttagaaatgcagtgtgttctgtccatttgctccaaattaacaattttttgaaaagcatcaggtttagtatcttactattatgctaacccattttagcttttgtagtttcttacttggtatttttcactatgcactttaacaggaattactcattgatatataattgacatttctttcttgttctgtagttacagaaatgtcatacaagaaaagaaaacaattagatgactgttttgtcttattaataatttaagtactttcaaccctgagctgagataataggactaatactagtatttcaggctattcttttttagtgcaatatttattttattaatcattaaatgaaatttaacctgtcattcattatccaaatgtttgttttaatgaatcccacttataaaacagtatttaatatttcagttaaaatgtttgtgttttgtagtctcactaatatatacaataacgaggtaaagataaaaatatatagcaaacatgagggaattactaacagcattaatgtaacagcacacattagcccacaatgaatggtttgtacaaaaattacagttagacccaaacaattcataagtgattcttccgttatgaatgcaggaaaatccacaggaataaaatcttgatataaatgtacttaaaaaaagacttttatgtttttacagcactcttagatgctcagaaaaagtgagatgaaggcacagagattccccttatgccccttgcccccacatgcagagtctctcctgttaccaacatcccccaccagagtggtgcatttgtgacaattgatgaacctacatgacgcatcattagcacccaaagtccatcatttacattagggtttatccttggtgttatacattctgtgggtttggacaaatatatgatgacatgtatccatgattatagtatcatacagagtattttcactgccctaaaaatcttctgtgctctgcctgttcattcttttccccaccccagttcctggcaaccactgatctttttactgtttccattgttttgccttttacagtatgtcatgcagttggaatcatgtggtatgtaggcttttaagattggctcctttcacttagtaatacacacgtaagtttattccatgtctgttcatggattgatagctcatttccttttagagatgaataacacttcattgcctggatgttccacagtttacctatccatttgcctactgaaggccatcttggttgctttcaagttttggcaaattatgaatgcagctgccatagatatttgcatgcaggttttcgtgtagacagaagtttttagcattttagggtacatatcaaggagtatgactggtggatcatgtagtaagacaatgtttagttgttatgagaaaccatcaaactgtcttctaaagtggttgtaccattttttttttattcccaccagcagtgaatgagagtttctgttgtctaatactttcttgtcagtatttgattgtgtaagttttctggatttgagcattccaaataggcgtgcagtggttgttttgatgtgcatttccctgatgacatataatgtggaacatcttttcatatgtttatgtgccatctgtatatcttctttggcaacttatctgttaaggtctttggtccatttttaaatcaacttgcattgttttttattactgggctttaagagatatttgtatatttaaaatcagatatttctattgcaaaaaaaaccttcctcccagtctgtggtttctcttcacataatgttgacagtcatttgcaaagcagaaatttttaattttagtgaagtccagtttattaattatttcttccctgaatcatgcctttggtgtcatatatgaaagtcatagcacaacctaagttcatctagattttctcataggttaccttctaggatttttataattttgcattttacatttatttacgtgatccattttaagttaatgttatgaaggacgtatgatctatgtttggatttatgttttgcatgtggacgttccagttgtcccagtaccgttagttgaaaagactactttttctttattgtattgcttttgttcctttgtcaaaggtcagttgactgtatttatgtgggtctatttctttgctctttcctgtgctccattgatctatctgtctattccttcaccaatacttcactgtcttggttatggtaactgtatagtgagtcttgaggttgggtagtgctagtcctctcactctttttctccttcaatattgtggtggatattcttggacctttgcctctccgtgtaaactttagtatcagtgtgtcaaaatccaccaactaagtcactgggattttgattgggattgaattgaatctatagatcaagttggaaataactgatatgctgacaatattgagtcttcctacccatgaagatggagtatctcttcattcatttggttcttctttgatttttccattagagccttacagttctcctcatatggaccttgaacatgttttgttagtaaatgtacttttaaacatattttcttcccactgttttatgtggacattcatcaagctttttttttgcttgattcagtcttttcagagtatgattttaaggtatgtattatttttaaaataatagatattttatcttatgtacagttagagatttccctgttgacactaaaatatttacatgttgttgatttttatgttttgcttttatgttcgttttagaaacaataatgcctactctaaattatgaaaacaatgaaatacaaatatgggcatcaaagaggaaaatgaagaagctatttcaagctgtcaagaatatactcttagctctgtattcaaaagtacttcatttgtataaaaaaattaaattcaaatccacactttaaaatttttaaaaaagtaattgtttctctcaaaatacgtatggtcaaatgaccatttttttccttctgtgtagttgcttattttagagagctttgtcccaacagggtagcagagagataatgattctactattgtctttaaattcttacccgcttctctgccagtcatcgaactactccctctactccaaaacttggtctgctctgctctaaatcaatgagatattgctatctgtctgatgcaggttacattccagtatcttatctttcccagtttgtattgcaataatattggggtaaaatattgcatgggtttacaaaagggattcagtaaaatacaagcacacatttagagcttgttcttggatttgatttgcattgtcagtttggtgccttcaggagtcatttcacattctttgcttccacatatcagcttttagtaaagctttgctctatatcggtagctttcaacctgtgctgcacttctgaaaccctagggagcttttaaaaaaagaatgatctcgtatcacaccagaccaattaaatcagaatctctggaggctggcactctggcatcagtacttaaaacagctccccaggagattctcaaaggcagcgatggtgacaaaccacagctctgtacaatagaacaggctgctcctttataattattaatcatagtgtatattaattcatcatcacatacgtggctagaaaaaaatttagaacaaaaagatatgtgatatgtaaaggcctacgataattcagacttctttgaggagagcttttattttattgttattcttattttatctcttgtcaatataaattgagagaataaacagacaaacattacaaattagtgattaattgcatttaaagcctagttaagactatttaagactattatgcataatacaggaaaactacctgtattatttatagtgggtgccttctgaaggatctgaaggagaatcagttctatgcctctctcctcattcccaggaggtgcctggcattccttggcttgtagacgcatcaccctaatctctacctctgccttcacatggtgtcccctgtgtgtgtgtttttgccccatgtgtctcctctttttatatggatgccagtcatgagatttaggcccaccctaaactactatgaccttatttaaagtaaacttaactaattacatctgcaaagaccacatttccacataaagtcatattcagagttccaggtagacatggatttttggaggacactcttcagcccagtactgcactcatattactcaacttctccactgcttttgatgctgttcaacactcttctgagaactccttcctcccatatcttctgtgtctattttgcctgttttgctcccttctgtcataatgcccctaacaacatattgcaagagtctgctaaataaatatctgcttcctcttattgtctgtgcaatcctggagggcagggagttgacttattcaggtctctatgtgaacaccaaccaatttttagctcatggaagcccgtagtaagaattggaaaaaaggaagagaggaagaaaaagagaaggttgtgacttctgcctccatggacatcatgaggaaacacacacgtgccttgacttgatggaactatgcaattcattttttaaaatattggcatttcatactcacatcaaatatcttgcacctgaatgatatcattccagctagtacagtttctggttataaaattgtagatgaggattaatgattattaagcccggttttccaaattattgaggctcacaattttgagaagtgtgatttccatagatttgtttaagaagtaaaaggctggccaggcacagtggctcatgcctgtaatcccagcactttgggaggccaaggtgggcagatcacctgaggtcaggagtttgagaccagcctggccaacatggcaaaaccccgtctctactaaaagtacaaaaattagctgggtatggtggcaggtgcctgtaatcccagctactcaggaggctgagggcaggagaagcttgaacccaggtagcagaggttgcagtgagccgagatcgcaccactgtactccagcctgggcgacaaaagcgagactccgtctcaaaataaataaataaataaataaataaaataataataataataataaataaaaggcttctatatgcacagaggatttgtttcacatattgattctcttatgtggtcttcatttcacaactgtatgaatctgtagcatgaaatacatatttggcaagtaaagattctataaaggaaagagtaggaaggtataacgaaccaattctgagatttccctaagcaatcagttcacctgcttgcctccatggaggccatcattgtcttctagcacaatttgtgagagacagcaaggcatctttttaccactattaacctaatctatggcagtgttcccagggaccaatgttgtcagttgtagagtaatgccatttagaggctggatgggtttacagttgcagccaagcaagggtctgcattgaattgacccaaacagggaattttcaagtaatttctctatctttgtatgtgtgagttttttagtagtcaattcaattttcattagcttgtcaactctaatatctgacaactgaaatataaagtagggaggagaaagagcagaattaagagaaggaatatatgtgccagaggcagagtattatcattgtcctgatgtagtcatgatgacctaagtcatcctttgatattgctttcatataaaggttgtagaatatatgaaccaaatcaaaatgggacaaggagagctccttgctcacaaaatgcctctgatctattgtgtgcataaagcatgactttatgacaaacacatagagactctagatgggggaagttacagtccttgagtgattttcgtattcaacccagtgggatcactatcatttagtggtatattaaaatgctaattctcatccaaggtcaaattcaactccatacaagctgttttaaaattcagaattggttgctttatgaaaagtaaatttgagactatttggaaataaagactatttgaaaattttctggcttccttaacttcagtacctcttgccattgtgtcacagcttgggtgtggtgggggaggtgcaatcttctgggtagagaccaggaatcccactaagcctatatcgtatgggatagccctatgacaaagaatgacatggcccaaaaggccaatcatgccaagcttgagaaactgctcagaataagcagggagagtgaagaaacaagctgatgctcaaactagtgaatctcattttgttgttaatcgccccttttctgcaacacttgtgggttagggaaaataattctaaagcaagagcaaagacagagttgggagatcaccagtgaggttcaattttccgtcacattcactctgctccacacctcagataatcatgtgcttaactgcgaaacttgcttgacaattacagaacactttctcacccattactaccttgatcctcacaattctgtggggtagtaggagcagatgctgaaattgccatacgcaaatcagtgaactgaagcttagagacctccagcaggggcagagggtcagcggaaactatcccagggttcagccaacaagaaagtatattggaatcagagtattaaaataagaataataaaaccaactaaaatttaccgtgctttttatttccactcagtgccaacaattcttaacagtgtcagtgatggatccctgtgccccaggggacagacttcttactagcttctgccactttggtcagctgctgttctggggaggttaactttcttacttcaaattcacactagagaggaaaaggaaatgcatacatataggaccaaatttcactcctgatgtctccacacacaaagctccttcaccatgccagtctcaatctgctgctctggggaggttaagttttgtttgtttgtttgtttgttttttgagacagagtttcattcttgttgcccaggctggagtgcagtggtgcaatctcggctcactgcaacctccgcctcccaggttcaagccattctcctgcttcagcctcccaagtagctgggattacgggtgtgcatcaccacacctggctagtttttgtattttcactagagatggggtttcaccatgttggtcaggctggtctcaaactccttactctcaggtgatccacctgccttggcctcccaaagtgctgggattacaggcatgagtcaccatgcccagccaggaagttaagtttcttacctcaaattaacgctagagaggaaaaggaaatgcataaatacaggaccaaatttcactcctgatgtctccacacacaaagttccttcactatgcctgtctcaatcttgtcattaaagtggtatttccttattaggaaaaaaagaactaggtccttaaaatactgttcattccatcccatgggttgagtacattacatattgacagtggtacattccagccacctgagacaaccaatcttatgccaatcagtgctacagagagcaccccttgccttacagctggcctaaccacagctggggatgactgactggagaatgttgtgatctttgactttgtcacaggtaaaatggtgtttctaactaatcacaggtctctgtgctgtgcctttcacttcatcacactctattctctctaattccaaccctgccaaactcattaggccaaatttgcttacttctgtgcattctacacacttccaacaaaccctatgtttgcctttccttgtgatgataaagagaaatggcagttagtggtctgaaagatggcgtctgacctttttatgatggggctgaaggctggatgctggaggcagggtgtgtgtttggtgcagcactgatattccctatggcagtgtcagagcctgcctaaatacaacctactgactagcatgaaaatattcctctgggcaagagggaaaaatgtgacaccatgggaggtaggatttgacatgatacggatttggaaaaatgaaatgtgacaattgctaattccatacagttcaaggaaaactggcctatttcaggttcccagcaggtatttaatactgaagtgtaaagaaaggtggcaaacttacaattattttgattgaactatggttatctccattcaactaagggagcatttgcagcaatgccgatgggccagctattttggttttgccatattgtttcatttcttgacccacgttacataatcactcagaccaacaacaactgactgaattgttattatatttatatgtattacctaagtatatatttcctgttagtctttcaatggatagctcaaagcagatagagtgagaaggacaattatgcctttgcttgatttacttgaatataatgcccctgacaaaggtatttttgatataataaatgtgtgagtttcttgtttagaatcttaaactcggtccgaaggttgggattttgcacaatggggttagaagaattcactgaaacacttatccagctgaaggcatatattgccaatttcatatttgtgtcttgctatttcaaaatattgcattgccaggcaagatttactgcagcattctgtagcttaaccctctttcacataggcacacatccctccaagcttttccaaagcatgtttaacagtgctactagaaatcagacaaaatgctcctaccatttggattttggctttaccaagtttattaagtctctatcaatggagcaggctactcacggcacagcacagtacctcacatggttgctacacagatcatcaacctatactgtttagtattcagatatcaaaatcagcagaatcaaaaagggctggagttagctggttcctgtccaattctaactccctggcggcctctctcttagggactcttgtgttggtttgtgttcccagagatgggagcctttaattgtgattttaagccattagattatgaactgaataatggcagagaaatgcctacccaactgccattagtgaggacaagcgttgttttcttgataaattgtaatgtttaattttttaattgacaaatcataattgtatatattcatggagtacatagtgatgtttttatatatagtgtacagtgatcagatcaaggtaattagcctagccatcatctctaacatttattatttcttcgtgtagggaacattcaaatcctccttggtgctctttgaaactatatattattgttaactatagtcattgctgctaacttgaccaagaaacctaaataagcatttgtctatagtcgacctttctgcatgcctcagaacagtagaaggggacttgctgacagagacccacagtcacgtggggtccaagttttgaactttcccctgactggccaagtgacaggcagcagtcactgtggtctttaaaataccccaaaatacaacatagattgtggtataactttctcatctgagttttccaactagcaagaaaatctctatctatgtgtgtcattatgtctcatttttcctcatttttaggcagtatataagttaaagaatctggtttgtgttttctcctgcatattctgtgatttatttgaaggttcgcaaattatataaagctaaaagttatttttacatgtaaactacatagaatcacatagcattattttgttgttttactatgacaaatgtctctaatttaaggcattgggccttataacctttgttagtaaatggaattggagaagaagtgtgcctaattaatattttggtttgaaaagtaagattactgtattagaattttatccaaggattaaatttttaatagggtatttaggtgaagtaatactttttttttcatccttcaagagagtaattaattctacaaaatattaagcctgctgactttgaatatttttaaatgctttagatttattagacaaatgctcattgtctacctgttgtaggctactctaggacttacattccagtggaagaagacagatcataaacaaataagtttcaaaaatcagtgggtattgggaagagaaaaataaagtaatggaagcaagacggggaataccagggaggctggaaggaattaaagaaaatactatatcaggtgatcagcatgcaatagatgctcagtaagcacttgttaccatttgaatgagtacatggatggatgaggtggttggttaaggcaatttcagagtatcacatgccaaaagcagtttaagggatggggagccactgacggcttttgatcaagggaacagcatgaacagttctttgagcacgtgaaacactggaaagccattttcaaagtgcactttatgcttacttttcatcgattttgttgccactttaactctccctgcgacagtctttgtgactctgaaaattatcatgtgaataggcatcatttaacaataggtattgatagggtgaatattaagtcaccaaataagtgaaggtcttagacaaaagcctttttaatagagggtgaaagctagacaggaagcagtgaacgtagagtaagccccaaatagatatattttatttcccagactctaggaactgaaatgctttcaaagaatctgataggaatagtcttgcctttcattctcacgtactggttcatatttcactcaggtttgtttccatcaaaaatagttccatctaaggatactttgttaccctatgttgtatgaaaaagtggattttctctttagttgctagtactgtattctgtgcggaaaagaccattggagtcacccctattttttgcaggctcaggggttggtattagatgaagaaacacaagatttctctgtcagttgggaaatcctttttcctcttaggagtttattaggttttttagctgccactaagtttagcttataagaagagagggaaacagcctctgaaacttccaggctgatcctttcatttatctaaattccatttctacctctgcagaaaagggctagataacaaatctgatcctcttttctctacagtaatagctcccacccaaagactattataaggctaaataggacaggatcttaaggactgagaagtgccatagagaacattgcctcctccctcttaattttacagctgagcaaactgaagcccaaaagattaagttattttcccaggagtcacatcagtaagaaggtcatatgtaaaattaaaataggtgagacagttattcattgaatgatgtgaacctgtctttccaacctagggatcagatgttaagaatcgtaacaatgggtcggaagggtaatgggcactcagagaatctgtatgaatcccaggcaaccaagctactatgggagagaagagaaatagcccagccagatacagtctgcatgggctgcaccactggccccacctccgctaactgcttattgcccactgatgcgttatgatctttagccatcctgatcactcttggattcatcactgcattctctactccatcccaggttccctaatacatgtacatatatatgtgcctcaccccctcaagattcagactcccagttgagagcatctcattggccacatgacatcatctacggttccctaattgctggggttagtggaaggggacagaaaagttagggataggctcttacctctcacctgtcttgtgactctacccaaatcaacgtgtgtttggatgcagaattgtcaaaatgacaatactcacgataactctgtgcagtagtagctctgttctgcacttgactcagaaagcagtcatagtcagagctctggcatgctctaaaccaagatttggttggaaatttgatctctcatggaaaaggtgcttttgttattgttgttttctcatggaagaagcaaccaaacatctgttgaatctttaagtcagattgtctcaaagcatgttggaaacaacacctacatcagaatcatctagggtgcttattagagcagatacctcatccctcaacccagaactgctgatttgaaattcatggggcccagatacaaatgcacactgaattgtgaggactgctgatctatactcagtcactacatatgttcctgtaggatgttacatcctttcatggactttttcgatttgttgccaaccacatagagaactagaaagttaggtcaagaaataagagaaagtattaggtttagatttctgggtgccaagcaagccctgcaattatttagttattgtgtctttatggttactgtatctttattgttactaggtccacatagttaccatgttatgctctacaagggcagaagagtaaaatatattaagctactagcaagtgctcatcatactcacactgaaggaatttgctagcaaaagccatatttgcattctaacttggtgcagtgatttacaaagtgtggtccctagacaaacagcatcagcatcacctgggaacttgttagaaatgcaaactcgctcctactctgtccccagacttacattttaactagctttctgggtgattctgatgcatgctaaagttagaactgctgctctcagcttccatttccttgtctgaataaaacaatgataattgatccttcatagtttttctttagattattttctgttgtcattataaaactaagataatgtacaaaaaggcacttagttcaaggtaagtgttcaataaatagtaagcatattattgagcttatatttaatttacaaacactgctcttattttctaattgtttaacttcaagagaatccacaggttgcctacaatataagcagtcatgttagatgttttatatatataagttctaaatgggatgcagaagttctaaaattgtgatacttaaccaggaaaatggcagatttttattcttccattttagaaattaggaccaggctacttacttttctactgtcatttaaatccactttaaggtattcacaatgactttaacatgacattaataagcttagtgggtctttgaatttcttaatcccagtttcctggggctaaatacaataatctgtatctcttcatctttgacacgctgataaaaatccctgaacctggatttgcatttggttttcaaaatcaatcattttgctattcaaaggcaaggcaattgagtgaggtttgagattgaaatacatatcaaccccactagagggtgacctttatctaaatcagggtgcatataaagtaagggcatcttctgtagccatctcataaaattggattgtataactgtttactcaaggtgaaggagaggctgagaagtgattcttacatgaataattaataactttcaatttctaaataatctattagtcttgtgggaatatttaaaaccaagctattgcaaatttctcagtttgtattttaggataaaattccttattaataaattcagctctgaattttaaaattatctgcttcaattccaattcaaaatatattccccccttttctcccaaaagacacacacaactaaacatatgagaaaatagaaccccaaatttgtttcataaaaacaagcaaacaaaaggctataggactttgttaagttttatatggtgatttagaaataagacaaacatattctctagataccaaaggagaaaaagaaaatccaaatgttcacatagtaattagagagctcagtttaggtcaaccttaagaaattaatgttgaacaccatatttggtttatcttttatagttcagatttagaaagtaaaacatttgtgttataactcctctgctaaaatctctcggtttgatatcagagttcaatgttattcttaaaaccacctcaataaatatttttttgtagtacttaaaatttcaactcaaaatttgcaacactatgaatacaagtaatatttatgtattctgagcactttttatactaacttaattttttaaaatttgatctttaataattattgacagaaaaaatctgggctcaggatagtgccaattgtatgaaaatatgtagattcaactgttatttgcttcttttctaggacagttttttgtttgtttgtttgtttgttttttgtttttttgttggtggaggaaggagtcttgctctgtcacccaggctggagtgcagtggcacgatctcagctcatggcaacctccgcctcctggattcaagcagttctcctgcctcagcctccccagtagctgggattacaggcatgtgccaccgcacccggctaatttttgtatttttagtagagacggggtttcaccatgttggccaggatgatctcaatctcctgacctcgtgatccgcccacctcagcctcccaaagtgctgggattacaggcgtgagccaccgtgcctggctttaagactattttaaagagtgtttctagaacactgaatggttatcttacaaataaaaaaaacaactaaactcatgcaaaacaagactacggcaattaaacttggattctcaggtacaaatgactttcatttttatctacctctacaagccagaaaaatagcatattataaaaatgcatttctattaaaacacaaagaaaggttttatgtggcatgaattagtctaaaataaatttttaactttaatctaagttcataaggagatattaactttggaaaaaggtaagtctttgaaggatgggtggctttatcattattgtatttttgaaggaaggttgcagtctgaattgaaacctttcttccaagaaaattcagcctgctgtgctctcgtactaaaatagtatctgtaacaatggcatatgatttttatatagaattgggaagagctacactaataacttttacaatctctcttgttcatgtattatttacctgagaatagctactcctgtctttaagattaggtactttttccattaattaaaaaactcccattttaaaactatagaagacgttcttgaaaagtgtatgtgggttgagaataagcatatactcttatcactaacccagcctaaagctgacatggggctaaactttcctttgcaaattagagttgaaagagaaaaaatgcaattcaattacttcatgaggaagccactcagactttcccaccagttgcagactaatcagatgacaaatatgcctaattgtttgtcaactgataagatatgacagtcctgtccatgtggagaacagcaattcaggcagtttcttcaattctctctccagtttgagatcaaattaccccaatttttctgaattccttgaaaatttgatctgatttatttttagccaactcttttgatcattattttttatttactcattttttttggaagagacggggtattactctgtcacctggagtgcagcggtgtgatcatacctcactgcaaactgaaactccgaggtgcaagcaatcctcctgattcagcctcccaaagtgctgggattacaggcatgaaacaccatgcctcgcctctggttcttcatgtgtaacgtaaagtttaagaggcaattgacagacataaagaaaattgggaaagaatatacaaggattaagagggtgggtagtgtgaagtgagaattattttattcttatgttatgcatctttgtgaaaaaacgtagctaacgtgagctattctaagtatttctagaatgtcttctctgcattcttttgaactaaactcaaaagtaattttaacccaaagtttgatatttccagacattgttatgattactatatcacatatagtaatgtttctgtagtatttgtttgtataagtttatatgtacatacttagatatttactccttcctgttttcttccaacaatgttgatatgccgtataagttcttaggcaaaaagatatgacatttaacttccatttctgttaggaagtgtattctacttagcattttaaccctagtttacagttaaatgagaaccgagaactgattttttctccaagtttaataactgtcatcttcctcttcatcattattatgagtattttggattttcagattctccatttatagaatggaaatcacaggaactgttcaactatttttgttaagaaattattattatttttttctttttgttatggagtcttacttcgtcacccaggctggggtgcagtggtgtgatctcgggtcactgcaatctccgcctcccaggttcaagcaattctcccgcctcagcctcctaagtagctgggactacaggtgcatgccactacgctcggctgagttttgtatttttagtaaagatgaggttgcaccatgttggccaggctggtcttgaactcctgacctcaggcgatccacctgcttcaccctcccaaagtgctgggattacaggtgtgagccactgcacctggccatttgttattgttaaaatgaaggtatactctagtgatatggcttaaacacattagaaacactgacaaagatagagcaacagggaaagatactgtctgagcagagctctgtgataactcttggcaacaaagaagaagctggcttttctctacttttttattaaggcaggaggaaacacacatgggtggatggctcctttgtccataccatctgcactgaaacagtgaccatgcggcaccctggatcagcccctaggagccccagcagctgaggagcttcagggagccagagaaacagcctaggagacacctaatccaactccaaactaggaagatgacaacattcatcctcaaaacattcttaagagtaatctagctagcacgaaaaggcaaagaaatggctattccaggcacgcgggcatacgtggtctccagatttggccgctttcttactttgttttctattttgttttgtttttgtttttttcatgggcagtgttcaatggcctcatctggctactttcttcaaacataggtctccttgcctggcatttaaaggatgttttttgagcttttactcaataacgagtaccagaaactctcctacactgttgagataaacaaggaaattttttttttttttttgagacggagttttgctcttgttgcccaggctggagtgcaatggctccatctcagctcactgcaacctgcgtctcccgggttcaagtaattctcctgcttcagcctctgcagtagccgggattacaggcatgcgccaccacgcccagctgatttttatttttagtagagacggggtttctccatgttgatcaggctggtctccaattcctgacctcaggtgatgcgcctgcctcagcctcccaaagtgctgggattacaggcgtgagccatcgcgcctggccaacaaggaaattttaataagaaaaatattggtttaaattacattttcaatgacaacaataaaaatttgcaaaccacaaaatccaaaaaagcaaatcaatatttaggaacaaaatactttaagactttaagttgagaaggtggaactaaaatagaatttaggtcttcttttaccaccattcaaattacagaccgtgtgtgtgtgtgtgtgtgtgtgtgtgtgtctgtctgtgtgtgtctgtgtgtgtgtgtatttgatcatatataatatatggaatgtggtattactgaattgcatttgcatgtcatattttttaattgggtcataccattaaatatatatcacttatatatttaaaatgttgcaagagaaagataaatttaccttaattccaaaagaattccttcatcctcactaacagaacctgcttttattagggggtcatatgtcctaattctggaagttgatgtttggttaaaggctactaaacaattatcaaaccataattaaactgtgattaatacatttcactttttatatctgtcatagcagccccacttcgcttatccagtgattagtctaggtgtggttatgtgcccctggttctgaacattaagataaataatattttttagaaagctgctgagaaactattttctttttccaaaaagatagccattttttggccctgccctcttctagcctacttgggatgctgttctatgaaaatataatgtttggagctagagcaaccattatgtgcgagaacgtcatcaataacttagaatggcagaagggaaaaaatagagagaacatgagttcctgatgaactcagaggcactgatctaacactagaagcaccaaggtttagagactttctgtatgaaaggggctcactttccactgcgtaagccactgcagtttgggaaatcccaaattcagctacaattcccttgttgctaaaagcattctgaaatgatacagagactgactttgccaagtactttcatttaatatcatcattcataatattatttttagtttaatatcatcattcacaatattaagacttgtttgtattttatacatgtagattactgttcttttgtattttatgcaactgattaaaatttgtatagaatatgttaaaaattcatttacatcaaattctaactatttcattcttctctggtcaacagtgcattagactgttgaaaagataaagatgatataaacatgtttttgatgttatttctagtgaagcaaaaacaagtacttcatatttctatttttctctttaatggttgatatttctttacttacagacttcatttaaaatgtgcccattcatatttactgataggagttaaagtgtatcaaaggtgataattaaaagtgaaataaaatatatggtgtagaatgctgtttaatctgtttcacaattgagttattttaatgaatcaacatgaatattatgttacctctatagatcagatagaaaaaaaaattctccacagtagtctctgcaaatctcatattctcacaggtatgtgtccaaggatggagttggtttttttgtttgtttgtttgtttttgttttgttttgtttttttcccccagagaaggtttccacatctcagcattattttttttatatataacattagggaatcccatgaatgctatatttagccaataggaactagagcaggagtcagcaggcattttctgtaaagtgcaagttaagtgttttaggcttgtgggtcagatggtctcaactgctactcctccactgcgtttggacgtcaaaaacagccttaggcaatatgtaaattaatggtcttggctgtcttccaaccatactttccttaaacagttggcaggctgtatatgacctaagggcttgttgttttctcactcctgacctagagattccatttttgcttcgtcaacctgggcttttaaatgtggttcttggaaacttaatgtatgtattttccctgatgcataattgctgagaattcctactgtggaacttattaagacatcagtgggggagcctttgcagcacctacgacagttctgcctccagaccaacatcctcctccaccctgagtcaaatttctcttttaattttttcaattaataaacttttaaaagcagttttagctttacagataaattgagcagtaagtagagcgttcccataaaccccttttgctcccatccctccctccacctatttcccttattcacatcttacattagtatggtacaaattttataatgaacgagccaatattgataaattaatattagctaacgtccatagtttacattagagttaactctaggtgttgtacattctatgggttttgtcaaatgtataatgacatgtatctaccattatagtaacatacagatagtgtcactgccctaaaaatcctgtgtgttcacttactcatcatccctccctctctccaccctccccctctcctctagaccttggcaaccactgatatttttactgtctccgttctgccttttccagaatgttatatagttggaatcgtatagtgtataggcttttcagactggcttctcttacttagtaatatgcatttaaggtttctcatattttttgatggctttataattttcctttatcactgaataatattccattgtctggaaagcttgtttgtatattcccctattgaaggccatcttgattgctttcaagttttggcaattaggaataaagctgccatgaacatttacaccaagtttttgtgtggatgtaagtttccaactcatttgagtaaacaccaaggatcaaggtttttagatcctatggtcagttatcttttctggtgaccatactagccccatcactcccagttactgtttgcattagttttcattttcatttctacatcacataacagtcactcctgttattcacaatattattttccttcacaaagacttctccagcagaaaagaagatggatgaatgccattcatccctcaaaattggaacctttcctcaaaatatgtgtttgtgtatgtactactatttttaaaaacttttataacttgcagtttgttttcatccttaaaggttattgtcagttcatcctgcatttttttttgtcattctgtatgtatagtgaaatatagtcaagtgctctatatcagtaagtctggaatgttccattctggcagttatatgctgggatacataacattgttgcacaagccagagtaagtgtaaagattgctgtatcttatttgtgctctgaccatagacatgatcttattctattcaggctgctacacgaaaatactataaactgtgtagcttatacacaacagaaatatatgtctcacagttctggaggctgggaactccagatcaaagtgctggaagacttggtatctgatgagggctttctggtttggggacagtgttttctcgatgtgtcttcacttgaaaggggagaactccagtctcttcagtccctcataagagcactaatcccatttcaggagggattcatcctcatggcctaaccaccttccaaagccccaccttcaaataccattacagtggggattaggttccaacatattaattttggggagggacacaaacatgtcagatcacagcaaacaccagctttagtagtcatctctttaattatttcacaatagtttataattttttaaactatctgataggaagctctcagttggactgtatttttcaaagtctatgtgaagaaagggcaaataaaattctggtttgaaaagtaacaaatgttctcagatgcaacatttgctaaactccaaatctttatatagatttatatagacaaaaagtcaaacgtgtctcctaaccctaacacacatgtagagaaaacattggattctgaacatggaggttgtaaaatagggtttattttccttttgcatacttagaaattttaattgtgataaaaatacaaaatttaccatcttaacccttttttattctctatttctgtatttttgtcattttaagagtgttacatagatgaaatatgacaatatgtaacctttgggattgacttttattgttgttttgctctgtataattctctagagatttatacatgttgctgcatgtatcaatagttcattcctttttattactgtcatattccatggtatggatgtaccacagtttgcttaatctttccatttttaaatgtacacttgaatactgttcggtatatttatatggctgtccatcagatctccagaaatctcaccctgcgaatctgaaactcttcacctaccaaacaacttccctttcctcctctccctagccaccggcaaccgcaattctaatttgtttctatgaatttagctactttagttacctcatataagtggatttgtatagtatttgtctttttgtgactgacatatttgacttagcgtaatgttctcaaggttcattcatgtaacatgtatcagaattcttccttttaaaaactaaatgatatcccattgtgtgtacctaccaagttttgtttattcattcatccattgctggacatttgggttgcttccacctctcagatgttgtgaataatgctgttgtaaacatggatgtgcaagtatctcttcaactccctgttttcaattctttgggacatatactcagaagtgaagttgctggattatatagtaattctattttttttttttttttttttttttttttagaaacctccatactcttttccttagtggctgcaagattttataattccacaaacaatgcacacagactccaatttctccacatacttgacagcacttgttattttttgttttttaatttgtataatttaggggctactagtactgtttttctttgttgctgtttttttacatggctgtattgtatagtggtaaagtatgggcttttagtgtacgttgtacccattaaagaatttatctgtcgtccccctcctatcctcaccccctttcaagtctccagtgtctattaatccatactgtatgtccatgtgtacagattatttaactcccacttataagtgagaacatgtggtatttggctctatgcttatgagttatttcacttaagataatgacctctagttccatccatgttattgcaaaatatataatttcattctttttttatggctgggtagtattccatggtgtgtgtgtgatacatatatatgtaacatcttctttatccaatcatctgttgatggacacttaggttgactacctatctttgctattttgagtagtgttgttatacacataaaagtccaggtgtcttttttttatagaataatttcttttcttttggatatagacccagtagtgggattgctggattgaatgttagttctatttttagttctttgagatatctccgtactgttttccataaatactgtactaagttaaatccccaccaacaatgtgtaagccttttcttttcctctgcatcctctccgacaccttcattttttgactttataatgataattattctttctggtgcaagatgatatctcattgtggttttaatttgcatttctcttgattagtgatgtgagcattttttcatatgcttcttggccatttgtatgtcttcttttaagaattgttcctttccccactttttaatgtggtgttttgttgttgctgatgttgttgttgtctgaattccttgtagattctgcatgttaatcttttgttggatgcatagtttgcagatattttctgccattgtacaggtttgttccctctgtagccatcctaatgggtgtgagatgatatctcattgtgattttcatttttattttaatgatgatcagcaatgttgagcatgttttcatgtttgttggtcagtaaggtgagtttttgtcgttttcttcatcatcagcctcatgtaagtgtcctagtctacctgcagtcttgtctcatcccttaacaattagaaggagagtcatcatttaaagaacttgccaaaagtaattaattagatctgtttgaattttttaattttcaaagtagcattttgtaacttttctttctgtctaaatttcccagtaaacttccttgagggcaggaaattatatctttttcactgctgaatctctgacacttattatagagcttgctagttaatgggtacctaatacttgtttgctggatgaatcacacagtcttgatgaaagacattttttccccagcatctatcatgtactcattagcagagctcagtcgctaaattgcctttaccagaggctattctgaggcttctttctttggcaggtactcatctatttcttatttggggctcattatctaatggagaagagcttcattgacaatgctcaacataccactttcctgccacaaaatgccttatacaccatagagactttagttaccaggcaaacctagaggcaaatatcatagtttagacagtctacccagaatgaagtatattttccaatctaataatctaatgttttctgagagtcaaaaggtgtagaatgctgtttcttgctgtaactattgctagtttctggaaatgaatacaattaagtttctaaagtataccagaattatggctagagaatgcgttatgataattttaaggggtttcccatgtgaatatcacatgatagaagggacaccatttttcacattggacaacactgactgcttaacatgtaaataatcactcaggttgagtaaagcacactcctggcattgataaagtgccttctcatgctcctgcctacctactgttgatcatcacacaaactctaccaggcactttatgcagtttgcccttctcgcctaaaataaagcaagagaagggaaaataagtagcttcatctacttacctaattacttagagcaacaattcttaactgcactctctaggagtatatgaacatattgaaattgcattcgacattgcatgagtactaacatttttggggggaagcaccactgagctagagttttcagtattttctaataataaatactgtcagtatataagatgactgagaagcatgtgaattgagactgagaacaagatagagaatattgtctggtgatttggggcataggttttcatctctacatgccttttacatcattacttttgagaagtttctgtttgaactcggtaaacctcttagcataatctaggttctaactgaatagttgtgaattagtgtctagactcataaaatgaagaaattgcacaaaaccaactcattaaggttccaaataattaatctcagccacatttgagagggttgggttcagaggagtccaatgtgacaatgttaaatatttctaattgcaggccatttaaaatttctgtaacatctaaataccatacatattaaccatacatatttattttcttcctccatctatcctgcacatctccgctgaattgatctgttctttctttctatcacattctttctaggacactataaatgaatcagtctgaaacctacctccttttccacttttacctccatctacaatcttgcgagcactctgcccaagcaaactgtttccatcttcattcccctaagtgtgttctcaacatttcacctccatatgtaggttctcaccatgaaacccacctacactccactcttctctccatataagctttattcttcaagacgtggtcaaacctaccttctttgaaaagttcttccaaaccatctacatttaaaacagtatctactaatgagctatcaagccatgaaaagagatgaagggagcttaaatgcatattgctaagttaaatagacctacttgtaaagactacatactgtatgatttcaactatatgacattctggaaaaggcaaaattatggagacagtaaaaagattactgattaccagggattaaattagaagggaggaattgatgaatgtgtgggacacagatattttttaggcaatgaaattgttctttgtgatactataatagtaatgcgtgactttatacatttgacaaaacccatagaatgtacagcacccaaagtgaaccctaatgtaaagtatgtactttgagtgatgataatgtgccaatgtaggttcattgattgcaacaagtataccactctagtgcaggacgctgataatggggaggagttaggcatggggcagtgggtatatgggaattctctgtactctgctcaatttttctgtgaatttaaaacttctctattaaataaaacgtgtatatatatccttactaaagcactcgcagaataagtgtgctatgtagttcacccagccaacaagaaaagacatgaataatcatttagttacattcttattatttaagttcttacatattaattttctcccaaataaaatgaacccctacagaatcaggagcggcatatgattctttgtcatttctgccattctagtcataattctgaccacatactagtgttcaaacatttatttgatgtttggtgccttctttttctcactactgaaatataaggtctttgagggcaggggatccaacttattttgattattcatgaaccccaaacacctagaagagagtctagcacaaggtagccactcaataaatgctaaccgaatgaacatacacgcatgtgttaataagtaaaatgaaataaactatttaaagcatcaattcttaataaaaatgacacgtttgtttttgtttttcagctctagatcttacaagtatacaatgggaatatttacatcccctagctcttagatttaaaagctatttcttttaggctgtattcccccacatacaatcctggatgctcagagagaacattttttaaaaccacttacttattcattcattcactcatttaatacgtgtttattaatcatctactgtgcattattctggacactggagactcacttgcaaaggtgactgacaaagtccccactctaattgaatataatgcattctgctaaaatgaaaaaaatgtaactcacaaaaataagatgaatagtgatttctggatgttgaggagggagatggggaaactacataagccagaaggtcaggaattgtgactttgtccccgagagttgtatgacatacatgtagcagccctgaattaggtggtaacagccctgaaataggtaaagtctcactggatgtagatctgtaggatttttataaggatttatggccaggctctagcatgctactttcaacatatacaataaaaaaatcacccacaagctcccaatcaaagcataaaggcagaagtttatattcctagtgtgcattttaataccttagtaagatacaaaggttgcaaatgttactgaattaatcctcagccattttagtggtcatgggaacatggtgaggggttgctcacagaatcatctcaattttacaatgctgcatttccttaggatccttaactcttattttggaacttttattttggtttctattctaatttcctaaaacatgtgcagtatatttgtaaacaattttgaggttaaatactatattcaaatagagtgctctagcttttaaatacttgatgcaattatatatgtatatatacctgatttgtaaaccctctttaaatatggttcagtttttaagaaaatggatgaatatcttaaatctttgaaataagcttatggtaaaaatatctacagatgtgaatatgttcaatatttattttctctttcaaaagaacatcaaacttaaatatagacagagcatagacattgcttcgttgtatatgtttctttatctgaacattctatcactgacagtgtgaaggcaagagaaaaataatttctaaatgattttcaagtgacacttgccttctttatcagttcttcaaagaagagggattcaccctcattcagtttttattaatattttgttacaaattagacaatcacagataacaatgttttgatgatggttccattcatagcatcttccaataaagcaaaataaataaattaattaattaaaaagccttaaattttcctccttaaacaacaagcttatgttcccatttgtagaattccacaattggtaaacagatctgaattcattttattgatctgcctcacagttatatgaattctgccagacagtattacagatctcttcattcttagtctctgtaaaccaaaaggtatctgagacaggtctcaatcaatttagaaagtatatttttccaaggttaaagatatgcctgtgacagcctcgggaggtactgacaacatgtgcccaagaaggttggggcaaaacttggttttatacattttagggctacatgagacatcaatcaatgtatgtatgacgcacattggttcagcctggaaaggcgggacaacttgaagcagggaggggacttccaggtcataggtagataagagaaatatgattgcattcttttgagtttctgattagcctttcagtgaatgcacaatttacagaaatagtcacttatgtcttcatctgctttagtggaacaatggggcagaggaagcaattagacatggatttgtctcatgtgaacagagggatgactttgagttcggcctgtccacaaggaatttccttgtggacaaattgcgagggaggtatgtagcttttttatctttgtaactatcttatttaggaatagaatgggaggcagctttgcccaatgcatttcccagcttgactcttccctttgacttagtgattttggggtcctgagatttatttttctttcacatcttttaatcataactatggctaacatttattgagggcacactttgcaccaaaaactgccaatcctcatgaaattcaataattccatagaggtaaatattttattttgaaggtgaagtgatgtttccaagacagttgttagtaagatgctggggtgggaagcaaatccaggtctgtttagtttctaaatcttcaatctttttattttctaaatctttaatcttaatgtctgcactatgcttagggttaaccatcctcaataatcactggtttttcatctgtaactttctcttcttgttcattcattcttgatgactttaatgtaacagcattcatttatttttagttctgggatacatgtgcagaacgtgcaggtttgttacataggtatacatgtgccatggtggtttgatgcacctaccaaccagtcatctaggttttaagccctgcatgcatcaggtatttgtcctaattacatggatgaagctagattctcagcaaactaacacaggaagagaaaaccaaacaccacatgttctcactcataagtgggagttgaataatgagaacacatggacacagggaggggaacatcacacactggggcctgatgggggttaggggacaactacattcatatttattgatctctaactctagccacttcctgacccctcacctgatttagttttctttctctgcatttttctattatccttaaaagtgtagtgcttcagggaccactcattcccctagggacaggctcagggcagctatgtaaaaaggtgtgctaatacttgctaatttactttcaatttttctccttagggggcccaccttttagttggcctttttagttgcagcagcaaactggactgaccaagtgaatagaagaactaatctatgaaaccagatctgaaagtttacacaatttaatttggaaagctaaatgtgccaagaatagaatcaaagtatatagaataataaaaggcagggaagtactctgatggaattcttttttttttttttttactgtaataaaatgtgagcataacaactatttttaaaggtttagatgaatttgtaaatggtggatttgccgttgacatcagtaagaaccatatctcatatattatcctgaaaaagttaagaattttacttcagcagggtttttttggtcttttactgatgtttaatggattcactgactgggaatataatggtttcctatggaaataacatttctgtttactgctcaccattagtaagctgatagtctcctactatagtactgctcatgagagaaaccttttgcagattgattgattctgagatggagtcttgccctgtctgccaggctggagtgcaatggtgtgatctcagctcactgcaacctctgcctccctggttcaagcaattctcctgcctcaccctcccatatagctgggattataggcacccaccaccatgcccagctaatttttgtatttttagtagagacagggtttcaccatgttggtcaggctggtcttgaactcctaacctcaggtggtccatctgcctcagcctcccaaagtgctgggattacaggttgcctccaactgggaagtctatcatggccattgtcctcttatgtttcagtggtgatgtgggaaccactttgcttactgaccggggacttttttataaaacataaaaccataagaaatttaaggacctttgcccctcaaattccagttctttatctttcaacttatttgctctgcaactaacaatatgtggtttgtctttgttataggaatgcatgaagatttctgaagtaatttggtactgaaaaaaagacatacccaccaaaaaataaaaataaaaaacaggttactaaggaaaaacttaaacatgcaacattgtggaaaattaccctatagatatttgaaatgatattctgtaaaaggacagaaagcactctggaaacttatgttatactcttacgctttttttttgcccaagaatacaaaactgcaatatttgacctttcagaagcaccaatgaacatggacaaaatgtcatccagttccacaggctagaaacctgcacactgcttgacactctgttccctcagctgccatatacaattacatagtgctgaccttctgacctcctaaatatttctccaatcagccatgttttgtccacctccattgccaatgccttggcccacacaactgttatgtttttttctttctggtactataatggacaaaccagaattcttatatccaaattggctctcttttaggcttcacattttggccagactagcctttccaaatttgtatctgagtgtgacatgttcctgcttaaaacttctaatgtcttcccattgcttttagagaacgatgaaaacccttgtagcagaatgagccgcagacaaaacctctcagacattgagttgtagaaggaagggctttattcagctgggaacatcggcaagctactgcctcaaaatctgagctccccgattgcaaaatttctgtcccgttgaagggctcacaacactaaagatttcacctgaaagggttgtgattgattgagcaatctaggggatacgtgacaggggtttcatgccctggtagtcagagtgaaacagaacagagcagggagtttcacaatgttcttttatacaatgcctgaaatctatgggtaacatcgggttctaagttgatttttaactactgagtttaggccaggcatagggttctaagttgatttttaactactgggtttaggccaggcaggcccaggcctggtttcaggcctggcgctgggctgcctgtctttggttttacttccttgttgttttttctttttttcttaaaacaggtactgagtataaaacaatatgagagcgtctctctcttccctcacccttaatgtgaccactggtttcactcatgcctaatacccaaatcccaaatcctactgctgtgtgttcacattctgcattctgatttcgttgttttctctttttcattcaaatgccttgtctctcctcctgccccagggtctttgtatattatatcaccctttccaggaatatttttcacgctgctcttagtctagttaactcatactggtgtttcagatctcagttcagaattcaatgcttttccttaccacccaagctaggccagatttatctatgtgatctcatagaaatcattccttttcttataagaacctttcttaatttgtaataatacgatcattagtgtaaacatttgtctctcattagactgtacacttcaaaaaatggtaaactatgtcaacttttgcttattctaacttctcaagatcaagaacagtgatggctaaatactaggatctcactaaatatttactgaataaatgaatgcatgaattttagacatcattaagtaaagaataaatggaaatttgtttccatgtgttcacagtactcaaaaattttaatttgttatttaatatctggtagaccaattttagtatttgtaatggtatatatatatatatatacatgtatatatatatatatatactgttaaagtatgagactatgaggtgggaagaatcatctttgtaattggtacacacacacctatatatatatatagatagatatacacacacacacatataaacacaccaattggcatatatatatatatacacacacacacacatacaatatatacatatacatatatatatataccaattggtatatacacacacactgcaattggtgtatgtgtgtgtgtgtgtgggtatatatatatataccaattacaaatattatgattcttcccactttatagtctcacactttcaactaacaacctggaaagtaagacaatataattcattaatttctataacatttcataatataatatgaaaattcactgctgatttttagaggacaaaatctatagcatggtgaactttcacagctccagctttatctagttagagttatttaacccacaggttgacattctcccctcctcagggtctctctttccccagaaggtattgcctcttttcttgctttcctggcctccctcttcagtgtttcatgtttgtccttttgtgttaacctttggaattatcaaacaagttgttgccagaatctggggactcatggccgatgtgttcccggctaataaagcaaaaccaagagaaaataatcctcagcattgcatttcagaactatgtgggcttcctttgtattccacaaattcagtgttgctgattcttatcagatgcttaatttcctcatatcccagtaagatgatttatttggtgccctggggaaaaaattaaaccccttttatctgttttgtattttcaacattgtaattattaataaatatttactaaatagcagcatgatgtaggtgaaatatcaaattggtagaaataaatgcttcttaatctattatgtcctctaagacacaaaatcatcatctatgacatggagatggtgctgtttttcttcttaaagcatctttcacagcattattgtatcaaatttagtatacaagaatagtctttgaaaatcaaaaagctcaatcagaaattattattatttgaagaatatggtcttttaggagaattgtagaacctgcttatatttcctccatttttctatgaaagctttcattttaaaggttggctaaacaggtatttttgatccttttgtttcatttctatttatataaataagtggttttgatggggtacattcttattaggaaaagtttacaacacatatgcttaatattaaaatgtttgatataaaggtctaatttaaaatgtggttgaaagagaaaaaagtagaaaaatcttgtatatgcatgtacacataggcctaaggagagaagcgtatggaattgcaagaatattattaaaatacaattcaaatagttaagggtaggaaaaatgtgatgaaaacaactggatttttattcatagactccagcagagtaaaaatcacaaatttggtttttttccaaaatatgtcattttgtattcaattattcaagacagaatgggcagagaagtacaaggaaatgaaagaaaatattgataaaggaagataaagtaaccagactagattttggtaggatatagcaagacacaaaattgatatctcctaactacataaactaaaatacttcaatttttgcacagcaaattctattcttgttctggctaacaaaaattctgttggagtaaattaaaactgtgatcatatcactttttcgttggacataaaagaactaaatattttccataacatttgttccactcaggagtatctttcttgcatcttccttcacctccactcccatgataatcgccaccattaaaaccgttattactaagaacacaggtatttgttgtctttttccagattcttggggtctcttaattacaaagtaatttcttaaattatgcctccctttatctttcctctatttttggtattagtaatatctaacaaatctagatcaagtaggccatccacaccaggtcatatcctactcccaacccaatgcttataaaacataaggctaaaataatgaaataagattaaaaaatagaatagttgctaagactgataacttttagaaataatttatctaaacaaattgaataatcttaaaaaatcttgtggttgccattgctgttgttaagccacatttccctctttgatttccttttagaactgtattgttttgagaactggtataattagtgatttagagctaaggctgtagactcaggttggcattagaacctgcttcgccacttactaactgtacaaactctcatcaagatattcacctgcagcattgtattctgttaaaaggaatgcaatgaggtaatgtatgcaaagcctttagcatactggttgcctcataccgataagtaaataaatattaaccatcaccaattctcaccttagctctcctttaattggatgtacattcatatccaaacccatgtataatagagcagtggccatcagactgcatgtggtgaaggacagtacttttattaattgccagtttttgtagaaagataatatcataaaatacaataaaattcaattaataggaaacgtaaaaatatacaaaataaaagcccagagattttattgttatattcaacaaatataaaaaacattctgttaaatttctatagaagtttataaatgttttcacataatttctgtacttgctttattgcagaggggaaataaaatctatagacaggcacaagttccttgatcatacttctatgaagaatgtatattttattatttctcttttgaataagataaccctatttctaaaatattcaaatgttcattgatatagttatgtatatatacacttatgtatacacacataacaatacacatacatatatatatttggcttaatgtgatatttgtgttacaatgaaagtataaatcactgagtctgaagtgtccttaaaatagaggatgaggcgaaactgaccatctggctttgagctatcactaatctctactttgatgcctgagtatttgtcaaacaaagaaacgttttgcatattactgtgtatatttgttctctgttgacattatttactcagataatccagaaatgtttaaaaaactgatggaagcactttctcttgattttgttacatatgtacagtttgatttctttcacgtaaagcagtatccattttacatttttcttttagacaatgttctatacagttagtatattaccctacacatgcccaagaaatgtacctttgagaagctgatgtatgaccaaacatgtttgatcttagagctcaatttttactcatgccaccacccactatgacaccctcatcccattctaccccttcctggggagttaataacaacaatgagctttttttttttttttcctatggggataattggcaatccagggaagccaacccaatttctattttgttcaatgtttctttaattgatcagtgagggggaaaaggtggatacaggttgcgtgaagaggaggaaagattcattttgagtacctataaattttttggtactttcttaaaaactctttttaaaatatgcttctttttctttacctttttgctccttatatttgttgcttctaagagacgtgtcacctctgctagggtgataggctatataattccttactgctttcatctatatatttttttatctgtaggtatagaggtagataaaaatcagcagcataaaatacatattttctatgtctagttgaatgagtgattcagtgaaattgataattatatgtatcagttatcaactgtataatgaacaaccacaaaacctggcataaaacaataagcgtatgcatattgcttgtgaaactaagaccaagtgggccttggctaggtggctctgtagatctcggcaggacttgatcacctctaggaataggttagttttgattgaatcaacctggctctgctccccactctctctctcctccagcgagagtagcccaggcatgagggagggcaatcccagctgcacaagcacttgttaagcctctactttctttatctttgttcaaagtaagagaatgctgcaaattacatggcaaaggtcgttggttgggaggaggaggatgaagaattagaatcatttttgcaattgatcacatatcttaaaaagtaaattctttcaattgaacaatatgataaattagtaggaatagttaaataattatatttatcttgatgaaagtaacgtactcgggcaagttacttcaaccttctgtgcctcggtttcttcagttctaaaatggggataataatagtgtcatcccatacgattatggtgagggttaaattagtgtattatgtagtgtgtagagcagtgctcaacatagaaatatgcataaggtgttaattatagttattaacatcattattattgttaatattgaggcaacacagttgaaaactgacaaatgtgtaaaaatgatatatggttgtcttaatactttcttgagcatatttattttgtgaatttttggctaatatttatagcactggtgccatctgttcatcttacaaggattattattttaggagtttatacatgtctatattccagagagaaagattttacattgtagaacaagttgggacacatttttatttataatcttaaaatatcttacttatagacgtattgtaaataccacagatttttgtttctattttcttgcttttataaattttgtactaatgttaagaaatggtagcaagcttatgactaatgtcaatttaattgacagctcttaaaatgtgatcattaattgatttgttctatgtagtaatgagaatatatgccaatatgtcccaattttaatgtgcatacagtcacctgggacctcgttaaaatgcaaatcctgattctgtaggtctgaggtgggcctgggattctgcatttctaacaagcttccaggtgatgaagttgctactggtccctgaataccacattttaaatgtacgtgcacacacacacacatgcacacacacacacagacatctccttatgtatatttaaaaattatgcacacatataaaatacatattttaaaatatataatacatatttatattgaataagtgaaaattcaaatcaaattatttgatatttagttattaaatgttataaaacatgtaataaatataatgaatcaaagtaacatataatatttaataaataaattattgtatctaatgatgtgttaatctctaaatgttgagaaatatttttactgccaaaaaatgctttaattttccattttgtttcccgggaaactacttaagtaacagaatttggccctataaatataagttgctgtcgagactcctttgttggtagaaatatacttaaatttcctgggtcctgtaatcaggataaaagttgtctctctctctctctctcttttttttttttttttttttgatggagtcttgttctgtcgccaggctggagtgcagtggcacaatctccgctcactgcaacctctgcctcccaggttcaagtgagtctcctgcctcagcctcccgagtagctgggactacaggcatgtgccactacgcccagctaattttggtatttttattagagatggggtttcaccatgttggccaggatggtctccatcttttgacctcatgatcgcctgccttggcctcccaaagtgctgggattacaggagtgaccaccgtgcactgccaaaagttgtctcttaaactcgtacataattatgcttttatttgaggtacacacacaaccaattaactaattttttttctcctgtgggcattagtcacagcccaatattaaaaatttttgactacatacaactttatataaataaagtacattagtcaacttaattttctgcttttgagtgttaactacaaatattttgtttcaacttcaggactgtaaaatctttctaaaagttcacgatattcttttctttataagtaatcttaagagtactctgcctttttgttttaaagaagtggttagtgtcagaatagtagcattaaaggatacaattgattttaaaactgtaaaagatgaaagagattgggataaatctctgctgacctcagataaactctagtagatcaaatctccaaaatgtagaaaagggaagaaaaaaaattgagaattcagattaagtggatctgaatatgggaattcccatctaaaggtatgtgtaattaagttgaaatctattaagaataattaaataacagccttcttcatgataacaacatttgagttgcactttcaaactcaatttctcgttgtaaatataactacagattacaacttaatttctagtccataaattatttttcacctctcttatcttatttgatatttgaaagaaccctttgttgtttaatattatactcaaagtaagaacttggacttggagacctcctcctcctttaagttcaagcctcctctgaggagagatactcctaaggagtccaggatgagggtcattattgagctgttactgggaggggactgaattcgtggatgactctggaaaatagaggttagtaatatattagtagctattatttatcatgtatttattatgtgctatttgctacttgtgtctaatatcgtttctctatttcctctttttaagttattttggaattgcctagtattctaaaaaatgttatgattgtgttcagaatgccccttttatagttttcccttaaatggtgatggtgggcaaacttgaagacattaacaaaaacataattttcatttagtcttagataacaccaaggtgacatagtaactaagtggagttggtgggctaattcctagtggaagcctgggctcgtaacagaacataaaggcttttccaaggatgaaacactggtgaagctcctccttcaagttgtatatgtttgcatatgtgaaaatatgtgcaatccaagtttaacttgggaatgcttagctccttaggaatttgctactgggttaataactcttccctcaattacttaggttggaaagtcctcaaattttaccttagatcaggattggcaaacttttggcaaaggaccatatagtaaacattttaggttttgtgagccataaagatctttctcgaccacgcagctctgaaatttgtagtgtaaatgcagacacagacaatatataaacaaaggaaagtgcctgttttccaatgaaaccttatttacaaaaacaggtgaaaattgtgtttggcctgagagtcagtttgctggaccactggattagattctcaaggtcactttcaattctgaggttatggttttgccagattatctgagttattcattcctgatgagttatggaaggagagctccttccaaccagaagtctctctttgtacaagcaaatggcccatcacggtattttcctaaacaaaggcatttccctcagaagaggaattctgctgctactgttaagataataagtacaccacagatggtgctttcatttcaaaaacaaccacaacataaaaaagatataacatttctgtttaattattgcatttttctatcctatgacttgatgatttagtttggcagtggtgcaaattaatattcaagcttctgctggaactcatctgttgttgattttgttgtggtgggggtgatggttctaaacatagtcaaggaggcaaggtgagaaaaagatacatcaaactccttatcgatctcgttttggcagattcaaagagtttatatttaagcctaaatttaaataagcattttcatattatcactgccagttttagagagtgtttcactggcacaataattgtattatccaactgtatagcaactatcaattagactaggactgccttgagaagcaaagtagggctcctctttctttggttcttgctgctgtacattggaggtctcatactgaaggctcacaggcttccctgtggccccttgacccactcaaggttgaaaaacaaaaactaagaaatagttgccaatgttaaaaggagattatctgtagaaacttacatttcttacttcctttgaaaaatcagatcttctaaagatctaaggtttttattttcacaggagaaccatgtgagggacggctgcttttttaaaaaaatcattgcttctaccactgtcttcatctcctcaccacagagcctgagtcagaggccatttatcctcattacggtgccatgatcatgccagctttcctcactcctgtatctacctggtcattagaggcatttgagtttgtggcccgtgctgtgcacattatccctggagatctcatcaattacaattatttccacctactggactttaagtagttctacctattggacattttcaatgcaatctgttttcctaaagcatactgcaggattgaagcacaaagtatgactgtgcaattactctcaagagcatttttgtttatgttggtcaatgtcagttttttaggtcccttataaggaaataccttttaaaaattcatgccaagaaacttttcattttcaaaaaggaaaatattttctttcttgaataatttttgtaacattatagtctttctctttttgtcctggctaccagaaagttcagaagtcagtgtgtcataatcctgatattatttctccccttactttgtgtgttctggttctctatttgtaatattaatactaactattaacgtgaacacacatatactcatgtgctacaaacaactttcaggttcattttgtgagagattagggttgaaaacatcagtacgacatgttcttaacttttcgaaaccatcctccacactgacaacagatttgtatttataacatacgaatcaggccctattattattcccttgcatattcaggaattcaacatgtcttcctctcacttataagacatctaatttgtttattagagttttcaagaccctttattatgtttctcaaacctatcttcccatctacaacattctccacttctgtcccacaaagcgtgtatctcagtgatgaactatttacagttctccaaatgtaccaggccatttcccacctcttgcctttcacaataccatttattctccctataatcactctagtattttataggtaagtcactcataacaaatattatattgttctgtcatttttcagtgaaatgaatgactattatttatcttggtatatttcatgctgaacccaatattttgtgtaaaatggttttcattgactaattatgtagctgacttttggtgagattttcacagaattgaaataactgatcaggatatattttttactacaaataatgagaaacttttaaagaataattattgagtgctcactgtataccaagttctcttctaaatgtgtaatacgtatttattcactcaatcatcccaactaccttattgccctatgatttttgtcctcattttagagatgaggaaactgaagcccagagagattgagtaatttccccaagaacacacagctagtggggtcagggttgaatcctactgtctgcctccacaggtgatgtttatctgctccattgcttcccatttacgtgttgaaagtatatcacttatgacatcaaatagcaactaacctcaacttccattggttctatcggttctataggaaatgctgggattatttgagacttcaatattggaggaacagattaagttctcaaaaagttttgagaaaatgtattagacaataacatctttgaatgtaacatgtgcatttgtgtgtgcattaattatttagccacaaataagaaggctgaaaatataccagtctccactatcacaagcaactgaaggcaatagttctacagaaagaatcacctatctgtgaagtcacgggcacagctcacagaaaggtgctgtggaattgacttctttggagtcctatgatgtgaacatttcatctgaaaagatatagtgtcagaatccttaaggtatccaccgagaataaattacttcctctacatcaagcatcttcttctcttccatattcaacacagtgaattcataatggagacaatacctccctaagttgctgatggtgttgcaagcaccattcatgttttggacattatggcagtgacgatcagaagagaatcctgtggacctacgtttctggtgtttgtagcaacaggatgagcatcagtgagccaggttctgggcagagacacccgaagcccaggaggcagagccagattcccctgacttccactaagtgacccactaagtcagctctcagcatgtcactcatagctgattttgagataggtttttaactggtaagcaatatgcttaggtgccctgccctgtctcagtaaaaagacaagtgaaatgccaaagtctaatccttttgtttgagaaagtatagtttcaaccaatatatttattagtctcttggggagaagccagatttatagcattccattttgttttactcacaataaatgcatgaacatgtactgttttatcaatcttttttttcgggcgcatggcctggacattgactcagtggactctcatttattagtgagaaaactaattggaggatatatggagatgcagaactcagtagaaagccagaacatttatttggatgggatcttattctaatctgaggtagcatcatcaagaagaaataaagatctacataagttgctccaggagggggctaaacctgtcatttggctattgtgatttcatcaaattgatcactgtaactgtcatctttgtcttgaaaagcatctgccactaacaaaggctgttccccttggaaaactattagctctcagtgaatgaaagttattcagcacactgaataaattgtctcctgcatgagacagcatttgataattcacacttttatggggaatattgaaaggaaatttctacatgacattaggtcacattcctaattacagttagcataaagtcaagcccttaatgttttagtttttagcccctaaggaatatttttcagaacaggtatacaacatttttagaagaaaaccaaaaattattattttctgcaataataaaatctattaaagaaaaatgaaaactttgtgtatattttttagtccagtggtattttcaaaaagatcaaggacagtaaggatctattttccatctatattttatatacatatagaatagcacagtgttggacctatttaaaactagctaggtgtctttcatggtctataaccagacaggttgaacttcaaatttatttttaatagagggctatcaaaaatgcatatgtagattgtacccttattaattttttatttatttggcatgggattatattcattattattcatcccaaagtaagaagtatataaaaatcatctgtgaatatttctgacattaataataattgtaaagtagtaagctttgtgctgctcatcaattaatgcagaccatggcattgagcataatagtatttaacaaactgtatgctttccaaaaatgctgtgtggtttttcagttggagcagcttttgatgtttatcttcaagagttccaacgggactcaaacctttggagccccattgaattattttcagctactgtcactatgaccagctaacatgacacctaacctcatctggttatacaatagctctagtggctggcaagtaagccagctgattgtctaagttttagtttgaggtttcagtttgttcctttgtaagtaaaatgtatcaccctgtgatttcagtgatccaaggagcaactggcaactgtagagtattatatcactgttcctatggaaacatgtaaaatggattataaaatatctgaaatgtgtattttatttggttcactttattgtgaatatctgatgctactttaatgctccctttctgattatactctggttgaattgtcttctgtttaagttaaatctttagtttgctcatgtattgttttcttatgatatacttttgcttctatatattttcaataatagtaggttcttctcaatttattgtatattttaaaaatgtatagacaattactgtgcgcaggaaggggtatatccggtcctccatgccaaagcactctttcaccatgctgggaaactttctagagaatgagtagaatgtacagtgaagatcaagttccttcctctaacttttgtttcattttctctccacaggaactttttacccctgaatgcaagtttaaagaatctgtttttgaaaattattatgtaatctactcatccatgttgtacagacaacaggaatctggtagagcctggtttttgggattaaataaggaagggcaagctatgaaagggaacagagtaaagaaaaccaaaccagcagctcattttctacccaagccattggaaggtgagtattatgcatgcattattattacatagacttattacatattttatttttcaaattgataggtctaccatggctctaagaaaccttcacaaagtgctggaaatgtcatttattttgatctaggtgatggttgcacaggtgcctacttaagttattgatttagaatttgtgccccttatacactttactatatttgtgtatgtatgtgtaccaggaaaaatttcttctctgccacctccaaaggctcaaatcctcactgctacaaccactctaacccttagataatttaaattaattaagttaaaacaattttaaatctgtaatgatacaaatctgcgatgataagtatattagaaaaagataataagtatattagaaaaaataagttttgagcgtggaatcaaaagtattttccattttgatattatctaggtgaaagtaattacctacttgtggattattataattacagaaaattaagagataatagcttgactcttaaagaacttgctgatattacacatctgctttcaaattgtgtaattcttcactgtatacatttgtagcattacttcttttactaaaataatttatccacattcatttgtgtgcaggaaggggtatatccagtcatccatgccggatgaatggaaatttcacatttactccaatcagatacccaaagagcaggctacaaagtttttttaattaatcaacaacatctgcacctctctcattaatgattctgccaaaagtgtcatttacttttatctatgtaacatttgagaattacaaaaatatttgattttaggatattcacatgtgtttctattcaagttcttttgtttactcttttgcagaagatcagatctacaataactcagtaaatattttaagctagcttggacagctcaattttctttttgtgttttattcctacaggaaaggcttagccatcacgagaaaatgcatattgttttcataatgcatattctctatattgaaataaaataatttaaaaatttgaacagtcaattcttcatcatctgtgagtgtataattttcaatttgcctaaattcagaaaatcgctcttgttggctaatactacttctgtaatttcaatgatgttgacttagtgtcactcttaattatatttttctgtagaacaatttattgaaacccaaacagttagctaccagggcctatacaggaaaagacagattattccagagtctgaaatatgagtgaattattctcagtatatggtggatcataaggatgattagagtagaaagaagttagaggatttccctgttcctcccaaaaaaaacacatccatgatacactttcattgttttaaataaattttgataacattggactcacctatatttaaatgcaaataaaaaattaaaaaataagcccacagaagctctaataagaccattgtttatttgccaccgtgctttatctcttttcactcattttatgttttgtaaatagttaagaattgactagatttttagaaccttaccctttagctgcataaatgtaacaaaacccaaaagggctgttatgtcatttaaccgaggtaaaatttgggaaccagttattttgcatatctcatagaaaatatctgagacaacaatgatgtggtatagaatgatacttggtatttcactcatgtatttgttatgtgtatatgagtgttttgtgtgtatatatacatatatatatatgagaaagagagaaataatactttttatgttttcaaaaaattagcagaagtactctaaaaacagttaagggggtaggtactataacgacagagattatcacattgtttacttgatagaggaaaattaatttcaaactttcaaaacccataccgaatataaataatgttattggaaatgtttgacaaattaagtacctggttaattattggtactctagggcattcatatctttgttttatatatatatatatatatatatatatatatatattttattattatactttaagttctagggtacatgtgcacaacgtgcaggtttgtgacatatgtatacatgtgccatgttggtgtgctgcacccagtaacttgtcatttacattaggtatatctcctaatgctatccctcccccatccccccaccccacaacaggcccgtgtgtgtgatgttccccttcctgtgtccaagtgttctcattgttcagttcccacctatgagtgagaacatgtggtgtttggttttttgtccttgagatagtttgctgagaatgatggtttccagcttcatccatgtccatgaactcatcattttttatggctgcatagtattccatggtgtatatgtgccacatttgcttaatccagtctatcattgttggacgatacaacttcactacatagaaaatcaaggtcaatgcttcatgcttttgtctgctaatttaattagtaataggagtgagggattggaatgtgctttcaggatacgcattagttccttttgctaccttagcaagtaatttaatagaaaccttatgtacatttgcactttcaagtatgtgtgctgatgaaaactcacgtgatgcattgatactaaaggccacattctacccccttgaacatagggaatgcatatggtagttcatcttaactaaatctaagggctcttcgtaaaataccttaaactttcaaaaacctaaaaagcagtttgggcagctctaatgcacttgtatttctgatggcagatgactttaatccctagttttccccaaccatcagtcactcttatatgtcctttctcaggacttccagaaatcattttctaaaaagccacgtgaactactatgattatgccaccagacactatttagataaatcctcagagtttattcaggtagtttcagttgctgtcttgccattctgttttctgcccctgtatcatgtcaattattagatttttaataacatagcagaaaatgagttgccttctgctgcccaagggtctttttccatgattgtaggaaatgaacattgaaatgataatctcctgaaggctctggcttatgggaagagagttatttgttattattttgtgtagctttgaagttgacactagtatgactatgttgcttttgaaccacatgaaagaaagtaatttaatgttctaggatgtaaataccgcagctcacaaagattgattgaagtgaatgagaagttcatgtgttgatattaatgtgcagtggaagggatgtctgagttttctttttttgagaattaagttaaatgcctgtcattctcctatagtgtgtgtgtgtgtgtgtgttttacatcatggacccacaaagaggccatagctcccatttaaacctgctgtcctagacaaaaatccatgcacactcatatacatattttaggtatacagaccagagaatgtgaagggagtaatgtcctctgtgggctggaaatgattgctttacaacaggaattctgtctcaatggaattgctttacttcagggaaaacagaaatgggcaaactgcagtggtctatgcaggtatggatggaccattctcacacctaaccaagcaatgtttgcttttcctcctcctttcttcccatcactagttgccatgtaccgagaaccatctttgcatgatgttggggaaacggtcccgaagcctggggtgacgccaagtaaaagcacaagtgcgtctgcaataatgaatggaggcaaaccagtcaacaagagtaagacaacatagccagatcctcacaggtgttgtgacttattcgtcctgagcacagttgagtgatttatcctcaccagacattcctgctccgtggctgaagagcagcaggaagtaagctaatgcttattctttgctgtctccgaacttctctgttgcaagtggataaatctcaacctgttgcaccccccacaacaagaagacacctggataaccagctaaactcagaccatggaatgccctaccagatatggaatgcctttttaatatcttttctgtgactgtgacacttcatgtgaatgacatacttcacaagtacactcgataccttgcctgctgacagctacccataatcctttttgagtcctgtttcagcgaaatctatgtgtttaagttcaattttgtagcacacaaataatattgagtaatttctagttagacgctgtaaacctgtgctattacggatttctcttcttcccatttttacagggctgctcgctccactgtctgtgaccttttgcagggattttgttcctctaaatcttaaatgttgcagttggcttaggtcggagagcaatcagggaatcaggaagccttctaaacctattattacaaattgcatctataaagaaagattaagaaagattgttgtctctggctcacactatcgattaaacacacatatacgctctgtccagtagcagatactgtgctcccaaggtcggcattgcctgggtgggaaatggctcaaacacaatccagggaagctctctatgatatgtgtttgacatccccctctagtttctttgtgtgtgtgtgttttatacatatcacaagcttactggtaatggtaacatttgccttgcccagcgagcaagacccactggtttttgagaaagtgggtccaaagatttctgtaggccttgtaggcctgattaaggttcatttttcatctattaattctcattatttggaaaaaaaaaaaaaggaaaatcagtaattataacctacaagaattgcgctacctaaatccatttcagatatactccgtcctgtttttaatgaaccaaacttaacgccatccccgtttctggctgcgttcccctcatactcagcagagcatgggcaagacggctgttgtgttctttcctgcagcagcaatgcaaacgttagttataaattaattagactttaatatttttggtgtttaatgacaagtttttaaactggacatattaggaaaaatattttttttagctcagcatgctgagtccggtactgtgtatttcaccagtacatgcctctagctcagcatctggggctcatgttgcccagtggctgggttagaggtgccttgccatgatctcagaatacagtctgttgaattatcctagatgaaaataaaggcaaaccaacacattcatccatgaggattttggtccattccatttattttcttttattttgcattcttaatttcctttttagtttaacactgtttgtttgagcttagggaagacaactaccaagaaaggccaggaacagttgactacacaatgaagattccatgcaaaatgttcaatattggatctaaaggggttcaaaatgtttcatactaaactgtttgggaatatatttgttaactctgtgtacacctaataaaattcaatgttttcttctcagaagagttcattgagaccaaactgaacctcatttattgaaaattatatgtgggatcaatgtactggcctcttgttattctttctatgtgggaggatgacccagtcatcattttccccatctgcactgtatttattgggaaattattttgtcactgctttcataaatcttcttcatgacagcccttgcccagcattaaaaaattctggcctgcttagctgattaaaggtttagtagaaatttaactgtttgtttatgcttatttcattttcatattggattctacttgaataaataaaaagttagcagaacgtttgagtagatttattgccaat

SEQ ID NO: 15426 - DNA, 42250 bp, Human
tggtatttatgcttccatggagtcaatgtgcataggtcccctgtaatcctaaagtcatccctatacaataatgagaacttctctgtcagggaggaaggggattttagtcctgagtgttttcatcattcatttctccctagtttggagaaatgtctagttagtttaaggactgaatattgaatttttctgcttaaagaatattggttcatcttctacctaagaagtagagagttgctaaaatagttgattatttattttatttattcagccacacttttgctatttattacttccaaaattgactttactggatatataatacacgcatctatttattgttgttttgataaacttttcattttggaaaaatgttatgttcacttttgatgttgcacattttatagattttaacaaatgtataatgacaggtgtccgccattatagtattgagcagagtagtttcacagccttaaaaatcctgtgcttcacccttgcatccctcccttccctcttgccccaggcaagcacttattttcttactgtctccatagatttgtcttttccagtatgtcataccgttttaaagaaaaaacttattcatgacatttgttgaagaacagtaaggcagattttattcagagggactactacagtagggttttgcagtcaagaaagagattgggtttgactcctaatattaagacaacaaggaagagtgggcatttataggcaaggagcaaaataagggagttggtgggtggaaaattactaagaggaaacatcaggggtggagcgtggggattctggctaaactgaccgaacaggattcttctgaaggcaggacagggtgatcagctgtcacctgggggatggtagaggatgaggaacctgatcagatgttgagagtggaggattccagctagagcaccttagcaggagagtcttgcaaaaattgggcaatgcagagatggacacggaagtgcaaaagttgaggccttaaagggaagaagattcaaaggaatttggctgaagtttggttaaggataaactgtcagaatcacacagtgtgtagccttttcagattggcttctttcacctagcaatatgcgtttaaggttccgctatgtcttttcatggcttgatagctcatttctttttggtactgaataatatttcattgtctggatataccacagtttatgtatctataaactgtgtcctactaaaggacattttgcttgcttccaaatttgagcaattatgaataaagctgctacagacgtctctgcacaggtttttgtgtgaatgaaagttttggggaataattttatatttataaaaaagttcccagtatagtacagaactttcccttataccctttacctggtttctcattgtgttaacatcttatgtgaatgcagtaacatcttactggtgtgttgtccaaactaagagattgacaattatttattgttattattattcttagactttattttgatttcaccagtatttccattaattttctttttctgtttcatgatccaatccaggataccaccttgttattagtacaatgttaattttaatttataggagtagtttggttatgttgacttattaaatatgtttataagacacagcatatcctgagaaaatgagtgtcaacctaacagttatcaggaggcagtgttacttaatgaaatggactcatttaattataatgttatttagaatttttttcaagtttgtttttgttagagggtcagatttccccatgtacagcaaacagtaacataagatttgttttataaggttgctgtttctaaaccaaatactaaagcttgttgaaagaaggtcattttaaagttgagcatttcaagacccaggagaaaaccggttgcagagttgtaataaaagctgtcagtgcctaatttttcaagttggtgcaaaggatgaagtgtccgggtagttctctaatgagcatctccaaatgttttgctggcagaaggactccatgaaagatgacagaagaagttattgtgatagccaagtgggactacaccgcccagcaggaccaggagctggacatcaagaagaacgagcggctgtggttgctggacgactccaagacgtggtggcgggtgaggaacgcggccaacaggacgggctatgtaccgtccaactacgtggagcggaagaacagcctgaagaagggctccctcgtgaagaacctgaaggacacactaggtgagtgtttcaccctcgagagaggaagccttgtgcatttcaagggacactgttcgtctttctagttagtttgctgtttcaaaaaaaaaaaaagtctgttttaaaagttaatatcttcctagttgtcttttttaataatctaagaattaagagatgaagatggagaaagaggatgtttttcatttcctggagattctggagtttggggtcctgtgtatggagacactttgtgtgcttgggacccctgcacaggtatctccttgtatcaaaacgttagaggagcctgacttggaattctcacctctaagtctacccagctctgccagtgtcgtgacatgaagttctttctctcttatacaatcctgtccatttggcctacgtgcctagagcaggggacagccaaagcactttttccctctctgaaatggatgctacatcacaccacagtcctgggtgccgttagctaagagggcagctttgtgacatcagaggccgctccagggtgggggcctagttcagccatactgttgtccccatgtgcctcttttttttttttttttttttgagacggagtctcacactcttgcccaggctggagtgcagtggcacgatcttgcctcactgcaagctccacctcctgggttcacaccattctcctgcctcagcctcccgagtagctgggactacaggcacccaccaccacatccggctaattttttgtatttttagtagagatggggtttcactgtgttagccaggatgatctcgatctcttgaccttgtgatccgcccaccttggcctcccaaagtgctgggattacaggcgtgagccaccgtgcccggctccccatgtgcctcttgttttcccaggtgttgtcaggttatgggcagtgccctcctggagttacacaaagttaacagtatccagtcttgcctttacatgcacacggaactgacttacagtatttactgcctcagattacctgagaaaataattgcgaggacttttttgaagaatgactcatctgagctgacatttaaaacattgttgttaccttcttatgagtataatgttgtctgtatccaagactgcaggttatcacttaagggtttgctagtgaaatgagttaatattatcacctgtgtcacatttacttggggttttaaaaaaatttctaacaagaggatttgttttcttttggggaatggagaatgaggaatacgtaggaaaactgaaagtaaaattatacaccaaatgtggtgggtgttgcaaaatgttcatcttttcttttctgccatgttgaaaagtctaaactccctctgcaaaatcatcgaaagccttcatgtattaggtagtatttttgtgtatggattaggttcttaccatgatttggagagataagtgagacatggaacttcgtatgaatcataccagctcactggccatcgtagattctcagcctgatggagaaatttcatttttgattagcaatatgctccttctccactgagctgcctccctttcatcttttcttcccccacataagcatgccacttgaaagaaacactgttttatgcttataactcttaattaactgtggttaccaaaaaaagagggtagcatgaatagagaaaaacttgaaggttgtcctgagctttatttttccaatttctacctttcaccaaagtaccatctttttagtgatgccaaacattgttacgttgttgacttgttgtgtgtcttctttttttttttttttttttgtatttacaagattctagtaaagcatgaagtgcttagagacttgtaggaagtagaacaaggcaaggcgagttctctgggtgacctggaaattcccttgaaaaccttgtcagttttcttcctcagttttctagaaggagaaaagacaaagccacaaattaaaactatgaaccacatcttccgcccagcatgcttagttttttcatgagctgtgatcggttcagccaatgcgtgtactcccaggctctcagactgagccagccgcccgtcctggagccggcactgggcccgcgcccgtccccgacagatggccatccagccctgctggagcgcagcgtcggttcgagtaggccaatcccatttttggcgaaaacagattgttagaaagctcttccttaaatagagtcagatttttacatttctttaactttcttccttcctttggctcttattctgccctctaggcctgtgctgagtaggtcagatcctcttctgtagagtgtcagccctcccataggcttggtctcagttcaggcaagcagttcttgggaaacattcctgttaagcattagctattgtaaaaatacagaaaaaatgatgttctgaacccctgtattgagtatagcagttgatcttcatagccaaaaggcccttggggatcagtatccccgtcatgagggagaaatatccccatggttagtatatattttttgttttgatctctttatcatgctcacctggaggtttttgttggacaaagggatgttgttatctcagcatgagttttcccttgccctgttgagctgcatccagtggaagaggaggcacccccgatcaggtctcaccatcatgcagtaacttctgtgcacttctgtgcaaagcttatagatgtggcgttgccaagaaggaaagtgagaatgctttccatagcccctcctgcctctcattagttgcatttgtgtgtgtgtgtgttttgttttttgttctttgttttttggggttttttttttgttttttttttttgctaaaaagataggagccaaagtgttcatggcttcctattactgttggtgatgataattaaacaggtataccatcagaatgacagtatgactttaggccaattgtgcagcctgcagaaattatccctgctgtgtattaggcatggaaacagcatcaaaagtacaccacatgtatactgaccacggtttgtttttgtttttgttttttgagacagggcctcactctgttgcctaggctggagtgcagtggcacaatccctgcttactgtagtattgacctcaggtgatcctcccaccttagcctcccgagtatctgggactacgggcatgcactaccacacccagctattttgtattttttatagagacaggattttgccatgttgcctgggctgatctttaactcctgggatcaatctagtaactcatggcaccacccacatttgccatttttactgctttgggagtccacctaattcataaatccatggtaagattccttcctgctttggaataaaatggcaccggcctccccagcaaaaccacagtgttgtgtattgcatctccaactgtagattaccctaactctgtgtagttctctcctgctttcttgtactcatttgctgtcctgaagttgttaataaacttaattttgtcacatacagtactttgttaagagtagcttgaggaaagacgtgagaacctttgacaaaaagctctctcatgaaagtatttacctgctttctttctctgcaataatttaaaattgattaaagcaacctgagctcttattttcacatgggcaaaacatttgtatactggatctcttctcatattcagcttatgatcatgaatagtcagaactttgccacagataacagggaacaatgatcaagaactgtttctgctggcagaatccagttgatgtttttgaagggctcagactgcacagctctgagctcagtggagagcggtcctgggctgaggtctggccttaatactgcaactccacttagaaaattgtgcaggcgaggtgttgtaaaagcactatgctacatcttttgagatggggaagctgctcccagggaggtatttttcaaagattttccctcaagctactgaagagcagttttttgttactactttatgacaccagctggagccttgcaaagccccaaaggttaattctcttttcggtggttaacataggcttaagggctgactcacattacccaaaaagttacggttccatttacaacctgatcatatcctcaggagggtttgttcacaggcccacctgcccgtggctcaccctgccaccctacctacctgggacttctgcatccagcgtcacctgccccagggctcactcctcagcattcctcccaacaggaccacacctaggcctagggtggttagaaacttgcatgatcagccccagaactcctgcctctgatccaacccagacctgggagcacagaggctactgagagggctccctaatgctaactgtgaaacagcctttgcactggtttgagctgatgcttttggatggggacagggtggctggcacccgtgggtgaaattgacagggttctgagaggcatatccctgctaggatcaactttggaattgaactgatcaaagtcacaaggagtacagctgtaggattgttacgtaagatccaaaagcagtgaaaagcaacacttggtgttagaattaagattacagtactctggagggagggaggcagagcctcagtgaaggtacaggggcttctgtcttggtgatctgccctggggtctgtggggcaggctcacgggcacacctgccttggaggagtttgcaaagctgactgcttatttctgttggtattatacttccgtttttaagaaatttattttagaaaaatgtcagttcaaaacaacaatcagggctgggcacgatggtttatgcctgtaatcccagtgctttgggaggctgaggtagaaggatcagttgaggccacgaatttgagaccagcctggggaacatagcaagacttcatctctacaaaaaaattttttaaaaaatagagcatggtgtcatgtgcctgtggtcccagctactcaagaggctcagttgggaggactgcttgagtccagaagttggaggctgcagtgagcagtgattgcaacactgcactccagcctgggccacagagtgagaccctgtctcaaaaaatgagccataaaaaaacaaaaacaaccatcagaacaacaaaatgtcagaacttttagagttcctgcatccacaaggggaccctacccaccaagtgccagcctccgtcccagaggtcaggatggacagagcccctgctctggtgtagtgtgtatgttccacacaggctcagggacctgctaagccgtaggcgtctcagaatgaggaggggcatcgcattgctggagtgaagttcacagcggggcatggaggatgagcgagcatgtagtcagaaccgcatggggaggccttactgggctgtgcacaggactcaagcatctccactgggtgatcacaaacagttgaagatttgagcaggggcatcccatgttcctctgcagagctggggaggaattggggatgaagaaacgtggaaagctcagagaggagaacacactggtccatagagagccgtggatgccggcggcgctgtaatggagatggaggagtgtagatccatgccccgcccgcctgtgcatttaccaggattgcctctcatgcctggattaaccattccttgcgactgcaacttgtggggcacacgagatggggaattttctctctacttcttccaagtttccactcagtgaagccgtggatggagccccaagggcactattgctacactggaggaacccaaggtcgttgtggatcccgaaagaagggacttggggcaggtggcttaggagagtcaaacctggtgtggaaaccctccaggcagcagtgaaggtaacaattgtttacggaaaactatcaaccattttctaaattgagttcttgtgaaagtaaaatatagatatgcctttactagggagaagagagcaatttgaattacattcttcagttactttttacacctttatggagtctgattttagattttaagtggactaacaaattcctcattatgtaaaaaataaatatctgcctggttttaacaatagatgcccttacaacatttttaaagcattaagatcatgcacgatctttaaagacaatgtatacagacgtcacatgtcttgtgaaaggaagtctggctcgtgcaccaggttctgaccacctctctatggggaaggaagcccacattaggtgctgtgtgctggatccaggagccaagtcgctttccttctggtatagctacctgctgaaagtgatagtggctgttggtgccgttgaggtttttctctttttttttttttttttttgagacggtgtcttgctctgtcacctaggctggagtgcagtggcacaatcttggctcactgcaacctccacctcccaggttcaagcgattctcctgcttcagcctccctagtagctgggactacaggtgtgtatcaccacacccagctaatttttgtatttttagtacagatggggttttaccatgttggccaggctggtctcgaactcctgacctcaaataatccacctccctcagcctcccaaagtcctgggattataggcatgagccaccgcacccggccagtttctctcattttaaagcacaccaagtcttaccacaagaatcatgctcagcaatttatcttaagatcagactggcctggaattctttcctccctccctccctccctccctccctcctgcccgctccccccttccctttcttccacctgcataatggctacaagaagtagcaggtggggatcagggtaactggctgtaaactgcaaccagggaaggcagccctgccccgggtaactaaaggccctttagttagggttagcctgcataaatacatgtaatgagagcagcaacagcttgcaatttatacagcactttgcaatttaccaggcggcttaacacttacaggcatttttttatatcagtggtaaagactctagaattatgtctaggaagaattagagggcttcagactagtgggaagggggtcggtcttgagcctgtgcttcatactaagcatgctgattttacttagatcgaaagacccaggttagtcgagtagtcaagcaagattttagttacatggtacataaatttatgaaaatgtccagttcatatgaaaatatgtaatagcaccccaggccagcctcagtagtgttactaatcacagatgaaaaaatgaagcctgagaacacagcagtcacaggtacgagacccagaggggacttcagatctaatctgaattatttttcctctaccaaattgactatctggatttagtggtaggccgctttgtacgtttggggggactctgtcccagagtcagaattataccaagttctttgttttagaaatgagaaacctcgggagtaactagcaagccttgaaggggttcaagggtgaggtgatagtcatgtattgatataaatttactgattttgatgaatgcccttatttgtggaaatacacataaagtattcgggtaatggaacatcgtcttggcagcttagtctcaaatggcttggggaaaataatgttttttgcgccgtttttgtaattttcctgtgcactaaaagaagcagacatatcagcagtggtttagagactaccctaggccgtaaaggtagctgggagtctggagacttgggctcccctgctgtgcctgggcagtgccctaagtttggcataagcctttaagaggccagaaagaatcatcgagtatctgctgcagttggacttagaacatgagaataataccagatgtcaacgtgcccagctgatgcttcacagaatggttctaacagtacatgattcagaactttctctaattattcatcatatctatatccccagcatgcaagtgaaaaccatctctgcttcttgctgggtcaccccaggctgttttgagctcctgggctcacagcctctgtgattgctgggaaatcggaaattctcatttcggcattataggattgtgggtctgtcatcgtgattataaatattctcacaggtctcaacaagggcagagctgttcatctctgaaatgaaatgtgggtaacaaatgcagcagcctggttctcgtggaagccgagtctaagcttcagttgtccctttctctatcccttggaaatcccgtctgagccactgcattctctgctgtgagtgacctttgagaacagtaaccaaaggctttgaaacagggatgcagacacgatgcagcaaccccaacagtgtaatagggtgtgttccgatcagaagggggagcctggtcagatgttatttcatctggtcgggatgtgaaggaaggataaggcttagtccctgactttctgaagcttgtatttgtaatataatcgggaaaataatactggcacaagatggacagtcctcattcaaacaatagcactgtcccttcctgtccaatgggaaactagggctgagttatgcagctcgggcacctgtgctttcagagagcatgtagcattgtgggcaggagggaggactctggagtcttcgatcacctgcattcaaatccaggctttgccacctactgctcttaatcattgagtgactttgaacaagccgctgaagcttctgagcctcagttgcgtcgtctgtataacgggatacgtgactgcttgtctcataaagtttttgagaactgaaggaagtcattcatgtgaagaatactctgagctgggttgagacttggcgagggggggtggggtctcacttgagggatgcagagtgcaagtgaggatgtgaagacggaaacccataggtgtggggaaggccatcggcgagccagccggactggggtgagcaagagggctggggcagcctctggggtggggcatgccacaccgtaaaggccctgggtgtgaaaaaagaaccctcggaggtttccacagggcttaagggggagatgagtgctggggtgtccggcaggggtcctgatccttgtcttcaggacacgactggaagggcctgagcctggcagtgggaggtgggggacggggcctgagagtgacccagggtgacatcccaagccctgagctcagctgtggggatggaggacaaaagagaaaaggaagattttgaaggaaaacccctaggactctgttgactggatggggaacacctcggagaagtattagaatgactcaagagtttccagcctgaaggaccaacagtgacccagagagtgggggaagtaagaggagactgagccacggtgcgtagtggagtttgaggttagggtgggacgtcagtaggatgcagagaaggctgcaggtgtgaatctcaggcttgggaggtacacagttatccttatgacatacttctttatgtcagtgaattttcattttcagatgtgtaaagataatgtaatccagggcctacctcggagagctggcacttctgaggcagctgattaggtacctcagccaggcattcaatttctctcatgttaaagactggacctggccttctcttctttgtccctttcacacatgagtttggccctccgaacccacgggaaagatctgtaacctctagctcacatgtgcatgtacacacacacacacacacacacacacacacacacacacacacacacggttccctgcaaatggatgactttagatgcagttaacaccatccaaataatactagaaagaataacactggaataacaccatccaaataacacgagtaccttcaactaaaaagcggtcaccagagccctccccagcaggaggcctcttggtagctggtgtcagggccgcaggctccctcagccagcatcagtgctccctgacctccctgctgaggagtatgtggcttccaccctgaagccaaacagaaagctcatgcagtagaaaagcctaaaccaagtcccccaaactaatctcacaagcgttttcccagcaaatgggccgtgataattatttctcctcgagtgcctaaagtgtgctaggtacctgccaggtgcccgaatatgtttttatttcatcttcacagtaagcctactagggaaatcataatagcctcattttgcatgtgagaaaactgatactcagaagttaagtgaggtgcccaagaacacacagtacgtgctgggactgacatttgagcccagtgtggcctgactctgcctcttgtgattgctgttcagtctcaggaattgggggtgctgattggtgtgggagggagatgcagttcctgctaggcatcaatactggcgactcccacccacacgactgttgaggttatttgctgcccttgcgctagcccccaaaatgctaagggaacagttccccagttctgcctggaccctagggattcacgtctttgtaacttttcctggttccttaatgttgaggtgagcaagagccattaatcaaaataactgagaagctgagtgtcataggagtatactccttttccgtaattgagtttaatctgggagcagttttgtcagcacacatgtgccgctgccgcatgagtcatcttcagcatctttgtcatcagtttctttgtatggcacagttttctgcaaacagatattcctcagaatcataatctctgaaatgcctgagttttataaaactattaatcagttgtcttcactcttaaagacagagatattattattattattattattattattattattattattatttgagacagagtttcattcttgttgcccaggctgaagtgcaatggcaatatcttggctcaccgcaacctccgcctaccaggttcgagcaattttcctgactcagcttcccaagtagctgggattacaggcatgcgccgccacacccagttgattttgtatttttagtagagacaaggtttctccatgttggccaggctggtctcgaactcctgacctcaggtgatccacccaccttggcctcccaaagtgccgggattacaggcgtgagccaccgtggccagctgggatattacttttaaaatttggaaactatagaaaagcataaaagagaaaagcaaatgctccgtgatcttatcactcagaagtaatcacggttgacattgtgtctcttttcccagtgttaatataagtatataatcaagatcctgttacacagatggcttcttgctgttgtcagtactagctgtcacagtgcagttcatctgtaacagcagtccccaaactttttggcaccaggaactggtttcgtggaagacagtttttacatggatggtggcaggaggtgggggcgatggtttcgggatgaaactgttccacctcagatcatcagcattagatagatgctcaaaaggagctcacaagctagatccctcacaggcgtagttcacaatagtgtttgcgctcctgtgagaatctaatgctgcaccgcctgacaggaggcagagctctggtggtaatgctcgccagcccactgctcatctcctgccgtgcagcccattcctaacaggccacagaggtactggtctgtggccccggggggttggggacccctggtctagagaacatcaggcttttcccacagggtacttggtcctgacacaggctggaaatgagatgtacccagtaatttttggtatatatgcttcctgggtgttgagtgcttgggatgctcagtgtggcttatatattctgtgagtcatgtaaaaggagaagctgattctttatggtgcatttgtcttagaagtagtttgtttttctgagttgaatgttcttcaggaatgagaaaattcctgttaatcatcctacataccattcagacatgctttctaaactaagccgctctccaaggaaccactttttcctttcaaatcagtacaaagccaaactgttccccttaaaatgtttgtatgtaacataaggggaagaaaattcagctatcttaattctattttaaatgttccgcttctccaacaaattgtttatcgtctctttatcacgctaagacaaggactctgtgggttttcagagatgcatttaatacttcacgtttacttttcatgtctctgttgtataatttaccattgtatgaacatgaattaaatataatgtatcagaatttagaattcattaaaattctgtcttgcaagattgttcataataggaagggcccacataacatggaatcttcggcagtagttgtggtgccagacaccccaaaataaatgtgggtttgtttttgtgtatctttagcttccaagtatttagaaccaaaaatgtaaaacaaatcacaacagattagtgggaggatacttcgagagaaaatagacacggattgtctaaaaagatttctaatggaggacaaggcaggagagaccctgggaagtgaaggtggggtccgtacccttggaatactaaggagaatcaggtgtggagttcacagtggggtgtgtgggattcacattgctgtgtgcgcttggctgggtgagagccagtcgtgtcctggtgaaaggcaaaacattaggcagagcatttcccaggaactggcatcttggttgcttcttactaagatgatctcaccctgcttcagcttcctaaagatcaccccttcctaactaattacttgagttactcaagcgggagtcttaagtttacgaataaagaaacgtgaaccaaatatgccagggaattagagaaccatcttcctagcatgtttctgtctgcatttacccatacggtgtgctttcttttttaggtgctatccatatgtccaaaatgttcctttgctctattccattttagtgtctgtttcctggaagcaggtatgaggctactgagagagcgctcgtttactggcttgatgtgtgaagctgcctgcctgcaagcaggtgggcatctgtagggctcctgcatggcccacgtgctgccttggtgtaaccgatggaccttggcaagtatgggtggagttgggtgtatttctgcacatcagcctgcattgactcatgtcagtttttgcccagaagtctgtccctatgatcaactcctccaggctgatgtgggtttttctttataacttccccttccgtttgggaattcacagattttgggcacgcactcaggttgtcctcagtgacccccacagctgtgagagccacccagagggcaactgttcataagttaaaggctggggtggcctgcgttccttcctggaagcaggccgtgctgaggcagctgttgatggggaatcttgcttggttttgtgtttttgtttttttaaggaacatagttgttgattgtctgatttgtgaaatttacaagtgggtgtttgtaaagtagagatgaattagtggtaaacatgcagttcgttctaatgctgctaattgaagttgactaaatctgtaatgtttaaccggctgtgctaagaaacttcattcagtggcgagaaaggttggttgtgtggtgtccaagaggaccacttgatccccttgtgcttctactgtgggttttctttttcttcttcaaagcctgctatacacagttacgtttaaaaagtgaagttaatcgatagtttgcactatctgtagaattctggaaaggcgatagcctggctcagcgcttttctatgaaaatgaagcagtcgaggcccggggcagccaagcgacttggccagggctatgagtctgcctcacagcaaggccaggagtgggcccctcgcagcccaggtttggaggctggagcccagttccatcaaggcccttctccaaagcacggaacaggtggaccgcacccaggcgctccagagcacttatgtctcagtaacgtttgtttgtccaaagcagcatacgatccagccccgctgcccacccttacctgggaaacggggctcctctcatagacccacagtgctccccctagcctgttcatacgtgccctcacatctgagctgctcctgaccctgagagccgaagtgagctgagactcacccctctggagctttttagggaggatagaggtgcgtgcataccttgttgagaaagtgccacaccggatcctgcatgtgtccctagccataacagcgaactggtatggggatgacaacacaatggcagccatcacctgggctcctgctgcgtgtcaacaccccgctgagtgccatcctcagttactgggccctcataacagccccacgggtaccaggggtttccttgtgttacagatgaagacatgtagatgcagagagatgttacagaaagtgccaaagccaagcacgaggaggcagagaggctgggctccagagtgttctgagaagctggcacaagtacggttcggctgtgtctttgccaaccacgtgccacctgcgtgttcccccgtgaatgtgctgtctctttttgtgtattcgtcacatttcactttcctgagcaggtgtggtcctgcagaacagcaggcgtgctgaacttttgccagtggattgacactttaagcagtgctccagaatgccgtgtctcatccttgccgcgtcttgtacactcttttgcatattcaaaaacgcttgggctcatggatctggtatatgtgttgagaggtactaaatatgtatttttaattaaaaattataatgaaaaaaatttttaattctcttcattggcatctgtgttcccatttgactttcattcacatttgtgagaaaattctatacttttagaccatttttttttcaggtttaaatattctatcattttgtttgcctgcctgctcacaaaggaatgggctttcttatgactggagtggaaagtcaggttcagagccctggacacaaggacccatgtggtggtcgggagggtgggtcctttgccccaacacctccctttcagagctggttcctggtgtgcccacccactggcaaagggactacctgcgcatagagatgttggaagacactcggccccacctgtatgggctgaagtccatcagtgagaccacagtgccacggggccaagcaggggccctacaggtgctcctcctaccctccccttcagagagcagccagctggaggctgaggaggcagggggccagcagccctaacccccacccaggcagggtggctgcttggggtttccctcagggatggcaactcccttctgtggcatgaggcttcttcctccctgccatcctgtggcagtcccttcctgaacttggggattttgaatggcgcacagtagaatgtttcattatggggtatgcatgcctagaaataagaaaagtcaggccaggcacagtggctcacacctgtaattcccagcacagtgggaggccgaggtgggcagatcacttgaggtcaagagctcgagaccagcctggccaacatggttaaaccccgtctctactaaaaatataaaaattagccagggtggtggcacatacctgcaatctcagctacttgggagacggaggcacaagaatcgcttgaacctgggaggcggaggttgcagccaagatcgcgccacctcactccagcctgggtgacacagtgagaccctgtctcaaaaaagaaagaaagaaagaataaaggtaaatatcctggagttattccagtctggggaaattcagggtggttcaggaaataatgtaccacagagccaccagacacagccagtaacagcggtgctttcaccctaggagcaacatcactgacatacgggtgtgtgagtgcccagcacatcgtaggatcttggtggaagggaaggaggaagaaatagctgcagagcagggtcagcgtgttgtgtgcttgggaggtctgctcatcgtgatcctggcctcctactttcgctcacacccctggcagtggaggtgcctgtcactgcagacacaggcctggagggtcgatgagtgcgtgtgaaatcggggtgatgagacagcgagtgaggtttattaattgcagatgtgtattgaatgcctgctccatgcccagatctgaggccacgatggtgactttgtttgtccttcccaaggagataaatacagagagatgaggaggatggtgagctgagcaccagtgagcgctcccacagcctgcgggagacaggcctttagacaggcaaggtgctgtcaggcgctgcgccacgttattgtagtgctggttactgatcaaggtgctccgcacgctttgggatcaaccctcattttaccatggagggaaggccagtggtgtttcctcatgggctgtgttgcctgcagtctgctcagggagatggggatttgctaagcttttgaaaaagataatggtttttcttttttcttttttttttgagacagagtctccctctgtcgcccaggctggagtgcagtggcgcgatctcggctcactgcaacctccgactcccaggttcaagcaattctcctgcctcagcctccccagtggctatcataggcatatgccaccacacccagctaatttttttgtatttttagtagagacggggtttcaccattttggccaggctggtcttgaactcctgacctcaagtgatctgcccaccttggcctcccaaagtgctgggattacaggcatcagccactgtgcccggcctggtttttgttttctaaagctaaactactagaggtaaaaagtttcctgggtcaacttcctaaggtcaattaggaccttagagagcggggaggaaactacatgacacctgacaacaacaggaacctgaagggacagttttggagatgggctgagatttcgtgcaagggaaattggtgcccaaaagggacatggaagactggggaagctgtcaagaatacatttactgctttttctccatggtggtcaggaatttagaatttcttcttccttaaacgtacgcagttcttaatggtgagattattttctgccagcaggacacttagaagagaaaggtcagttgacgaatatttttgctttgctcgacacgtttctgccagcctcagctggagagctctatgctcctgccctgcccagatccctctctgcagctacgggatcagctgaaggtgcctgctgctgcttgcacgctgtcacccgctaccttccccccgccaccaggcctgccctgtgcccttgctgttcacagtgtggccctaacacctccttcacatcactgaatggctctgagtccttctgctcacagccgtggtgtagcctgtcttccttgccacgggtacttcctgtcctcacctgagcgcctccgtgtcctgcgggaccgaaagagacatgctcagggaggtcctccctgacctcctcctctttattgcgattgtcaccgttggtcatctgcaacttgggtttgtgtaagtgattctctatttcactagtctgtgaggtttaggaggctgggtaggttcttcacactttccctcaggctgagcattaaacaacaaatgagcaaagaacccttcttgagaactctgaagaaatgaagaaagaggtacagccagaggtggcatttgtaggtattctagtgtaaattcatggcagagccaagggacagcatttcaggaaggaatggagagcatcgtgatctgttagttgactgaaagtttttgcaccttaaatgccatttgttgctagggaggagtcagaaatgattcggagaaatctctgaaaaagtaactgagtcccctttctccttcatccggggacacctctgttgagcagtgagtacattctgatgcccttcccggaagtggacgttagcagcgcctgtcctctgcctgtcttggcaggtgtgctgtgaccctggttggggccagaccagtggcatctggtgccctcacccggctgccaggaaaggtcactgtccttccatatcccacacccccagttccatgatccttggccagcagtcagtgtcatgtctgagcctccatatgacaaaaggaatgggtgtcagctgaagcagctagctgatggcatttgtgcgtgagtctcttccaacttaaatttgaccttgtctgaaatcgatttgtacccaaaagtctgtcccactctcatgagccactctcaggatgttctctgaccactgtgcctaagatactggccccagtgaattcatgtgggcccaccctaagtcaactctgagagcccccagaaaatcgaggttacatcatgttggtctgtgaggcctaatggatgtggcctcccagcatcacaggtttctcattattactcctgcagtaaatattttaagcccagattctccaggcttaggaaacatgcacgccacccagctatgaattatgtctgctgatccaccgccaccaccaccctcactcccacacccaaaacccttggtcactgtgttcttttcagctcacccatatttaccacgttttcagatgggaatcaacagtttggctcgtttaaggggatggttggggagaggaacagtgaggctgggggaagggtggttttattttttgggggctcttaattgaagagactgaaagtcaactcaaaagtaactgaaggggaaaaaaagaaaacgaaaagttggctcagatgattgggaagtacgattggatccaggggtgcaactcttggttggggcctgtctctctgagcctctccctgctcacctctgcccttcactccttacatgaacctctgcagcgtgggcagatgctgctgcaaccctggccatgtcctcctagggacggtatttcccccatgactgtagcaagggtcccgggagtgccctgaccacacagatatgagtcatgggccttcccccatggccagcaaaggcgggggaaggctcggggtgagatggggcccttcacagagaggaattttgtttgactaagagaagggacaaagggttctgaacagattaagacaatagaaccatgacattaatctcatgtggccgccctttcaaaaaatccttaagttgagtgaatttgagttttttccctttacctattgaaatattatgatgataaatttgtgcccttcgtactctgaatagtggaagctaatcttagcagcataactaaaaaagtagatgcaaattaaatgaatatacagcaacacaaaaacttgtagaagctgagctgaacgttagttatattctgactcttatatggaaatgtactttggtcactttataccataatcagatcttatctccatagtatttaataaaagctttttgtaatatttagctgactttaataataggttctgactctagtgggggaaacccccacagatcaataatctcgattcttagcaaaaatagcattttcaataaaaggaagttttctgattaaatttggtttatgttacacatctgatcagtagcaaaaattaaatgattttgccatagagcccccaaaacttgagcacaccgcgtctaaacgaattggcttgaatatgtttccaaagtaccaagtttgtttgacgcttcagcttaaatctcccgaactccagctggaagatgacaggcagagcatgttttaaagtcatctgttacaacatctcttcatctgaaaggggatataaaagattttgactttaaatttactgacattaataatgtatgacatattcaggcttttattaggacccaatctttaatgtctgtaattttattcaggaaagttaaaatgtgcttattatcaataaaaataaaacttgtgatcagagatccagtagcttgatgctgcaaaatcaccaccaaagcagaaactatagtttacctttaaatccaagtcagctatttgccacttaaaattatactttctgtctgctcactgagtgacaaatgttattacctgcagtacacatgttattttattattatgaaatgcagataaagtcatggcacagttggtggctggtctttaatgtggcacctgtggtggtagcttggttaaggagtttgttcacactccttgctgtccatcttgggcagctctatgctcaggagctctgtgtccttgccctccaacctggctgctgactggcctgggagacctcaggcaaatgctcagcctctccaagcctctgtcactcgtctcatctgtggagcacactgtcaagcacccagggcccctgtgtagagcaaacagaacattgcagctgctggaggtgctggcggtacggggtctcctgccccgcccagtcccctgggctgtacacacatggaatcctgggactcatttcccacagcagcagcctgagaacaactggccaagctgctgcagactgaactgcaactggccaagctgcctcagatcgtgttccccccattcatatgttgaaatcctaacccgtaatatgatggtattgggaggtgattatgtcatgagactgatgccctcatgaatgggattcgtgcccttataaaagagacctcagagagcacccttgctgcttctgccatgtgaggacacagcaaggaggcaccatctgtgaactaggaaatgggccctcaccagacaccgaatctcctggggccttgacatggggcttccagcctccagaatggtgagaaataaatgtctgtaattttactttataagtcagttggtttacagtattttgttataggcgcctgaaccaattaagataccatcagatctctaaggtttcttctagaacttaaacaccgtaattttatgatgatagatttaaagtgcttgagatgcttttcagtgtaagagttaaaatcctgctcactgctgagcatgtctatgaaacagcatcttgctttttttttagttactttcattctttcattctttttcatgcaaagatatagcagtttatacattattgaacaagctgtagataaagtcattactttgtgagaaaatgctgcttcatctaatacacagcatgccagccattggaagggttttgtaacggtcacattctagatatgatcatcgcaatatgatttatccaaagcatgctgctgtgacacctccaaccaaaatgctcaaaaccaggtaaattctgtgcagtaggattttatgattaacttgagaattgaaagaaaaacacatcatttcatctcttgtctcaagtcttgctaaaacacatgaccgcacaccatgcctcggtaagggcaggatgggaggcattggaactgtctgggtgttctgcatgggtgaggacccacctacctcacgtctccctgaaggatccacctggcctgcagcctgctttggagttcactgttgaccccaaggtgagcaggctccagggacatgctagcgaatgtgctcttccaaaatgcaacatagaaagactggtgagcaggggccctggatgatgggggcttccagtctgccatgttctggttggctatggtttcattatggtagctaaagacagcccaaatctgagaagtgggtatgaggatttgcctgtcttgttgagaaaatatgttaaaattctatgagaaaagaatcatgttaccctgttaaacacacattggacttcaaattgtgcttctgttacaactggaagcagtaggtggttttactttaatgaaagatgaggcgatgaagcggagatgtgtagaaaaactacacagagagaatgaaaggaaactgggatctgggtgccgcctctttacctacaaggtaatgagtttgccttcgaattagagagaggcagtcgcttagagcctggaccactcagggacttgccctcggtctggacgcacagctgcagtgctccgtctcccagacatgcatgaatccctgcttgttctgcagcagaaaccgtccctttgagatgtcccggctgccacctggcggggtcacagctccaggtgaagtccaggcaagaggagaaggacaagggatcgctgagtcccctaagcctgcccccatgtaaaggctctcctgactctagggttgcagtttacttaattatcctcacacagaaaggccacctgcactcttggtgcatttttctcttcccactcctcctcctaccactgagacaccttgcccaggcacccttcccctccctccccctggccacagctttcttgctctggtatccttagcagtcaggagggcggcacacattaaatcttcatatgccagcattcaggatctcccatcccttctgttctagatgaccctggctctggccattgggcaggatcagggtgcagggaggagaagggacctgctttctcagcaacccagcaacttggtcccattgacgtctttcccacacagtacccctccagcctgctgagacctattaactgctgttctggggccctggcctgtcactggtattacacttcttatccaaaatcttcattatctgaacctcagcccctcttccatctggagacacaggggcctcttcattctgtagagaaagagaaaaggtttctctctgcttgggcatgcaagcaggcagggagggagtggagtagattcttggcaccccaattcagagtcctagtttcatttcctatagaaatcatattacagatgataatgctttccataaaaaccattctggacaccagccgctatcagaactatgctccttcactattatggattgaatgggaatttactgggagtacagtctgtgccacatcactggtgggtatgttgggccaattcctttacctcctgtagcctcagtttccttatttccacaaattaagaagttgcccactttgtcacaggactgttgtgagggtttagataacatagtaaagtcaggtccctctccatctccagacacctgcctcttgaatttcactgcaccagcagctacatacaacattgctcccatggaagagtgtttgcttcccaggtgtcaaagtctggcaggcaggctttctattttgatggccatccaacactggtaggatcatggccaagtgtttttaaagaggactttggccctcttttggtaaagtattgttcagagcaacaagaaagccacagcttagttaataagggtaatcattgttatccacagagcacttcctgtgctttatagcatcagctgaacgctggtgcctgtcatgggccagattgcatcttcctgaaattcatacgaagtcccaatccccaggacctcagaatgggactgtgtttggagacaaagcctttacaggggtgattaagttaaaatgaagtcactggggtgggccctcatccagtctaactggtgttcttataagaaaaggagattggaacacaaagaaaaggagattggaacacagacacactcagagggaagaccatgtgaagacacacaggaagaagacagcatctgcaggtccaggagagaggccttgcaaggaaccaaccctgcccacaccttgatttggacttccagcctccagaattgtgaggaaataaatgtctgttgtttaagccacccagtctatggtacttatcatggttccctgagcagactagtatgttcacatttggggggtaagaaaaccagtacacagagagacatttattaagtaatttgactaagagcatgcagctctctgtcagtctgcactgaccctctgagttgcgccaaagactatttagatcacattcaagcaaaacaggtaaaatttccgctgcatgcttgctatgtgcaatgttccagtcttgatggagaagtataagctctatgcaggcagaaagcatgcctgtctgctcatttcacccctcaccaaagtctagtttgctgcctggtatgtctcaggaactcagtggctgtattaattagattactgtattttgtttttgaaagaagtcactaaagtagaatattcgtctatcagttataaagtgtctttataacgtattgtgatggccactatcaaatgtcttttttgctgatcttttcacctttatcttcatggcctgatgaatattccgaaacctgctcttccacaggcgttttttctcaagtagcttttgtaattcacatgtttgcaaaggtctattaaaagtttattgttcaatgttatttcttgacatcattgttgccaataaaagttggcctcagcgtagccctcacgccccggcttgctagctgttttgataaggccgtgaggccttcctggttgagcttcgggcaccactgccttctggacaaaaaagtttgctttcatggatggcctgccttctggattgtggagctgtggcggtatcatggtgctttcattgtgtagttgaaccatcctgcatttgaaatcctatgaaaggatgagttctcagatttagaggtttgtgtttttatataagttaacacaaagtagaaatctaagcgtttcacctgttctaatattctggcttactcttgtgtttcccatgcacatgcataaaatgtggtacaaagagaaacggcagaggccattagcataaatgaatcagtgtatttgctctgaaacgtacgtggcctcacatgcctcctggcgccgcgtgggcacatgtcccagggtagtggcagtgggaggggggcagcagcccagctctccaccattgaggacaatcagcctttttaccctcttcacctcctgcccactcagcaaggccatagaagcacaagtaattcttaggactgatcgccctttactctagtttaaggaagaaaaggagaaaggggtacaagctacccatggaagtgcttggaggaagtcattttgaggagtctacaaatgactaaacctccacactgattaaggtagaggtcgaagcagagctgtggtgggagcactcatctctcaggacagctgaggaagggccagtctgcttgtgtggggtgtgtccccagctctggggctgacatgctttcctctcctagaatgttccggaattccgtgcattttaacacagttaaaacatttttaccttagggcttttctagcatttttcctcatgcacaggaagaaatgtttctcaatctgattcgatactcgtatctgtgactgaagaaacagtacttactgtaattgtgtttgatgcactgaaattttctactttattcccttaaattcaacacatacctataggctggttgcagcccattaaagtgattttttatgatccactagtgggctttgaatcacagtatgaaaaaatttgccttcgattgaaggtatcagctaagttttcctaatgcactcatcacaatctgttgtgggaaattagtctgctgttttgaaagaagagaaggattgtaagaagagaagaaaggtgaagatgatgggttttgcccagtagggctgttatgctgcccaggggtgagggtgggggcagtgagtgtcccaggagtggaggaggcagcggcaaggcagctgggggcagggcaggttatacaggctgcgttccctaagactggatggtcttagagttctaacgggtctttgaattcatttagtctgacttcccacccattctaggaatgaaaaagatattttctctgcatttatactttatttttctgagaggcgcagggatgctctaaaaatggttatttcagaaggaaaccacctactcttgttatcttttgtgtcactggtattcccgcattttttggttttagagacagggcctcactctgttgcacaggctggagtgcagtggagcgatcatggctcactgcagtctcaactctggctcaagccatcctcccacctcagcctctccagtagctggggccacagatgtgcaccacaggtggctaattttttttttttttttttttttttttttttttgcagacacggtctcgctatgttgcttaggctggtctcagactcctggcctcaagcaatcttcccgcctgggcctctcaaaggctgggattccaggcgtgagccactgtgctggccctgtgacatgtttttatggataaaatagatcaatttaattctcaactttaagtaacttcgcaactacaggaggcagctgccagcaaccgtatttttctcatggtaattacagtttgtaagcactgtccatgtgtcgtccccttgtatttaaccgccagagaaactgcgtggaaatcccggtaggctagggagtgtggtggtgcccaagtgccctgcgccactgagccttgctgtgtctccacaggcctcggcaagacgcgcaggaagaccagcgcgcgggatgcgtcccccacgcccagcacggacgccgagtaccccgccaatggcagcggcgccgaccgcatctacgacctcaacatcccggccttcgtcaagttcgcctatgtggccgagcgggaggatgagttgtccctggtgaaggggtcgcgcgtcaccgtcatggagaagtgcagcgacggttggtggcggggcagctacaacgggcagatcggctggttcccctccaactacgtcttggaggaggtggacgaggcggctgcggagtccccaagcttcctgagcctgcgcaagggcgcctcgctgagcaatggccagggctcccgcgtgctgcatgtggtccagacgctgtaccccttcagctcagtcaccgaggaggagctcaacttcgagaagggggagaccatggaggtgattgagaagccggagaacgaccccgagtggtggaaatgcaaaaatgcccggggccaggtgggcctcgtccccaaaaactacgtggtggtcctcagtgacgggcctgccctgcaccctgcgcacgccccacagataagctacaccgggccctcgtccagcgggcgcttcgcgggcagagagtggtactacgggaacgtgacgcggcaccaggccgagtgcgccctcaacgagcggggcgtggagggcgacttcctcattagggacagcgagtcctcggtaagtgcgctgcgcccacagctccggctgcaggcagtaaatgcgccttgcgcggtgggtctgtgtgccgcgcccttttcacattgtgtgagtacactagaaagagcgggagacgcagatgaatgcaatttagtataatgtttgctactccgtgatttacttgcatctgttttggggatagtgggtgtccatttctggaggtgggagattaactaaaaagatgtttttagctcacagaggtggttctgcttctctcccaagattccccctcttgtatttcacaggctcaaacatcattttctctcctggttgcccattctgtgtacgtagaaggcccgagtgatttactttgtttctattcggtctgtgtcccagagaaagcattctttgcaagactggtggctggtttctgacacctccttttgttgtttgcttgctttctctttgtaaaccatataatcccaaggtcattgccacggcaggcagcgccactgagttcatctctcaaaagcttttaaagcacttacgagataaattgaaaagaaaacaggggttcttgggagagatgagttttgtttgtgtgcagtgagtcggagatatgaggccactcgactggggcagcagacccagttcagcggtgggcaggctgggggcggtgagtttcaggcatggggtcaagcctgcatcccagaaggcaggcttttcgtgtgtgaaggaaatactcgaccagttttgcaaacgtctttccgaatacaccttctacaatcgagagacttccaaaacaagcatttaggagatagagtttaatgtatttgaattgtattggttctaggaggcttcaatttcatttttaaatgcacgctataagactagtaagtatgtactacctgctgccactgctgtcctctgaaaagattactggcacaatgaataagtgctcattcaagggtcctgttgactgatcagagaggcattcaaagccctccagagagaggcgactgggatgtgctcctctttgaggacggagcatcgtggtggtggaaactggactcctttatggtgtcatcaattttgcggagccttacatgtgcttggacgggaatgccaggctgaaagctaacttcatctgaaatctgaactctgagatttatcaagtcaccagagtttatcattcctggcaagacatcacattgaattgttctcacatgacgagagctctgtgcaccacttcttttagatcgtgtttgaagccttaagcaaattaaggacagcagcgcttttaactcaatcgagcagaaacttagagaaagcgctggaaaaccaattacaatattaagtgcttggtccagagtccttaagggctaagtataatgcacaaaatatgatcttggcttaaaattttttgagtttgaggagacttctcagaaggaagtcctgcagtgtggagacattggtcccagtcattattctttctgcctaagatttggggaaaagaggaaagactttagagggtagatgaaaaaggtgttctccggggttgctggccttagggaggacctatggcttttctgtggaacatgcacaggtggtcattgctgtctgaattcagggaccaagtccctttggataaggagggatgcatgcattgtctgggtttcatctcagaactctgcaccccactgtctcagttgtcttatattgttagagaatgagctaactttttctaaagaactaaagcacgaattgtttgtatttccttttaacagttttttaatgggggcctttcagggttttttgcattctctcctaacttagaaagtcaaggaacaacatatatgattctaggaatatagggcggaaagagctttactgggacttgcatcggctctgcacacatagcagcaccgtctttgtctgaggttccacgtggcctgatgctgtgcagggcagcttgtcctgatggatcttgccgtgacacgggccattttcagctgttagtgtgcatgccttgttccatggggattctgcaagagccctgaggtgtgtgtgtggcttcttttctcctgacagcagaaccatgccaggtttgctgtatttcctgttcataaccaaggcgttctcagctgtcatctgtgactaccagggacctgtcctggtggacaagtggacaagtcctttgcttgtttttttcccaccatccactgcctccccccgtccccatgtgttttcctgctcattttggcatttctcaggttagagctggctttcgcagccaccactaggccaccaagagcccttaggttcatgatctgacataattccttcgcagcatgccaggatggaaaggtttctgaggggttcagcctccctgcaggactcagtcaggcatctttatttaatttcctttttttcttgcagtctttgggcctgggcctttaattgaggttatcacatgaggcctggcttctggataagcacagctgttttttttggaatggatcttcaataaaatatcctgagtgattgcagtgtaaatgagctagacccttgcttgacgatattgaggggtgcgtatttcagggaagacaaacattgccacatgctacactatccactatcagtaagtgctgggtatttcagaagtatctgttggatatgttagatgaatcagtgaaccaacaaacgaacgaacctcttggaccctctttcctgtcctgaacttcagtacctactgcttgtccttccatttcttcctcctccctcgctctcctctctcatctacaattgtcatttatccttagcagctaaaggtgatgcattgttgttgcttattctccatatttcgttatcataccttcacctgtgagccatacctgcttaaatccagaaaactcagaaatcctactcaccctgtgtgtgtccattataaatccttttatattacattttgtccacattgattctatggatgtggctagaaagctgtacttaaaatgaacagtaaccctttactgggtttctggtaaactgtacaagttgtcaatattttattttcttaattgctgcatctcccatccttgtaaagcttgttcagaaaatgacagatcacaactaggatatggttggaaaaggtgcagagctggcctgcaagtgcgggaggccattttcctctgtaagattttagttcccgaagatatcatgtatttattatgtcctgcaatagtattagatactaatattttttgtcatacagtacttttttttccagtagagaaaaactgtctcgctaaggataatttaatgcacatatttgtttcatttctcttttttaaaatatatgaaaagtatttggctgggaaataaaatagaatagctcctttctgtatttttaaagttataatatttcttaaagaaattataacttttacccaaaactctattttcaggcaatttcatcattccatttctctaaataatgattctctaactgtatgtagtgtgtatcagaattgccttgaagcttgttaaaacaaattgctgggtcctacctgaaatggtactgattcaggaggtctggggcccaagaatttgcatttctattaatagcacgtttcttggtggtgatgctgctgcttttgggaccacactttgaaaacccttgatccctatgatgcattcttagtggttttatatattcttgcagctgttattaaaaccatttctgcataatactacatttccatgaattataaaaatattgtcataaagctgaacttcatttagaactgaagcttttgttgagtgggatttatctcttgaagtatatttctgttgagttttttggggggcttttttgtgtttttgtttgtttgttttttactgtttagagtttgaaaataaacgtgctgtatttgctgtgtttctgctgatgaattaggaggaggtagattgtcagagcaatgtgaaagctgcttccagggtttcatggttaggctccgtgatccatggtgtttcttcataaatgagttaatgttaagatgacttaaccttaggttgctgtgagcagtgcctgtaggcatctttccagtttcaaagataacaagttatttttaattgccaggctttttgcccagtaccaaatggaagttttaagcctggatttttgtaatagttctaattttaagcatatttaactcttgaagatggaaaggcctgcaagatcatgcagtacaggctgttatctggaagtttagtgctcatcacctgattctgattctcaaatgggccagagcccttgaagactctgccttctcactctggctggctcttcaatgctgacctttaaaacagacaacatccagcatcaccagcaaacttgctagaatgcagattgccccagcttgctgacttcgaatctctggggtagggctctgcaaccttggtttgaagaagccctctgagtcctttttttgttccaaatcctgagaacctatgaactcctgaataattctgatgcgccaatttgagaaccactacgttgtggagtatgcacttgattcaagcccttttgcatactgttgtgtaatatggtaaaattctgacttaaatgtatcactcagtcacatcaggtatgacactatggaaagacaaagaataacaaggacaatattctacaggtctatatggtgaggtattacatgtgactttaggaaatacatttggggatagggagggctaaccacacacatgcatactaactggaaagtggacagggaacgctccgtttgcctagattaggtagatgggacttggacagctgctctgtagttgatgattgacttttcatttatgtaaataagattacttccaaagttaatgagatgaatatttgaacatgtcagtgtggattggcttcaggcctgtggagtaaatattttatagagtgaacattgataggagaataggaaaagctggtgagactcttcacacttggggcaaggaagagataatctgatgtaaaaacaaagaacatagggtcaactgacagctagcagcataagtataggcaggagtaatttttattaaaagaaggctaccttagacaactagggcaggtgaccaaatagaatggtaaaactgaaaggcagtttttctgagataaaaacagagaaactattaatcagtggatcacgatttgcctctaacccatttgttctcacttttgggaggtaaatgaaccacttctgtggacagaagagtgccttctgtaaagaagtaaaaggggaaaaacatgtctttaccaaaagaaaagaatgatacaacttgtgataagaaaccaacagggtgacctctctctgggggtagaaggagatgtgtagattattgatgcttggagacttcagcgtggctggagatcagtccagggtctgtgtggaaggcctggtgaatcacacaaagggcatttctaccctcatcatttcataaagtccaaagtgaaagataaggagaagttttaaggtttaaagaaccaaaagtacctggagcaaggcccctccctcccgtttcctcatgactattgtgcttagaagaaaatcgcattaatacataagctttcaggaatggaggaggaaataaaggatattaaagtctgtcctcggcattcatttttttccttctatgagaaaacaatgattaaatcttgagagagggagaggcgtatctgatcaggacatctgttttataaaactgcaaaggtgcttttcagcaagtatttgaggcaatggatcaagctggcaaagccatagagatgggatcaaagagtgtgctctctactgttcttttctaaaagtacccacttatcgcgagcacaaattgcaaagagatgaggtgtaagaattacctaaaggaatgaataatggaagaggtagtcaaaattagaaatttttaagtctgcacgtttgttgaacaccagatactctgagcccggtgtggggatgtggagctaaatagggttcttgcacttagttgtattcaaacacagaatctaaagcctaaacaaaaataatgatgatagaggccccgagagaggttggttttccgccaacctattaattgtccttagattccacttggaaaatgacttctgaaaagaagggtcaaatgaatgggttgtactaattgttcattctccagaaccattgattcaaaaactatgagaatggaaaaatcattccttataaggagtactcatagaaggacataacaggaagaagtggtctgatgtttgaaaatttgaagaatttgcccagtagtcagcacagagaaattactatataccaagtaagtacagtgtttggagatggaaagtgtaggaaatgcggacagtgggaggtagcacaaaggtggcaattaaagaggagaaatcaaaggggagatgtttcaaaacccggggactgagtctagttaggttttagtccaatcatagaaaattgtaatgagtgtcctgtccatctatgatggcttaaaaagatgtccataaattctttggtactctttgcttcagaaggtggagcctgaccctcttcccttcagcatgggctgcactgagcaactcacttctaatgaccaagatgtggcagaagcgatggagggcagcttccgagatgggcattgtggctgcctctttgctctctcttgggtcacttgatctagggtgagccagctgtcatgttgagagtacattcaggcagccctacagagccccctaggggttcatgtgagcagactgccttggaagtagagcctgcatccccagtctagccttcagatgactgcagcctcagccagcatcctgactgcatgtttcaaaaatgtgttaagattctttgacaagcttaaatgtagagtactctaccatactatcagtactctagtacttgttgaggagcaagtgtggcatggtcctttttcatccgatttcttgaaatctgttctagaaagccaaccgtggaaggactgcaacagatgagaataggactgatggagttgctttcatgggaatcattccctggctccctctggaggcagagttgttttgggtcgggagtaactccatctccatcagatgcagggactggtggctcactttgaaaggaggagaccatacagcagtgtcccagctgtcccttcaggggaaattccctatgagagatgtctggagcagagccagagtcctcaggacagaattggaaaagtatccacagactggagctccctccatcatgggctgctttgcccataaatggcattcccatctttttctggtgaccaaacatttgttggtggctccagcactgccgatgtttgttccagattttctttcttccagttctcaaactgcatcagagtcccctgaagggcttattaaaacacacggtgctggaggttaaaacacagatggctgggctccaccccagaatttctgctacagcagggttgaggcagagcctgagaatttgcatttcttttttttttttttttttttaattattttgagatagggtctcactctgtcatctaggctggagtgcagtggccctgtcatacctcactgttgccttgacctcccgggctcaagtgatcctcccaccctggcctcccaagtagctgggaccacaggtatgcatcaccacacctggctaattattttaaattttatgtagagatagggtcccactatgttgcccaggctgatctcaaagtcctggcctcaagtaatcctgccaccatggcatcccaaagggcagggattacaggtgtgagcttccatggctggcccttgagaatatgcttcctaaccagttctcagaggatgctcatgctgctggtcttgagagcacacttggagaacatcttaactagttcatcttcacacttcacttagaggtgttcagtggtcatatgtaacggtgtatgttagtatacagattgttctttttcagatttcctacagaaaatctacttagtttaaattaaagaacactccccaacttttagcactcctgcttggcataaattggttctacatccttaacttttaaaggtttctgctcaggagcccacgaaattaaaaattacctcttctgctgcgaaaattttattgctgcaactcatgcatgcatacaggcacacacacaccatgatgttaaattaaggagcttgaattaaaagcaaatttcccttatgtagaaagtcatctgttgatcatttggcttaattaaaattgggtgtatcttacatctaccatgattcactcccatactgcctccactaaaaatgatgccacattatctctaaattgagcctggcttatagtaaactctataagtgagactgcccttcatcttttcctaaagatacaacttctagtacagaatattaatcatctataggctgaggcctaatctgagattaaccttctggtttcttcctggagtttcatccaggagtatgccctgggcctcacatggggatgagatggggcttttcgcctcaaaggtttgttcttatttggtctatttgagacagaggcatgcataaatacaaactatacttacaattgttcctttcattcttttctgttaacagctatggctgctgggtgagcccagctgccttgcacaatttgagtcttctcagacactcattcccctgagttgtcattggtagaaatggagtgattccttgttttgcaagggttgcacacttctcatcaaacatttatttgggcttttgtgaactctgtaatagacaatggcctagtcctttgttaactgtctggaggtcctgctgggaggtcgcagagcagggctgagctgctggaccctcagagcaggaagtttctgggctttgagaaaagcagaaaactggtctgggaattccaggaagaatttcggatgttaggctgtggtcctgccactggccaggcatgtccgaggtaccagccctgcctcggagagcacatgctcagctccacattgtccagagggctctcctgcccccacacgcacttatacattcacacagatgaactcacacgctacgcatactctcacacactctcaatactcacatactccctctcacatctgcgcacgctcacacacttagagctgcggtatctcatgctcctctttcatgcaactcttttttttgtttgttttctttttttttttcatagaacttactgccctgtgcagccatctgtacacctctatttatctgttccccacaccagattgtcacagagcatatgtcctgcatgcacacacatgtatccagggcaccgcctgcctggcatgtgttagtaactaattgttattcatttaatgaattgatcaaaacttgatatttttgtacaaagaacatttatcgttcagtatcttctttcctgcatgcttttcagcaaatgagataaaagaccaatttttttttttttttttttttttgagatagagttttcgctcttgttgcccagaccagagtgcagtggcgtgatctcagcttacaacttccacctcccaggttcaagcgattctcctgcctcagcctcccaagtagctgggattacaggcacactaccaccatgcctggctaattttgtattttttagcagagatgaggtttcaccatgttggccaggctggtctcaaagtcctgaccacaggtgatccacctgccttggcctcccaaagtgctgagattacaggcgtgagctactgcacctggccaataaaagacacattttaattaaaataatgacatgtttctaaaatattctgaaatagaaggcacatcacagaatttaaatatttttcaataaaatctgtaatcaaaccatagttcagcttcctctgggatattgtgaactatgtttaaaatgcgaccggaattttccactgctgttcatatttttaaatgcttagaattagaaaaattagccaggcatggtggcacatcgggaggctgaggcaggagaatctgcttgaacctgggaggcgcaggttgcagtgagccaagatcacaccattgcactctagcctgggcaacaaaagcaaaactgcgtctcaaaaaaaaaaagaattagaaaaattttgatgtcttaatttctaatagggttagacatcagaagtagtaaaatttctagctactgcctgcatgcaaaccactcttaataaattcccagtttatcaaaaaatagtttgggaaatgaaaaacagcaaatttcttgagcagtcagggcaacactgtatattccatagtgaagtgctgtatattccataatgagtttgcacttttcaaataactaaaacgcatttagcactgaaactgggctaagcagaatttattttttctttggttcagaatttcagaatcgtggactacctccaggtctttctgaacatcagatgccgttctagatataaaacagagacccggctgggcgtggtggctcatgcctgtaatccgagcaatttggaaggctgaggctgggaggggggtggggatcacctgaggtcagaagttcaagaccagcctggccaacatggcgaaaccctgtctctactaaaaatacaaatattagccgggcatggtggcaggttcctgtaatcccagctactcgggaggccgagacaggagaatcgcttgaacccgtgaggcggaggttgcagtgagccgagattgggccactacactacagcctgggcaaaagagtgaaactccatctcaaaaaaaaaaaaaaaagcagagacccagtgtttgagcaatgggtggtttggatttagacgcacaagagatgtggatggatttagacacagctccccgctgtggcccggctgtaactgtgttctgtttcctccccagcccagcgacttctccgtgtcccttaaagcgtcagggaagaacaaacacttcaaggtgcagctcgtggacaatgtctactgcattgggcagcggcgcttccacaccatggacgagctggtggaacactacaaaaaggcgcccatcttcaccagcgagcacggggagaagctctacctcgtcagggccctgcagtgacggcgccccggccccacactcgcctcccgggccccacggtggagctgcccgcccggccttgtggcagaggctcctcccgcggggacggccccgacggcttctctgcgagtctctctttatgttcaggtcgcttggtcggttcgtctcccatttgccatccaggcctcacacccacactcgagcccacccggccggccagctttagaggaggggaggagcagggcgagttcacattattccttttccatcggaagtggcgctcgtgcattcaactcgttcccgctcatggaacccctctttaaaaagacgcagggcacctgtgagcgcaggagcgagcctaaggccacccagcggcagcgcccgtgtcctgggcactcagcgtgctgggcagagcaggtgcgatggccccagtcctagcagccctcgcccatgtcctgtgcccttacatggctcccggactgtgcagggagccgatacgtttgctgatagcaatactggaaccaccgggtgcgatggcagtgaggagactgcccagtgcctttggggctgtgcttgcaataaagaaagaatttcctggaaaggcagtctgcaaaagagggaaccggtgactcagaaagacagatgttttggtaatttaccccaaatgtgccatccacatagtgctttttcctcttgcccttcggcttgtttgaatctcacaattatgtatttaattctcaaagaaatatgtatctgtagccgtttgttgacactaatacagatgattaaggaaaacagctgatctttggggaagggagctaccaacactttatacacacacacacgtgcacacacacacacacacacactatatatatatatattatttacagggaaatttttcagggtttacaaaagagtatgtgattggtagtaagagacacacagaatgtttatgaagaaattgcattttctttttcctttacatttgaacttctttatagtttaaatataacgtcttgagatggcacattcctacgattgaagaaggggtcttgagatcccctaaacttgcatacccagttttttggatattgtaataaaaaaaagtattatgacaaggctctgtgtgtatttatctttgggaaaactcagactcaatcatgggagagtaattactgaagcattcactcattgcggagtggaaatcatttttagagaagagcttaacatttattacttgtgtgttttcattttctacccccacatttttgtatattgaaataatgagttttaattagtgaaaccccaagggaacccagaatctcaagcttggtctgaactttgctctttggaaaatatttgtttagaaatatgttgctgaactcttggcagccagcgctctcacaccatgtgtcccccacgactaactctcgatttgtcctcttgatcgggagcatttatattgatgtgccaggccctgggggtgcagagtcacatgacttggcatttgtgccctcctaggccaatcacgtatcaagcgctccctctgcaccatgcactgcgcccccatttgttcctcatcacagccccatgaggtgggacctgctatcatccccattttatagatggggaaagtgaggtctacaggcagtgcacccaacatgtggctgctgcatggtggagccaggatgcacagccaaggatctgcactagcgctggacccttccaaccccagcgtaggaaggtgttcgggagaagcgaggtgttgcacacttactctgccatgcgagttccctgtgaggaaattgtatctttttgctgctgccttagattacaataaattagaactctggtgtcttgtacctgaggttggtggcacccagtcattgtgaatagacattcaggtgagggagatcattacatgagacagaatacatccagggaaaaaccagtccctccagactctttcgggtctcactaatgagaatgacattttgacctgatgctggaatcccactaaatattgagtgcctggacagctgaatgactttgatgtacacatagcaattcaggtatagccgagcaactaaaggaccaaagacagatgtacattttggcttcagg

SEQ ID NO: 15427 - DNA, 81585 bp, Human
  misc_feature (1)...(81585): n = A,T,C or G
ttgccttgacagggacacttagaggatttgacaggtccagctacatcagatcattggaattggcatgaaaaagagcttctgggccttacataggtttttccaaagagtggggaaaccccaaggaattctgtaaccttaaaataaactgagattcattagtgcagaaacacagaaagctgtcttctgagtctcggaaactaagattttagatgaagttaattttcttataaaagaatacaatattattgtaaataatttagagattgcatataagacaaagaagaaaataaaatgagctatatccgttcctccagccatcaacaccttccacatttgtggcacatcctttcaggatgtatgtgtgtgtgtgggaggggggtgcttacctgtgtgtagtaacttcatgttatacatatgcctttttccctcaagggtgaccactgttgttgcccaggctggagtgcaatggcgcgatcttggctcaccgcaacctctgcctcctggattcaagcgattctgctgcctcagcctcccaagtagctgggattacaggtgcccactaccacacctggctaatttttttgtatttttaatagaaacagggtttcaccatgttggtcaggctggtctcgaactcctgaactcatgtgatctgcccccccctcacccgccccttggcctcccaaagtgctaggattacaggcgtgggccatgacctgctttttattatcaatctataattatatgtattgttcctatatcattaaatattctcctttgacatttctaaaggttgcagcgtgttttgctttgctttatttttgattttatttttagagacagagccttgctttgttgcccaggctggagtgcagtgacacgttcataactcactgcagccttgaactccagggctcaagtgatcctcctgcctcagcctctcaaaatgctgggattacaggcataagccactgtgattggtctgttctgcttttttatatactatttctcatttaatcagcccccttttgatagccatttaggttgtttccaacttttcctaattccaagataaaaagagcttcgagaaatgtccttgcagctgtatctctgcccacatccactattctttcctcgggataaatctgcaggcttagaattgttgtggtaatgcagacagctgtcgccaaatagtcctcagaagaagttggccctcgccatgggtgagtgccttttcagcatactcgtaagtaagacattaaggaagaatcaggagctgttggtcccccaaatcagtttctcttcctctcccagcatatggctttaaaaatgctctgggaagatttcactgttttaattctatagagaaaacagtgtatggctcaagaaacccttataatcatgcatgagcagggaggatagggagggagagaactttctgcgaatgtattccactccacggcttcacaaatgcctggcatttattaagccgattgttcgatcttcccaacatcctctcacccaagcaaatgcccttgtaagctagagagctcgttccaaaggcagcactagaaatccacatttcccagctcacagaggtgctgtgtagcctgggggaagtgtcctttcactcctgggcctccatgccagttacctaatctggggggtgcacagaggtggagctgagcagcctgttggaggctctgcctcttgtatgacaaagtgaggtccctttctggtgctggtggccttcccagtttagccaccctttggattcctggaaaatatgaggcctcgtgtgtccttgaagcaggcaggacaaacgaggacatggcagccccttcccatctgggagctgaggcttctttaatctggagaccttaaaaggcacgtgggagccaggggctgggttcttatctcctaggcctggccaatgtccagacgtgccttatttatagcgccactgacaagggcagcgcagctggctggcagctgcacagaaggttggggccatccaaccaggcagtccgcctgcacagcagctgtccctgctcatcgggctggaggacagaagacagaaccctaaaaccacaggtaagggccactggttcccctgtgcccttctctcacccttgccatccttcccagcctgtctctgcagcagctctgtaggcatcttgttgcatgcagagggagtgtccagccctgggaggaagctctcaggcactgggagctcgctgaccccagcagagatgcaggtgttgctggcagctggctcccaccaacggcagagcccaagaacagaagccaccctgcccagagctacagggggtgtcagcttgaagatagagaacccctgctcattgggaatgaggagagatttaaataaaattgaacctctgccccctttcagtgggaatctgttttgaacaacggaaaacattttttaaggggaaagcaaaagaagaaatgttataaaataaacattggaaagggagaaaaccacagtgcacttgaactttttctccctgacagaatttccggaaagcctgggatgaaaagacaaattactgatgagtctgattactctgggaaagtgtgtttatgcaacatgactcttcgcagctgatggtttgaaagcccagagagctattgcatgctttaaaaaggaaatgcatgaatattttacaatttccagagcagggcaaactccaaaatgcacagtcctgagtaatgccctggccaattgtgtaataatctcaatattgataggatgccatatatatgataatagacatcatatatataaacatcctctagccagactccatgtaagacactttatcaagtctaatctaaaaagaaaaataaagttgtcagtccagtttatttttctaaattattctgacgtccaaagatagtgttaataaacacctgccttacagattaatgctattgtagctcatatttgctatatgtaagtttactatagttgttttatttgtttcttgggaatattatttgaattttattttattgctaggctttcaaaattttatcgatacataatattttacatatttatggggtacatgtgagtgttcggtacatacatagaatgtgtatcagtacatacatagaatgtgtaatgaccaagtcagggttttggggtatccaggatgggctggaataaggtctattatgtgttgagatccacccgaccccttacacaagtttttgtatttaactgagtaggtgactaatccactcaaatgattacactttggaggcattttcttatattaaaaaatattttaatgcataacttccatgaaaagttgcatattttccaatacggggttccctgactgctcacccaccatcttgcctttcagcaggtttcgtacttttaggtttcattgttctattcagggcttccagagttctccattgatttcagatccccaaggccaggccaagccatgcctctcactgcattcccatgacctaaagcacagggacctgcactctttctaccgatctctgaaatgtttcatatttacaagatatggcccagagactgattctaattcattctctccccaccaaagaaagaggtaaaattatattgattgtttatatctttttcactctacaaataatctgtttactataaaaaatacagaccagcaaaaagaagaaaatggaaaatcatatatagtcttactactcaaagataactatttttgcagttaattgtttatcttaattatttattcattctaagatatctttgattgaaagattaaccattaacttaatattcgttttttttaaaaaaataccactatgagatattttaaggtgaatccaaaaacattaaattatgtgggaaactgtaaataataattaacaaaacatatatatatgtatatataaatcaagttatttgctaatcttctttcttccaatttatggccaatgtcttttactgttgattcaaaatctaattccttgaaaattggttatctctatatatcattatgaccaatttgtttagtcaacatattaaaatattcataatagttggatagatgagaagtaaaaaaggataaagatttagataagacattttattagaatatagcaatataacatcagttcaaagtatgatctggtaattgacttctacactattactggtcccttttgaatcatgaaaaactcaaccaccttgcgccttgatctgcatgccctccacaccccacaaaatctggtttactgatttttttttattaccgttgatttgtcagcacctcctcacttaatctctaatacactaaaatgtggatgaaaaatagaaaagaactcacataagttctgagcaatttaatgttttacaatttgatacttcatttgaatttaatggatacattttagatggagaaaagaggaataaaaatccattttaacacaggacttttgttatagttaaaaagtaatactgaaaaattaaactgaactaagaccatatcaaggcaacaatgcataaaacatacttgatctgttttattaaggaggagcagataattagatattaagaagaaagtgcaagaatttcattcaggtctttttttattgtttgtttgtttatttatttatttatgttttgagaaggagtctcactctgtcacccaggctggagtgcagtggcacaatctcggctcactgcaacctccacctcctgggttcaagtgattcttctgcctcagcctcccgagtagctgggattacaggcgcctgccaccatgtccggctaatttttgtttttttagtgaagacagtgtttcgtcatgttggccaggctggtcatgaactcctgatcccaggtgatccacctgcctcagcctcccaaagtgctgtcattctggtctttaaagagtaagcatgtctagatggtatctgaagcggctatgggaaccacctactttcatgttaagtagaagccatcatagtgctttttgcctgggcttagttctgtgcagataaatctagagtaatttcaaggtatcagttcacggtttcgtatgaacacaaaatagaaaatgacatgatttgaatgttctactccaagtcgtatcctttgtaggaagatgaaatggttaagatgaaggcacaatgggttatatgaaaacattacatatatgtaataatatgtaataactaaaaccaataaacagtgcaatagctcaaaagtgaagtatggttaaataaaatatgattagccatagtatggaatatatgcaaccatcaaaaataaagtttgcatagaacttttgatttttaaaactcaaactagaaagcaatattcataatatatgaactgaaaaaatacaccaaaatatataaaattattgattctgaaggataagattggtagtaatgttacatttttctctacattttaaatagtttactaaattttctatactaagtctgatcatgaaagttttcgtaatgcaaaattctatgcaaacataaaacagtctaattattaccaccaattataaaaatcataaataaccaaccagaatgatttagtctattaaaaataatagctagtttcggaggctgaggtgagaggattggttgagcccaggagtttgaaaacagcctgggcaagagatcaagaccccatttaaaaaaaaaagttgaaatttattgaaagatcattatatccagtaactatgttttagctcatttaatacaacagcactataggtaaacattattattaattttgttattattcctattttcagagaaggaaactgaagcttataaccatgttattcattgccgagggtgcaaccaagttaaagataatgtcttgttttttttgtttgtttgttttgttttttttttgagatggagtctcactctgttgcccaagccggagtgcagtggcaagatctcagctcactgcaacctccgtctcccaggttcaagtgattctagtgcctcagcctcctgagtagctgggattacaggcataggccaccactgctaatttttgtatttttagtagagacagtgtttcaccatgttggccaggctggtctcgaactcctgacctcaggcgatccgcccacctcagcctcccaaagtactaggattacaggcgtgagccaccgtgcctggtcaatgtctttctttccagtactttccgatccagttggcattagacttcaattgcaaaagagcaaccctgttgccatatgcaagggacagcatggtttgaatgacataaatgaatgcttcaggtattgagggcaaaatctatgaatgttttaaaatacttgggataaagtttacagagaaagggacgtggtgcctcaaggaaaggagaaattagcagaggctgagaacattacaggtgagaaggaatgtgaacaatatggagatggaaagtgataggattcctttgaaggtaccagaaaatatgctaaatgtgttgaggggtgggtaatgacttaaggacaagggctacctcacttctctttgttctcttttggacattttgaaaactcaacattctgtaagatgaaataagaaagtctcttgactccccaaagtaaaaggggaaaaaagaaaaaaatcattttcataaagaatctggaataggactgatttggattccagatttaaaataaaataaagctctgaattagagagataatagttgttggcgttcgagtgctcatggtgtgtgcagcagtgttgtgtatgctgcacacacactcaggatgtacagggtggctctatgaggagtgttcctggtttccttgtttacaggtgaggacgccgaggcactgagaggcaaaggggcacagaggcagtacaggggaagccagatttaaatacaagcagtgcaatgccagtttcacactaatcccactagaaacttggaaaagtctccacaacggagaaaggacctcatcttaaaaatgaagccgggcgcggtggctcacgcctgtaatcccagcactttgggaggccgaggtgggcagatcacctgaagtcagaagttcaagaccagtctggccagcacggggaaaccctgcctctcctaaaaaataccaaaattagctgggcatggtggagcgtgcctgtaatcccagttactcaggaggctgagggaggagaattgcttgaacttgagaggtggaggttgcagtgagctgagatcgtgccactgcacttcacccagggtgacagagagagactccttctcaaaaaaaaaaaaaaaagaagaagaagaagaatgaggactttgaacttatttttatttttcgtttttaattctccctttagtttcagcaccttctcaagaggctgggaagggtattcatccatcctagttaaaccctgagagctagcactgtaacctgcacacagtgcacaactgactaataaatatttgctgaaccaaactgttgtgtttaattcagttgagttctaggagtgttgaaatccaaaggaaggagctagaagtttctcttcttggctagtacttttcccttctgcaatcctggctgggaaccaggtttcatattcactccctacctttcaatacgtagcacaaggacgtgttttttacatggaattttttggacgcaatcagtattaacatttgatgataatgtatgcttaaggagtagattctctgacttgaaagcttccatttactaatttattagtttgtgtgagtgtgcctgtgtgcacacatgtctctgtgtacacatgtctctgcgtgtgtctgtgtgtgcctctgtataagtctgtttgtgttgggggaagagaagaggatggaaatgctgaaaaaattctaaactctgtaaacttcctttttgaaaagcgtccaattttcttcagaatcttttaattaacttactaggaaactgtaatattttgctctctttaaatataatttaggaaccgaaaaagcaggtgagagaggatagtctctttccttcaactttatttacattgaatagagaaccaatggccaaatgttatgcccttccaatcccaaaatcaaagacagaggtcaaacaagacagtcaaatcagttaggttcagagaaaaaataatagcgagtgtaagacataaagctgagatgtggaaagtgcatgagacaaactccttttaggtccctgtttctctactcctgcaaattgaaaatgcaaaaatctatgagcaggtgcaaatgtgttgggactcaaatgaaccagcatgggcgatcatccaagtgaggggagaaataagcacacccacaatttcatgtctacaaacactctcagaaggaaaatctctgcaggcagcaaggaaaagtgggatgaggaccttctaattaagacagggctctccacaagtcagacagtttggaaactcatagtggcaagttcaacattgtttgaataatgaaagttgggtagaaggactgataaacccttcagctacttttattaacagcagcagcagcagcacatcctccactctggctgctgatgagctccggcaggatcctggcctgctgccctgagctgcttctacttttgtctgctgtgcttcactctttcctgggaagtgtcagcaaacctccgccagccttgggcaggagcagccaggcaaccccagaggccaatgtgagcccaatttaaccacaggtctctgtttaaaatttgcgatcatatttgtaacttaaattagacagtgtgtctccttttcccaaacgttccaatggcttcccaagtcaaaataaaatcctaactccaaccatagccaacagagccctacatgatccaggccctaggaatctgacctcatctcttccttctctctctgtccatctagagaggcaccagtcacactgccctgacccagctgtgccaagcactgccctgccccagggcatttgcacctgctggcatctctgtcagactcttccccaagacaatcacatgccttcctccttccttcattcatacccaatctgagagctacccctaaacacttcatctaaaatgacactccttatcaatctctagctccttaccctggttcacttgctatctcacacatatacacatccacctacatatatgtttatctctcctccaataaaatgtgaactccaatgaatgcagagactctattttgttcactgagatatgcccaatacctacagcagtgagtggtgtctactagatgctaaataaatgtctgttgaacgatgaagttgtgaataatctattttcatgtatttaatttgagatcttagaaactttttgactgtaattcatattgtagaggggaaatgttataaaactcttcctccccatcataagggcatggcaggcattcctatcacaaaatctagattaacaagagaaaagcataactaatttatttcgtgatatgggaggcttgagaaaggaagacccaaagatcaaagagaaaactgtccatttttatgtttagagtcgaggaagagtgtacagtggtgtaaaaatgtgattggacataatgggtatggcctaatggcaacagacttagtggggaaccccagcaaggcctgtctgctctgattcatcttggcctctgtatggggcagtcttttctcccagacacagggcaggacctctgtggaatgaggtcttaggatctcctttcagacaaggtaggtttgggaatttctttatacccaactcctacacaaaagggctggggaaagcttaaagtaatatgtctagggttttgttagatggagtttcgctcttgttgcccaggctggagtgcagtggcgcgatctcagctcacttcaacctctacctcccagggtcaagcgattctcatggcttagcctccagagtagcttggactacaggtgcccaccaccacacccagctaattttttgtatttttagtagagacgaggttacaccatgttggcccggctggtctcaaactcctgacctcgggtgatctgcccgccttggcctcccgaagtgctgggattacaggcgtgagccacctcgcctggcctatttctaggttttattttggaggaagagtggttctggcttctctgacctgctttaagggaggaaaggaaacaagaggaggacaggagaagatcagacagagactttgcttcagaggcctttccagtgtgcttcaattcaaagcactcagcaagccacagcgccacactttggggtgtcgtttgctaagccccaacgatgcctatcactggtcacagtgttcttgttaggattcaagtctaatgtcccttgttcaccacttaaacttcactttaaaaatttccactacacttgcattttgtcaaggaagggaggtgggagctgacgagtcaggttgccagggcacaaggtcctagttctgctgttcacactgggcccaggcaagattttaacttcccagaaccacgtctgtaaaatgggaataataacagtaaccttgtcggtcacttgcagggattcaaggaggcactaacagccatggctaccatgaactgagcccacgttgtatcacagaaagtaccccatactcttgacttgctttgcactgtcccgtcttcacagcagccacctggtgcagggacaattacaattcctaggctgcagatgagggaacaaacctagaaaagtatctgaactaaggagctatagttgctgtactagtttcctatggatgccgtagcaaattaccataaacttactgtcttaaagcaacacaaatttactttcatttttggaggtcagaagtctgaaacaggtctcactaggccagaatcaaggtatcagcagggctgcattctggaggctctagagaaggaatgtttccccaccttttccagcttctggaagctacctacgttccttggctcatggccccttcttctatcttcaaagcccagagcatagcatcttcacatttctctttcaccctggctctcctgtctccatctttcatatataaggacactggtgattacattgggggatgtccagataatgtagaataatccccctatctcatgatccttaacttaatcacatctgcaaagcccctcttgccatgtaaggtgtcatattcatgggttccaggaattcagatgtgcacattttgggagaccatcattttgctaccaattactaagaggcagaactgcgatttgactcccagccgatttcttgaccatcatattgtggggcaaagtctttggtgtttattaagtcctttttcccccttgtggcagtggagggagggtggaaacctctggatcccagattcaggttttgtatgccacattaaacaggacaggtcatccccttctgcccttctcctctgcagtataggacgccaaaggctcacagttaactttcaacattgttttatcttatgaaggtaaggtttaaaacaatccatctcaccccatctccaaatatattattgacttttaagcaaccacagacgtttgataaaagtaggttacaaagtaaaaatgaaagcctagcatggggacaggccatgacatgcctcccatccaacagggtgtctgtacagagtacagagcagccgccaagggcagacctggaagcaggatccccacagtaagaggagcaggtaaggaagagctgaggcggcctagctcagagtgctccagtgagggacacagggtccgggcacacaggtgaccagggagagcgtggcaacccaggccacaacagatagaagctccaggaaccagcctagcaaggtggcagaacaagctgacccacacgaagccaagggacagggcaagcatggtcatggggcagccatgggcgggcctgtccgcaggagagggtagtagacggtcctccgagtcaggctggcggcctatgaggagcccaacctctcagggatggaaagatcccgaaggtaattccaaggcccagcaaaccagccaggtttgatccaccagggagggagcaagtcaacaggacatgagaattatttgggtacaaaagaagtggggttgcagggaaactagaagctggagatgagctgtagtttggggaagatggggtgttcacagctcagcaagcccctggctcccaaatctgtgtcagctgagctatgtccagacctcacctatgggtggcacgggccgcccttacacatatacgcatacctccactcacttgggggtggctcagggcctccaggactggaatctaaaaggacctttgttcctccaggtgggaaagactaggggccaccctcagcaggcttctagttgactgagaccttttatgaccatgagttctcagaacaggattacttacctggtacccagttgctttgatcctttgcttaatgtgagcatcacagtgttagaaatcagaggtgaatttacatgggctgtgtgtttttgtgacaaagcaataagaataaagtagactgcatactctagacatactttcctcagttattcatacttagagtgactattgaatttatggtccaaactgaggcacttttgagagcacttttaataagtatgtgaggtccacaggtgtaactgctggttctcggggccctgtcagagggggtcccttctctgagcccaaagcctcacacccaggcacccagggcctagtgaagctgccttagctgtaagcacaatggtttagagggattattcaacatctaaatgcttgcctgcaacctcaaacactctcattcctttcacatgcaagacaagaaatgctgaataaagtttcttttgaggcagaccaatgatgtaactccctcacaagggcctctgttcgaaagtcagggacacgtttatcctattgattattgacatttgagagttgcacctccatcccccaagccccggagctcacttttcttttgtgacattgttctaaattgaggtgcttttctgctgccctctccacatgttcacaagacactctctcttgtccagacttcactgaaacagaagtgtttcaagctccgggtgagtttcatagtgcatatcatgggtcatgaaatcagttcagtggattgagatcagcatatttttaacaacaaaatgaaattgactagagcaggaaaaaatagaattaaagggaatagaatgcttttcacatagtaagaaattctttccagaattttttcatgacagtatatttttctagcattaaatgtgagggtgattgatgtggttatgatgtaaaaaatgtacttcctggtgtgggcagccaccaaaatttgcagtcccctgctataaaccatctttgcaggttttctttttcctttcgcctggattcttacagtgccaagggcggctctcttactcctacacacccctctcaggcatcctccattctctgcagatggcttagtttgatcctttaggctagagccaacgaaatgccttcctatttgatcagttctatcaacataagtctttatcgaaaaaggaaaagaaagaaaaagccaaaaccttgcaccattcaccaaggagtgataagggccatgtgagtagagatctctgagaagcttcaaagcaacccggctaattctcagcaaccccacacctcctcggcagcatctgcaccccagcactatttgtgcctaagtgtgggagtgctgggtgttgctgtgcgtgtgttctcatgcacctcccttctgtgccacaacataagtggaaaatatctccgcctgagtgcctggccccccttctgcattgtttcggggtctttgcagcagcacaggggcttctagcctcttcctgtaattttgcagaaggtaggtgcaggagtggggagccctcacatcaaaggctgccttccaggactgctggctcagggaagggaggagggtgaccctggtgcagagcagaagagagcgaccctaggcaggatgtctggaaggagagataaaagcaaactgcaaaggtattttgatagaccatgctgtttccattctttaccatgtgtttttcattctgcttttggttacttttgacttgaattatggagcctggttaaggtaacatagatgcaattacttttatacgtcaaaaatgaatactgacttttcctagtggggctgggggtgatgggaagtggctaagacagaatgcacattgccttttagaaagctggaaagttcttttcttctcacttccttatggcagcagagaacctgtttttccaagagctaagagcactttgacaaatgcaccgggtaaaagcttgcatgcaagatagaaagacacccccgatgatgacatagtgtggccattacattgccgaagaggaagcaaataccaaatacatctatattatatatgaaggagtggcctgcccctccacacctgtgggtatttctagttgggtgggacgagagactgagaaaagaaataagacacagagacaaagtatagagaaacaatagtgggcccaggggaccggcgctcagcacaccaaggacctgcaccggcaccggcctctgaattccctcagtttttattgattattattttcattatttcagcaaaaaggaatgtagtaggagagcagcgtgataataaggagaaggtcagcaaaaaacatgtgagcaaaagaatctatgtcataattaggttcaagggaaggtactatgactggacgtgcacgtaagccagatttatgtttctctccacccaaacatctcagtggagtaaagaataacaaggcagtattactgcaaacatgtctcgtctcccgccacagggcagcttttctcctatctcagagttgaacaaatgtacaatcgggttttacaccgagacattcagttcccaggggcaagcaggagacagtggccttcctccatctcaactgcaagaggctttcctcttttactaatccacctcagcacagaccctttacgggtgttgggctgggggacagtcaggtctttctcatcccacaaggccatatttcagactatcacatggggagaaaccttggacaataccctgctttcaagggcagagttcctgcggctttctgcagtgcattgtgcccctggtttattgagactagagaatggcaatgacctttaccaagtatactgcttgtaaatattttgttaacaaggcacgtcctgcacagccctaggtcccttaaaccttgattttatacaacacatgtttttgtgagctccaagttgggtcaaagtggctgaggcaaagtggctggggcaaagctacaaattaacaacatctcagcaaagcaattgtttaaagtacaggtctttttcaaaatggagtctcttatgtcttccctttctacatagacacagtgacagtctgatctctctttcttttccctacaatatatatatactttaagttctggggtacatgtacggaatgtgcaggtttgttacataggtacacatgtgccacggtggtttgctgcaaccatcaatccatcatctacattaggtatttctcctaatgctatccctctcccaggcccccactccctgacaggtcctggtgtgtgatgttcccctccgtgtgtccatgtgttctcattgttcaactcccacttatgagtgagaacatgtggtgtttggttttctgttcctgtgttagcttgctgagaatgttccagcttcatccatttccctgcaaaggacatgaacttatcctttttatggctgcatagtattccatggtgtatatgtgccactttttctttacccagtctatcattgatgggcatttgggttggttccaagtctttgctattgtgaacagtgccacaataaacatatgtgtgcatgtatctttatagcagaatgatttataatcctttgggtatatacccagtaatgggattgctgggtgaaatggtaattctagttctagatccttgaggaataaccacactgtcttccacaatggttgaactaatttacactcccaccaacaatgttaaagtgctcctatttctccacatcctctccagcatctgttgtttcctgactttttaatgatcagcattctaactggcatgagatggtatctcgttgtggttttgatttgcgtttctctgatggccagtgatgatgagcattttttcatgtgtctgttggctgcataaatgtcttcttttgagaagcgtctgttcatatcctttgcccactttttgatggggttgtttgttttttcttgtaaatttgtttaagttcttgtagattctggatattagccctttgtcagatggctagattgcaaaaattttctcccattctgtaggttgcctgttcaactctgatgatagttgattttactgttcagaagctctttagtttaattagatcccatttgtctatttgggcttttgttgccattgcttttggtgttttagtcatgaagtctttgcccatgcctatgtcctgaatggtattgcctaggttttcttctagggtttttatggtttcaggtcttatgtttaagtctttaacccatcttgagtcaatttttgtacaaggtgtaaggaagggatccagtttcagctttctgcatatggctagccagttttcccaacaccatttatataattgggaatcctttccctatttctggtgtttgtcaggtttgtcaaagatcagatggttgtagatgtgtggtgttgtttctgaggcctctgttatgttccactggtctatatatctgttttggtaccagtaccatgctgtttttgttactgtagccttgtaatatagtttgaagtcaggtagtgtgatggaagtaaatacctttaaccagaaagacaagacacagagataaacattcttcctgctacagaaatatggtggattcctcaatggctgtgatctttgaaaagagaagcaactgttgtctatcaaatagctaaaaatactgttagaagtataaatatgtcccctgatattgtcagaagtttcatcgaagcctcaggcaagcaaaatgtgtcctctgtttgtacctcaatctctactcctgcaaaatgcagataattataccagtaaaggactattgttagagttgatgcaataggtttatgaaatcttcaagtggcttgcaaataattcaaaatcgaactgtaatttccaatcattctaaaagcttcatgtttcattttttggagacattattgctctgttggctttttctaacatatgggtatcactgacagcctccattctgtactaaaatctagaagaatcttcattcctctgggggcaaacatcagagagaggaatggaagagctgccccagggacctgacgcttgataccacttcctgagtcaggcccaatgcaagcatcctcagcttgctttccactatgagggagttgtaatgggttcccatgccgtctgagctgcaggaaaaggaaagaagtgggagagtaaattagtgttctgacattattgacggaagactttactctcgtttcctagttatctgagaggtacagtgtctattgagtaaaactgtcagaacgaaaaacagtggttctgcaatgattttggtatcttgtacaatgcaacctgtagtataactgatacagacaatccttttctcaatcaagtaatcaattgataaaataaacaggacaaaaaaatcaacctaaagatgcaatctcgtggcagtattaaactccagacagtatttaattttgatttctctcacctggagcattttttttttttttttttgccagagatgaatcacatctgtcacaacaataacaacaacaacaaattagcggaaaattgattttcatggtcctgttgtctctaagtggcttgtggtttagtttgtagatcatgtcttatctagagctataatcctataatgaaaaagtaaattaaaccaagaggaaactataaataaaaaaaatatttctcttatatgtgatccactattcccatcacagttttgcttcctaagtagttttgtcttatctgagaagcaccaaggatccatccacatagggcccctgcaattcccatgcacatgacatgcacctccatatgcatcttgccaccaacttgagaatgccaggagctggttatggttcacaaggcatgggagttcttgccattctcaccaataacaccagcatcttgaaaacccaaagcataaaagcaaacaagttacaaacataagcaaaccaacacatcttcaagccaaacagctgtttcttactatggcttttcctttctggtccacaacgcggccaagattgctgctggacatgcatggtgttggaggacttgcatgtatgtggggaaggactgccctccaccgtgattctttcctagggcaactcctctgagctacgctgccaatgcacgcaacaggaccccaagaggggcaaaaagctgatgggaacaaaaagatgtaccagtgaactctggtcttaatataaaactagcatggtgggcaatagaaacatcttttccattaaatcaaagaaacagatctggaaaactaaatcctagaatgttgagtccctgatggcagagactgcattgcaagctcatgcatggaactgtgccctctgcatcacagaagtgcctccatttgacagttacgatatcagtgtcatgaggctgggatacctctcttggtcaatgcaagccatagtataactgagctagacactttctcaatcaagcagccttttgataaagaggacacaaaaatcaacctaaagatggaatttggtggcagtgttaaactgcagacagtatttaattttgatttctttcatctggagcattttgttgccagagatctgtcacaacaacaacaacaacaaaaaatgggcagaaaattgattttcatcatcctgatagcatttgtcctagagacagcatttgtgttaagagaatagtgtttgtctttttgatcaggagagttgagcttatggtcttaacttcaggcattgggccttctgtagcgtgcttgtgaatactccacccagcatctacactccagtgaccaggcttttgggttgctggtctttgaactttggcctgtaacctcaagcagggcagaacattgccacaaagccccagatcactgacaccaaatcaaatttgtgtggactctgtcccagacattccatgtgaaactggctgtccttacaagccagagagaacccagtgacgatgggaccagggacagttcactttcttcccattggattaccttctttatcaagggagcactggaccacatggagtctgaccataaactgcatctgtctcatgagctggatccagtataggacagggacactgggccaccactggctctgtacaaccccagtgccccattctcatggtgtggatggagccccgttttctcctaaaacttgtcccactagttcaggggtccccagtccccaggccatagaccggtacttggttcatggcctgttaggaacccagccacacagcaggaggtgagcagcaggcgagaagcattccccactgagctccacctcctgtcagatcagtggaggcgttagatacttacaggagcatgaaccctaatgtgagctgcacatgtgagggatctaggttgcatgccccttgtgagaatctaatgcctgattatctgagttggaacagtttcatcctgaaaccctctgccccccacctcccaattcatggaaaaattgtcttccacaaaatgggtccctggtgccaaaaaggttagggatatctgcactagttcctcctcgccatccctctctctgccccacatctgttagattcttcctcatgttactattagttatgaataatttgctactattattagtgaaggtgttatgggttgagtgtctctcccccaaattgatatgctgaagccgtaactcctaataactctatggccttattcggaaatggggttgttaccgagtaattagttaagaggaggtcattagggtatccctaatccaatatgagtggtgcccttgtaaaaggggatattagggggacatttgggcagacgcacacacagggagatactatgtccacgtgaagacagagatcagggaagtgagtctacaagccaagggatgccaaagattgccagcaaaccaccagcagctagggagaggcatggagcaaatgctccctcacagccctcagaagggaccaaccctgctgacaccttgatcttggacttccagcttccaaaacttggagacaataaatttctgttgtttaagccatccagtgtgtggtactttgtgatgacagccctggcagactaacacaatggggcattgggtggcttatctttgagcaaatgaagaactgaatccaagcagtcacttctcctcttgagaccttggccaatgcatcccctcccaccctcaactgaacactttcccttaatgacaatgcatgttcagtcatactggactatgtagtataggggaggaaaataaaacttttcctcaaccttcttctgttccttagctggggtctgttaattacactggcaaaagtgagaccatcaggagaaaagacagacaaatcttattttatgttattattttaatttttatgtgaagggacattcatagaaaagaagtgaagaaccaaagaggctgttagacccaggagtttatataccattttaacaaagggtgataaatttgcagagaagtaacaaaacaagcaaaaagcaacctgggcttctaggactgggagagtacacatataggggaacctaatgaaagataagggtgatattggtgaggtttgtttgtgcagacctgtcttggtgctgactttctgtttccagtgacaagagttggtctcctcttggtatggaagatgggaggagaaacaccttcacaaagggaaatttatgtcctgctttttctgcatttgctgcttcttaattgccttcacctcaaaacaatccttatacaaatgatgcaatagactttggggactcttggagaaagggtgggaagggggtgagggataaaagactacaaattgggtgcagtgtctactgcttgggtgacgggtgcacccaaatttcacaaatcaccactaaagaacttacttacgtaaccaaacaccaccagttccgaaaaacctatgaaaataaaaaaattttttaaaaatccttatgccaaagtggcatattctggtgtgacatattttggtttggcatattttgattctccagtggccttctatagatctacatgtctgtctttctgatgtatgggtataggaaagcctactttgtggacagacatatactaaagaaaatacttgtatacaaatattacacaccagtctccccttatctggtggggataagttccaagacttgcagtgcatgcctgaaactgtggatagtcccaaaccctgcatatactatgttttttcctgtgtatacatacatatgataaattttaacttataaactagtcaccgtaagagattaacaataaataataataaaatagaacaattataacaatatgctgtaataaaaggtatgtgaatgtggcctctctctgtcaaaatattgtactgtactgtacttaatctattttcagccccacagtggaccatgagtaactgaaagcgtggaaagagaaactgcagataaggggagcgggaggagggcgctactgtatgaataaatacactttatagagagatatatccttgaagaagaaatagaatactctatgtctgcgcatactttatccacagttgtattcataaaaatgtaaagtgcagaacggaaactgctcactaaatcagctcaactgaaatatctggataattagtggtacctggtcttttggacccagttctcatgaaatgtgcaactctgacctacttatgagattaaaatgggttttttgttttttttttgttgatgttgtttgaccacctgggtctctgaggcttattttcaataggaggaaaataagtggtttctgttggggagagtgtttccctgtggcccaggtggcttgccctggtgcttatctgcctggtccccacatctttcaaaccagaaggcccaggagttaggatatccagcttaacaagcccagcactatctcaatgatgagcccttggcagccttgggtggccattcgcagagtcaaaaataaggacagatatgaaacactagctatacagactgtgtctgaatctccaccatttacccacatggtggaaaatacactacctccagtcctattacaaaatataatgacttccccagcctaaagtgttttaattctgtggttctcaatgtgtggtccctatacccctgagtccttttcaaggagtttttgtggttaaagctatttttttgatactattaagatatgactcatcttttcactgtgttgacatttatgctggtacaaaagttgtggtgggaagactcctagtgccttagcaggaatcaaggtggtggctccaaaccaaactagtaatcatgatattcttcatcaccaagcagtagggggaaaaagaaaagcccagctgcattccagaatgaccttgacaaaacaacagtaacaattattaatgttattaaatctggacccttaaacacacacatcctctttttttcattctttctttctttttttttttttttttttggagatggagtctcgctgtattgcccaggctggagtgcagtgacacaatcttgactcactgcaacctccacctcccaggttcaagcagttcttctgcctcagcctcctgagtagctgggactacaggcacacgctgccacacctggctaattttctgtattttagtagagactgagtttcaccatgttgcccaggctgatcgcgaactctgagctcagacaatctgcccgcctcagtctcccgaattgctgggattacaggcgtgagccaccgtgcccagcaacacattttttttttcttttttgagatggagtctagctctgttgccaggctggagttcagtggcaagatcttggctcactgcaacctctgcctcctgggttcaagcgattctcctgcctcagcctcccgagtagctgggattacaggcacgtgccaccatgcccagctaatttttgtatttttagtagagatggggtttcaccgtgttagccaggatggtctcagtctcctgacctcttgatccacccaccttggcctcccaaagtgctgggattaccggcgtgagccaccgcgcccggccacaacacacatctttttagtattcagagtgatgaaagggaagatgcatgaagcacttctgctcatatcaaagaactgtgactgtcttgaggaaaggaagttgtgcagtggcccaagtcgtgagttcaacaagatgtttcttccattttcacttggaagaacaactgacagacaaagcatacttagattttggcagtagatattttcccaaaaatgcagagtagcctgtcattctaagggaaacaactgacagtatttgtttttgttttcaaggataaaatttgagttttcaggtgaaaattagcattttgggaaactgtgagtgtggcagcttcccagtgtgtaaaaactttcctgattagatggatggtgatatcaattactgtaatttgttaatattgtataatgaaatgtatcagcatttggaagatctatagaagcaatattttctaaatctaacaaaacaatgtgtaggttaaagatctgtttaaagcttaagatagaccaaatgggctttaatgtaatagaatatgaaaagtattgatgtgatttcagattccacattgcaatctttaagcagtagttaagaaacatctctttttcaaattttggtgtagaatctatccatttatagagagagatgatgatctgagatggctatcaagatatttctcttttccaacgacatttctgtataaggttgcatttccttcataaatttcaaccaaaaccacatactccacagatcgaatgcagaagcagacatgagcattgagctttccagctgtcttctattaagctcaatgttaaagagatttgcaaaaattcaaaaccacaccactcttcttactagttgttttgttttggaaagtgtaattatttttcatgaaaacattctatgttacctgttacggatttaatgttaattttaaatgaattaattttttagcttctaagttttattttctaatgcagtaaatataatagatataacctacataaacaaaagccctttgggattcttaataatattaaagagtagatagggctgtactctttgaggcactctttaagaacaggggttaagagtagctggtttaattaaacttgaaattgattgaatatggttccacacacagtttcaattcttgttaatattccccatctattcctattgtataaaacactgagtcaaagacgtattttttgctgaaatcatctagataattgtaccatatgggccattttcccaccatggggtaccattcggttccaaggagtccctggtacttaacttggggttagggccacaaagaaataacttaaaaacacaggaatcccggtgcttttaagaaatttgcattgcttacttcatttgtttatttatttattgttggttctattttaggaacagtttttcttcaggctgtttcccaacacattttaatgtgattttcagacacggttttcgttcttgcaaactgtgtcacatattatttccctgcccattgtgaagccaccttcaatctctgtttaaaagtgttattgaatttaattgtttaaagacattatttaaaccacctttgctgtggtaagatatgctgattatttatttactttatattattttagttattaacaggtaatcaatgcacacggtgcaaaattcagaagcaacaaaaagagaataattaaaagtaattttccccctccctccattctcttccttagttctccccagaagcaactactattgccaactccttgtgcatccttccagatattccaaacatgtataatagccacacatccttttcttacaaatggtaggatactccacacaatgacttgcactttcctctttcacttaacaccctgtcttggagattgtcccagagagtgagattttgcctcactatttatagcggtgtagcgcttgctccattgtatggacgaatgacttgactctgcccctacctataaacatttagattgtttcccaacttatgctaccttaaagaatgttctagtatctgtatacatctgcgtttgtgtacaacaaacatatactaatataactttaaggatcaaaagatatgtaagccaacattacttagactacagttgtattagagaaaattgtaagtcataggttactgaggaattgtaaagaagctggtgatattgtgaaacagatatttggtcttctttcagtttcctgatgtacagctcctaaaatcctttaaatctggccaggcacagtggctcacacttgtaatcttagcactttgagaggccaaggtgggtggatcacttgaagccagaaattggagaccagcctggccaacatggcaaaaccccatcactactaaaaatataaaaattagctggacatggtagcgtgtgcctgtaaccccagctactctagaggcggaggcaggagaattgcttgaactcaggagacagaggttgcagtgagctgagatcctgctactgcactccagcctgggcgacagagcgagactctgtctcaaaaaccaaaccaaaccaaaccaaacaaaaacctttaaatctcttgagtgacaagagtacttttgtatgctaatgagataatggcggcggagggggggcgggtcctagctagcttcaggatgggggttggtcactggaaagaacaaggcatgactagagggttgggactttcagccccaacgccaacctcccaggagggcagaggggctcaaggttaagttgatcactagtggccaatggtctaatcaatcatgcctatgcaatgaagcctccatgaaaaccctaaagggcagggttcagatgggtgtccggatggttgaacatagggaggttcctggagggtggtgaccccaaggaggaaacagaagctccacgtgtctttccccatgctttgttctgtatccctcacaatatcttcataatacatggtaaatattaataaagtgcttccctcagttctgtgagctgctctaccaaattaatggaagccaaggaggggttctaggaccccctccccaactaatagcctgttggtcagaagtataggtgacaacctactatttgcaagcggcatctgaagtacagagtggcagtcttgtgggactgagccctcatcctgtgggatctaactccaggtagatagtgtcagaattgaatttgaggacacccagctggtgtcttctagagaatcgtttgcagaattgcttggtatatggagggaaaattacccccatctggggtcacagaagtgttctgcattgtgagcatccagtagaagaaaaacagcttggggttgggcgtgatggctcacacttgtaatctcagggctttgggaagccaaagaaagacaattgcttgaggccaggagttcaagactagcccgggcaacatagcaagaccttgtctctataaaaacaaaaattaaaaaaagattagttgggtgtggtggagcacctgtggtcccagcttgtcgggaggctgaggtgggaggatcacctgagcccaggaacttgaggttatagtgagctgtgatcatgccactgtactccagcccgggtaaccctgcctctaaaaaaatttttgtaaactgttttttttttctgatatcttacaaagttctgtggtaagtagtgcttagctttgttgttaactgctagaatagctccagggagcggtgctgttcctcttttctttaaaagagagtggaaagaaaataaatcgtttcgttagtctgactagaaaaagaaatcaggctttatgcttcttgattttggaaatttttcagtccctttttgtcaggagagtgaagaaatagggaagagggttgcagagaggctttgcctttctgttttgactattgtatttcttgtgctggttgagaaggagacgctatgaagatgggtcatgagagctcagaaactgatcactgccttgcttcaggaggcagcctggtggaagggatggaaccaggaaacgtgagcagtcacaccagtcacacgctgtcctcatttgcatcctgtccttctacaccattaactctgactttgagtacattatttgccctctctgggcctcagtttccttactgagctacgtggaatttcttcctttttttcccatcagacctcttacatcaccgtctccacaccctccattgtcactgaccctcagcccactgcaatgtgcttctgtccccatcatgccactgatcacattcagacgtcaccaacagccactgtgctgccacgtgcaacacactctcagcaccccctggccactgctcctcggctgtgtcagtcactggcttcactgcccccgcctctggctctttctcctcatccttccttgacgctgccttctcagccacctctgcggatgctgccccctaaaccttaggctcccctggagcttgaccttcgacccactcctaaccatccacgtgctttcttgcacgacctcactcactctcctggtttatttatttgctcttttgctctactggtttttacctaccatttggctaatgacccctatgttcataccatcagctccaaccttctccctgaatctcatccttctacaagtttgggaaaattttctatttggatggctgtccccaaactgcttctgtttcaataagtcaaaattgaattcatcctccaccaccagtttgtttttttctattttcctgatgattataccttttggttatccaagctacctctgccttctgggttcaagcaattctcattcaagcttagcataatgacctcaaggtccatccctgttggagcatgtgtcagaatgtccttcctttttaagtgtgaataagattccattgtatggatgtactacatgttgttcacgcattcacctatctatggaagcctgggctgcatccacctgttggctattgtgaataatgctgctatgaacatgagtgtgcaggtatttcttccaaaccctgctttcaattcttttagatatatacccagaagtggggtatactttcatatcttaaccttgaccggaacttattggagtttcatctttactcagctggctccctcccttctggtcacactggactttaacccttagaagggatggagtgagatttattcatcttggtggcattgtgaggatgagtcacttagcaatcaacaagtttctgctcaatagtttccctcgggctctctactcaatccaattactaggagaaggatgccatgtgaacttttttttttttgagatggagtcttgctctgttgcccaggctggagtgcactggcgtgatctcggcttaccacaacctccgcctcctgggttcaagccattatcctgtctcagccttctgagctcaccaccatgcccaattaatttttgtattttgagtagagacagggtttcaccatgttggtcaggctggtcttgaattcctgacctcaagtgatccgcccgcctcggcctaccaaagtgctgggaaccatgagaacttttaaagtcaaaaaaaaaaaaaaaaaaaaaaaaaccctaagttcaggaccatttacaaattcatcatttcaaagatgaggattctgggtgagtaggaaaaaagaattccatctaaaaccaggagtaagagacaaggtttatcaagctgtgcttgaaaaagaatgagaaaaaaaaattgtacattatacttttttttaaaatttgctcagtatgtgacagaattgacagttcatagtattctttctaaagttacaatttgtctttatcttaaaaagttactttttaaaacaaactcaaagataatactaggaaattgtgctaataacctttaatgcatctacagtttaggacgcagtgggtgtcagtctgccttaattttagaatcagttttttgactgaaatgagaaagaatgaacctaaggattagagcgatggtggttatgcacacacctgtgtccacagaggctcgctggtacttctcttatgttgggtcatattactgtttccctctccccttcaaatttcacaaagattcaataagcaagctgtagattcagggtggacattttgtaaaggatgaaatggaactgtagaatcttaaacaccttctatgtactggtcccaaggcatctcaactgaggttggctctatgtgcagcacttggcttcctaaaataactaagtccattttcgaatgttggcagctgtaactgcaacctccaaggtccagcactgctaacttctatctgaaaggattactcatgccattgctcctcaccttaaatctggcagcattttttttccaccagtgtggacacctcaggtctccagcataagagaaacacaagctgatacaggaagacgcacataccacacacttccctctgcttgcctgtgccaagaatccttctcgtctgagaaagaccaatgtgttggttttggacaccaccaccaaataatagcatacgatgtgacatgtttcccagagattagcagtcaaaactttagacttcaaaaggcatcaccctgctaaatctgctagtaggtagcttagcaccattcgagtgatatctaccgagagactggtgctgttagagaccctccattaaaatgggtcatggcccctgacacaggctcacattcagtttaactctcacctctccaactgccaatagaatggtcatggaccctctagaagcagacaagagaaaataattcattttgcagctatgtggggttatctgcttggggaaagctggtgtgcaagtgaggccactagaaggtgaagcaactgccagtaacctgcctgggtttaagactgctcaggtgttctcctagctggcaagctgcctctccggcctccgcctgattccttttgggggacaaagctgtcctgctgacctcctgctctgaatctgaatctgattctgggttggacctaggttagcaaacttctcctgtgtcccgattctggtgtgatccctgaactctgtctgggtccagccttctggatggcagactcagcttccagctctgcctgagtgtgcacagtaatctcagcatccccagctcagcctggtaagtgggctgagctcctggtattcctgatccttggcagtgtcccttcattccagcgtacttggcactggccctcgtgtgggagtccaggcatgagtcggcttgctctcctggcggagatgctagggcaagtttcccaggcatgaactgtggctttgttacctacttcatggaaaagtgcagccacgtgtttttccagtctgattcacacaggcagctccaggtcttcagaggaatcaagaacaaccagccctgagatggctccaaggtggattttatatcaccccttcgcatcctctttctgggacaaagagcctagatgggcatgtgaacaataatatcatattatttactaacacatcagaaatgggattctctcaaacaatgatcaaaatggtagcattgatcctaagcacatacgcatatttaaactggcaccaagctgttaattatgttaatgcctttatggcacaaaaatgtaaaatttactattaacttgggggctgacctaaagagctggcaaatctcccctatccttccctatctggctatcttgctgggcttgcaatgccagggcctacttagaatagccacagccacacatgagcatcatgggagacttctgggggcaacttcagcttcttcctctaaaatgattcccgactcccagaaatcagcaggtgaattacacccagcgcccttgtttgcacatataaattgcacagctgccaagtgcagactccttgaatatttccccaacaaaaacttcctttggcttgctctccccatagtctctttctttccctcacttgcccatttttcctgcagagggtctccttttgttctcactgggcctgctcctcccaactggtctctgaggttccctctctgtgagctaaagcctcaaagcatgaaggctttctccttctttgggccacaacaccctctctcagccattcctacccccacctcctgctgctttcttgcacccacagagaggacaccatgacctggtgctgccttggctcagcctggtctcccctctgcccttgctctgctgcctgctacatcacgttggatgtagggtccctctgaaactgcctgtcttctgagagcttcagacggaaaggggaagaaagtaatctttcaagactctaagagtaagatccactctggatctcaccttcctataccaaaaatgtcaccctatcagcagtcaaaatatgctaataaataagatgaacatcatagtggcaatcatggtggtagtagtgatgacgaaagattgctcctccaaactctgcatctaggatcagggccatcatgtgtatgctcactaactgtctgccccattagttctgctccagccaggagctgctgtcctttctctgcatccacgtgccagttgtaagtgaggaagagtgacctgtccaaaataaatgaattctcgatacaaagccaactggctgggtgaagccgtacttctcgtaagggaaggctgtgaagggaaggctgtgattctgcaagtgccaaagtgctggttccagtcttggttggaaagtgttctaagacaggctgtggatgctcaaatcaacattaggattacatgacttggaaattcccagtcatctctgtgggtttggatggtgatagtcaaggaaggtgtgcatgtattagtcaaacttatcttttgaaaatatttatacatccaaaatacgtgcaagtgaggggaaaataccagtttctcaatccaagtgagtccaccttaaaacaggtagggttgaaaggcagtggtcatatgtgggccatctctgccggctgcctagcaaaagcacactgcaactgtgagggtacctctgcaaagccacagaatagttgttgtcatggcaagtaggcctgcttccacaaatgagacatgctcatgctggtagagatgaaagaacctttatggaatttctgtgggagacagaatttttgtttaactttgtatgttaccatttacgcagacagaaattttttaaagcatttgatagaaaatcaacaagcttcaagcagaaactaaagccatgaattccccagatagactcctaaaaattaagatggtggcttccgtttgcaggatgcagatttcaaggaagtccctcaatgagtggccttctctgcgattaaggcctaggctggtggtggtggtggcagcggggggaggattggggcaggagaagaagcccctcactagcaaagaaaagctggactctgagagagaagcaccatcccaagaacgtccacatgcacacttccctgcagcctcattttcagctcttcattgtatctgcggatgctgtaacctgggggttacttcctttaattcaggcagagattcccaagtttgcatctgctgatatctggaaggccaagctcttggctttgctttaattcaagttatttgccaactggatctcggtgcaaagcccagataactcgactgcctaaatgggaaatgggcttgatgtgtttgttctgagcagggtcatatagagccattatatagcagccttatgttggcttaggcattttctttccttcttctttttttttttttttttgagacagagtctcgctctgtcacccaggctggagtgcagtggagcgatctcagctcactgcaagctccacctcctgggttcatgccattctcctgcctcagcctcctgagtagctgggactacaggcgcccgccaccacgtccagctaattttttgtatttttagtagagacagggtttcaccgtgttagccaggatggtctctatctcttgaccttgtgatccacccaccttggcctcccaaagtgctgggattataggcgtgagccaccacgcccagcagcttaggcattttcaagaaaactgaattaaattcagtaatactgatcaagctgcaaagtgctgtgaacacagattcaaatgtctcagttcttgcccctaaggagctcacagtctcctctgttgttataaacatgggaaagaaggagtggactggtcaaaaatgaggctatgatggctatccatgcagctttcctagttgggataccttatttggtctaaggataaacaggagtccaccaggcagaagagagtgaggaagggagttccagcagtcacaggatgaaaggctctcccctcactggccgcaggtagaacatgtgaggtgcaaagagagtgagcagcgagggctctcaaagactctctcctgcgcaggattgcagtgtctgctttcctgacctcatcattttccaaacatattcttagaaaaagaaaacctctcaagcattctttccatctgcttctaccctgacctggaaattcaagggaccagaagcaatacagcaatacagacagaccctccatgcaaagagcgtgagacagagaactgagtccagaaagtgttagcaatggctggggagctagattacattacagccatgtgccaaatggaaattgaatttcaagttatcaaaaggaaggccaaaaaaaaaaaaaagataagaaaaagccctcgagtttaaagatggctacatgaatagttcagatatctgatggtgattcaccgctggaacccctccggccctccgtggagacaatgactcctctggtcttactgaggagtaattgctcagcatctctgactgtacacacgattccaagtatatttatagtgttaggatggcccagaatttttgaaggtttttttatttttgccaaacagtcctgccaggagatgctgaaggtcagatattttagaaaatctgtttctggtacttcagcagtcaactactattgcaaggatggagaaagatgcttggttgttccaggaagctctgtcatgactcccaggtccaattttaaagtaccttctgaaataggtgaaaggtattcctaaacatgctctctagaacttaaagcataggttttcatcacacacaaatctgtaccatggggcagaattagccacaggagacattctcaattgtcaattagccataaaagtggcttgaggaaaaactagataatgtgaaataactctttaaaggaagaagagaggtggtacattctttatttcacagataatgtaaagaagacatacaaaggtgaagggtgttacctgtggccacatacactgctccataggagctcctggacctggggttcaccccctgcctcctagagcctggccagtccaggctctttctagttagactattgggattttctgttaatgaccctaatcaaagtggaaatagcacaaaacgaccttggtggcagtgaagagagaacttgggatttcaaatttttaatgttgactcataaagttaattcacaaagaataacagatcttggtgtggtttaaaataaacactcttgccaggcatggtggctcacgcctgtaatcctagcactttgggaggccatggcaggggaatcacttgaatcagggaaggcagagtttacagtgagcggagattgctccactgcattccagcctgggtgacagagtaagactctgtctcaaataaaataacataaacattctgaggaacaagtgaggcatgagactcccccatttcagaaatgcctggaagaatctcccatttcaggtattttagggaagcaaaccgttcactcaaaagagaattttgccaggtttgcacagactttagacattaatacttcctttaaatggattttggaatcattgacagaggaaaaaaagagtaaaactctaagagaaggcaggcagagaagtgaatggattgctcctgaaaaggactgaaatcagagacaaagagatctcaaataagaagcaaagtttttcagagtctaccttacaaatacttttcatctgaaaccatccagcaacatttactggcccaaatgaactatgggtgtgaatagtttcattctattggtcattaatgtaccaaacagagtctttcttaaagaggtatcaaagccacagtggaaactgtatccgacgctccaaataaactctaaccaaggatgggaaactcggaatcatggagttgtttgtggatttggctaaaagtcaggcatgttttgaggctttaaacactgattatttatatccaacaaatagtttgtgaaaaaggagagagggaagaaatgggatatggaaattgtgtatctcaagaaagagccaatcattttccctcctaaccagagcatggcagaagggagaagaaaaggaaaagagcttgccctttgtggaaagctgagcttttcctgaaagtctgacaggcagagaaacaaagtttggatcctgcaagatcgttcctgtaaccagatcaagttcctcctgtttgctggaggcccttgggtctcccgtcacaactgcacccagctcacgggcacaggcaggtgcataccctgcccgtagagtcatctttcatagacttccctgctggatccgggcaaatagtgtttccagaaaaagcgaatccagctttctgtgccaccaccctgggatctggtactgtgtcatgggaaggcatgcagggacttgcctcctgaccccactgccaggaggggtgctggtttgatcactcctgaccccttcccgccagcatttatgatcttagacacttactcaccttccaaccatgtgaggcaattaagaatgattgcctctgaatcaagggcaaatcatccaccagtttcctggccaaggtttgagtgggaggaacagcttgtgtgaaatcctttaacggtgacaaaatgcttaacaatcttgatggcagtggtcagttagggtaacgaacatagggcggtctgacctccagctcatgttttcctgtgttcactttctacctggtaatggtgagctcatcctaatccccctggggtagcccccatccgggtaggaggctactgttggcccctgcacagatgggtctagcccaccagcctcccccccacgaccccaccacagggtggcagttgcgagcacacgcctagaagccctgcctttctttggcctctcccagagaatgaaatttcagcatttgtacagctcagacccactggctgaaacttctacctcctggctcaaacttctacctcctgcttccctgagtgaagtaactgacagaggaagtaatacttccaactggattttagagttcctgagtctagtctatgtttagtctatctctatttccctgtccctcccccacgccctaaactgacatttcgtaggtttctggtaaattaccgagtccagagttggaagccctaagtggtatttattttacttcaaatcacctttagtcatcagaatcacctggagggcgtgttaaagcaggagctggcctgagaatgtgcacttctaacaggtttgcaggggatcctgctgcactctgggacaaggctttgagacctgctagccgcaggaagtcttttcctctctttcctcccttcctagctgtgcctctccctgaagcccacctacaggagagacgggaaaacgttatgggcagtgttgtctcaagaaggaatgtcaggataattggaataaacaaaagaagaacttgaataactgatcacagtcaccgttgatcctttccccaggaaatagtactttttgtttttattttcttccatgaactagccttttatccatagcagagaggttttctctcaagaagaaacaggatctgaacaggatctgaaccttaattcttcttctggtgggagttcagtccatttccttcttattctggattaatttcccctttgccattgaataaaacagaggactttacaaagggcctacttcatgccaagtaatgtgttaatagttctaagtggtttatgtgcatctcaaaagaccttcgccacaatttcacagactatatgttattagcccattttacaaactagcaaactgagggttagggaagttttgtagttactggagatcatagtagtcatagatagaacagagattcaaatcctggcttgacttcaaagatcaagctatgctgccatagacagcattacgctttctatagtgaaagacttgtcacaaacaattctgtgatctgtcacttattcaatacacatatttattaagcacatactatgtgccatgctctataattaattaggtcctaggaatataatgatgtacaagatggatggaacttttcaaaacatattttcttagattgtctcatgaaaatttgtttttaatactttgtccttcgatggaattgctcatgaaagcatatgtcattaaacccagaaattgcattcccctcctcaatttcttgccatcctcctttgacttactattaatatcagtttaacaaatttgtttcctattttccttaaaggagtctgttgcttttatttttaaaatatatttagtttttgggccaggcatggtcgcccacacctgtaatttcagcactttgggaggccaagtgggtggatcacaagatcaggagatcaagaccatcctggctaacatgatgaaacctcgtctctactaaaattataaaaaattagccgggtgtggtggcacatgcctgtagtcccagctactcaggaggctgaggcaggagaatcgcttgcacctgggaggcagaggtttcagtgagccaagacagcgccactgtactccagcatgggcaacagagcaagactccatctcaaatacatatatatatacacacacacacatatatatatacacacatatatatacatatatacacatatatatacatatatacatacagatacatatatacatatacatacatgtgtatatgtgtgtatatgtgtatatgtatatatgtatatatacgtgtatatatacacgtatatatacacatatatacatgtatatgtacatacatacgtatatatacgtatatatatattcgtgtatatatacgtatatatgtatatattcgtgtatatatatatttagtttttgaatgagtacattaacatagctcaaaatttacaagaaataaaaatgtgtacagtaaaaattaatctcctttccaccccatgacccctagccactcagatctccccagaagcaaccgcttataaatatacattgtcttcccccgtcctttctttgctcatgaacacaaatggttggtttctacctacaaagtgttctctacttttatttttctcagttgatttatcttggagatcatgccaaatcagtaaatatagttacctcgttcattttaacagccgcatatgtaaataattctaaaatgcaccatactgtatttaactaagcccttgttgacgaacacataacatggcccagtatttttctattacaaacaattctacaatgactactcttgtgtgtctatcgttttacacaggagcaagtatatctacaagataatttcctataaagggaaatgctgggtaaagagaaaatggtatgttcatctgtaatttaaaaatgttttcattatggaatttttcaagcattacaaaaggagacagactagtaagatgaactgctgcatatccatcatcaagcttcagcgattatccacaatccatggctgatagtatttcgtatatatataggccctatccatttccccaccccaaattattttgaaacaactccaggcataatgttatttcactaggaaatattttggcactgttcttgaaaagcaaggacttaagaaaagaaaaatatatgtgtgtgtgtaatcacattatcacccctaacataaattgttcattaatactagaaaatatcctgtcagtgtcatattttccaaggttgtctcataaaaattgattttctactagtttattctttgattagaatccaataagatccaaaaaaaaaaaaaaaaaagaatccaataagatccatacatggcagttggctaagtctttttttaatctcttggttctgtctccatctctcttgtttttctttgtgcatcgttgttgtagaaactgggtatgtttgtttccagagtccggattttactgaccctatcgaatgaccacagggtcatttaaaatgttctgctacccattaggtcaaaaattaaacacaaaattaaattgcagaatttcttaataataaaacacaacatagctgaacctatgtgacacagctaaagcagttattagaagaaaaataacagaactaaataactctatcagtaaaaaagcaaagctaaatggattacacccgtaagtcagaaagctaaaaaaaaaaaaaaaattaaaatataagacaaaaggaatcagaaagaagataaatgcagaattaatgtttcatcattttagggcttgtttttacaaactgaagcttaagactcaccatttgagaactaggagaccatttcctaatttgtaacgatatcaacaacacatctaggtagctgtcaggggctgggagccttttctacacaaactttgctctgaatttcaaaatactagcctgccttgacacttagtggaaattcaggtagggtggccttaactcaggttcttcaggaaagcgtcctgtttcagggacacagtggggtggggtcgggggagggctgtattccgcacatctagttctggctgggcttatggcaagtctcagtcctctggagtcacctgagtgactgagggatgagaggcatttctgatcccgtaatatacttacatggctttgccatctaccacatcccagttcaaatctcagctggcacagttaccgttcacgtggcctggagcaaatctgagctgaactttcctcaccgtaaatctggtaaaaatctttaccttaaaggagtgtggatcaaatgagataccaggtagagctagtgctcaccgagtggaagctaaggtgatgaagcccctttattctcaagttctgtgattccatgatggagacccatgaggcctaccagacggagagtatcaattaaaagaaagcaatcacggagttcttcccgccttctctggaggatgtattcctatgagctgccccgaatgttaaaaataatacacctgcccccaaagtgccgaggacgcctttgtggtccacctactcatcgtccaccggtttctgcaagtggaccggttacctgctcaggagcaaatgtttccatcacgacgcaccctctcccagggatgggctcaacctgtgctctccctgcgacaatgctgaacagtgccatctgtccctacccagcgtcagcgtcacgcagagggcccgggcttggaatgtgggaggcacgctcccagctcactttggttttcccgccctggaggggaatccaagatgtctaactagtcttctggccccgagagggagaggtggggataggaccttcctttagtcccctccgtagtggaacgaaggattctttatggtcatctgtggtgttcatttcgtaaagaagcatctgcagggtaagaaggaaaaacgtccaccttgcaaatatatcccaggcacatgcctcctgagaagtgaccccctcctccctccgcctcccccggcacgtcctggggcttctccagtctcccgctcctgggaccaggcagagatcccggcgtgggcagacccctgccaccgcgcccaggcctcgtccgaaactcgcgcccgagagcccacgccggaggcgacgctcccgataactactgtgctcccaagacccggagggcacgaagaaaggagccctggcaaacaaagggtacgggccgggaccgccgcagcccggggcgggggcacggcaaccgcgaggcctgggggcgcccgccccccgcgccccacgcccggtgccagcgagccgaggcgtgcatctccttatatggtcaaatgacacggcggggtttctcgagggcgggagctgcgcagcgctccactcggccggcagcggagccgcagccaccagccgcccgcgccctccagccccgtccgggagtccccggcccgctgcggtgccgtgagtacctccaaccccctgcgccccggagggaggccgaggggcttagccaccagggctcggaagtgggggccgaatccggtgcgagacccaaggagaggggagcagagccggagttggggagactggtgagaggagagcagagctgtgggtccgggaagaccactgggagaggggacccgaaccgtgcggggagaagccgggagaaaggannnnnnnnnnnnnnnnnnnnnnnnnnnnnnnnnnnnnnnnnnnnnnnnnnnnnnnnnnnnnnnnnggtctagaccctgggggcgctggtagctcaaaggagcccaccgactcatccccagtagggaggactgcagcccgcgtcctcaccaggtggggcaccgccatgcgggcagggaccgggcgagcctgggtaaaggctggccgcgggtcccagccggcggctgcggggaggtgacgctgtccgcctgcttccaggcccgactcccggagcgggctgtcctggcacggtggtctgcgcgggggagtccgggccatttccctttagtagaaataagtggagtttgcagtgtgacctcgctccttgactcaggtagacatttaataactgaaccattcggttaaaacaaaaatggcttattttaaatgaaaaagattctaagtttttcttaagtcgcactcgtgtgatatcttagcataccagaaatagagggaagaaaatattgagtgtttttctgattttaaatgaatcagtcatatttattttcatatcctcagtcgggttttaactggaagtaggctaatccggttagctgaaatgtgtagctggcttgcaagcagcagtgtacttagacatcactgaacttaaggcccgcactcccttccacatattttggaaggtaataaatcacaatttgggtttagaatcaggagaactgtcttcaaaacacaactcccaatacatctcacatttttggtgctgactctactaatgagtgttttataataatatattaaagaaaagaggttttgcactatcctgaagatgttttagacaaaaaaacaaaaaaaaaacaaaaaaacaaaaaccatttgcatcaagtcttagaagtacaggaattcctagtctatcaattaaactttaataaaaccaaactcaaagaacatttcattgtgcatttatataaaattttgtcaagtgttactggatttagatcaccccccagtttagaagatcatcagttaatacacagaattgtgtttccacggtgtttattagcctgccatggtttaaaatgcgtttacaccataacatgtcgatgaaggctaatgatgggcttactacagaccagaaactgttctgggcacataggttctgtctcattttagctcaccgtctcacaaatagccacaggcagatgcagtaggctaggggatgccggggactgcatgtaggctgcctaaatttacatccgggtccctcaacctgtgcagcctgggccaagtcacttaatctcgtagtgtctcggttttctccactgggaaacagggacaatgatgttgtctttttgttagggttgttaagaagcctggacatcatagacagtgtatacatatttgatagcctcatttttacaggtaaagacactgaaaacagagatcaaagtaactttaactcagggtttcccgggctgtaaatggtagccctgagatctgaccccaggcagcttaactggagaacctgagttctaaccactaaacgcaccacgggaggaacatttgaatatttatttattttttttaacatttgaatatttctatgaggccttatgatgcatactttgacccaagattgcgtgttaaaccatttccagtactgaaagatatttaaattgcagtcaaaaacgcccaatagaatattgccaaaaaaaaaaaaaaaaaaaaaaacagactagatatcaggagtagtttactcctgtcctgtgccgagggccagttactcagcctcagtgactcaggcagcctcctttgtcagcaccgggcctgagtcgctaagcggctctctgactcagatgccctgaggtacaaagttccttgagcttgggtgaatggaaacattagacattgggttcttctgtgcggttttattatgagaatttgatcaaaaccacatttattaagtgtccatctcaagttgcgttatactgagttcgcttcctcaagatgaccatctgaaacaaaacacgtgtgctttctctagtggctgagaactgtgtcttcctggagactaggctggcattttgactttggggtgagtcaagtgaatttcctctgttatcctaaattgtggatttcagttttagctactgtgatggttactttcatgtgtcaacttgactgggccatgcggtgcccaaacattcagtcatatgttctgggtgtgtctgggagggtgtttttggatgagattgacatatgaatgggtagactgagtaaagcaggctgctctccataatgtgagtgggccttgtccaaacagttgaaggcctgaatagaacaaaaaaactgagtaagagggaagcccccctgccggactgcttgagctgggacattggtcctttccgcctttggactcacactgaaacatcggctcttcttgggtctatagagtctcctcttttcagactgcaatttgcaccatcggctctcctgggtctccagcctactgactgcaggtcttgggactttttcaccttcgtaattgtgtgagctaaatcattgcgataaatctctctatgtacatctcttgttggttctatttttctagaaaaccctgactattacagctctctggtaacatctatttaaaaagtctccccaccaactgtcattctccctttttttaagatttgatcactactttgctcctgggagtcttggctttcctcttgctgtaaaacatgctctctgcatggggatgtcacgaggggtctggagcagcgtctggtctcccaggtccatcccagtgctcgtgggtggtgtcttgcctggtgtgaacttagacttcacactcatcctcagccttcggtggcccacgcctttactagcctgattctgtctgcggcttcaagatcctcccgtcatatggtcttgagtgagatgtgggatgtctgtggcagaagcagctgccctgttttcatgggtgaacagaattaatgccagaatgtccttgcagtatgtaaatatggagcttgtcagccaacaaggaaatagacctgtctgcttgggttaatacaacttttggagtcactaagaagcaggcagtcaatgaaggaagcagaaggaactgtgcaagcctctcgggacagagtcctgttgcagtgcgccagagaaaccccacagagtggcaggactgcagtgagaaggaggtggccagtcattcatggaagctgctggatgccaagagaaaggccagcatgggggtgggggtcataggcacctcagatagctgggagagtgaacagtgagccgcacttgggaggtgagaggagacccctgccatgaagaagagtgggtggttttcgttttgtaggtgtagaagtgttcgtaactcactcagggaaggcatggtagagccatagcatgcaggatggagtctcccttggtccccacactggtgtgattgacggacccgaggccacccgccattctagcgtgtgcagctatggttgtcctgcatggctgcaattgatgtgttttgagattaaatgacaagatgggatcttaaaagtgatttaaattatttggagctagaactagactggaactccttcatagactgtgtgttttatctcagcttcccagtgcctcacgtagcacatggaaaacagtggttactcaacacattcttgtcggctgggttcaaaaggctgaacgacatcaaaacaagtgtaactcctcttgtagtcatggacttcagatcagaaatttgatatttattgttttccctttatttttagtattcaatattcaaaagataattcagaagacagcagtttaccttattcaaacattgcctcatgcagaaccaccagagatgaagatgtttatttattttttttaagttggaagttaccagtttatgtaaactataatacacctctgacacctgtctgtacatgcatttagtaaaggcttattaaattaatctgtaaatatattatacagtggtaagcatagtcaattttataccttacaaactaagattgtttaaaatccaacaatttaaaaatagatttcaagtggatgctagatactttttttctttctttcttttttctctttctttctttctttccttcttttctttttttttttccagggtctcattctgttgctcaggctggagtgcagtagcttttcacaggtgccatcatagctcactaaagcctcaaacccctgggctcaagcagtcctcctgcctcagtctcccaggtagctaggactgtaggcacacatcaccatatccaactgatataaaattttttttttttttagagaccgggtcttacactgtggtccaggctggagtatagtggcagcactacagctcactgcagcctcgaactcttgggctcaagagatcctctctctttagggactccaaggcttgatccattattctagtttataaaacagcaactttccttgacatgatggccctctccgttttatcagaatttctgtttaaaacaacccgtttagctagacaaatgaagagtgttgggggtgagcggtttttgtgtgtagatactcccatccgtaggaaaataaaatggtgcggggtattctctgagcacatttccaggtgtgagagtcccgtgcctttgaatggaggatctttgattataggcatcacatgtctgtagaacatcagggccttctgctgacacctggagcccgtgttggggatctgtgcgttcttcccaaagtgggcacgactcccagctggctttttgcttcttgacctggccaggctgcatcctggactgtgcagctgtgtgttcacatgggattggagtccaaacacaataagaagagttatatccgctgcggaagcagcagcttatctggaaggagggacgagggcagcgatggaagctcatgatgtcatatgccaaaccacattacatgttgggtttgctatgcagagtggattgttcacataatatgtttctaatttttcatgcttgatttttgcctgtatgtttgtactctgacatgtttgtattcatccacccgtcaattcatttgttcatccattccacaagtattcacaaaggccctggtcctgtgtgtgttccctgctggtgaggtctcagcgacaggtagtgggcacccttcccaatgcttacggttggtagaagacggggcaattgcatgaaaacactgcacttttataatgtattttttaaaagagcccacatagaccagttttcctaattgtctctggaaagctctggttgattattgataagtaattgaatatcccttgcggatccctggtgacatctaaagatacagggactgacttaccgaagctgcttttgcatgtgttgaagggctgcatgcaggaagggcttggggacgttcacagatttctccttaggaaatggctatgttagaggagcctcctgcagcagggttgatagggagaagcacttggggtttcaaagggggaggagaaaatgggcccattggggtcagatcaaagtaggtagtcaataaaaggtgcattgaaaaggatgcttaaatagacttcttttgctaatctgacctcttcaggctttacctgtagggatctgccaggctcctggaactccaaggcctgagccagcaagccaagggaggctgtctatcatggcagcccctcctttgatcgaaatctttctggttaaaaaaaaaaaaaaaattagctgggtgcggtgatgcacgcctgtaataccagctacttgggaggctgagacaggagaatcgcttgaacctaggatgtggaggctgaagtgagccaagatagggccagtgcactccagcctgggtgatagagtgacactgtctcaagaaaaaaaaaaaaaaaaaaaaagcttcctggcatgcagggtccttgcctctcttctgcctcatttcatttaccctcctccttcctttttttgtcctgtcaccacccttctccccttctctttactctttctgtttccttttccctttattttcctccagctttgatactttccccactcatactttgttttacagtttttgaatctgaaaatttaaaaatagatcacactgatgagcttgtgaacttttaaaattagtatgaattgtgagtagtagagtgcattgttgctccctggccctctgaacctttattcttacatcctttttatttctttttcttttttttctttggagacatggtctgtgtcaccatgaggctgtttccttgaggctggagagcagtgatgctatcatggctcactgcagcctcgacctcctgggctcaagatcctcccacctcagcctcctgagtagtagggactacaaatgcatgccaccacacccggcaaattttttgtgttttttgtagagatggggtttctccatgttgcccaggctggtcttgaactacagggctcaaacgatatgtctgcctcggtctcccaaagtactgggactacaggcatgagcctctgtacccgacctattcttacatctgagtcaaagctgggctagcgagagactcagagatcaaagccttccctgggccatccccagacctccgagctgcacctggcacctgcctcacccattgcagttcccttggcctggagtcaagcctgtaccctaagatccagctttttcaaataccctattcagggccgaaggggtaatgacatcatggaatgatttagcttggtgaggaataagaactccaggaaactgtgatttggaatttgattcagtgaaataaaaaggaggggttgcgccttatgtttgggcatctccctgcaggctgttgcctgatgctttcagcattcctgtgtaccagctaaggagcaggaattattgataacctgtcaggagggatgtggagttcacagagagtaaatggattgtacacaattaggttaataagtccttgtagaaccaagatgtcctacttttatttgaagaaatcattcagaaatgggctctgataccctgatacattttttaggagtcattgccccctgtcttgcatagtaaaggcaggcttccatgcagtaaactttcactgggctgtccgtttctccactgcctgcgaggcatacccaagtccatgaacaaggcatccaggccctcattgccttggctgttgactgggtcttccatcttcctgggctctctgcctaccctactctgtctctcatgtctctggctttgcctactccaccccttgacctgacctgccatatcacctggctgacctgttcctagcacagatagcatctcctctgggatgcctgcctgctctctcaggggctcctcctctgcgtgcccatcatacctgtgcacctccagcacgcactgagtaaggggcttggtagtctgtttggtatatatctcttttcctcactagataacaagtcccttgaggggaggggcctgcattttattcatctttgtatcttctgcacttttcatgactttagacacatagttccagctcaaccaatgtttattcagtgaatgaatgagcaatcaggtatttatgggatgtaaaaaatgcaagtggctcatgactgtaatcctagcactttaggaggccaaggcaggcggatcacctgaggtcaggagtttgagaccagtctggccaacatggtgaaactccgtctctactaaaaaaaaaaaaatacacatacacacacacacatacacacacacacaaattagctgagtgtggtggcgtgtgcccgtaatcccagcaacccaggaggctgaggcaggagaatcactgaaacccgggaggtggaggctgcagtgagctgagatcatgccactgcactccagcctgggtgacacagcaagactctgtctcaaaaaaaaaaaaaaatgcaagttataggagatttctaatacaggacaataggtatacttttaaacatgttgtaatagaagggaagctctgagcttgcttattagctcatggactttttattctgatgctcagggcttgtgcagtatgtaactgtgtggaactccttcaggggcctgctttcacacagtgcatcctgctgtgctcctaggtagcagcagttgctcattttatgctctgccctgttggttggagtagaaatgctctctgctctttgtagaactctagtgtcctcttagaagatgaggaacaaggtagaagagggatccaccactctcagaaagaattctgtagaattaggagctgaaccacagggccaagtgcctcctcccaggtggacccactgagcagatagcagctgctactgttcctgctgggagctggtatcactgataatgatattcatcatatcactgatgatgacattcaccatgatgacattcataacctcagtcgtactttgagcaaatgtggagccctacttattttcagagtttattctcttagatttatttttttatttttttagacggagtctcgctttgtcgcccaggctggagtgcagtggcacgatctcagctcactgcaagctctacctcttggttcacgccattctcctgccccagcctcccaagtagctgggactacaggtgcccgccaccacacccggataatttttttttttgtatttttagtagagatggggtttcaccgtgttagccaggatggtctcaatctcctgacctcgtgtttcacccgcctcagcctcccaaagtgctgggattacaggcgtgagccaccgcacctggccagattttttttgtttttgtttttttctgtcctggtcctgtagaatcagaggaagtggaaaacacatatcaggtatatgagcaccgtgatcacgattattacctcagaggaaaacaggtgtacccctttcaccagctgccaacataaatggagctctgcagacattaacagaggctgtagactgtctcccttccctagcagggctggtgcttgtcctgacccacacagacggcctttcaagttagactgggagttcattttctgtaagtcagacggctatttgagaaagctcagtggaccctctttttcataaatatgcgtgggcttcagtttttccatccatagaatgaggaagttgtcatagataatctggggatttgtttccagcttttacaattccgcaatttatagttctctgtcctttcatggttcttatttcaaattcccaaattattattcttatgtttgtgggcatggaatgggcagtgagcctcttgtcccacagctaaatcacaccctttattggaaaaacatatatgttggaaaaacagctctcaattgtgatgaaataaatgacagcaactttcaaggccaataactgaacaattacaggaaagcattgaatcttgtgccagcatggctgctccaactcgagatggctgcggtacaaaggatatttatacgttgggcttcagaataataattcaagtgctcaagagcctcatcttgtgatgttatcacaagaatgtccagacaatgttttctttaactccaggaagagtgatttagaaggacggatcttgccgcatgtgtccagctgcatatttattgctcttggaagagaattattctgtaaacacagaaatatccaagaatgaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaccaagttttcttagatcctgtgaactcttgctcagagttacatagccaaccagtgtacctatttttttttttttgagacggagtctcgctctgttgcccaggctggggtgcagtggtatcatctcagctcactgcaacctccacttcctgggttcaaatgattctcctgccttagcgtcctgagtagctgggattacaggcatgtgccagtaagcccggctaattttttttttttttttgtatttttagtagagacagggtttcaccatgttggccagactggtctcaagctcccaacctcaggtgatccacctgtctcggcctcccaaagtgctgggattacaggcgtgagtgactgcacccagcccagtgtacctatttaagaacagagaaaactttccacttttagcaaatggaatattgccatttattcctgaagaaaattgtctgtgtttttaatgccctatggccgtttctccacaccagctattcctgtggtaggctttttctctccaggaacattctaacatgattttataggaatggtcataagaggagggcccatcacttgctgcttattcacactgcgtattcatcctagaaaaatgcagtgtgccgggcatggagacccctttttttaaacttttattttaggttcggggtacatgtgcaggtttgttatacaggtaaactcttgtcacaggggtttgttgtacatattatttcatcacccaggtattaagcctagtacccaagtgttatgttttctgctcctctctctcctgccatcctccctccccgctcaagtagaccccagcgtctgttgtttacctctttgtgttcatgtgttccctcatttagccctcacttacaagtgagaacatgcagtatttggctttctgttcctgcattagtttgctaaggataatggcctccagctccatccgtgttcctgcaaaagacatgatctcattcttttttgtggctgcatagtatttcatgatgtatatgtaccacattttctttatccaatctgtcatcgctgggcatttaggttgattccatgttgtcggtattgtgaagagtgctgcaatgaacattcatgtacatgtgtctttatggtagaatgatttgtattcctctgggtgtattcccagtaatgggattgctgggtcaaatggtagttctgtttttagctcttggaggaatcaccatactgctttccacaagggttgaactaatttacactcccacccacagtgtataaatgttcccttttctctgcaacctcgccagtgtcctgttcctgttggaagggcttgaggtgttgcccagagagccactgactgcagccactgcatttctgactatttgatatcattgttttgggaagtgagtctttccatttatcctgctctcagggtacctgggcagctgcaggatgatcttacccgcagggagcaatgattcatcctcagggactttggcagtttttcttgtgcaagggcagcttgcactcccaggtcaagggtattagtgccctcattgcatctaatctcaggtttcccaggtcagatctccctcccttttgccactgtgatttcttcctattcaaatcatgaatcataaagaggagctcacggaaaatctttttatagaaatggacgtattatttctatgcctgcctttctattttggaggcagggagaaggggaagatgcaaggccgggtcacagccggacaggatgggggctctggtgtcagcccttacctgcatttaaaactgagatagctttttctgacacagtaaaaaataatttgtgcttttcaagaagtggaatgtgaccaggcgtgatggctcacgcctgtaatctcagcagtttgggaggctgaggtgggcagatcacccgaggtcaggagtttgagaccagcctagccaacatggtaaaaccctgtctctactaaaaatataaaagttagctgggtgtggtggcaggtgcctgtaatctcagctacttgggaggctgaggcaggagaatcacttgaacctgggaggcggaggttgcagtgagccgagatcgcaccactgcactccagcctgggcaaaagaacaagactctgtctccaaaaaaaaaaaaaaaaaaaaaaaaagtggaatgcattcaaacacaaaaccgccctagctaatgaaaaaaggtgttatcattaaaaattatgaccgattaaagggtgagttttaattattcatccagaggaattagccacctttcggctaaagatgacagacagtgggacagttaatgcctttgcgtgcacccctttcagagagtgcttaatgggacttggattttcttttctttttgataggttgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggtacctgctgcgggcctctgcgggtccccggcgctcccctaggaaacacgggtttctctgtggtttgtgctgaagccctgatccaccactgaagtctgtctcttgagccccctctgaggggcgtggaccctgcgtgtagcctttcggaagcttcttccctctagcgaatgtgatctctgcccacaagcactgggtgagggccttgccaggacttttgtgcttagtatctctaagtacattttctgtattctagcaattagtgcccttatctaactacccagctgcctaccaatactggaactttcttaagggtggtgctctcttcctcttgtctgtttgccccgtggtgagtaacgtggagcaggtgctgtgctcagtcaatatttgatgaatgaatgtgtacatgagagaaccagagttggttcctggataaatgggcacataaaagcacaaagtccttggaagattgtgagctcttttcctttaatgagagaaggacaggatttgtattgtttcctttcaatggggaaatgtgttcatggctctcctggtatgtcacagcgtggttcagcaaagaccactggtcacttgtaccaactgccccgtggttgagggtggtgaaccctgacctgcgcttctcagcagactcttgttccaacctggattgctgaaggacaccctgggggacccatccatagctctgaactctctgataccttcacccgcaaacggcttctaaaacactccagtgaaacccctcatgtggctgtcatcctgagtgccgtgaaactggctacaaaatgggattcctttggcatctctaaaggaattcccaactgaatgggcaccaagtcagttcatggcattttactatctcttttctgctctcattgctttgtgctctgtagggatttttgctgctctcctccctggtcgttaatatcagcacattgccgctgactgattgacttaggccatgcatgcagttggatcattctagcacatccaacatgtgttccttctatttccttctctgatcacatcattcttaggaaagacaggaatcagaaggctgcaccatcactttctgttcccagggatttagtgacagttgagggatggtttccatcttgtagcgaaagagacctctgccttgagcagagacgaaagaggtacagcaccagccccctaaaccaatgctgcagccctgtgtcttttggcttcagggcagatgctgtgctgaatgtaaaagaaacgaaactcaacagtggtattgtgccaaacctttgaaataccataagcaaaaatagctgatctggctactctaaaagttgtgtatcttcctgtatcctgtcttgcctgctgcgtgtctcactgcacctgacgacttttctctgtcccttttcatgtatttaacaggacaagcatgagagctcagccaccagactgcccagttccagcccaggctctgtgtctcacttgctgtgtggccttgggtcagttacttgacccttccgtgcacatctccacatctataaaatggggagaaccaggccaggggcataggctcaaagcctataatcccagcactttgggaggccaaggcgggtgaatcaattgaggccgggagttcgagaccagcctggccaacatggcgaaaccctgtgtctactgaaaatacaaaaattagctgggcgtggtggtgcatatctgtaatcccagctacttgagaggctgaggcacgagaatcacttgaacctgggaggcagaagttacagtgagccgagatcatgccactgcactccagcctgggacacagagtaagactctgtctcaaaaaagacccaaaaaaaactggggagaaccaggggtctgcttcatagggtctttctagtatgtagatacaagcccttgcactcgcactcgtactcttctagcagctgacagggtaagctccagactgccacctttctgctgactacttccttattcttttcgtgacacgtcccttccacacacctttcagaagcttcaccctctctctttgtcgcttttcattttggaaacatcaataaaaatgtccagtttgaggaagaagtagatagcccgagaaaaatataattataaaagctttagctggaaaagaaatacttacgtaggtgagaggttcagatatcatctggcaaaaggtaagtctcactttcaaggacagattttggatatttggggctaatcatccctgaccagtggctgaaataaaaacaaaacaaaaatcacttgctgtttctccagtgatttagtggaaagacccttaaaagccgtcatccttccacgcatgttttatgagcaaataaacaagagtctcccaaatggagccaaaatcatcaaggctgctgtcaagccaggagtgaattgtgctgaacttttcaacccggattaatgttttgagatacgtggggttacactgtatgattttgtacattttggaacaaaaagagacattgagttgaagcgagaccttggcatttggggcttttgatgctttaggcgtgcttttcttgactttcaaaaataatcgggtagttgggtttgtagtggaagcaatgatagaaaaaaatgttcctgtttttttctggaagtaaagcccacaatcctggcaggcggggagatacctgatagaggaactgtgctcttaggtctggtggccaatctcttctcttaaaatagcacagccaccacaggcctcagctacttccctctaaaggacatgttcatgtgtgtgagttttaaatgttggcatgcctatgggaattaggctaattttgagagtcctgacctacttaaatgagacaggcaagacttcagagcctgttatatagtttgaacatcctctctatgtagccactgaattgtaatctttatttctattaagttactctgggaaaatgctgtgatctcaaagggtaaagattattgatttgtatggccagtgtaatagtggagaatagacaatgctaatacaattttatgatcctctgacattacatgcttcctgaaccttttcttggatacctgttagcattaacaaaatattttcgtagactgattacagagtttttgggggatctgcctacgttctgggcttcaaaaattcaaccaactaaagaaaaaatagggctgggcacagtggcccacgcctgtaattccagcactttgggaggccgaggcaggtggaacacttgaggccaggagctggagaccagcctggccaacatggcgaaaccccgtctctactaaaaatacaaaaataagctgggtgtggtggcgtgcacctgtaatcccagctacttgggaggctgaggcaggagaatcatttgaacctggaaggtagaggttgcagtgagccaagattgcgccactgtactccagcctgggtgacagagcaagactccatcttaaaaaaataaaaataaaaaataggctggccaataactccagagacagctgctaatactgtgcatttaacaaattggtgattttaagccctgggcgacacacgtaacctagactttgaatgttccatgggtctgcaagcaatgccatgaaattggactggccaccatacccacccatgtgcttggagggtgctacaaagagaaaaaaaaaataataaacaagaacaaaagatctgcagatcagaaactagcattcagggtttagtttctagtggtagtctttgaaaccactgtgtattgcctgatgacttgttccaggcacttgtaaatgcctaaactgcatgatctaaattgctcctaacaccctataggtaggaacttttttcattccattttatggagtagccgctgaggcctagagaggatgaggatcttgccaagggttaaagggattaggaagtatccgaggtacaatttgagcccagacccggagggtcctcacctagcatgcgatgccacctgctacctgcagcctcgggcaggaccctgtctatgtgactctcgggccagatgtggtcagtccttatgagtaagagatggtgaccacctggcctcaatcaagtgaccttcagtcagaggcccctactcttctcatgggcccctttagatggtgatgattacattgcagaattgaggctcaagttgtttcacaaactctctttccagcttttgtagctaataggaaacattgaagtgatgatcaaattggctgtaaaagtctcagttaatgtttggtaatggacagaaatgttcagtgatattttggcagaaagcaacctggcagggctctgaaataggagacgaaggttttcacacatacaggttaaatctagatgcccctagtatattttggaaggtttctgaccaagcctagtgaaaggtgtaaggtcaggtttgaaaaacccacccttctgtcctcggtgtaacacaggcctccctcgctggtctttctggacccttttctgggaagagcgcctactccagtcacattctcagggtccagcctgccaacctggtgcttttttatttgttggggtggtttttaagttctcaatgagcaaattaccttcttggatcttcttccgtgtagaatttgtccacagagtttgtaacgagcactgaaaacgcgtatttatttggatttcctcctaaaagacaaaaatctgtctgtgaagggaatttaatcaagcagggtcctaggatcagaagcaaagctgtctggatggatttcatgagaagggcctgtcagtgcacgaacttggcctgtcagtgcataaaaccaaaagttcagccacaagacatagcagcagaggtgcacagcgctcagcagtgacctcgcatgcaccgaggctggaccccggaaccaaatctccctggctccacctttgacaagctgcgcgaaggggacaagtcctgccacctataagcctccgtttccatgtctatacactggggttcctagctcacgggactgtcggggtaattgagtgagttaacgtctagggagcacctgtgacatgccaacacagtgctgtcatttctgctgttgtccatttttctgcatctttatttgtaaggatttgaaagaatgtacagttggaaacctgatgatctcaagcagaaaatatcttttcataacgctgagcatgaatgacatgagaatccatgtctgaagtgaaatcgtatggatctgaagaatggttggtgccagccctggtggaatggggtgcgaaggagggaggatgagagccagacgtttcagtctgggtgaccctgccacccagagccaccttccattaactgaggagtccagggctccctccaggccacttgccactaaagctcagctaaagtctcaaaaaggacacattcggagccaagcaacaggcacagcccatgttaggaatgtttctgcaatggaaaaatacaaaaccagaaaggaagtgtgtgggcctaatcgtacatgtttatcaacattttactgcaatgtatgacatttctgtgagcacaagattagccttggtatttttttctgggaagtataaaagactttttttttctttctttttgttttcaatttctctctagaggaatttaaaaccggatatttccatcttaaagttcttgagcaagtctgtcaaggtgtccatatttcttaccctgttcctctcagcatcgaagtgctatctctgttacactcatgtttgctgttcacaatggagtactaatgaaatagcaaaattaagctaccggcatggtgctaataactgaaactaaaaatcggtttggagcttttctgtttggaaagagtcacttgagccgggcgtggtggctcatgcctgtaattccagcactttgggaggctgaggcaggaggatcacttaaggccaagagtttgagaccagcctgggcaatatagcaagacccctgtctctaaacagatagatgatagatagacagacagaacagatagatagaagaaaagaaaagggtcacttggcactaggtcttcacaggtaaagattcagagtgtgataggaagcacaggctcaggcacccgggtctaatcaatgacaatctcgcttctaggccttttggtggcattttctagtctacctctaagctctagggaatcgtgtggctaaaatcttccctcctgctgagactcagagaataccatgttggccaagatctctaaaacaatcaaacctggcagtattgagttaccttcctcttatcataaagtctttcctcacttcctccttattgtgaactttcttaagaagcgagtccaggaggaagcagtgacatgaatttattaacttgactcagacttctaaagacaacacaaactgggcgccccattcagagagtgacagggaaaccccgtggcataattagttacctacgagtttccaaataggatttggaaggagacatacaaactaggtcgccggcgtggcacatggcttccctgaagccagcattgccctggccaaggaagctttgcagaacagatgagatttcagctgggacttgcagccaagtgggatttggccttttggggagaagggaaagggcattcaaaggccagggacagagtatggtcaaaggcatggagatgaggaagaggggaccagagcagagggtcaggttggaaagcgagttggggtcaatctgcaaaggggctgacgtgccaggtaaaaaacaggagcacagtttagttttgtcggatcatttcaggtggaagggcagtgggaatgttggagaaaacactttttggtgtcgttacattgaatctgctcatctataagaataaaactttatttcatagagttattgtatggctcaaaataggtatgaagaattaagaaaaagaattttagatttaaaatgaaaaagcacctacaaaagtagagtggtagagttaccaacgtggagctttaaggtggcagatattctcattgataggactgtcttcataaggaaatgtaggttcagcaagtgacacattgaggcaactcttctcattattagctgtggtctaaataatgacttatactaacatccattgagcaattgtaatacataccagcaactgttatacatgcttgttacagccagtagtgggtccattattcctgctgtacaggtcagaaatctggcaagagaggttcaattacttcccaatggtgatgtacgtggcatagggcagagccaggatttaagtttagtcaatctggcatttgggcccttgaattgaacccctagggtgaaataaccaagcaatttaatcacgtgctcctgggatcccagaggggcgggcgcttgacccacagtgatacaagagatgtggactgtgggacctcatgctctcccatcctgcttgcatgcagcaggcattcaggcatttctggcccaggaagcccaccaccctgtactgcagcagggaggtgggccagttctgttcccactgaggacccaccaacaacaatgatgcaagcttgtttacagagtatttttagttattgtacaccacaaaacttaagaacgtgagcataggttaatatttatcttcagggaaaagagtttcctttagaaggttttagaattaggaactgctgcacgcatattcactcaggaatgcttgtgtgtgcagtcataaaggtaggctgagagaaacgttgcggagctgagtgcagatggccccagggaatgatgccgagataacgcagccctgggcaggcaaaggcactttgtggaaggcactctgtcttttgtttcttaggacaaaacctggatctctgcatgccccaacccgaatgggatggggagcactttcaggtgtccactctacaccagcctgaagggaaagggcagcatctggcaggagccaaggcgaaatggttcccaggggatatagcagaccaggttgtcctgagagaatgcggccttcaccttgcgaggtgggatccgatagagcagggtgtggggggacaggctgcgcctgcagaaggtctccaagtcttgcatggatgcttagtccagtaacatgtggataatatccacatttagagggacagtttcaagtgtcacgtgtcaatgaatcagtcttaaactgtagctattgcatttttgtgccataaatattaactgtaggaaaaatggaattctgcagtgccttggacccatgtgcatgtcttagccagcttttccatgtctgtgcaggcatgctgatgtgctctttcctccatctggggacttaatgaccggagcactggctgtggtgacatctagtggctttgctttcctgttgaccttggagatttctctctcagtttttcttgaaggtcagtcccaaaaggcaaattttctagaaattgtatttctcttccctctcttgtcactgataacttgccacccctctgggcgtaatgcctcctccctgggcagggcagccaccatgtaaaaagcaactatcttcccagagagaggccaaggatctcctcccctctccctggcgcctgctccttcaggtctcttgtcccagccagacagtgactcttgggtcatggaaaacattctgcagcttttccccaaacgagcagtcctctatgaggtggctcgcctgcacagggggacagaggtaacttctgaaacggtgttttttacctgctacataacaatcaaaacttacttttttttcttttggagacagtttcactcttgttgcccaggctggagtgcaatggtgcgatcttggctcactgcaacctccaccctccacctcccgggttcaagattctcctgcctcagcctcctgagtagctgggattacaggcatgcaccaccatgcctggctaatttttgtatttttagtagagatggggtttaaccatgttggccaggctggtctcgaactcatgacctcaggtgatccgcccgcctcggcctcccaaagtgctgggattacaggcgtgagccacctcgcctggccaaaacttacttttttattcttttaattatggtaaaatacacagaacatcacacttaccttcttaaccactgttaagagtactgttcagtagtaagtgcattcagatggctgtgcaaccaatccccagagcttttgcttcttgcaaatctgaaatactacccccatcaagcccatttacgcctagtattccattagtggaatgctaagcatgtgggagttatgtatatcttactgctcaagatcatcgccaaggtctgattgcagaaattcaaaaaattgcaacctcaggcatgaatgggttacagaacacattctcactcccattcccctctcatcccagcccctggcaaccactcttctactttctgtctccatgaatgtgacttccctaagtatctcacatgtgtgagatcatgcagtatttgtccttttgtgaccgatttgtcgtttcacttaacgtcatgtcctcaagattcatccatgctgtagcatgagtcagaattcctttcctttctaaggctgaataaaattccattgtatgcacagaccacattttgtttaccccttcacctattgatagacatctggcttgctcccaccttttggctatggtgaataattcttcaatgaacgtggatgtacaaatatatcttcgagaccttacttttaattcttttgggtatatatccaaaagtacaattgctgaatcatatggtaattctacttttaatatcagccatggtgttttccacacaaaatttattcttaatgcatttcttccacaatcagcattctaacagtgataacatgaataaaatctccatctcttcttaaattaggcagattactgttttgggtggatagggcttctaatgatttgttcaattttattcaaagtctaaacaaaggcaatactgagccacattcatttaggtacaaaatatgttctagaaagttgccagagtttggtcgtttctggatttttttaaatgaacacacacacacatctcctcaaggctatctgttttgaaagcaaagagtaacacagacccgaccaggattttgcctgggctggttcagtggaaataactttcgcatcaggaggacttgagctcgaagcttggcttagctccgtgccaggtatgtgactgggcaagttacggaacttctctgaccttcagtaataacatttaccttgcagggctgtgccgtgcctggagctcacagatggggtaatgatggtcatcactagtgtttcagatgtctttttgaagccggggcgtgtgcatggaaagaatggagaccatgcctgttcccgaacgatgatgatgtccatgtggattgtgggctttgctgtttctcatgagttcacatgtgtagacatcaactcaaatcaaagcagtttgtcctctatttcacttgtcaaaataaccaataaagcacaggtgatgttcccctcagatttctgaaaatactttaagctaaaaatacaaaagacaggttagccctctgcccccaactcccagtgcatacccagtttgggttctcaaggatgaagagggcttgggcatttcagcaacctgcccccgagtccccctgacaggcagtgcctaccccaggggacccacaatacccagaggtgctgggctcaggtgagaatgaattccgcagaaacaagggcatttagtccagctttgagagcactctatgctcctctcaccttcattccttttgttttgagactgagtctccttctgtcaccaaggctgtgcaacctccacctcccaggttcaagcgattctcctgcctcagcttcccaagtagctgggactaaaggcatgcaccaccacgcccggctaatgtttgtatttttagtggagatagggtttcgccatgttggccaggcttgtcttgaactcctgacctctccttcattctttatcgtcttgcgtcagcaataatcctattcccagatgttctaggaagcaaacttccaacagggatagcacaagaggtcacccctcacaaaggccatagtcatgactgtcttcaaagtgtctcagcgttcacatttttaaaattccttgaactaaaacaaaatgcgcaaagagatcactaaatcaaataactagtttggttccaggttccgggaaaacacacatacatgcacacatgtgcacacgcacgcgcacacacacacacacacacacacatacttcagcaaaagagaactgtttgttctagttttggttccgagttagctggtgttttaggactttctaatcaaggccaagatccatgtcttcacatcctacattcagcataactccagcttcgacttcggtttcagtaacagagacatcgtgggcaggctcttcttcagggccatcgcgtgaacagccctcctgtgccctgttcaggatacctaccaactggaagcctgcccaggaaaccgtgcagagcctaatactctgtttctgcctcatgtataaatggatgatgatttggggtcagagctgggaacacaaagacagcaatagaaacatatcctttctaagataaagctgggcataaagagattgttattttaattttgtgttggcactttaaaaatgccgtatgtcatttttaaaaggcaaatatggagggttctcttattcctcaggcaagatgaagccaagtgtggagtcgagttttctgcggggctcctttctctccctcatcttttactcaaaagcacacgtctgtcttctcagggcctctcccatgtgtgctcagtttttgtctcacttctcccaccctcacgcccctccactcccacatccttactcgtcccccagtctgagcacttcactctcctgttgaaaagcagctgtccactgccttcaggatcaatggaatctctacacagacataaaaggcaaaaaggcagccatatcttccagtccagccaggccggggggccctcccacctcgcccctggcctgtggtccctccaatctgacatgccccccgtccccagatcttctgtgtctgtgctctttctctgcctgaaattcccttcctcccccagctcacggccacccacagaggtagcacccacacacacagtctctcctgaccgtctcccaccaaacagtccttgggcctcctgtgaacatcccgacacccagagcctctctgccatgccggtgaccacagtgatctgagttgggcagggctccctcagccaaggatgtcctgcagtctgtttctctgtcaccggatgtggtgtgagacgaattgataggtgttcatgttttctgtttctctttcttgcaggcaatacataagggaaatccctttgttttttagaagcatctctcacacacagacatgtgcatacatgcacatctgtctaacctgttgctctaaaatgcagcaagagaaaagcagcctagtcttaattgatttcagcagttaggtggtcctggggcatgaatgtgggtgcgccagggtgcctcggcccaacttctttccttgtttgccctgcagattcgcaaggggcccctatgctgtgggtccaagccctcctgtcctgcctctgactgtcttgtgtggtctggccccacaggacttgtcttacaaggaccggcactggcatgaagcctgtttccactgctcgcagtgcagaaactcactggtggacaagccctttgctgccaaggaggaccagctgctctgtacagactgctattccaacgagtactcatccaagtgccaggaatgcaagaagaccatcatgccaggtcaggaggcactcctttctcatgcgtgagccagtctagcttcaagccttgtgcacgttcctctgaccccctgttcacattgacttggttccagacactcgtgttgactttccagtttgaccttgaactgcagaggagtatttagagtacttacgaagcagggacatacaggttctatcatgggcagtaacgggatctttttgctgtgcacgtggggcagtgttatgcagtcaaattgttagagtaagaaaatggtgggtatcccccttaaaaatacatctcctgcatcagcccccactttcccaccaccatagatagtttctcttttcttcccttctacctgctgaatttgtactcattcagttatttcaccaagtgtgcatggtgcccttgcgtgccaggcactgggctcgagctgagcattcgtagggtgtgagccgaggtgcacctggtcctctgcccttgtagagttggtgttctagacggacagtcaaaaagggcacagccgcaactgggccaggtgccgaggatggcaataaaggtgccttgtgtgttgatgggactgtgtccctcatggtttttttgtgtgtgtatgtggggggagttatttgttttgttttgttttttatgtaggagagcagaatcttttattttaaaaagcaaagtggacaaaaatatgtggaatttcaaaatacagaaagaagctgggtgcggtggcttatacctgtaattccagtactttgggaggctgaggtgggtggatcacttgaggtcaggagtttgaaatcggcctggccaatgtggttcagtggtgcaatcttgactcactgcaacctctgcctcccaggttcaagagattcttctgccttagcctcctaagtagctgagactacaggcgtgcaccaccacacctggctaatttttgtatttttagtagagatggggtttcatcatgttggtttgctttgtttttgataataaagaaatactgaagagactgacatatgggaaatagtttagaaagatatgtaggatgccaggtgtggtggctcacccctgtaatcccagcactttgcaaggctaaggagggcggatcacgaggtcaggagtttgagaccagccaggctaacatggtaaaacgctgtctctactaaaaatacaaaaaattagccgggcatagtggcgggcgtctgtagtcccagctactcgggaggctgaggcaggagaatggcctgaacccaggagatggagcttgcagtgagctgagatcacgccactgcactccagcctgggtgacagagtgagactccgtctcaaaaaaaaagaaagttatgtaggataaggaataatcattttttaaaaaggcaaggaggtaatctgacctttggtaagatggtttcttactgccactacatttctctggttaatataactttaaaacaactgtgacacactatgacagggaagaaaaatgcccaggctgacacagtcccagccctgttggcagctgtaagggaaaacagctggaagggctgcatggtgactttagatggggcagctccaggcaggaaggcctcttctaagatcatgtggatcctgcagaggctggaaactcgggccccagtgctgtgcgacagtgcaaatgagaattgaagcccgtagaaagccaggctgacctgtgtcctgccccacagggagtcactgcagagacacaacactcagtaacaataagaaccacgacattaattgaaaaacaaattaaacccttactagtttcctgaacaagggcccaaggaagcttccactggggactctaggggctgtttaaagactttaactgttagcaccaaccatgacataaaaagtatgcatatttcccggattttgaatttttcacctgtcttgactttctgtgttagtcacgttctccagagaaacagaatcaatcaaggaaatgtatacacatagatacatacataaggagagagagagagagagagagagagagagagagagagagatttcaagggattggctcatgagattgtggaggcggtaagtctggaatctatagaacagggcagcaggctggaggctcagggaagagatgatactgcagttccaaatgggagcatttgaattccgtagggcggcaggctggaaactcaggcagggtgtgtctattgcagtcttgagaagaattagttgcccttagggaaaccttagtctttgcccctaaggcccactaccgattagatgaagcccggccctgatacgtgggtaacgtgctgcactcgaagcttgctgacttagatgttagtcacatctaaaaaacaccttcacggcaacaagtaaacctgttttttgaccaaacaactgggtaccagagcccagccacgctgacacataaaattaaccatcacaccttccctttctcatggtgtttactggggagggaaagaaaagaaaaacatgatcagataagaagtaaaaacctaatgttcagtgagaggtaacccatactgaatatctgagaattaactggccggcagcctcttctactaaggaatgggggaagcaagaattcaggctctgtggtaagaaatgctgtgtagtaataataacaacacagctacagcttccagcccctgagcacacacacaggcgtcagaccctgctgctttacagaatcccattgaatcttcggtgttccctgggttggatggcttcatccccattttacaggtgcctctgccagaagaaacggactgggcaccaaaggcagggcgtctagaagaatcccggtgtatgcaaaacaaaccagcaccgacaaaacactgaatcaaagcacttgcttgcctgggtttgatttttaaaagtgttagaacccattcaagatgaatatgggtttacagcgtcagtgcacagcttttgcggtgaatttacatttagaggacaagtgaaaaactcacccaccagctccacaccccccacacaagtcagtttcctgatgaccaatcaggaaactggaataccatcagtaaccccagtgctggggtttaccggctctcgcgcccctattagcagacgttgcttacagatgcaccacagcctctgagcagactcaagtagcgattctgtctccaaccctgcaaccaaatttctggctcctcatttgactttttttttttttgagccaggatctcgctctgtcgctcaggcgggagagtagtggtacgatcactgctcactgcagccttgacctctcgggctcaaatgatcctcccacctcagcctcctacgtgtctaggacctcaggcacacaccaccacacccgcctaattttttttttgggggggtagagacagggactccctatgttgcccaggctggtcgccaactcctgggctcaagagatctcccgccttagcctcccaaagtgctgggattacaaggctgaggcaccgcagccagcctcatttgactatttgaatcagattaagacatcccttcttcaagactgcgcttccgcctgcgggagacttggttcagagtgtgcgattcagttaggagaaggaacgctcctgccacctgccggtattgctgcatatgaccatgcaggcttgcggccactgctgtcgccatgcctgaggtgcacgcgccatgtccctgaggctccaggtgccctgtgcattccctgcacgtagagttgccctcgaactggtgttgatctgatcagacttatttcagaactcgacaagaatgccatgagagtcataattgccccatattcattggcaaaatcctttggcttctgggctgcttgatcagaatgaatgtcagagatccaaagagcaagtgacaaaagtatgcatggaggttgaagaaaatctttgtgaattcaaagtccttccactatttttacttgaatttcaattgcttcatgtaatgtttgttttaggattcatcaccccacaattgaattccatagattgtacagcttagttttgaattaaaagatcgctgcgtgtcaccatcccaaattccctctcacacattgccccccaacacacaccctgcttattttatataatctcaaatgtctggtcttggaagtacaggaagctgagaaaatgatcctaaataacaatcgtgataattctcagcacattcctaattactggaggacagacatttcatgaccaactttctagccagctaaaatacaacccctagctttgtccttgggaccataagattttggggctgagagctatggactagtctatagactcctataagccacctgtgttactgcagctgcttccacctggtctggagcggggcagtccccctgtcggcttgattccccatcattccctgacccccagttgaagtcacatgtatgtgaccctcatgccacagtccccagggattggcaacatttttccttcaaaaatcagataaatatttggggctttgtggaccatacagtctctgtcacaactactcaactattacaactacacaacaactgcacaactgcacacagctgcacactactcggccgtctagcttaaaagcggatgtaaacaatggaagtaaattaatgggcgtggctgtgttccaataaaacttcatttgaaaagcaggcagcagtctggatttggtcttacacagtggccaggcccctcagctagtccgggcacttacaacactttcctctttctttgtccctgatacttatttccccagattgttctttacctttgctttatatgaagggtacttgtttacacgcctatctggaatcatccgttactataaatagatacacttctttctggcaaacaaaaatgaaaaaatgtcagtcaacagacaccgagcacttgcagtgagtccagcttggtggtggcaggggtgacccataagtgtttcagttctctagagctcctcagttcacttggagaaatggtagaaatgtatcaaatgctaatagttattcaaaagacaatggatggcgtaggtttaggcaattactaaatgggatgtacaagtaacacatgaagatttcagccaggcatggtggtgtgcacctgtagttccagctactcaggttgaggcaggagtttccctggagcccagatgttcaaggctgcagtgagccaggatcgcaccactgcactccagcctgggtgacagagtgagaccctgtctcgaaaacaaaaaaaaactacatgtaggttttaattatagcacttagtacagtgcataaaactacctagatacatcacaacttggttcaacaggcagtatgtaaagtgagtgttgtagaggctgctcactgaatcaggttcgaggttccaggttcattcacactctagccatttccatcctgctgtgaaccagacggggtgttcattatcaggtgtgcaataggtgaatacagtccctagactccaaaagtcatgctccatgggaattcatcggagctatgccacacttctctttatactttgcattgctgagagagacttaactttttttagatttaacattcctaaccacggtattcaataaataaatgttaagtgcctaaaatgtacacgtgttgttctaggagctgggtgtacagtagtgaaccaaaagacaaagtccacgccctgcacaaaataggaattacctccatgtagaggcgagccttcaagagctgaagtggcttgctctggtcataaaactagagggcagcaagctctgaaggcagattgctgggactccacacccctctaaccataactctgctgtgttcctcttgaccctgatgacaggtacccgcaagatggagtacaagggcagcagctggcatgagacctgcttcatctgccaccgctgccagcagccaattggaaccaagagtttcatccccaaagacaatcagaatttctgtgtgccctgctatgagaaacaacatgccatgcagtgcgttcagtgcaaaaaggtatctcagatgcccccttggcccttgcacgttctggctggtttgcctccatggtccatgtctgtcagttctctttccaaaaccaaggatacctgtgatacttaagtggcgtgggagctgtgcctgtcctgccttacattctgagcatttatccatcgggtctgggtgtccatccttctttcaaagacatcaacattgttgagctctgtgatcaaatcgtttaaccctgccttcttctagaccatttctaaatatgttcttatgttgataacctgaggttagagggaaggggagccaccatcccaaagctgtcttgttcagcttctctccatgaataaaacaagaaaacaactgcaaacttgagagggagagaaagatggaaggaagagggaggagaggaagggaggagagagagacggatgtgagaagaaaagtaaaggagaaaagtctgcctccatggatatgggacagatcatttattaaatgtatctactctggccgggcatggaggctcatgcctgtaatcccagcactgtgggaggccaaggctggtggatcacctgtgggaggccaaggctggtggattaccttaggtcaggagttcaagaccagcctgggcaacatgatgaaactccatctctactaaaaatacacaacttagctgggtgtggtggcacacgcctgtagtcccagctactcaggagactgaggcaggagaatcacttgaacccgggaggtggaggttgcagtgagccaagatcccaccactgcactccagcctgggcgactgagcgagactccatctcaaaaaattaaaaaaataaataaataaacttatctactcgataatgtgctattccagtcatggctctgttagggttaaagaaagaaagggaactgcatatctgtaggaagccatctctctgcccagttgccccccgacctgcacccttcagggtgtagcttagttttctgctgtgccctctgactcttagacacacgcaattcttattatgctatagcttccagcgtctctgtcctgttaggatttgcatcagcctgttgagtggcaccctcccactgctcactcgccctgggcagcgccagctgtggaactcatcacaggttctgttcgctctcctcctgttattgactctgctcacccagcttctgctgttttgcccttggggcctctacccttgcgtctgggccatggagaaacatccccaatgctgctacctgtacctggctggcctgggcaagaatatccccatcttgcccacaccttttctaagtgctgagtattcttaccaatttccattcagtctttctctcatttccattttttttttctttttttgagacagaatctcacactgtcgcccaggctggagtgcagtggctcgatcttggctcactgcaacctccgcctcttgggttcgagcaatttctcctgcctcagcctcccaagtagctgagattacaggcgtgcgtcaccatgcccagccggttttttttgtatttttagtacagacggggtttcaacatgttggccaggctgatctcggaactcctgacctcaggtgatcgacctgcctccacctcccaaagtgctgggattacaggcgtgagccaccatgcctggccccatttgttctttactgttattttaaattttatttctctttatttcctctccttttatgcttctgtttttttctttttttgagacagtttcactctgccacctgggctgtagtacagtggcatgatctcaactcactgcaacctctgctttccgggttcaagtgattctcctgcctcagcctcctgagcagctgggattacaggcaggtgccaccaccaaacccacctaattttttttttttttttttgtagtagagacggtgtctcactttgttggccagactggtcacaaactcctgtttttttctttattcttagattgagctctcattcctgcttttattttaggaaccctcttccctgttctctcccctttttatttttattttggtttgttcttctcatcaagacctaacggaagttcatctgagttgctcttcctctgtcatctttccaatgtgtgctttattcatttgcagaaatgaaagcaacacatccttctgggatgcatgctttttgtgtgcatgttcattaaatacacaaaaacattcatgccagaagcatccattcctcgacatgaacttggccctctcaggcactggggatctgatgctggacaagatgcagacacttaactgtagtctaggtggaagtacactccagtgtcaaacccgtcagtagttactgagcagtgtgctatggaggagaagagcagagtgtggaatggagggacctcaactaatctgaggagttgggggccagggtggtgttgagggaaggagtctctgagaaagtcatgctatgctcagaggcattgagttagctgatgtgggtgggaagcatggaatccggagcaagggaggactgaggacacatgttgcaggcagagatgtcttacacacacaggctactgcattcacatggatacgttgcaaccaagcgtgtttggtgttcattctcttgtgcagtggggtgggttatactaagatgcttcatgatttatggtttaatgaaaagaatacaagatagaagggagtccagaattctagttcctgcttcgtcattaaccagctatgaattctttggcaagtcactttttaatttctctgagtctcagtttactcatccataaaattaagataatatctttcctacttcacaagctttatgtaaagaccaaaggagttactgcatgatactgaaatgttcaaaaaataaaaagcaaaaaagtgtgattgtgaggtgcttgcactccatcttccacagccttcgtttgccaagctgaggccacctacactcctctctgatagcttactcagctccaccaagcactcatttttaaatagaatgtgagatgcaacatttggagaaaaatatcaggtaaaattgaggtactgatggccagttccacctcatgtggctttgcagcttcacctcacagatgttctaagaccacaagacaggtgagaatgaaggcatccagcttatttttcccaaaacttccaagatgcccatctcttcttgtggcatcagcaggtgctagtcccggctgtcctttaagcctcttccttctttcaccgtaagtggctggagagacaggctcgtgagtggcattggagaggttaccacttgccagggtttttgttttgttttgttttgttttgtttttgagacagtctcactctgttgtccaggctggtgtgcagtggcatgatcttggctcactgcaacctctgtttccagggttcaagcgattctcctgccttagcctcctgagtagctgggaatacaggtgcaccaccacactcagctaattttttgtatttttagtagagatggggtttcgccatgttggccaggctggtctcgaactcctgacctcaagtgatccacctgcctcggcctcccaaagtcctgagattacaggtgtgagccaccagccctgccaggcttctaagtaaggactcctcatcaacttgcccaattaacctcatcaccctcacttcctggatgagaaaactgaagtgcagagatctttatcatgacctgctcccagccacagggctggtaaggagtagggttaggattcaaacccaggtctccttgatgctgtattgaatcccgacccctccactgtgctgcttccctgctcagaaaggtggcaacaccactgaggcaccctatgccttagatccccagcatccctgggaagggctgagggcaaccccaagctccagtttcactaacgggaaagccagggcctatgacactggaatgaaagcgtgtggtgagggtgacgagtgactgtgaagtttgtaaagcagcttcttggtgacttaacaaactggacgtttctggatgaggatcttgcatcgtccagtggcagtagctgagactgaagatgtctgccaagcacagaggccacactaactctccccctcgtccctgcagcccatcaccacgggaggggtcacttaccgggagcagccctggcacaaggagtgcttcgtgtgcaccgcctgcaggaagcagctgtctgggcagcgcttcacagctcgcgatgactttgcctactgcctgaactgcttctgtgacttgtatgccaagaagtgtgctgggtgcaccaaccccatcagcggtgagtgtcccggggttcccatttccaggggcgattggaagcttgaacaaggcctagcattttagcctgtgaccctgtctatatccctcaactccccagacctccctaaggctctgaacacagcagacttttctgcctatctgctttcctctccttggtgcactggctatgcttcagcaagtaatgattccttcctctgcagcccacctgatcacaaccatatggccagtgctccagtttagtttctgctttgggttggattatcgctaaaactgcagtctgtgagcctgtgacatcacaaaagcacaataaaaactggccttttcaggcttagcagctgtgctgtgttcttagaagtgtcccctagcatcttagtgggacggttgtactccaaaacatcttaatgggaaacttctaccacaaggccatagctatatgagggcagagggtacattctaaggagtttttcatattgtattcccccaaagaattcagctaagtgagagcccaaaatctggctggctggcagaccaggcttctggactagactattaagcaggctggagaaattcagtgtggagaacagaggagttcacactaaagtcctttaaatggtcaccacatatcgctacacaaatgagtgactgggtggggagagaaaagtgtgtgttctgtaataacacaggagaagttttatgatgtgggatttgcaatcccgttgcattcagttgactggttcgttcctatcagaggaaggtggcagacacttggagtacccggtggcctggctttcctgtgtggcttttcagtgtaactacagaaacacatctatacaccccctgtgtacttgtccttgactttcctttcccttaggcctagaaccaagttcacctaactcagctaactcaccttcccaggtcgctaaaacagtactctcatgtgtaatgcagagctcattacatttccatgtgaaattaaaacatgaagaaaagcacagtatttacactttacctatgttaaaatatctgtttctggtcatttatataccagatttcccttggaatcttttagggggaaaatgtaatcttttgccagaacatattcatctttaatgctgttttcagcagtaacttctgttgaggtaaatgtttataacattaagctttataaagtgatacaatctatataaaagcacttttaaatgtaaaacattagatatgaatgtgaattgtggttattgtggcactgagaaaaaacactaggtaaaaaccaactgtattataatcacggaccaatgtaccttaaatatttgattccattctatctgtctgcagctttctcaggatcttcccactgcgacaatatccctctcccctcattcccacccacatcgcactttatctgtgaggcctttcctggccatcccagggaggattaaccttttcctcttctacactcccttcactgcttcaatcattaagtcataaaaatttgagcaccaggcaacgtgaggcacctagtgaagacataagagaaatctgctccctcttctcatggagtttcattttgtgggaaaacacataacaaatacacagtcagcattctttgatcgcacttatcccatcgttttggaaccagtttatatatctcttctgatattcacgagatcctccaggctgtgcatagaatctgatttacatatggattcccaacacccagtcactagaaattcacattatccatattacacaatccaaactttgaaatggatcaaaccagaattccttcttcagtcccagttgcctgattctaactttcttcatccggtattattttctctctgttaacaggacttggtggcacaaaatacatctcctttgaggaacggcagtggcataacgactgctttaactgtaagaagtgctccctctcactggtggggcgtggcttcctcacagagagggacgacatcctgtgccccgactgtgggaaagacatctgaattcaacacagagaagttgctgcttgtgatctcacacacagatttttatgttttctttctcacccaggcaatcttgccttctggtttcttccagccacattgagactttcttctagtgcttttcagtgatactcacgtttgcttaaaccctttagtgctttgtgatagttcagtcccagggaaagagaaaactcgccctaggccctaggtgggaagatggtttgaaatttttgtaatcgagtaaggcacacccaaatgtaaaaatccttttgaatgatgcctttataaatctttctctcactgtctatttaagtgcaattaacatatgtcacgaacttgaaagttttctaaactcaataaggtaatgaccagttgttatttacagctctgtaacctcccgttgcgtcaagtctaaaccaagattatgtgacttgcaataaagttattcagaacagaatcttttgccaggcacagagtgtgaaatcatgattacaggtcgaggcactgagtctaagtaacactttattgcatggtcccatggtcactgtatgaagtgcagttccaatgttccaatggcctggggcattgccaactggaacagcatcacaccctttaaaggaagccttcggctgggcacggtggctcacgcctgtaatcccagcactttgggaggccaaggcgggtggatcatgaggtcaggagatcaagaccatcctggctaacatggtgatacccgtctctacgaaaaatacaaaaaattagccgggtgtggtggtgagcgcctgtagtcgcagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctgggattataggcatgagccaccgcacccagctaccttctctgtctttcccatactctttctcttggaatgtaatcctctgcatttgacacagtaacataaactgacagtgaagccaattttcaggtcatttttcttggcagagcttatcggctctgtcccagtgttatggatccacatcttacaccgacttccataaagtgaaagattgcacaaggacataagcaacttgaggccagagacgacatcctgttcatctttatgttctcaacaccctcgcaactgagggcacactgggagccttcagtgtttctgaaaagggcagtaaagcaggagagacacacagtcattacagtaaaaataacattctgagctactagtgtggcagtagtctgtggaataatctcagatagcagtatacagttgggaagcacggagccaatgtatgggatagaacattgcacagttctctttagaatgggagcatcagtgacctttttgtccttagttttctaagacaatgcaatataataaaatgataggctgagcaacagaaaaatttggtggaaatcaagtctgatatatgctgagcatatgtgaaatcagtttcttaatctgagtgttagtcactgttagaatgtttgataatgtctggaatgagtcttttggttttatagttgacttgaggttttgcttaaaaagaataatttcatcctttgttagttgttttgctgttttctacttcataatataaaagtaaaagcactccaaatttcattttggaacatcttacttgttcctcattaaaaccatagactctcccaaccttaaattacccattctaaaattaatggttagggggaattccacttctagtaaatagctccaattggactaattctcctccaaattaacagtcattctggacaaaatatttatttaattgttaagaacactggagcacgatccaaagcaggcagatattggagggcagtagacacttggaagaagagaacgacactgggtgattttcctgtttcggccttttatccaatggcaggcccccgccagggatctaaaactctgttaggaaacctgcagtcttactggcctgaggaaccagaggccagagttcgggacaaacagcctctggaaagtgaggaagaaaatcctgaaaaggagag

SEQ ID NO: 15428 - DNA, 42992 bp, Human
  misc_feature (1)...(42992): n = A,T,C or G
accaggaggtgttgagaagtttacccacaacctctcagaagctttgtttcctcagctaaaaattagtataataaaatctccttaccttaagctttgtaaagactcaaagaagtataaattgctttgcagtagttgctaggcagttatcattatgtaaaagtacagctccccctttgagcagagggcataaaccagtagatgctattctgaataacccactccagcaaggctccaacagaaggaagtaattataaagtattagatttgaatgtaagtccactctggccccagggtccttttctacctgaaatgtgcatcttctaaaacagtgccttaggttggaagagaatgggatcaaataagtatgactgccaatgcatttggatcatttggggagtgctttcaattttttagtggaaaaaaatgctattaagcttagaaaatgtccccattcttctaggcccccaagcatgctgaagtcatcatttattacacatttactgagcatctactctgcatcggacattgtgctagggaagatagacctggtcccctgccattaatggtgccttcatgttgattcatacattaaacaaagagtcacacaaataaggataaaattcaaatggcgatcagtgctatgaaggaggaagtcagggtgtataagagcctaaaacttagagaactacgtgagccttacctttctgagataactcttcctaatcccctatgcaggaaaaagatttcttgtgaaaagcaatgatagaagagcaatccggggaagcaaaatgaaacccagcctgagttagaaaggagagaccagtacatgacattctagactggactctcctttactccttttcaatgggctcatgggccagtgtttattttgctgactgcctcaaaggaagtagtgtcctcctcagacttaaccactcttttccaagtgaagacttgggtgggttaagcagcatggatattaacaaggcaggaattaagagggtccgcgtgaggccgggtgcggtggctcacgcctgtaatcccagcactttcggaggccaaggcgggcggatcacgaggtcaagagattgaagtgatcctggccaacatggtaaaaccccgtctctactaaaaatacaaaaattagctgggcgtggtggtgtgtgcctgtagtcccagctacttgggagactgaagcaggagaatcacttgaaccctggaggaggaggttgcagtaaactgagatcacaccatgcactgcagcctggcaacagagagagactctgtctcaacaacaacagcaataacaacaacaacagcaacaaaaagaggctcctcttgaagtataagagtcagtaccagccagcccctggacacaaccaaacctagaagaactgaggctgggatcaccaccttgcccagtctccaggagttacatggagcagaaaagtggtgcagaggaagcacggcccactgcaattgcagatctatgtattttagccagagatagatctgaatggtttccaggagcttctaagagcctgaacatgaagcccctcttggaactgtcctttctttctctgccttaactcaaaaagttgagaggggacaccctgaagcttatccccagtatgaccctgctccaacagcttcagcaaggggatggggcctgattccacagggcagctcaactcggggactcagcttgcagtgcatgctggcctcaagcctttccattatgtgctttatttttggtaacattggtttagttttcaacttatattattggtcaaattgttatgactacttggggaatgcatctcaccattgcttcagagctctcccctgtaacaaaagaaaccaacacccaagctctgtgctagtttttctatctcttctctctttctctctctcttttttcttttttgagacaaggtcttgctctgttacccaggctagaatgcagtggcatgatcatagcttactgcagtctcaatctcctgggatcaggcaaccctctcacctcagcctcccaagtagctgggactacaggtgcacgctaccatgcctggctaatttttttgtacttttagtaaagacggggttttgtcatgttgctcgggctagcctcaaactcctgggctcaagcgatcctccctcctcggcctcccaaagtgctgggattacaggcttgagccaccgcacctggccttccccatttttctcttaatccatatctcagacaggaatctgtatctctcactctacagatcattctgtaggcactatgctaaactgacaccagtttcaaatttagtccttaattgatcttggcctttaggtgagcaaagttacagtggtaaattacgctccttcgcttacaaaatctcttgcttggtatttattccccaggggttacatagaatagagtggaggcagtagacatggagaaatcctatcttttaagaaagaaaaaaatgggcatttttctcatggggaaggatttttatttttcaaatgggtgtttgaactgtaatgatttcatgacatctgcctaacggttttgtttctttgtcttacagaaacaaacagtcgttgctgtcaaaaaagaggtaattagtcttacacttccagtgaagaatggttttaaatcttctaacaggttatatgtactttgttttaccctctgcgcttggtaatgaaatgaaaaccacgtgcaatgttcaaacaattatttccaaattcacggacagcacagagtgacgaagcatcttctgtaagctctggctggggctggggctgaggctggcactcagggtctgaaaaacccctcgaaggcacagagctgaggggtggccagagaggactgtggaaccaatgctgcaggctgcagagactctacatccccaacgtggcccctgcacctatcattacagggccagaatctacccaaggtggcaactgcctattttggcaaatcttatgtctggggcccaagacagagtcctgggaaccatggggcattgagctggggtgtacggttagctatctgaacgtggaggaaggtggttgaggaggggataacttgctttggccaatgctgcagaatcaggaagtttaaggatgtcacctgtggtggggaccactctctgcttctgtctgccagagacatgtgagggaaaagccaagcgtttgtccccgtgtctcagttgaatgctccttagaacttttttttttttctgctgatgctttttcccagactaatacataatggctgaaggaggccactgatttgaagtctgtggtcatctgtccactgtgggcctgacccactggtactgagggggctggctctgggcatggaacgggatgtggctctgggtaaatggcttctgggtttggaggctgtgtgtagtgacactgaagggtgggagggggttgaataccttctaacaactgtgtctcttccagatcatgtattaccaacaggccttgatgaggtccacagtgaagtcttctgtgtccctgggagggtatgtccctgatttgttgatcttgctaaagtctgatgaacaggtagacaagaggagaacttctgcaaactcgacaagtcctgggctgacagactgaagattcagcagaactgtgagggacaaaaccagtctcttgggggcttagttcctagttcatccctcagaataaacctccgggtctcatcttgggttatgcaaaatcgagcgtaggtgaggttctagaaaagactgttatgtttcttggaatccactaatgtgtggatggggaagttagaaagagttggaagtccgtggactgtagaccctgtgaggatccaagacagcctgggttcctatcgttactggttccaattcattaggagtgtgtgagtcatgtttactggttccatgtgctactaaatgtccattgttcatctttgatttaaaatcccattaagataaattggacatttatgtttgatttattgaactttctggctaccttgacccagccccccataggacatcatctaggagacaagaaagagctgagtgctgcctcccacgtgcaagcagttattcttttaaaatgcggaatttatcttaggactgcatttctaactctgggattttcctgcacacatgaaaataaacttggcttattcctgggaggcacgatgtgactaatcatgtattctgactgtgtaagactcaagtcatggtactaatcgggactgaagatgctgttttgtttagtgccttccttcaatatgtttaagggttgggctcttgtaaaaatgttttacatcttcctatgtccccagtttgcaaaaatgccatctgcctgagaaaatatgccctgaccccacacacatttcagtgactctgctgctgctaagccctgatcccagctgaggagggcacctgtgtactcaggggcattcactttgggttataataatcatcattgttcagtgataaactcaaaaccatttacttccgtgttccataaacccagtttcatgaaaccaaacagaaagaaaatggaaggagacccaaggatagttcttagacccagtttccaatttttatttgtctcaggacctcattaccgtaattttgacatcattagtgttttgacctgtgaaccagtttttttttttgttgttgttgttgttttttacctccagcttctccactggtaaatgtctgggcccgtcgaggtgcctcatgcctgtaatcccagtactttgggaggctggggtgggcagatcacctgaggtcaggatttcagggctgaggtcggggcggatcacctgaggtcaggagttcaagaccagcctggtcaaaatggagccccgtctctactaaaaatacaaaaattagccaggaatggtggtgtgcccctgtagtctcagctacttgggaggctgaggcacaagaattgcttgaacccaggaggaggtggcttcagtgagctgagatagcgccactgcactccagcctgggagacagagcaagactttgtctcaaaaagaaaaaaataaaaaaggtctgattgtcgactaagagagtctcgggagagaataagccagggggcttgagttctgaatagaattgcaaacccagtgcttgtctctaaggtaccagtggtttatctctaaggcatggatcctgttctgtccaaatcttatggctgagggaagacttcagggcaggtgcatttcacattcactgtggacacaattccccacctacggggaggaggcacagcaggttttcaatacccagacagcaggaaatgcattgactcagaaggtctgactcaactcaagggaattagctttttttagaaaagttttttaaattgacacataattgtacatgtttagggggtacatagtgatgtttcaatacatacaatgtgtattgataggatcagggtaattagcatatccatcatctcaaacatttatcatttgtttgtgttgggaacattcaatatcttcttttctggctatttgaaagtatataaagtaaaacagaggttactacagactgggaagggaagggggaaggggagatagggaagtatttgttaaaggataaaaaattaggccgggagcggtggctcacgcctataatcccagcactttgggaagtttcaggcaggaggattgcttgagtctaggagttgaagaccagcctgggcaacatagtgagaccacatctctacaaagaataaaaaaaattagccaggtggtggcacatgcccgtggtcccatctcatcatgacactgacgtgggaggacggcttgagctggggaggtcaaggctgcagtgagccatgattgcatcactgcactccagccttagtgacagagcaagacaatgtctcaaaaaaaaaaaaaaagttacgaaattacagctagatagtgttctgtagcactgaaggatgactgtagttaataataatacagtatgtatttccataatagctagaagagaaggaattagctcttcctccaaatagtgtgtttggaccaattaagccccaggtttaaataatgggcctaagtttccaaacccaggcattatcctgagaaagggtagaacccaacatggcaagagtcttggagtctgtggcaactttgggcttctaagatgggtgcagagacacaagtttgaacactccaagttggtttgaatctaaaaacctattgataaaatataaacaggccatattttaatgaaatagatacagaaaggccgggcatggtggctcacacctgtaatcccagcacttcgggagactgaggtggatcgcttgaccccaggagtttgagaccagcctgggcaacttggcaaaaccctatctctaccaaaaatacaaaaaaaaaaaaaaattagcctggcctggtggtgcgcgtctgtgatcccagctactcaggaggctgaggtgggaggattgcttgagcctgggaggcggaggctgcagtgagccaagattgtgccactgcactccagcttggctgtctcaaaaaaaaaaaaaaaagaaaaaaaagaaaaagaaataggtatagaggaatgacagagggactggatggaagacaatgtttcatttcacaagtagaattgggactgattttgtcaaatacctgccaatcccaagggttatttgatttgaggaaatttctaggaaaacagtaataagtatgtcaccaaatcgatacaggaaaagaggacagcctggtcagttgacctgtgtattgatgtcatatcttgggtgtcgagcttctaggaaatcattttctgtttccttttcaggattgtgaaatacagtgagcagttctcatccaacgatgccatcatgtcaggctgcctccccagcaacccctggatcaccgatgacacccagttctgggacttaaatgccaaattgtatgtattttatatattggtgttttttaaaaaaccgtttttgagttacaattcacatgccataaaattcaccccttcaaagcatacagttcaatggtttttattatattcatagagctacaatcaattttaaaacatgttcattacacaaaaaagaaaccctggacgccctccagccttaggcaactatgaatctactttctgtgtttacggatttgtctgtctggacatttcctatcaatggcatcacttggaatctgaggaatgacagagggactggctggcagacaatgtttcatttcacaagtagaagaggaactgattttgtcaaatacttgccaatcccaagggctactcgattcgagcaagtttctaagaagacagtaataagtatgtcactaaatcgatacaggaaaagaggacaggctggtcagttgacctgtgtattgatttcatctcttgggtattgcgcttctaggaaatctaggaaagactatggggtcttttgcgacgagcttttttcacttagcatcatgttttcaaggtttacgaatcttgtagcatggatcagaacttcattcccatttatggttgaatcatcttcatggtatggatgcactagagtttgtttatccattcatctgctgatggacatttgggtggtttctgccttttagctattatgaagaatgcggctatgaacattcgtgggcaggtttttgtgtgggcatattttcatttctctcgggtgtatatccaggagtggaattgctgagtcaaatggtgactctatgtttaacaacagattggttttgaaaattaaaaaatcatatgtatggctttgcatgtttgatatctaattagcgtaaacttaagttctgggcgggcagggccctaaacctgccctttcccttaccctttggcttttttttgtcagttttgaatagtcattgctcactggacctgcacgcttgtgttatttggaagagggggcagaggcagaaacacaggagagttccggcacacagagggaggaagaagagaagggtgtaatggtcaaattagagggagagagagaggaggacaggggagaagggacaggcctgagtgtgtgagggaggtggggtgatgggaaaggaaggagtgccaggtataggtcacagcttgggtcaacactgccgaggccatgaggaacacacaggtgacactgacccagctgggtaagcaggcctggcctgggagggccctgattctcatcttaagcaacactggtacctattccacgtggcccgctctgggcagccaacaggttaaggaggccactcctctggagtcaggggtcccctgtctactaaggtcaactgcagagccaaagactctagaactaccttctggggaggcttcccttatcctctttgggctctggctgttggggtgcttctctgcagcccatgtctgcctcccagcgtactgaatgagagaggcgacctgtgtctgcctgtggacaagcatgtgcggacgctggctctccctggaggagaaggcagggaatctggccaggaagagggttgtcctaggagggcttggggaggagagatggatggccgctgaattttaaataaaatggggagcatggtattgaagacaggtagagattgctggcaagaagaaaaatgtgtgttctgtgtaagaaccgttgatcagagggcactgggtgggtgacaactggaactccccattaaagtgggaagccctgttcttttttgtggatcctatatgtttattgaaccaaatatatatatacacatatatgtatttgtaagtatatgtatatatatatttttattggtgcacctatcaactgtgccgcgtacactgaaccccgtttttagtcttatatccctcactcccttttcacccctttcccctgagtccccgaagtgcatcgtgtcattcataagcctttgcatcctcatagcttagctcacatgaaagcgggaagtcttgttcttaatggtttagattttagaacagtattacaattactggggaagcttaacaaaaacatcaacgttcaggccttatcctcccaaacctcttatttggttggcctgggttgctgtctcaccactatcagcgttttttgaaagctctgctgattttcacaaacagccaggattcttaggctggtttacagcgttgattcccagtgtgggccctggaccagcggcatccgcagcaccagggaacctgtcagacatgcgtattcttgggccccacccactcctactgaatcagaaactctgaggttgggacccagcaatctgtttcaatgcatcttccaggtgattctgatgcatgtggaagtttgcaaaccactgtcgtcatcacaactcagcttcttactaattatgtgagacttggcaagtatttaatctctttgagcctcagttttcttgacaatgagatgggatagtaatactcaattcatagtgttcttttaaggattcgatggtatgtgtgtaacgcacagtacctcacataggacaatgctttgtgaatggcagttgttaatgttatcagttttcttattgtttgtacacttgttcttatggaaagtgtaaaacttgcttggcatgctttatcttggatcccatagacatgaattgtgcctggttctggtcctagctgctacatcagtgggaaaaatggtgtgagggacttgaaaccttagtttcaaaggtctgtgttaggtttaggagaattccataagggataggagagaacactgagtctttttctgattctctggaatgttagatctctgctagctgggctcgaatatcctacctgggatcagggaaatctttccaaacaaggaggtgcagtgggacctgcatcttagaggaagccctgaaagggagtgcagagatggcaaatgggtctactccgaggcacatggcctgaggcaggtacaggaggagccaccggctcccaccagaagccagggtgtgccatggtaggggggcagctgtcgtgggtgataggcacccagcaggtggcagtgattgtagcacccatcaccaatgctgctccagaattctctcctagtccaggtggcagcctgaccctctgctggccaggctccaggctgttaccatgccttggaggaggcatttgaattcgtttgtccttaaggttaagtgagcaggacctgagtgtgggctccccacggtgggcatcctcctcacctctgggatggtcatgtctttgatgtgagccccgggggacttgtctgtggctgcatcttcctagcaagtgattacttggcttgtgtgttatgcagggattgggaggaggaggattgaattgagccctgggccatgagactaaaggccctcaccccaacccaggccaccacctgtcacaaccgctacctctctggtgcatttacaaatcatccttgcagggtggaaatcccaaccaagatgcgagtggaacgatgggccttcaacttcagcgaattgatccgagaccccaaaggtcgacagagcttccagtacttcctcaagaaagaattcagtggtgggtctttgtttacaaaaaaaaattaaaataacttacttttagaaagagtcctttaatgtctagcctagggtttggggaatttctcagcagatgttttcagagctttgcttatgcccttaaacagttgcttcctttcacagctttaagaatgggacctgagcccaagactcgttctttccatagactcaaagaggccccaccgtctgggggaaaattgcacctgctcacagaatctacatcaggatccctcacatttctgagggctccatccatcctggatgcccccactgtcacccgaggagcccccgctccttctagtcagcctctaaatataatgaacctggaggaagggaagggagacaggcaggctttccctttctttctctttttgtctcccagcctgattttcttttttctttgtttctttcttttttttttttctggagacagagtcttgctgtgtcgcccagcctggagtgcagtgggatgatctcagctcactgcaacctccgcctccctagttcaagcgattcccctgcctcagcctcccaagtagctggcgttacaggtgcctgtcaccacacctggctattgttttgtattttgagtagagatggggtttcaccatattggccacgctggtctgaaactcctgacctcaggtgatctgccctccccagcctcccaaagtgctaggattacaggcgtgagccactgcgcctggcttcctgattctctttagctcagtggttctacacattcagtctgcctggggatattttaaaacatgttttcctggatctcatccctaaagttgcttttaaattggtgggggttggaatccttgaagttttggaaactccccagatgattccaatgtgtggtgattgacagccatcaccttagctcctggcctgatttcttcagggccttaggagggtgtggattttagtgaaatgggcagggccacattttgtcccatctctgaatgtcacctcatgaggggaactgtgacttttttttttttttgatatggagtctcgctctgttgcccaggctgaagtgcagtggcatgatctcagctcactgcaaccattgcctccgaggttcaagtgattctcctgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagtgatccacctgcctcggcctcccaaagtgttgggattacaggcgtgagccactgcaccaggactgtggctttttaaatatactgcacttcccggagaagcatccacaaaaaaacacgaggccagatcagaaccaggctgtgcattcaccaccttcattgaaatatttacctttacgggattcttttacttccttgctcagtacccagccctgggggcatcactcctgagccttgacactcagctgcttactacccaagatccacttgtctgtggcactgctccagaaacgaatcctactggacatgcctttagcctggctgactgccggatgcaaaacattacatgataatatggattgttgataatcatctccctaatcaagtctaattgctgctctagaacaaaacccagaaaagatggatggactggcgaataagtggttatagtgccatctagtggcaaagtgacaacatacaccctgaatttattatctcccccccactaattccttagtgagaatccagcgaaaagatttccctgcattatttaaaccgtattattagcaatctcctcatgagattcctgaggctttaggtatgaacagggcagataaatcatcaatttgctcatttactttttaaaaagatttttaaattgaaatattatttgcatatgatgaaattaactttttaaaagtgtacaattcaggggttttagtgtattcactaaattgtgcaaccatcatcactaattctagaacatttttgccacattaaaaagaaactctttacccattagaatcatcttctattcctgcttctcctgcaccccagccctaggcaaccacaaatctactttctacccctacggattcacctcttcaagacatttcatgtaaacgaaatcatgcaatatgtgaccttttgtcttttttcacttagcataatgttttcaaggcttgtctgtgtttcagcatataacagcgcttctgttcctttttttttttttttttttttttttgacaaattctcactctgtcgcccaggctggagcgcagtggcgtgatctcatctcactgcaacttctgcctcccgggttcaagtgattctcctgcctcagcctcccaagtagctgggattacaggcgcccgccaccatgcccagctaatttttgtatttttagtagagacggggtttcatcatgttggccaggctggtctcaaactcctgacctcaggtgatccacccgcctcggcctcccaaagtgctgggattacaggcgtgagccactgcgcctggccacgtggttcctttttaatgactgcataatatttccttcattcctttttaatgaccccataatatttccttgtttgtatgtaccacattttgcttatccatttgtaagttaatgaacatttgggttgctttgactttttagctgttatgaataatgctgctatgaactttggtgtacatatttttgtgtgctcatttaatatttttggtgggaaaacgtatgtaacataaattttaccattttaaccatttgcttttgagacggagtcttgctctgtcgcccaggctggagtgcaatggtaccatctcggctcactgcaaccactgcctccctggttcaagcaattctcctgcctcagcctcctgagtagctgggattagaggcgcccgccaccacggccggctaatttttgtatttttagtagagacagggtttcaccatgtttgtcaggctggtctcgaactcctgaccttgtgatccgcccccctcagcctcccaaagtgctgggattacaggcgtgagccacccatgcccagccgaaatcttcttcctttttaaggccaaatgatattcccttgtagtcttcaccatattttgttcatccattcttttatcgatggacatctgagtgctttccacttactggctatcacgaataattgcttatttaattttactaagcaatcaactgtcttttgctatgggcaagatggtttacatggcacttttgtcagatcagttacattttagttgagagcatcactggtctgtgatctcagtccaaagaacgccctaaagttcatgctgaaaaggaaggacctctatagagctatgggacaaatgccaactagtttaaaattgtgcagccttttctaatatgaagcacccaggagcttttaaaaaaatgcagttgacccttgaccaacactggtttgaactgcacgagaccacttataggtggatttttttttcagtaaatatatttaaaaacttggggggatttgcaacaatctgaaaaaacttgcagatgaactgcatagcctagaaatagaaaaaagttatgaaaaggtatcatgaatccataaaatatatatgtagatacatatccacttatgtgtccattgactgtttatgttattagtaaggcctctggtaaacagtaggctatttgtagttaagtttttggattttctactgcataatggtctgcgccctaaccccttaattgttcaaggtcaactgtactgagaaaagagaggagaggattttgttgttcatttccccacactgtgacacactccacgatttacacacacacacacacacagacacacacacacttgctctctcttgtgatcgtctttattttcccaggcaaaaatcaccacctgggaccactgtatgaacatatgcgtggtacctctggacgctgcaggttagagaacctcgagttggagggagatgaaggatttgggggaacctggcttttccttctgggccaatcccctctggctcaggtgatgctcagttcagtcctgctcctggccagaccttccctgagggtcagtccatcagcactgcttcttgaacagcctctctgtaagaaccgttggcctggaatatgtctggtgagggactgcaaatgatgggttctctaagcacagccaaacaaaggaggaagaactcacgctcagtcattcaacgggagcaaaggaaggaggtcttgatgtagaaaaccgtagcgtagcaacgcatgtatagaagcctattcatgtgcgagctcgttcaagcaatatttcctacagccaaattctagaataaaaaagagtacgacaacctctggggggtgatatgaactctggcctgtgtattgttggaggaaaggaagctgccacggtgtgaatgcattgctgcaaacatggtaggtgccaatctagtttatttctaaggccacgtattgagcaattactaagttcccaatgttcttccaggccgtagaagtgaagatgtggctcctttccccaaggagtattgttgtctagcatcacaatgtgcaatagcttgttctgcggcaggaaaggtgttcactgagctgggaaatggaatccatcccggttgactcatttcttttatttcctcttttcttcttccaacttatttcctgcccggccctcatccacgtggacttctcaccatgcaggagagaatctgggattctgggaagcctgcgaggatctgaagtatggagatcagtccaaagtcaaggagaaagcagaggagatttacaagtgagcatcagccagggtgctggaaagccttcccttgggcctctgaggaccaccccattgtgcttgaggtgaagataggatgagaggacaacagcctggtagctggctgggccctggtcagcatcagttcactgtacttgccatgctagaaatagttccccgctgctttgggaggtttgggggttccctgaagaaagcctggtgagacatgcagtgtgagtcacctgttcctatgggaatgtgtctaggggttaaaaaagcaagctgtcccgaattacagtgcagagtgctctgtctttgactaaagccttcttaggtgtcctgaggggtgtgtgtgtgtgtgtgtgtgtgtgtgtgtgtgtgtgagagagagagagagagagagagtgagagagagagagaagaagcagcaagatgggaaacctattcctcacgcttccttagagatgtgaggaacacaggggaagggagctcctcccacatgtctgggacagtgagcgcagcttggggtacaaacatgggtgggcacatctcattcctgacatcacggctccagcccccacttgttctgagcagcaataagtctgtccctctccatgactgtctctcctccaaattacacaaaagccaagagttccaggttaaaagggtcagtcctgttttcaatggccaggtggagagggaggggaaggtgtgatgaggctcccaagttgctgaaagccacactccccctccccaacactcctccccctacaggcctggtgggtgctcctgtcctgctgtggtcccatctctgtgggtcctttcatctgcactggctgcagtggacatgagtcctggatactgagggcccagcattgttagttcatactcacatgcttagccgtgttgcccaaagcccaagcaccacgctgggctggaaccagccctttgcagtcaccagactgtggtgctgaactttgggcagcaggccaaacagccccttccctctgaggacttagcctctggaccctggatgtccttcctgcaaatgaactcagattgcaacaccccggtttccagagaagcaccagcagcattgaagagaaaagcttgaggtctcacttcttcttatacttagaggttcatacactctattgcaaatttgcccagctcctcccacagggaggggatccatgcgctgagagaaatgggggtgcgggtggggtgcagtggggagggctgtcggtccgggaagcttccatgacatcctttgcagtacaatgggtgcctgattgccttacacacagtgacgcacacacaactcctgattccaaaaatctgctacaggaagcccgctgcctctgccattagaccagtttccttccccaggctccctggttatgttatgtaaatctcagtttcaattccaaaattttaatgtacatcttagaaaggtaggaaaatattcatatgagtatttctaattcagcaacagctcagaactggaaatactgagagagctctgcatcccgacatcccaggtagagccacgggctcaggaagtgtggccaagtttggtctaattgggagccttggcctgtctgcccagcgggtcagacctctgggttctgggactatgggctgcctctcgacacagcatgtgaaattcattacaaagcacatgtgggttgggaggagagcagagacccccagaacacctgtgtgaaggtgtcttagcctggtcccaggttgcccctggaatcctggtgcagaaggtgtgaagttggaggctgagttcttcaccctcatggccaggacctaatccgacctgggccccagccccttcttgctctctctcctggaggttggaaacatcaaagttaaatattcatattcccaatactggaagtttcttgcttcaaggaaaaattgcttgacaacctcttcaaaagttcatgctctttagtgtctcctaaaaaaaccaccaccctcaccctcggtaaccgattcgtatcagtccttccctcccaagcagctgtgagctatccatgaattgacttggtttagttacttttgctaacatctccctcccaccccaggctgttcctggccccgggggcgaggcgctggatcaacatagatggcaaaaccatggacatcacagtgaaggggctgaagcacccccaccgctatgtgctggacgccgcacaaacccacatttacatgctcatgaagaaggtaggtgggtccgtgctgtggatacggggtccagataggctttctgtcactaagtacccggaaaattctttagatataggaaaaagagagaggatacgtggatagagctttgccggttgtggcatgcagctaagcatgggggctcatgtctgtaatcccagctctttgggaagctgagatgggaggatatcttgagcccagaagtttgagaccagcctgggcaacacagtgagaccctgtctttatataaaaaagaaagagagagaaagagaaaaaccccagaattgtcaaccgtctcttccacctgtccactggggtggacttgccttgagcccctcacccacgggcctagaggaactcctgtagaagctgtgtgcatccttacgggccccactctgcagcagtagacaggtaggagtaatggcattagtaatgacaacattataataacagccatcattcgttgagggcttacaaggtgcagtcgctgtgcgaaacacagaactttatgctcaaagacagcccacaagttaggctttgctgctccagaatctagtggcttggtcaaggtctcaccagagatggggctgggattcatagccaggtctgcctgggtttcaaggccgagctcttagtttctgctgcagagtgatggcaattctcaccaccctggccccaggcaaatattacacatagaggcgtagtgtctaggagagacaaatttgtgtgtgtgtgattgtagtaagaccctgtgagaatttagatagccctctggattattaacaaagtgcgaatgcggtgggaatttaaaaaaaaatatgtgaagggtacctgagagaaaaatcaatcattttcttaagaaactagaatcggaggctcagagttagccttaaagaacttgtctagtttgattcttctttggtgccatccttgacaagactttctttgggtgcttcaacttctcattatggcaatgatttctttaagggcaaagtatctttataggatataggttatgtgatataggctatttgatataggttatgtgatataggttatatgagatagattatgtgatataggttatggatattggttatgtgatacaggttatgtgatatagaccatctgatataggttatatgagatagattatatgacataggttgcgtgatatagcttatatgagatagactatgtcatacaggttatatgatataggttatgtgatataggctatttgatataggttatatgatataggttatatgagattatatgacataggttacatgatgtaggttatatgatataggttataatgtgatataggctatctgatataggttatgtgatataggctatatgagatagattatatgatatgagttatatgttatagattgtaatgtgttataggctatctgatgtaggtcatgtgatataggttatatgatatacattatatgatataggttatgtgatatagattatgtaatataggttatatgatatagattatatgatataggttatgtgatattggttatgtgatatagattatgtggtatcagttatgtgatataggttatataatataggttgtgtgatataggctatctgatataggttatgtgatataggttatatgatatagattatatgatgtaggttacatgatgtgggttatatgagataggttatatgatgtggtttatatgatataggctatgtgatataggctgtgtgatataggttatgtgatataggttatatgatataggttatgtatataggtttgtgtgaatggtaaatgctgattagctttcctgatttatatttcttctatttagtcttttattgtatcatttaaaagtatttttactttgtttttaaagcatgtaataatttagaattgccgccaagccagattagccattttcatcattttttgaatcagtggggtgtttctgtgtgttttgaatcagtggctgtctctttgtttttgttactagacgattcacagcagggtttctttaataataatcctctttaatgtattttaaaacgttttggttcttaaaaatgtagttttcggctgggcgcagtggctcacgcctgtaatcccagtactttggaaggctgaggtgggcagatcacgaggtcgggagtttgagaccagcctggccaacatggtgaaaccccgtctctaccaaaaatacaaaaattagctgggcgtggtggtggatgcctgtaatcttgctacccaggaggctgaggcaggagaatcacttgaacctgggaggtggaggttgcagtgagttgagatcgtgccactgcaatccggcctgggcgaaagagtgaaactccgtctcaaaaaacaaacaaacaaacaaacaaaaaaacctgtagttttcatacggctttttaggggatgcccagggaggccagttactagccagaatggaacagtcattggtaactgcagaaaagaatggcatatatgcccactggactccctatatgccattacagctatgtcctatggtgaaacactcaacgtatcccagtggctccatggtccctattcctagactctatcctagttctcataacttttactgctcccacttagtctttagaatagtgccatttcaataaatttttaaaatacctcaatccctggtttgttgcagtggcctttgtcccatattgggtatgactagagttttccgctcgcttaaaagtaacgagcattcatgaagcttctctgaaattgcccagagtcccagtaaacagccccataactggactctacgcgttggttgtttttgtttttgctttggtattctcttgcctttacacccaaaacacagggcagaaagggatgtcaatggcttagaagtgggctccatactcctggctgctcatcttccttggaagaaagtcttggagaggagaggtcagatgtgctcttgtctcatgctggcttcactgaaccactccaaggtggatcttcatgtgtagggttacagactgtaattctcaaacttaaaggtgcagcagaattacctggagactgttcaggtagttgttaattgttaattgtttaggtgtcctcatgtgaacaaatgatgacaggcaatgtctccatacatgaccagctgtctcacctgtttggcatgtagcatgcagcatatgagaataagtgaaacaaattaagcagttctgggtctagtgtacttttaactgtagcagcttttatgcaactggctacatttacaacataggctgaatcacagacaatgttgataggatctgaagctgtgagctgtaaaacctgagactgttcaggctcagggtgaatcactcccagagtttctcatcaggacggctggggcaggcctgagaagttcccaggtgaaattgatgcttctggaggggaccacacttgagaaccactgctctcaacacctcccccaacacctttcacccaaggagacaaattctcataacttttccattctactgccaagggaggcttgaaaatggcaagggtattggtttgatttgactgcttttttctctcataattactgttgttttcttgttcccactaggattcttatgctcgctatttaaaatctccgatctataaggacatgctggccaaagctattgaacctcaggaaaccaccaagaaaaggcaagtggaattatctgtaattgctggctgcctgctgcttagtttacagagaagtgagggtctctttcagccaaatggctattatggagatatttgcttgatgaaaatattggggactgggaagtattgctcagggaatgagtgcctcatttgcttcataatgccctgaaatcactctagcaagatttccttagtaattaccaccactaagttttgtttcccctaaagctggcttgaaagagtttagaggatcagaccaataattacccttatcacaaatggaagcttctccttggttttttaactgctactcgttacctccaaactgatgtatgggaattaattaaggtacatccttgtatttaaattgttctaagaccttagagagaatagcagattgcaccccaagagaaaatgctcagtgaaggggaaacggacagtaacgggctaggtattcttgctgcctccggggaccatgttttagaagtccatgaacttgttcattctcacttttctcattggagatgtggatcatctcatctggtagagccattgggacaatggacgaaataatgtcctgaggggcagattgaactcttttccgggggaattcaatctacaaggattgaagatttaaaatataaattgaatggcagcttgaacaaaactgtaaggctttggcagaggtttttccactggcaatcgtgtgtcctgtcccccccaaagtgagtgactgttcccctgtttgctgggtcaacccacactgggctcctttccagcatcttccatcaattcaaaagggggatggccggaccagagcctttatcaaaggagaaaaaacaacaacaacaacaaaaaaaaccaacttggcttcattcttgaggataatggccctgttatgaaaaggagagaaagaaggtctttgtggtgctattcttctgggtttaccaagtaaggaagggagttcagtgcccctggggacttaaaagcttctactttaagccagaagaaaggcctgtaatagctccagtagttctgccagaaagtaatgaggggacaaaagaggagtctcatacctctctctccagatattttagaagttggggcagacgtgagaattctcactattgtgagtgagaattacacgtgaatgcattcgtaaagtgtgaagcctggtctgtgtccataccaggactacagtgggtgtgaattttgttccatgatcccaggtataagacaatgtattcaaactcaatttttgcatgacaagttacccctagctccaagccttcctcttggcagggctggtgagaaatccaatgtcagtgtcaggctttacatcctggtaggggagcccttcttctccttaagatagatataagagttcaaggggcttatgtagtcaaggggcttatgtagtccagaaatatggagtatgttgcaggtctttgtctcttattgctgctgaagttcttggctccaagcttacgtgggccctcaaaggcaggtgggctccactgctcactgcccactacatcacttggatacctagagctttgtcctggctcctaaggccatggcagggagagtttggttccaggaatccagtttggctttgaagaaggttctggcatgtgtcaagatattgcacatgagcagggtaccaccagcccaccagccctcttcaggcctcttccctctttctctgttcactggggcctagctattttggacagtccagctctttccttccttcccagaaccatagcttttgaaaacaaatgctccagccaggcgcagtgactcacgcctgtaatcccagcactttgggaggctgaggcggatggatcagttgaggtcaggagtttgagaccagcctggccaacgtggtgaaagcctgcctctactaaaaatataaaaattagcctggtgtggtagtacatgcctgtagtcccagctacttgggagtctgaagcatgagaatggcttgaacctgggagatggaggttgcagtgagccgaagtcgtgccactgcattccagcctcggtgattcagagagactctgtccccgctgcccaccccccaaccgccccaaaaaagaaaagaaaataaacaaatgctccaactctctccagtacccaagccttcattatccacttctttcatgaagatgttacaaaaagttaagataacaaattgatttctacatactgtagaagttcaatgcaacttcgccaacaaaagggtcttccttgtgcctgacctaaaatctgatggcagttggtactcactctggtctcatcctccaagtggggagaaaggagccaaggttggaccccactggaggttcactggaaaaaggagggaacaaaatatagattctggaccttccagccccagctcccatcaagtgtgacagggtcagtgttgggcaagctgtgtcattttcctccaaccaccaatctgtccttccttccagctccaccctcccttttatgcggcgtcacctgcgctccagcccaagccctgtcatcctgagacagctggaagaggaagccaaggcccgagaagcagccaacactgtggacatcacccaggtcatgagcaagctggaccgcaggagccaactccaaaaagagctgcctcctaaataaatctgtgattcctgggggtggggtcatgcacttgggagaggcaaatgaagaagggtagggtcagagtctagaaggttccattccccatttgtggaggtcatcaggttcatcccatactcctctaactttcttcatgggggacttcctaataccacagcaaccagagcttgttctcccaagcccactcatcaggggacagggtgggcgaaggcggtgggtgggagaggggatcacctgactcaattgctgtgtggctgcctattgtaccttagagagttcttaggggaactatgaactttttcagtaagagccagggggaaaaagctgtctcagtgagagccatagggaaaagtggtacacaaagctctcactgagagagagctttgtctaccactctctgctttggaaaattaaaaagaaggcctctccccatacccaaggcctagtgtttttcagggagatttgtttaaaatagctttatgaagctcctcatcctatctctctaatttagactattgtttccaaatcattctgaggatccgccgaggggctagttgcagggaagtactttctctgaactcccctgctatgcctgcctggaaagaccctgctgagacgtttctcctgttgagtttgttcttagtcataattactggagggttgatgggctctcttcttcccatctccccatccccttgtccatgctggggaaataagcggcttgcgggaatgaaggactcaaatggccctctgaggagcatctttttggctaaagaacaaaggcattgatgtcttcattcatgggaagaggatggtagacatcgagatgagtgaggatcagagatgatactctctaggacattttctagatgttgattcttccctcttctgtaggtgtagacgaggtcagccctgtggtcaggactgggggagaggacagttctaactgaccttggggggtttagaaggtcattctcgaagttaggctcactccttacacttgtgcaagaatgcaacagagatagagcacagaagtgagcaagagaccagcctgaccaagcaggaatactcactcattcagcacgtctattgagcacctactatgtgcaaacatcggtgaataaaacagacgtggttctctctcatggagcttcttctagtctaggactgagacaaaataattaaacaaactatcaggtagctattgctgtgtgacaatcaaccagaaaaatagagcaacattcagcaagtgttcattgttcatgcatgtggggtcatctgtgtggctctgtggatcttggctgggtccactcatctgtctaggagtgttgcagtggcctaggctgagatgagtgagatgagttttctctgcttcatgtacctctcttctcccagcagtcttgcctaggcagaatcccatgctgaagactgaattgcaagggagcaagtagaaacacacaaggcttcacatagtctcttctactttattttattggccaaagaaagtcataaagccagcctagattcaaggggcaaggaaatagactctacctctttagtgagagaaatttcaaagtctcatggcgaaagatggatgaaatttcaaagtctcgttgcaaaagacagggaaagttgaagaatgagggccattgttgtaattaacaacacaaatgcctgcccaaggattataaaggaaattaatgtggtactgggataggaaagatgggatgtgtgtaggctatgcccctgctaggtggtgacagagaagcagggaatgagaaagagttggccataagagcatgtggaccaggcagggagaacgttctggggagagagggctgtgtgggcaaaggctcagagctgggaagtagctcagagtgaaccgaaaggccaggtgagtgaagcctgctgggtgagggggaaactgtgcaagatgagtttagagagtgggcaggggccagatcattgatgaccttcaaggctgttctaaggagtctgtggtcactggtttcatgttagcaaaatgattctagcccagaagagggacacttacactttccatttgcactggttgcagaccagtttccactctgaaagtgcatggagggatatgctttgctcatctctcttctggagaatcttggagtcttcccactctggaaggtaccccaagtagaaatgtaaaccattgtaaactgggtgacacgagaggagggactgtatttatctcattcattacttggagcctgattcctgacacccagggggttctgcaccaacatgaatgacatgagtggatgaatgaatgaaagaatgaatgaatgaatgaaaagagccctggatttggagaaagcctcctggttcctgttcctggctctagcactagtcatgtagccttggacaagtcacttaacctctctacatccttatttgtgaaatgaggtatcaggaccagctctaaacttctctaaacagactttgtgaattccgactgggaacccgggctggggcatccattttacttgaagatttggaatgggaggaaaattaggtaatttctaaaagtttcacattaaaataatcatgaaaatattatgaaatagaatgtaaaatgtacatgaatttttaaagatacaatttgagacatcaaaggcattttgtgcttggctgtggcaggctcaggcccctgccctccaacttctgggggaacgtgttttcgggctctcctgctgtgtggcctacttttatgggaacatttgagaagcatgaaaccagagaatatttgctgtcccttttggttactccatatgagctgagatgacatacccagcagcctggtggtgagggtggtggtgagcatgttgttgagggtggtggtgagtgtggtggtgagggtggtggtgagtgtggtggtgagggtggtggtgtgggcatcgcatgcattgtggcttctacagggcacagattgtgtcttgttcatctttggctcaggtatctcttgtctcactcgccacaggtttgtgctccagttatctctcattctcccacaggctactatgtgctctgtgtcaggctcatacggggactccttgtgtattgatggaagcctgctcaagttgagacacacaggatctcacaatctaatgagagacacagcacgtaaacaaagcagatgagcattctttattaaatgaatgaggacatgagcgtctcaacactatctgtctagaggaaggaatataaatggcttcatggctaaatggcagcatttatgcttcatagatgtattttatttatgtatttatttattttttgtttgagacagggtcttgctctgttgcccaggctggagtgcagtggtgcaatcatggctcactgcagccttgacctcccaggctctagcaattcgctcatctcagcttcccaggtagctgggactataggtgtgcgccaccaggcttggctaattttttgtattttttgtacagattgggtttcgccatgttgaccaggctggtcttgatttcctgggctcaagtgatgcaccaacctcagcctcccaaagtgctgggattataggcatgaacaattgcacctgccccatagatatattttaaagaccttttttgtgtaagaatctgtggtgagtgctatggtggatacaaaaatgaacaaaatggtctctgccctcaaggggctgacaaggtgcatggatgcaaacagctgtagccggaggcaggatgcagtcgagactggatgatgatcaaggatgatgattgttgattgagaccacaagctggaggaacccagaggtgggagagaattgtttggctgggggatcatgataaggtttttggaggaggcgtgcttgaggtatgtctcaaaggagagtagggtgtcatcagatagagattgggaagtgggcactgcagggcatgtgggcagagcccaggcacggctactgctggcctctaggcagcttattgggtcaggaaaaggtgctccctccaagtaggtgtccttataacacctggctggatttcagtcccaccttgcccctcagccaggtgcccctgagcagcacacagcttgcataaccatttggtggccctgagcacagggtccaggaagcaaagctgggagggtgctaggttgaagatgtatcatggaaggctggaatgtggactcgttactgcagtctcataagcgccactccccatccacccctggctgatttagatgccccttctctggctctccttccattctgctcatacctctgtctgtgaatgctgcactgtatcgaaacattgtttatgtgtctttttctctcactgggctgtaaaactccttaaaaaggagagttagtgtcttgtggggttttgtgtctcagggctagacacagcatgggcttgcagttcgtatgctggatgtctgaagagcttcagcacactggaaatcaggagctgaggagtgaagacgagttaagaagtggttgctgtggtctctgtcaagaggaaggtgtggattaggagggtggtggtgggttcagaggaaagaagagagatgctggaggcaggtggataggacccgattgaaatggggtgatgtgggggaagaaattaaagaagacccagagattttgatcctcctaagacaagggtgatgttaagaaaggtattgattatgaaagaggactggattttgtgttagcagttggggaggcaccagggaggtttggagtcccagacgaaaatgtgtacaccattcatgtaatcaacatttacggagtttctctttctttctttctttctctatctttctttcgttctttcgttctttctttctttctttctttctttctttctttctttctttctttctttctttctttttttttgttttgagacagagtctcaggctggagtgcagtggcaccatcctggctcaatacaacctcagccttccaagttcaagccattcccctgcctcagcctcccaagttcaagccattcccctgcctcagcctccccagtagctgggattacaggcacccaccaccacgcctggctaatttttgtattttcagtagagacagggtttcaccatgttggccaggctggtctcgaacacctgacctcaagtgatccgctggcctcggcctcccaaagtgctgggattacaggtgtgagccactgcgcctggccttggagctcttatgtaccagacactgggagcctgcaaagcccctcaaggagttccagactaggaaagagacagacacactgtacaactcactgacacagagggtatcaggactcatagcggagcaagcagaacagaaggagaatgtcaaggaggaagtgatggatcctatctggaggcatcggggaaactggacctcaaagattgagtataattttccaagtggaaggcagagagctgtggttaataattatagttcccccttcttccagaagggatttgaggcagctcataatactataatactatatgatggaatgtctaaaatgatagattgaaaactaattttagacagtagtttgtacacagtgaaccgtggatgactgggttatcaaaactgaatgttacattttttttaagcattaaattttgctctgaaattcctgacaactaccaagcaaacagagagacagattggttttagaattttactgtgtctggttgggtgcagtggctcacgcctgtaatcccagcactttgggaggcggaggcgggctggtcatgaggtcaggaaatcgaagcatcctggctaacccagtgaaaccctgtctctactaaaaatacaaaaattagccgggcgtggtggcaggcgcctgtagtcccagctactcaggcggctgagacaggagaatcgcttgaacccgggaggcagaagttgcagcgagctgagatcgcgccactgcacttcagcctgggcaacgattttacagtgtcatgaagtcaagcattcaagtccttttttacctggatcctccccctactcctaagtcccaacacgaggttgaaaatgtgcttctggtgagggagatttctaatccattcctgttctaggcataacggatgcagaactgaataagatcatcaagtcttatttcatcgagtttgcattttagctgggggtgcggggacaggcagtagataataaataagtgctctgaaggaaaggaaagtaggttcgagtaactctgaattaaggaaggggagtaattttagatgggttcattgatccagaattgactgttgaagatgtgacagtggatggaacttgagggccagagagtggatggagagagaaaagaaggctaagagggaagcttggacgaggccacattttaaaggtgtaagaggagagagaagagttaagaacggagtggcagagctgttaggacgcctccctgagaagatgggtgggggatacgggtgggtggccagcagcgttgagcagagacagtgcctactggatagtccctgggcacccttccacttcccagccaccctgcaattagctggggccacatgtctagttgtggccaatagacatgggctctgctgaggtggatcagagcatggggctccacctccatctcatcccctgctgtggacctgggagtccctcctggcccacacaggactttatgtgaacaaaaaaccagacctttattataagaagtcacagagagtttggagttgctgtagcatagcccatcctgccgtgccgaatcaagaagttgagcatgtcaaggactggcagaggccactggatttagcagtaaggaaatcactggggattttgagtgggtgatttcagcagaatagtgaaggaagaagtcacttttgtgggaataaaggagaagatgttggaagtaaggagagtgagctgtgtgtgtagattaccatttcaagtagtttgggaggaaggcgagagatatagtggtaacttagataatggagggttgagaggaggcatttccaaaggacagcgtgaggtgggggtgtttgccaaatgaggggatgatcctggggaggtggggagataaaataaagaataattgataagagaaagcctggaaaaaattggaggggatcagaccaaagccaagattggttttggagaggaatagtttactctctgatgttgcaactcagagagatttggaagtggaagggaaggaagctgaaggctaagttaaggtaagatcaattttaatgattagggaatatttgaggcatttgctgagagcattgcaggaggagggcagtgtggctacagaagcaaggccatgtgactgcaggagaagtccctgaagtgttgaaccaaacaagtgcttgacaatcactgtgaggcagtgatgatggatgctgaaccaaacagttgagtagaaggttgtcaagctaggagagggaagaagtgtctcctctccttatatggaagtttctgtatgttcaaaggtggcatagagagagatgtacattccatgatactccttggtcagccaagcagccattcaggaaaactttggaattcccagcaactttgtcaatgggaaatgctgtgggatggccacgggaaagagggaggtgttgtcttccagcagtcattgactactttcgatgcagaactttaagaaacccgcttgctatcagcttccagtcagaacagcacttgtaaagggttgatccttaaacatcgctaaatgaacacatctctgtcttgtggttccaggaattttaatccttgaagctagatggtatgagaacagctttttttctgaagccaggcttgaatggtaggggaaggaatgtggactttggggttaggcagacatagttttgatattttagctgggtggctttgaccttcaacctgtctgaagttatcatttctcttagaatgttattgatagtagagagtgtctggcttagggtggatgctcagaaatagctctctctctctttcctccccctttctttctgtcctcttctctcactctctctttcttgctcactctcttgcttcttgtaatctgccaaggctgggatccagagttccagcttctgtgaatagaggggtcaggctctgataacagttttcctctatctgttatgaccactcaacattcaacagagatattcagcacctgttacatgcccagcatcctgctaagtgcttgggatcaccagtgagcaagagagacacccttgcggcatttgctgttcaacaggagagacaattaaaccaaatggtgtgatattatagggaagccacataatgttttgggaagggttggcaaggactgctagcctggtgaaggcagtggagacttggggagatcagcagaggctaaagcagaggggtgggcagggccaggcagggcagttcgttggtgatcaggaccagtggccaaccgggaccatccatcctggaaagctctatgcagctcctagggactcagggctgtgtgcatttgtgtggcttcaccatgatctcaactccaggtatcagctcttttccaccttgcacctccctctccccaacatcagtgtatgccagtgctctgctttccaaccctggagtccaccaggaaattctcatgtttggtagtgaagggactgcaggttctgagggcttgcaagcatctgtggctgctgctattgttccagcaggtggcagcttctcctgctaatgtttaaactatgtgtcccacagggcccgttgaaatcccaaatagcataaaaaataaacatttatttggacaatattaacgatatatttaaatcactatgaaaatctctattatgccgtgtccttagacacctttgaattccttaatgttatattttaaacaacttaacaaacccctctatccatggggtgcatagcttgtgctaggatataagttattctgtaagtacaaggatttcctttatagagttccattttccaacttgacttttagagaaaaggctgctttcattgtgaatattaagtaaaaatataagggccagggacaaaatatgagtaaagacctaagacaattcttggcctattataagccctcaacgaacactagctgctatcatcatcatcaccaccatcatcattgtcaccaccttcatcgccatcactatcaccattatcaccatcaccaccatcaccatcactatcaccatcataccatcatcaccatcatcatcatcactatcatcatcaccatcaccaccatatcattattattatcatcaccgccatcctcaccatcaccatcaccattaatacacaatcatcatcatcatcactatcatcatcaccatcaacatcaccaccactaccatcatcaccatcatcaccatatcattattattatcatcaccaccatcctcaccatcaccatcaccattaatacaccatcatcaccatcatcacctagtagcttcagtcttagagtaagcttgtgctttcttctagctgttggtgttgtccaatatagtaaatcattattctttatttaaggcatttcctgagagatatttaaaacattgtcatctcaaaccatctatcttctctgttctttgagaattttgcagtgcggtcctccagctctccagagaacgttaggatatatttgaggggaggagggggagaagttgatgtcatgtcctctgtctgcagcttctaggagaggactgaccagcaacagtgtagtgactggtcaatcctgtagtctggagtttcatggctgaagtaagggtcgttgctaactgagaaggtcttgtgctagactgtgtcaaatgggatgaccagtatggggtcatgccatgtgttcacccatggcagagttttccccatggggctaactttgcacatttgcttgggggcggtggggaaggggagagtgggaaggcactggaagaggggactttgcacactgcatgctgcacctaaatgtggccctctgctcacctttctgctcccaggaagtgggagttcaggtggccccaaggtctctttcaaattctcaaccacattccgaggacagaaaatgaatttcatctctatgcactacctgctttgccattcattaaaatgcctgtgattgtgttctcatgttaacatacctgtttcatttcatgctcctttactcccttctcttggttcccttgtacaataaaacagcagcatgaaacaaaacaatgctaagctctccttcactgtgtctctgtggtgtcacatttctttgccatgtgtcatgcatgccactgctttgctgcctcacaccaatggtaggtggggcatgggctggaggggctgggtctccaagcagagccccaggctccatgggagggaccaaggtggggaattgtgggaacgggtggaaaagacatctgcttagattgtccaggaccagtaaagctaatggtcatttgcccagaagaaaggaccatctcaggccaggtaagtggccatcttcctcgcctgtctgtcattcatcccagaaaagagaagatgctaggggaggagtggagccagagatggaccgagagaggtaggagggtgggaggagggcacagagttgggggagggcatatagagaggctgatctggtcacaaactttgagttttgtcaagttgcatcatatccatgaacctcagttgtcttatctgtatagtgggatgatagaagtttatcacaaattctgaggaagtggaatggaagttaattctgtatctctcttgacaaagccgagttcctagttttggtatttttggatggcaatgtgaatcagcaaggaaagcaaggccctttgggtcacacagacctggcctcaggttctcatttagtcactgcttcagttttctattgctgcataacaatgaccacaagcaccagccaggtatgagctcagttttccaggagacatttggctgatgtcttgttcaaggggctgtaagggaattccataaactagggaacttatcaacaacaaacacttcccgcggttctgaaggctgggatgtccacgatggaggccccaacagattcggggtctggtggagtcccactttgtggttcatagatggagtctcttcactgtgtcttcccacggtggaagggccaacctagtgccctggggtctatttcataaggatactgatccttttcacaagggctctgccctcatgactaatcacctcccaaagaccccgcttcctaatactatcacctgcaaggggaaggccttcaacatatacattttgtggaggacacaaatcttagacagcgcagctgggttctcagctcagggtctcacattcaaggtgtcagccaggctgacggggttctcatctggatgcttctaagaagaatctgcttccaagctcatttgggttgctggcaggattcagttcctcgtttaagactcaggtcactgtcttcttgctggccatcagctgggagctgctctcagcagctgggggccacctgcattccttgagatgtgccccctccatcttcaaagccagccatggagaccttctccccagttgaatccttgccaagcttccgatctctctgccttctgcctctggcctctagactcagatggaaagggctcctgtgaccagctggagctcacccagacactccccctttttaaaagtcagctatgcctcatcacatagcctgactgggagtgactaccccatcacatttatggttcacgtgtacactcaaggacaggggtgggaatcctacatgccacagtcactgtgattctacatgccacagtcactgactagtcatgagagctggtaaagggtaatgagcccctgtgggcctcaatgttctgttctctaaaatggggtggttatagataagcaaagtacctagcatgtagtagatacttgatacatctacgagccacccttttccacctaacagttgtctcccaagcccctaatcaaggcccagctttccctgctgtacattctttgcagaatgtgtcctaagtagagttgcacctccctatagaagggaaggggttagaagcttagtgcagagtcccttaagcttacagggcagaataatctcagatgtcagctagaaatgctttccttcagtcgcacccccctgatattctccttcagtggggctgtggtggggccaggttctgcctttgtactaagcaccctgagtgattctgatgtggccgatctgtagaccacaccgaggcatcccgcgagcgatgactgcgccgactccgagtcagccagttgggtttcaaagtctgagcccactgttcctggcagggtgtccctggaggaatggctggacttctcttagtgtcctcatctgtaaaatggggataataacagttgcctcactgggtggctctgtggagcatgcaataatccacaatagtggatttgcaattacagtaataattgcaattataatagttattgcaaatgcaataattcatgattattgagtaaagtgctcagtccagggcctcacatttgctgtgttctcactgtgaattaatgatgtgattgttattactataataaccccatggccctgggcgtgggcctggcttttgctctgccaccctgtgggattctgggcagtgagggggaatgatgggctctgagctgctgtttgggaacagaatctcgtttgaacttcagggagctggtgggaaggaatgagacaagccctccatgccctcctggccctgccctcagtggcccctggcctttcttcccccaccagagctgttcttgggtgcgcctgcccttccctgttcaggctgggacctgcccatgcaggtgatctgaaagccaggccaccctctgcaggagccacctgctcagggaccagggctacctccttcagcccgggggcagtgcccagatcccggggtcagccagctctcactgagcagggcaactatgtggctgtgctgtgtgttaggccttttgtgctctgactgtcctggagcccctcacctccttctcgaggaccagagcatccccagcttgttcatgccaggcttttttttttttttttaagatggagttttgctctgtcacccaggctggagtgcagtgacgcgatctcggctcactgcaatctatgcctcccgggttcaagtgatcctcctgcctcagcctcctgagtagctgggattacaggcacccaccaccacatccagctattttttttttttgtatttttagtagagatggggtttcttcatgttggccaggctggtctcgaactcctgacctcaggttatccacccgcctcagcttcccaaagtgctgggattacaggggtgagccaccatgctgggcttcatgccaggctttgatgtggcttgggccacagcaggcctttaggagggaatccagcaaacccaggcccatgggccagtgtgttccgccatgggaaaagtggtgatagcagacaggctcactgaaaattccgattttaatttccttttgtctgctttcaggcaactttgggctgtaaatgccagatttacccctcctggcctatgctctgggggctggggccatggtggcccaggaaggttgagatacttcccctttctccactgaacacctcctcgccatgtattcctgtttccttctccccagcctggcctggttccacattcaacctttcttcctgaccaccccggctctgcctgaggggagatctgggaaggtgctgggcctagaccaccccaaaagggtggtcactgtggatactgggcagggctcagagcaaggaggggcctcaggcccggagcagtcaggaaggcatgagctgggacttcttctgtcacctccacttatcagctaaaagtgttttaaatgcctccagacctgaggttggggcccaaggatggagaaggcagggcatgggctgtggcaggtactatgcattgctcatttggggactggagttgaggggtgatcgggaatgcagcctggccatactccagcatccttggcctggaagaaggtcagttcatgtcccgggatacaactgcttagccctgggactgtgaccagggctgggcgacaggcaggtccctggacaggaggcctctgtgtggctgtgccattgtcataggtagctttggacaccgttcccagctccctaggaggcagccatatcaggcccgcactcttgtcgctggaaggggactaagttagcagaggacagcccaggggccctgctggctggggccatgcaactcaccactgagctctctcctttccttctctacagccgggccagcacatggctcccagcccccatctgaccgtgtacaccgggacctgcatgcccccgtctccttctagccccttctcctcctcctgccgctcccccaggaagcctttcgcctcacccagccgcttcatccggcgacccagcaccaccatctgcccctcacccatcagagtggccttggagagctcatcgggcttggagcagaaaggggagtgcagcgggtccatggccccccgtgggccctctgtcaccgagagcagcgaggcctccctcgacacctcctggcctcgcagccggcccagggcccctcctaaggcccgcatggctctgtccttcagcaggtttctgagacgaggctgtctggcctcacctgtctttgccaggctctcacccaagtgccctgctgtgtcccacgggagggtgcagcccctgggggacgtgggccagcagctgccacgattgaaatccaagagagtagcaaagtaagaacccgaaggggacgtgccgtatgcatgggtggctgtgggtgtgcaggcctctgcatgtgaatatgcatgctttgggctggggactgggatgggtgagaacagataccccaggcagcccactcagatcccttggccactggaagatattcagaaactcagttttgtcctctgctgtcctcccgagggagaaggaacaggtgtccttctttttcatcttccaaatcttttccatttttccaaatctcttttccccttatatgttcttccactcacattgtcccatcccaagaccgttattagtctaagaaacccattgcatctgtaaagagcaggaaagattggtggcagcagtgggagctgcaggtgttgggatgccctgggcatgcttctgggtgctccagcccctccctcaccataagtgcccttgcctcccttcccccaccctaaggaaaccttcccaccctcctctgcatccattggcacagtctcttagagggactttcagggagccttgttctggcagtcatttctgtgaaaatgaaagtgcgtagcctttgcctgagggggggcccctctaaacttcattttgggtggtcctgcaagcctgatctctgagaacccccagttccctgagacaggccagagggggcagaactaaggctctgaggagtgctccataacgcctggatcagagcagaaagaaaacttgtgagcgatgcaacacagagaatcagctcctacacttactgagttttgggggagacagtcaggggcacccctgcaccaatcaacatgtgtttggcctcgtctgggcttggagaagaaagcaccatgcagaagtcttaggttgccagggatacccggggacagccaggcagaggttgttatccctcctgcctgtgtcgcttagggggagagggaggagcaggtgactctagttgccttaggagaagggtcagaatcctgtgtgagtgtgtctattgatttttcccaacaggccctgcagagggaatattccagctttggggccgctgctatgcctcatacatgggcttgggactttaaaaggctctcttctcaagggccactacttcctcagaaggcagttttttgtttgtctgggtgtttttttttttttgagatggagttttgctctgtagtccaagctggagtgcagtggtgtaatcttggctcactgcagtgtccgtctcccaggttccagcaattctcctgcctcagcctcccaggtagctgaaatcacaggcacatgccaccacgcccggctaatttttttgtatttttagtagagacggggtttcgccattttggccaggctggtctcgaactcctgacctcaggcgatccgcctgtctcagcctctcaaagtgctaagattacaggcatgagccacagtgcccagcacccatgaagtcagtttaaaggggttgatgactaagtcctggtatgtcctacagggacctcctgaatccatcaaaaccacagggatccgagcacctcaaaaatgaaaacaaagcaccttcagaattatttttcattcaaaatgaaaatatgaatccccaataaaaagattccaccaagccaatcactgcacacacaacctttgtagtcaaatgctctacccctgagctatacctgcccccaccacagtctttggcaaatgcacctggtatgttcatcttcaaggatgtcaggatgatttggggaggtgcagtccctcctgcccctgcccctacattactggctttcctcttgcacctgaagctttttccagatcaaaatggatgtgcccacggggagcgggacctgcttgatggactcggaggatgctggaacaggagagtcgggtgaccgggccacagaaaaggaggtcatctgcccctgggagagcctgtaaggaaagaggcaggctgagctgggggctctggaccaggaagatgctctgacagatgccatggtatgggccacaggacacacttgctcgagaaccaaagtgcatttgggtgacatttgaagattggggagacaagatggggtagattgtggcaaagaatgctctggctggttaccaggggccaactccttctcctcttcctgaccctccctcccctgggcagaagaaacgcatgtggaccagaagactttccctgctgccttaaaaccaataaaaggttaactttaagtttcttggaatgttagtgtgtgtctggttttgttagtaatttgtgagctattatttatgagttaaactcacgtcttcttcaatcttctggacaaagggacattgagtcgcttccaagagctctctccttgtctaaatgggtttgtgcacaatgcttttctcatcagcagagctccccaggggatgccccggggcatggcatctcacaggaatggacagagggctgggagcaggcacactcctaaaatgccaggtgtgttgcctcaggtcctccaagaagcagacaccaaggtgagattcgatggacaagagatttgttggggaaaacacctgtggtagataaaggaagggccagagctggagaaagttgaagttgagtgttgagggggttcggggcggggggcagtccagaccgtgctgcaagtctgacctctgggcagggagagtcttagatggcagtgcagtccaagaaagttttgaacaggctgctggggtgtcctttatgcagtccaagaaagttttggccaggctgctggggtgtcctttgtgcagtccaagaaagttttgaccaggctgctggggtgtccttgagccaaagtcattgctggagagggcctgcatctctgggaacggccctgcattcgtacccccacggtgcatggtcatgtgctgggagatcccgtggaaagcctgaccttggcatggatatgctggtggatcctgagctgcagcagcttggccatcagcccgcgtgctccctgcagttggagatctgagtgctccttttcacttccgctgcactaggccagtgggaaattctagaggtttgggctttggtgtgctcctcccacctcccctcctagttactcactcaacatgtgtttattgagtccctactatgtgccagacgctatgacaggcgctggggatgttgctgtgagtaggactccttgtctcatggaattcatccgggacagtgtttctccaccaggtcaatgttgccctctagggaacaccggtcagtgtttggagacatttttggttatcaagactgcggcagtgggtgggggttgctactggtgtctagcaggtaaaggccagggacgctgctaagtatcctacaatgcacagaagctcccacaacagaagattatcagttcaaaccaccagtggtgccactgttgagaaaccccgcactagagattacagcgtatgtacttgtccctggtttctgcgcatgctctgaagtattgccccaaacggcactgctgggatcataattagattggacagcgggttgcgattaagggctacgcggtgaataaaacagctcttaaaagttgcataggaagtcctcacaggagaaaaaaatcaagtggtttgccaaaccactcattatacccctcccctttagccctcaacttcctcagaattcaattagtagataagagcccctgacttgcttttaacctctgacaacttatttagcccataaatactggggttgctgactcatctctgcacacttctacaaatgaatgttgggtgggtgcatggctgaaacctagatttgctaatccccgtagggaaaacacagagcttcaatacttaaagaccattgctcattgtagattttactgaatctattccactgggctcacaagagtcactcacaaagggctaagaaaaattttcccccagaatgtaagtgagagagtctggtcctttcttggaagagtgagtgagctgttaacctgatgcctttatttgcaatgctgatctaaaatgagatgaaaggcgaagcaatccacacccttagtttactaccagccaatgtcaagaaataaggagaatctcaaccctaggtttgtatatcagtgtttaagggttcctctcctaagcccccagggtcctaaagagaaactaagcccacatggaaactaagatccacatggatagagcgtcaatgacagaaggctccagaatccactggttggatt

SEQ ID NO: 15429 - DNA, 17748 bp, Human
gggcttctggaatgtggcaatgtcctgttcttacgaggatgctagttggttgggtgtgttcagtttgcattcttctatatgtatatcatacttcaataaaagttcaaggagaatcatctccgggtggattgcagaactaaatgtgaaaagcaaaacaatcgtctagtagaccacataggaaaatatgatgggggtaagggaagatttcctaaggcacatgcacatgcacacacacccaatccactaacctaaagaaaataattgaactacataaaacttggaaacttctcagccaggcgaggcggctcacgcctgtaatcccagcactgtgggagtctgaggcaggtggatcacttgagctcaggagttggagaccagcctgggccacatatcaaaaccttgtctctacaaaaaatacaaaagttagccaggcctgttgacctgtgcctatagtcccggctatttgggaggctgaggtgggaggatctcttgagcctgagaggtcaaggctgcagtgagtcctgatggcaccactgcactccggcctaggtgacagagtgagaccctgtttaaaaaaaaaaaaaaaaaaaaaaaaaaaaaatctaatcatcaacaccattaagagtgaaaaggcaagccacagagtgtgttcatatccctaatatataaagaaattccacaaatcaataagaaaaaaggcagacaactccataaggaaaaaaaaaaaatgagccagggactcgaaagaacacttaaccaaggaagctatcagaatgggcaccatacacatgagaaggttctcagcttcattagttattagagaaaagcaaagcaaagcagtagtgcaataccaccacacacccatcagaatagctgaagttatagagttaaaatgccaagaaggctgaagctggaagccatgaaaacccttacacaccgctggagtgtgtatattatttcagcctcttagcataactgttgggcattacttattgatgatagatataccctatgtcccagcagtcccactccaggacaaactcatgcaaacgtgcatcagaaccacgtaccagaaaattcatagtagcattactcagaatagccctaactgaaaacaactttgatgtctatcaacagcagaataagtaatttatggtataatatatacaatggaattctcttcagcagcaaaagcaaacaaaccatctctgtatgcaacctggatggactccagacataatatagactccatgaaactaggccaaaaaaaaaagcatactgcatgattctatttatagcaaaagcaagcaaaccgaatttgtagtgttgagttcgcggttgccttttgggaaagagggaggctttcagaatagcggtgttttggatcccggtgtcggctacgcagctgtgttcactctggtcattaatcactgtaaattcctgatatgcacacttttatgtatatcacatttcatacatatgaatattcagaagtctaaaggtcacaagcttaaccgcaaaccctaccgtgcccgaggccgggctggacttgcggggcggtggggttgtcccggcgacctgccccaggcgggccacctagcccgggatctcacactgtagcccggagccaaggcccaggcccggggcgggcacctgaactgctggacccttcactgaaccccacgggttcccgcgacggctggtggagggaggacagtcaccgcttcccctcccacctcgaggtgcgctaatgcatgagaaagttcccctcgggtgtttccacattcgccttaacttttaaacaccaacgtctggaatcaggggtcctccagactccgaaacacaccctaggaaacaacccagaacgagacacatcccctgtgcgcgcgccacgacttccggcaagaacgcccccggaggcgtggctcttcgattgcttcggcctggcggtcgagctgcgcgcgcactcggcggctgcgattggtgctgcctggcggcggggcgcggggcacgctgggacgtctcgctggcgggaggccacgggctttccacagcgcgggggaacgggaggctgcaggatggtcaagctgacggcggagctgatcgagcaggcggcgcagtacaccaacgcggtgcgcgaccgggagctggacctccggggtgagtccgggggcgtgggcggccagtccccaggcggcaccgagccgccttattttccgcgctttgccgcgtgcaccgaaggccggagcttggcccgcgggccggttgtctgggctccgaccgggctgcgcagggaacgccgggcctgattcttgccgttgttgccagatgagcatccggttaagctcctgggagccttctgttagcgccgtgcctcttgacaggcacgggtgacttcattacttcctggtgcgtcctcgtggggccctgttaggccttgcttggctgtttcgccgctggctgtttgagggcccggaagagcggctcattaatggttgtaacgcaagtgcagggcgcgggattggttcttaatacttgccgccagatgatattttgagcgtagataggatatgtgttcattattcctaatgtgagggaggaaactaagtccccgaacaaccgcgattgtttcctccagtattttctacttagtagctttaattgtctggcgtttcccctatatgaagacgttttaaaaattgaactgtgtcacccaggcttgcaccgccgggtgctgtgtgtaagttgtggaagcgctcgcaattattcagattcctgtactatttcaaccttagcaagacttggtaagatactgggagggcagctagctagttggcatttcaggagacggctttaaaagggacgtgatagagcaacttctctgaggataagaccatgctgtcgtagcctgagatttgttcccatggggacctatggcctcggagcagcatcgctgcgggatctgcttagatttcttgccgacctttgggaaatcccactgttttgtgttgtgttgtgttgagatggagtctcgctctttccgccccagctggagcgcagtggcgtgatctcggctcactgcaaccgccgcctccccggttcaggtgattcctgtgtctcaagcctcccgagtagctgggaatacaggcatgcgccaccacgcccggctaattttttgtatttttagtaaagacatggtttctccatgttggtcaggctggtctcgaactcccgacctcaggtgatccgcccgccttggtctcccgaagtgctgggattacaggcttgagccactgcgcccggcccaactcaccacttttgatgatctctgccatttctctttatggagcatgtgcagtgttgagaatacgtattttgatgcagtacgtgtagtacagctctgaattgtgtcctttaactttgggtaagttctttttttagtagaccttgcttcttcggaatatttcttttcttatagtgcctaacacaataattatgcccaaattagacaaattaacatttgagtgttcacagatttattactgtatttaaaccattgatcttcaattctgaattggagctgggggaggggagggagaactgtcgtgatatgttgaggctgttctgatgggttctaagaatctggcctgtggagatgcaagagtggagaactgtcgtccacaatgtttgaacgccgtttgggcactgagactaagcagctccaagtgtaaactcctgttgtgccgattccgcttaactagcccaaacgacttaggacagtgtgaggcaccttgtaaatgttcttataaatgttagctgcctatatcagccattgttattgtccttgtccttgttgtcatcagattctaagcttcatggcactggggacttgagactcgttcagcgttttctctctagtatcttaaacagcggcaagtcatgcgtgacccgacataggtgctaggtaatacttcctgaataaatcaaagcctggagtcagatactatgaaatacagctaatgctttaaggggcaactgtttagttatattaatacctcttgtgtttttttcctccattttatagggtataaaattcccgtcattgaaaatctaggtgctacgttagaccagtttgatgctattgatttttctgacaatgagatcaggaaactggatggttttcctttgttgagaagactgaaaacattgttagtgaacaacaacagaatatggtacgtgtctgtaggggaaagtaattttttcccctagagtaaatgttgcagtgtttcctgaagaagttgtagcacgtgctactggttaaacctacatgtttctttttctttttctttttcttttttatttatattttgaaaaaatattttttccataatggaagccacattcaatacatgttttttcttaaaatgagaaatgaacttcacttttcctatagagatccagagattaacctggcattagtctagtcttacttgtatctgttcagaaatcatgtatttttattttcatggttaagtttctaaataaaaacatgttgctttgtatacattttggcttctaaaacaattatcaaaggggtcatagtaaaaggatatataaaggtaacaattatacttttgactgagcgtctctgcttttttttttttttaactgcaactaatttctagactgttacttattgaaattgagatcttttttgaccctgccttcatcagctctgtgtaaactttattggaaaaaaagcacttggtgtatagataatgtctttaaaggtactgggtggtgagtgggatttccttcagatagaaatatttctcataggttaaccattcccctatagtatagttgttgtgtcttgtacctgagctgggaatccagaattatttgtatttctgtgctgcctgcacaaaaaatcatgaagtgagttaagtagtttgtgccacccaggagttgcaccttttctcaggttccactagatggtatgacagtggaattagccccaggcagtgtctaaaatcccacttctgttgctgaccctgtggcctcagaaaagggttctttttgctttgtttcctctttatcagggtgttggaagaaggatctctaagtgtctctctgtgatcctctgagcaaggaggtagataaaattgttagcttatttaattttcacttttactaagactctatttttattttagccgtataggtgagggacttgatcaggctctgccctgtctgacagaactcattctcaccaataatagtctcgtggaactggtaagttgcacagaaggaaaatgtatttggtgggtggggttaaaggtactatgtgcttcctacagaaaatttacaaaatctagaaaatgatctcagtatcctctttcttgtctttttcttaattcaggatctgggccttttgggttctgcagccgtatgttgcaaatattttcctacttttacttgacttttgacttaggatgtcttgttagagaagttcctaatttaggtgcagtccaatgaatcaatcttcttctttattgtagcccttttgatgtttaaatttcccctattccagggttataaactcctatgttgttttctacaattgcagtgttcaatatagtaccagtaactacaggtggctacttataattgagatgtgctagaactataaaatacacactggatttcaaagacttaagtgcaaaaaaaaaaaaaagtaaactatctcagtaatttttttatatcgatgttgaaatgataacgttttggataataagttaaatggcatattattaaaattagtttcacctattttaacatggctactagaaaattttagattacatatctgatatgcattaaatcttgctgaacagttccagtctagaaaccttgttttactcttcacgttagatgaacaatccacttggaactgttttcatgctttttaaatttctgttctgtgtatccaatttttaacataattgagatactgtgtattgttttgtaacctaaattcttcacttaaacactggatgcttaaatttatattgtaggccaggtgccatagctcatgcctgtaatccaagcactttgggaagccaaggtgggaggatcacttgagcccaggagttctagaccagcctgggcaacatagtgagaccttgtctctctctataagtaatttttttagaaaagccgggtgcagtggctcatgcctgtaatcccagcactttgggaggccgaggcgggtggatcacgaggtcaggagttcaagaccagcctgggcaatatggtgaaaccccgtctctactaaaaatacaaaaattagccgggcgtggtggtgggttcctgtaatcccagcttcttgggaggctgagacaggaggattgcttgaacccaggaggcagaggttgcaatgagctgagatcatgccactgcactccagcctgggcaaagaaagagactccgtctcaaaaaaaaaaaaaaaaaaaatgccaaaagtggtagcgtgcatctgtggtcccaggtattccagtggctaaagtgggaggatcacttgagccctagccatcagtcgaggctgcagtgagacatgatcatgtctctgtactccagtctgggcaatagtgcaagacctcatctcaaaaaaaaaaaaaaatcgtataacttaattttgtgacttaaccttcctcccgtattttcctgattgttgagaatgaactgtgttcctttccttgtggacaaggtccatagcatccttcagattctcaaggagatgcttgactacaaacataagacagcactggtccatggccatgtcctttctgaagtgtgtgaagtattcaacccgaaatacatatttataggcaatgtgtctcatgataggtgctgttagagaaattagagttgtatttaaagctctttgcaaagatgaagactactgggcttatcagttattgagagaggtatgttagaatctcacagcatggtagtggatttgactatccctgaagttctgtcgattttagttttgtatattttgaagttgccttatttgatacatacaaattttaaattattcatatctttctggtgaacggaaactttttattatgttgtgaccctcgatctctattaatgctgtttaccttgaggtttcttttacctcgaaacaatctttgttttggttagttatatgcatgataaatcgttttccatccaaaatttactttcagcttgtctgtacctcttgtagtttagatttctctcttaaaaactgtatggttgaattttttttttttttttttgagatggagtggctggagtgcagtggcgagatctcggctcactgcaacctctgcctcctgggttcaagtgattctcctgctgcctcagcctcccgagtagctgggattacaggtgggcgccatcacatctggctaatttttgtattttttttttttttagtagagacgaagtttcaccatgttggtcaggctggtctcgaactcctgaccttgtgatccacccgccttggcctcccaaagtgctgggattataggcgtgagtcaccgcgcccagctctggttggaattttttacaatccagtctgaaagctcttttaagtgaattatttatatttagtctgtttacatttaatgtaattactggtgtgttccagtttgtcttctctctgttctggggcttcctgtctgtcccacccgttcttcaatccgttttctctcctttattgtagatgctctccttctgtcattccattttttcttctgatggtttagaaattactctctttcaatcttgagttagcatcgtaggaattaaaacacacatatttataaaagtttaaaattaaatgttaagatcactgtaccatgaccttcaacatttaattttaaactttgacacctttaccctgctaaacaatacagtacagtgaccttcaacatttcagcagccttcgggttgttacatatttattcttttttgaagcccatcactacatcgccattacgttttacactgtgtatgtaacaaatgttaccactttgttctttattcctttttggatcatcttcagtgggggtaaaacagtatcaagctctagagctccctctggtggtttttgtgacatatttgaagatggcagcttgctttttgagaatttctggctctgctctccctgtttttatctgtacttttttttctcattgtgcctcttgcacacacacaccccttccccaccatctacccaatttgcgcctgttccagcagtttctcttcagggcagggccgtgttgggacatgatttctattaagagtgagggcccaaattgctcttgcccctgcagcccttatcacagacccctgtagtcattattggaacatgctggtcttgggcctgcttttctcagtcactggagttctccagtttgtaagacggctcctcgcctcccctctgcttcttcctgtacaaaggccgtcaccctgcaagccttgttgctctcaacatgggttgtctctacttgttcctattttagagttactgcagaatgccttgccatctagcttggttgtagctggtaaccataggtttttgtttttttgctatccttattgcactatgttttatggaacaattggagaagattaaaaattcaccctgcccactgggcgtggtggctcacgcctgtaatcccagctctttgggaggccgaggcaggcagatcacgaggtcaggagatcgagaccatcgtggctaatacagtgaaaccccgtctctactaaaaatgcaaaaaaaattagccgggcatggtggtgggcgcctgtagtcccagctacttgggaggctgaggcaggagaatggcatgaattcgggaggcggagcttgcagtgagccaagatcacgccactgtactccagcctgggcaacagagcgagactccgtctcaaaaaaaaaaaaaaaaaaaatcaccctgccttctttccattaattcgatcatttttaagctatactattccttgtccctgcaaattttatttaaagagattttcaggggcagctaggataaatgtaccttctttcaaaagacagtatacctttgttgttcttagacgctgaagctggcgctagcaggaaagcccacttacaccaagattctggcttgcagttcccagtgtgaataggttgctccagagtcccatcagctttgccattgttttcttttccaaatcatggctcagcagccactttgagattcctgtaggaaagcaatttcttatctcctgctattgagacagaagctgttaatgccaagattttaagaagctcccatgtattcatcggtagaaattatttaaacatttgtgatgtgctagtattgggcttgttgctagagagtaaaaattcagtaaataatgaaaagacaacttgcttcaaaagcactctccatttcagaatctcaaaatagcgtgtggtattcgcgttcttacctgtggctattgcttgacagggtgatctggaccctctggcatctctcaaatcgctgacttacctaaggtatgggaattacatattgtgacaaaatgaagccctttaaaataacattacttttaccagccttgaccttaatgtaatcagataattaaaaaatgtggcacatatgcaccatggaatactatgcagccataaaaaaggatgagttcatgtcctctgtagggacatggatgaagctggaaaccatcattctcagcaaactatcgcaaggacaaaaaaccaaacaccccatgttctcactcgtaggtgagaattgaacaatgagaacacttggacacaggaaggggaacatcacacaccggggcctgttgtggggtggggaaaggggggagggaaagcattaggagatatacctaatgtaaatgacaagttaatgggtgcagcccaccaacatggcacatgtatacatatgtaacaaacctgcaagttgtgcacatgtaccctagaacttaaaagtataatttaaaaaaaaagtgccttttacaaagaaagattgaatatatttccttaatgttaaattgttacaatgttgcaatgtgaagaatgtgaatgttcccttgatttataggttccttagactattcaaacagacctcttgagtgctgtgccatgaacaagtttgccattgtgtcattccttttcttgtagtatcctaagaaatccggtaaccaataagaagcattacagattgtatgtgatttataaagttccgcaagtcagagtactggatttccagaaagtgaaactaaaagtaagtagtaatctgttgcttgtgagccattatagagttgtgtgtttttctttatatttttgttactgattattaaaattgtctaaatgagtaaattttaccattagtttgtaataaaagtgggagggaaaatgttacatcacatttttttctaatagcagagtttatgatagaacttttaagttggagctctcttatgtaatgctggctattccgaagttcgcaaagtgctgaggccacggtgagcagtcttaacagtggattgtctgcctagatacgttcccagcggagaacttaatgtaacctactttcgtgcagctccgtgtgttaggatgatttttccctttattaggaattcattattttattattcatttaattgccttcttagttccctgggatcccctccttggagctaggagaatgaactttcttcagggagctctaccaaagaaagaagaccactgtgtcttctcttaatttgaaattgctttttggtattttcaccagcccggagtactgtaggagagttcgcttccatgtcttctgaggaatgcatctaaatgcatgtggtattcctatttccattaactctgtgtgtggtgtcgctgtaggagcgtcaggaagcagagaaaatgttcaagggcaaacggggtgcacagcttgcaaaggatattgccaggagaagcaaaacgtaagacacggatatccaacttaactctacttcaccttcagaaacatgatctgatctgtctggcagttcgtctcctacaaaattaaccaaaaactctgacatattaatgtggtattaaatttgagtgcttatagtccatgtacatcaatggtccacacatcacaagaaatttctaccagcttagcagagcaaatatttcagtagtcagtcttcatgtgataccatgtacatcctattttctatataggaagatgaactggatggtgtttctgaaggagagagttcttgtatcagtttgttaacaaagataagatactacactggttgaattactttcaaaagcttttgaaagtaaaagagaagcaacttctgttggtctaggtctaacagttatgttcttccccctcttaagttttaatccaggtgctggtttgccaactgacaaaaagaaaggtgggccatctccaggggatgtagaagcaatcaaggtaatcatgtgttaggattcttggactggaatgagctaagatgggttcagaacacaaagctggataataaacatgttccgaacattgcagatttcattttcccacagttattagcatacagcaatatttctgtttaaggaaaaactagcataaagttattatttgatcagacttgaaattacacaagctaattaatgtggaggcagctttgtctttctcattttccaaggtgcatttatcacttcgaacagttacttaccttggtatgctgtctcagtgtttgccttaatttttactttcgaagatttgctgtctggcaaatccttttgactgatcagtagggaccctcgttttataatattgcctccttaaattattcagtaacataattgcaaatagttacttcacttagctacgattttagaacatgtggagtgattatttataagaaggcctgcatctcttcaccaattttagaaatttgtggtttggcttctagttttatttttgtgggccaataacattcttccccctacaccaaagtatttaatgttcctgatggagaagttgctgtgaatttctgtaggtgattgacacttagttttctgggtagctgatacttggttgaagttaatcatccatctccattgccctctgtcctccagaatgccatagcaaatgcttcaactctggctgaagtggagaggctgaaggggttgctgcagtctggtcagatccctggcagagaacgcagatcaggtgaacaaatggtgttctttgtatgttcaaattaatgttacactcagagtgtaactcacaaccatttagatgccatgactctggaatgccagagtagtgcctccttacatcaaatctaatatatgaaatctctttaaatgctctttgaagataaagtatttgatgggttgggtgccagtggctcacgcctgtaatcccagcactttgggagcctgaggcgggcggatcacctgaggtcaggagttcgagaccagcctgaccaacatggagaaaccccatctctactaaaaatacaaaattagccgggggtggtggtgcgcgcctgtaatcccagctactcgggaggctgaggcaggagaatcgcttgaacccgggaggtggaggttgtggtgagccgagatcgcacttttgtactccagcctgggcaacgagcaaaactgcagctcaaaaaaaaaaaaaaggtatttcatgaagaaagttaagttacagcactgtggggggttttatgtaaaagttgaagctagaattacttcagccatggagtgcaccgaacactagcgatagccatgtggacttttacctatatatatttgcgtgtgtgcatgatacctcagtagttaggaacacaggctctagagccaagcagtccgaggcccaaatctcagcttcaccagctctgcctttggacaagtttcttcaagtctttcctcatctttaaatctgagataacaatagtagcaaacctcaaaaggttgccgagaggctgagagactgaacacagcacaaggctcaacattagcgagtttttgataagtggtaactgttctgacatctgaatgcctgctttatgctaggctgcatgtggggcactagggatataagataaaaagtactgaaatacgtcttacaagttttgatatgaatgtaactggggacagccactcagactgccgtcttggggaagtttcctagggaaataatgtttgagctgggagctaaaaattaaaaagacatttttttcctttttgagtcggagttttgctctttttgcccaggctggagtgcagtggcgcgatctcggctcacgccaacctccgcctcccgggttcaagcgattctcctgcctcagcctcccaagtagctgggattacaggcacctgctaccgtgcccggctaattaatttttagtagagacagcgtttcaccatgttggccaggatggtctcaatctcttgaccccgtgatccacctgcctcgtcttcccaaagtgctgggattacaggcgtgagccccgtgcccagccaaaaagaaattttttaagaccagtaattctctactgtatggtttgtgggcctctgggagtctgtaaggtgaagactgattttgttgttgttgttgttttgagacggagtctcgctctgtcgcccaggctatagggcagtggtgcaatctcacctcactgcaagctccgcctcctgggttcatgccattcttctgccccagcctcccgagtagctgggactacaggcgcccaccaccaagcatggctaactttttgtattttttttttttttagtagagacagggtttctactaaaaacacatgttagccaggatggtctcgatctcctgacctcatgatccacccgccttggcctcccaaagtgctgggattacaggcgtgagccaccgcgcccggccgaagactgttttcatctaataacaccaaggtgttacttgctttagtatgaacatttgcactgatggagcaatagtgggtagaactgcgggcacctcagtaggagtcaaggcagcagcctaaataatagctgttacattcttccctgctctgcactcccagtagcgtgcataccagtttcacttaagagtgtcctggatgcagcagtaaagataattaaatatcactcctcgggcacacgtctctttgatattctgggtgacagaaagggggtgcacatgtctgcattcttgagttaggtggttatctccatgcactggtgcagttgtttcagttgagaggcagctacctgtcttctcaaacatgatgaagtgagcctgtcacttcagggaaaacaattgaaaattcaaggtttaaagcaaaaattaaaatttagaaaacttgtatccactgccgtaacctgccagcttcccagtactttaagacttttctggggaactcaatagtaatgttatgtgcatgtgaattaatgggtgtgacatttttgatgtgtaattacatggctcaacgtttggaagatctgcaaaagtcggtgaaccacagttttccaaatgatacgaaatcatgtacgggtaaaagatttgttcaaagtacaagataaaccaagtaagagtatgaaaagttcattgataaggtttcagacttttacactgccatctaaccttgaggaagctaccatttgtcaagttttagcatagtatctaaaaagagcatccaccattatctgcacaggctgttaaaatcttcctcccttttctaactgtgtgcctgtgtggccagattttcttcatgcccgtcaatcaaaatgccgtattgcacaggatggaatgatgaaaccaatacaataattcagctgactgatgttaagtcagacattaagtcaacaataacaattgtttcccaaacaattgaaggagttacaacttttttttccccctggaatacattgagcaaaatacctgccataaattgttgaacaaatgtaacattttttggtagttgttggcatatttccctaatttagagacaataaagtcattgaactgttgccagtatatggcatgtagtaggtgcccagatgtttttgagtatttccggtttctttgcctacggtagtgccatgaaaagcacatgagtataggctttaccttcaccaaaaatgaattattatcaactacaatgggaggcaacaattttgaaatctttgtgacccttttcctttgaaattgagcatcccttccagtacctgccaaagacagactagaccgtccctggacgataagctcctcaaaggcaggtgctgcttttgatctttttgtacctacttcagtgtgtaacaaacagtggccacagaacaaacacttgcatgctaagggaatggattctctaaaattgatactacttttgctttggtggttttctttagggcccactgatgatggtgaagaagagatggaagaagacacagtcacaaacgggtcctgagcagtgaggcagatgtataataataggccctcttggaacaagtcttgcttttcgaacatggtataatagccttgtttgtgttagcaaagtggaatctatcagcattgttgaaatgcttaagactgctgctgataattttgtaatataagttttgaaatctaaatgtcaattttctacaaattataaaaataaactccactcactatgctaccaagttgtgtgtcatcatggtgcatttgcagtgaggtctaaggacacgttgaaattggaaatgcaggagggcagcgttttctcggtaggcttcctgggctggattagcgtctggctcctgcagtgtcatgacacatgccaggaaggccgccttttccactcccacatagcccttctgttagtgcagacttacctgtcgctccggcttctgataggacaactgaaatgattccatttttgaaattgattggtgtgtcccaccaaacctggctatgttttttgtttttttctcccccgcccccaggctggtctccaactctggcttcaagtgatcctcccgccttggcctcccaagggagtacaggcctgagccaccatacccagcctttagttttatatatgtacatagttaacataaaggtcatatggagagtctacaagaacatttgttgaaaggggcgtaagttactcatatttgaagaacactactgtttcattgccatctctctgatcccccttagccacgacagtcttaatcccatcttgttgcatatacttttgtgaaaagcttggcactttatcagttagctcttgctgcaataatgctgtataacaatccacccgaaaactcagggttttgtttgttgttttttttttgagacggagtcttgctctgtcccccaggctggagtgcagtggcgcgatctcggctcactgcaagctccgcctcctgggttcacagcattctcctgcctcagcctcccaagtagctgggactacaggcgtccgccatcacgcccggctaattttttgtatttttagtagagatggggtttcactgtgttagccaggatggtgtcaatctcctgacctcatgatcctcccgcctcggccgcccaaagtgctgggattacaggcgtgagccaccacgcctggccaaactcaggggttttaatcaacaacactattatgtagttggctctgcttatcactgtaggtctggattaactggggtggcttggtttctttacaggtctcagataagccagctcacccggcaaaggcacaagaaataaacactaggagcttcttaaggcctacctacactcaaaactgacacacttatttctgcccacttgatattaaccaaagcaagccacctcgccaagtacaaagtcaaaggatgatggggaaatatactcctttgaccttgccatagcaaggatatggctgtgagaaggagtgacaaattagggccactctttcagcctcggccaatcatttagcctacaacagtcagtgataggtggcagccctggttactgtccacctttgtcctctttttgcaaataatacctgagcaattacattgagcaaagtgtttgttgaaatacctttccagttctagacaagccaagccaggtgaggttataacacctgattaaagggacaaaggtaacaaattcctggctaggatgagtaacttctatcaataggaccataagatcaatgtgctaggaactgaaaagccatcatccatgcattcaaataatatctattagattttagtggaatatatgcattatatgtatatatgtatacaatagttcacaatagtttacaaggatactttggttttctatatgcttagaatgtgcattattttcatgagttaatactggtttccattttatatcgcaaagtcctgagtgaaaaggattgttgcctttttttaatgatagaacctaaaatgttacaatttattccatctttgtgattacagacattacaggataaggtagctaaacaaggcaaataaagcaaacgttcccttcatttaatcagatgcaacattttggcatttttatactgtgcacgttgactttaattcattgacatggattgaaagccggcaacaacaaatctttgcaatttaggatcttcttccataactaagttttgtgggttttttttcttttcttttctttcttttttagacagtct

SEQ ID NO: 15430 - DNA, 36203 bp, Human
  misc_feature (1)...(36203): n = A,T,C or G
cctggctgcactttcctccccgcactaacttaactcttcttcctcagttattaatttctcgctgttaccaagtgatgacttgctggatggcaaaagtgaactcttggatttagtttcagctggaagaataaacctgtaattgtagcctggccttttcctggtgcgcttccctgggggcctggcctcacattggagacgctaagcttccagaagccagacaggcaaatcccaatggtgaccgatgctctcagttctggattccaaactggggggcagctggtctctgctcacctgcccagccagagtctgcctcctgtgcttggtccccaaccgactcagaccaggcttcctcactatgagcttcagaggtttttgtgggtttttttttttttaacattctatcaacttttaagttctggggtacatgtgcaggatgtgcaggtttgttacataggtaaacatgtgccatggtggtttgctgcatggatcaacccatcacccaggtattaagccggagctgtggagtttatacaggaagcccaatacagagaatgtaaccaagactcatgcttaggagatggctgccctctctcatctgtcatcactggggagtcaaatgtttcaaatgaatcaatttcacaataattgaaattagcccttgagggacgcaattcttcctttaaacaattcaaaaagaagcaaagtaaagctatgtataccacatgcagatagatgtaaaaacggaacctgatgaactaattctgtactcagaaattactgacggcattttacttgagagacatgcgtgtcagccatttctgccacgggggttcttctgatgctgtgataggctgtgatgaggaagccattccaagttggtgtagcaggagtttgtgtgtcttctggctgggcagccggggacctccgtgctgtcggaatgtgttttgtatattgtctgtcatgtctcttcctagttttttccaaaagccctctcttttaacatgacattaataagacaattagaacttagtgtaaactaacagtaaatagtacatatgtttcagtgcatggacttcgtatgttcttcttagtctgctcatgatgtcttttgtcaaaaaaactttcattctcatctgcattctggatcattgaggttcccagaaaagtgatttctgcgggttatataaacagttatttgcgacatctcttaatgtaacctggaaagtttctaacccagacatttaactttgtacttcaacgctggtttattatcaagcttcggaggtttttctgggtttttttttttttttttttgacattttatcaacttttattttaagttctagggtacatgtgcaggatgtgcaggtctgtgacataggtaaacatgcgccatggtggtttgctatgaaaatacacattttaaggggaatgtgctggggagggacatgctgatgtgcattggtgaaaactgaagggcgatggtgagatcctcctcaaagtgagctccttggcaatcaatcttgctgagtgttgccactgaaaggagaaagggagtgctcggtgcgtccttacccttcaggggcaggcggactgcttgggacttttatgtatataaacctattgactcttcccccaaagtctattggggtatgagattccattcacagcctctatttaaccatttaacttagccattcctctgtgaatccatgttattgctgaagataataataataatttagaaaaaaatctctaagtgactatagttttatttgaccaaaacttgaatttcgagtctgtcctagttgatctgttggtcatgcagtcctgggactctgttcccctccgggtctcatctataagatgtcgaaggggagagggaagcagcagagaggaaggtggacaagatggataagacgtcacctaaggtccttagcatgttgaaattatatgattttgatctaaacctaattggttacacttcctttcctggttagatatttatcaacaatgaatggcacgaatccaagagtgggaaaaagtttgctacatgtaacccttcaactcgggagcaaatatgtgaagtggaagaaggagataaggtaaatacttaaaataaatttgctctaagtaattcaattatggatgaccaaaggataaggaaacggttcggcttagctataagacagaactggcctatcctgggggcagggcctgggctagctgcgcgaattggcatgtggttctcagacgtgtggcacagaatggcatcaattaccgatgatcctctgcagagaatcattctcccttgatagatgtttctcctactatgaggatgacctcagctatcctcatcatatggctaaaggaaaggttttcttttttctttttttttttttttttatcaattatttggacctggaggcattaaagaatctttccagaaagcatttcccgctggtgtgtttcacgaaatgaagctttctggcagaagacactttagaaaaaaatagacactttgaaggaaaaaaaatagttgctacccgggtgatgcggggatagttaacaatgtaaccaccagatttcttttctcctagaaatttacatgagcatggaaagcggtaacctttatcactctatttgcaagtgcaaggtctatatagtaatacagaagctaagggacttccgaatgtgtcctttatacattgcaaggccatcaaatctattctgaatgtcagtgcagaggtaaagcccttccactgagggcagggagatgtaaatgtttccttagctgctggagtgctggactgatgttcttggtcagcaaactgatgacgttggaagtggatgcagtgaagggcgtgtgcagagtaggcttggattttatcttgcccatgagtttttgtgacagacgtgcaaatgcacactggccccacctatacagacccccctctgtgtggcacctcatgacagttaggctctgctaacaaagaaagtggcacagaggagctcatagaaaaatgtgagggcattggggggaagccatgacatggaatggggtttccactaggagactcccaagtgccccgtacaggtgctaggaggagaacgagacccttgccctgggccttgatttctcccttggtctgagtgactgttctgagccagaggccaccacaccctctgcagctggaaaggtcctggcctccaccccagagcctgggagaagaaattcagtgtcccacatctcccctgccaagcttctgctcacccccaagccagctctggacacacagagactcggtagagtcactcctgactggtgtcccacatccactccctgctgtaccttcctagaaagagagaggcatggaggggccttcgagatgaatgtggcccattttcctgagaaaaagagacagtgacactactctaaatggccctcacttctttccttttagaaagaaggttccgttgtgattattctatcagtgcacaaaagatccagttctgctcccatggggtgggtgaggctgaagggagaaaaacggccttcatgctcctccctgtctgcgaactgttccacgatggtcagttctgcaatccagaaaggaaggaatttccccattctcactcttggaccacaagttcccagctgggatcaaatgccaggcagacacttcccacctgatctgtgaacagcaggctcgtgtgcgttcacactgaggcagccagtggaaagtccttccgtacttgggtccctgagaaaaatactctttaggaaatatttttaaatgctttttataatcagaaacaaacattggtatttggccactgtagaaatattaagatgtaaagaagaaaaaaaatcacttgaacgctcccagccattcaagtgattgaaaaacatgctgctgcttgcagcctgtctgccagcgggacaatctgctgttctctataactgatggccgtggtcccaaactgcagtcacgtcaaaagatgacacccaaactgcagtcacctcaaaagatgacacccaaactgcagtcacgtcaaaagatgacacccaaactgcagtcacctcaaaagatgacacccaaactgcagtcacctcaaaagatgacaccgaaactgcagtcacttcaaaagatgacacccaaactgcagtcacgtcaaaagatgacacccaaactgcagtcacctcaaaagatgacacccaaacttcagtcacgtcaaaagatgacacccaaactgcagtcacgtcaaaagatgacagtctctctctgttgttctggtcgctcagcccgacgtggacaaggctgtggaggctgcacaggttgccttccagaggggctcgccatggcgccggctggatgccctgagtcgtgggcggctgctgcaccagctggctgacctggtggagagggaccgcgccaccttggccgtgagtacatgcacttgggggccggtgggggatgagccagcctcactgagggtcctgtccaccatggggtatgggaaaaaagatcacggtcctggttttgtgtggtcgtgggtctgttccatcctctgagacacggctctctggcaatacttgcaggtgttaatgcctctagactgaatccctttcattttgaagtcagacttttgtcctctgcagctcagcttcttgaccaagttgttgtctataggcagttgagctacatcagtggtctcagacttggggcactcacagattggtgaccatgagctgggccatatcctggtaccacctgtgtgtttatgtacttaacttttttcttttttgtataaacttccttttatttattttattttatttatttttttgagacagagtctccctctgtcacccaggctggagtgcagtggcgcgatctcggctcactgcagcctctgcctcccaggttaaaatgattctcttgcctcagcctcctgagtagctgggactacaggtgcctgccaccatgcccggctaatttttatatttgtaacagagacagggtttcatcatgttggccaggtcttgaactcctggtctcgaactcctggcctcaggtgatctaccggccttggcctcccaaagtgctgggattacagatgtgagccactgcacccagccttaactcccttttaaacttaagtttaatctcatcctaagaaacaatattcatgaaatcacaggtttgatgtgctaattttatttttctaatacttaccaaaataaatgccaccacttaacatagaaaaaattgttcccatgtgacctaaaatcattcctcagtcacccctgaactggctagtagcgagcatatgtggagcggtggtgagggcaggatagcctggttataggaaacctcagaatagaaaagacctgggttcaaatccccactctgccacttactagctgtgtgactttggacaagttgtgaaacctctctgagatttatttcttcatgtaaaatgtcaccgataatgataactcagtggtgtaagaatgatctatttaagattctaggcagagtccctggcaggcagtaagcactaaatagatgacagctatcattaataatagcagttatcataatgaggtcatgtgaagacccattttctaacctcagctacatgcactgctggccagtaatttctagataccctaggtggggatattgatggagcataccccatgaggctgagctgccaaggcattcatcagttgtaagtccattttttagcaggatcctcagaccctcctctggtcatgagggagtgatcagaggacatctcagggccacgttgggccatgaggtcctttgcatcctgtccttgcccatctcagcctcttgtttttaaaagttgttccaaaccttgaggcccggttgtaggggaggagatctcctttctggcctttgatttggaaaaatggtttttctgatgtcgggaacaagcagtagggtagccactgtttaaaggagggtgtcagccaggacacggaaattgctgttgcccctgaatgtgtttctcagggtggaggaactctcaggccgtactcttgggtgcatttccctaagggtgcatccacacagaaactcgagctccccttccttccttcccagtcagcccggccagtccacatgttccccgggtgagggtagctccctcccagggtaagcgcttctctctgaggagcctctggtttcttcctgcaacgtaagccagcgtcaaccctcaagctgccaaactggctttttcaaaaacatttctgttttcacccggcatgagctcatcggtcggcaatgtccgtgtggactaatagcaggctagagaggatgtgccctgggcaccccccgccctgaaccctgtccttaagtgtcagtatcatcttaggagcagaggctacaaagccaccttcatcttcaggctgccccattgtcctggcacgactgtgttttgatagcagacagctttggaggatctcagaatgcaaacccagcaaatcacttctgccactggcacctcgcagcccacgagaaataagatccagctctttgccacaacatgaaagggacaagagaattactggcaaacacggtttttaaaactccaaccacatcacaggagagcgccccttgctctccacctcgatatggtttccgtgcatgttcatggagcgtgttctcttgccggctcagtggtttgacagagctgggtgtttatttctgtgctcagtgtctggaaacagatgtgggggatccagcggcccctggatggctttcctttgctggggcacccaggccccaactctgctctttgggcgctcattttgggagctcccaaacggaagccctccctatccactctccttttcaccccaagtgccatttctgggtcctctcgttgtaagccctgccgtgctgttttcctggcacttcccgtcattctttagtatctgagggttctgatgtgttaatttctcaggaggcacattttcctcttaaaatgttaaaggaaataaacttaggagtggctatggtttactcatgattgagccacagtaacaagttgtttaaaggatgactgtttcaatctgtagcgagcacttggactcactcacctgcataattttttttaataatttcccgtctaaacctatcatgacctgggttttgctcagagaaattccataaaactaacctggtaaattcatgttgtcactccagtaagcaaacttgctgaagttgacaataaaaacaaatagcaatgctggctgaatgttcgccatgtacctggcttgttgacctgtaggatttattatctcatttcagagatgagaaactgaggcccagagaggttaagtaacctgtcctaggtcacccagccagaggtggtaatccaggactggaggcagaatcttggctccatgtctcgcgcttaccctcagtgctggatgttgaagtcctctctcttgttccatcccagaaaagagcaaagaataaacttgcaattccactgacagatatnnnnnnnnnnnnnnnnnnnncactatttgcaattgctaggcttcccctggaaaaatgaaagttcacgcttgagtgaaaatctataggaaccaacactagagtatacttgatgtcacactggcctgactcagtccctgagtggcagctgctgggggcagaacacacaccccaacctagaccagtcctgtggtctttagcaacccagtgcgctgtctgggtccccaggtgaggatcgccaagcccttctctggtgcctaaagggaagttgatgatagtcagtgtaatcatcagtgttctcatgtgaacaccaatccagcactcaccatgggcgggcactgtggttgctgctctgtggacactgactcctttcactctaacgctggccctgtgaggtaggaaccgttattattcttattttacagatgaggaaactgaggcaaggagtgattcagggacttacccaaggcccacttacttaactagggttcagcagatgtggttgcctcctatttaaagggggcttggctcattcctgaagcaaaggggagctggggtagcccgagcatccggagtggctgccctgcagtctttccagacacacctgtccaggagcagcctgtaaaggccagtcgctgtgctggccagaagtagatgcccccagttcagctgctgcattactgggtggccttggccaagtcactgggccgttagcgtccgtgcctgcaccttgaagtgggaatgcagtcatggagctcaaagggtgagacatcggggagtgcgctggggttaaagccctggatctgaggaggggccttcttcctttttcaatcaccatctcactccactgactcttccacaagaatccagccctgggctatgtgtcagggcggccacttcctgcagaggcggatgactggcggtttcagcgctgggctcaactggggccacttgtctgagggacaaaggggttctcttccaccccggctggaaatagaaaagaatccctgccattgagtggctgcacactcgccctgggtaatcacctccctcaccagcagggcagtctgctcccttccgactctgcatccggccggccgggctctgcagtgcaggagggaaggattgcatctttgtgctgggggcgcgacccttctcggctcagtcactttccacagccacactggccagcctggccgagaaggaagagcctacatcttctctttctcttttgttcgaggagggcagctcccactgcagccaccccagagccagctaaccttcagagagcttcctgggaacacacaagcacacacgactggccacacagcagaggccactgtgctacagatggaagatcagatgccagtgtgcgttccttcccagcacagctttaaatccgcctggcctccaaggggcccttcaaagagggtgcatgtctatgttttagcccaccaccctgcagcccactttaggtgttttgaaataaaagcaatcctcacactcagagacaggcctcgctttacatttggtgtcatgctttctgaagaggtgcatctgactgtgaggtctacagagcaatgtcctaggactgtgttctctccccaacttccatctttaacaacctgacagtgcaaaagaaaagcaagctatgtccgaaacagacatcatcttgttattgcaggccctggagacgatggatacagggaagccatttcttcatgcttttttcatcgacctggagggctgtattagaaccctcagatactttgcagggtgggcagacaaaatccagggcaagaccatccccacaggtgagcaaggtggattatagcttcatttgggatccctttggggctatatcttttcattaatccagagccccccctgactgtttccctaaggcaccattcccaaccccactccctctccaaatggtactgccaattcttcttctaagaacttcacttttaaagttgaggtcaaatcacttctctgtataatagacaagacttgaatctggcacccttgttggtttctttcttgtctttttactacttgaagttcctaacctggactaagtgagtgtgtccttccccaccatgtaaccctcttccagatgacaacgtcgtgtgcttcaccaggcatgagcccattggtgtctgtggggccatcactccagtaagtatggcagcctttctcagtagattctatgtagatcctgccccactgccctgtgtcctttggaatcaatttctggtgtgtttttatctgattgcaccagcgttgaacaagcattttcttcgtggcatggaactccatgcttgggggctcttgagatggattagaccccatttctgctctcctaagaccggctttaggcatgccacagaaagcactgtggttcccagccagagtggtcaggaatggccagcattcccaggaaggtggtctcttagctgggccttaaagataagaaagacttgttcaacaaggaaaaggattttccaaggagtgggaatggcctaggcaaaagtgcagaggtggctgggctacttggaagggaacagcaggaaagctggtggggctagagctcaggcaggagcaaaagtgaggaaaagggtgagcacacgtggcaggtggtgtgggccagcttccagcagctttggctgctaaggggccgggactttattcattgggcggtggggatgcttataggtgcccaagaagtgcaacaatgctgcctgtctgtttgggaagcctctggccattgcaacaacagccaggcaggaagctgaagagccaggtggcaacatgaagtgagggttcaaaaagtgcccatggaggcagggaggaggacacgtcttcagcagatgttttagagggagaggtagaacacatgcaacagcatcctctttgcaaaggctgcctattagtaccacccagaatgcagtttaggaagtgctgtgcaggattgcagttctgatcattgcacactcctatgttaccccacataccccaaatccagaccatgaaaagcaagtgtcctccacaaaggcatcgttgagcacatgggacagggtaagagggtggatctgggcctccaaagcccctgtgctctgtcgcagtggaacttccccctgctgatgctggtgtggaagctggcacccgccctctgctgtgggaacaccatggtcctgaagcctgcggagcagacacctctcaccgccctttatctcggctctctgatcaaagaggtgagacatccaaaaagaaaatatcacatgttcttggtaacattcccactcctaggaaccaggccaccgtcacgagatgggacagtggcagactgctggcaatcgagtgggaagggaatgacttccagtgttttgtttggcgactgcacgttctttctcctgcttgtggccactgagctggagaaactccattcctcccagtggtcctaatgagaatgcttaactcttattatgggctcaaacctatggttgaggacccagtggtttgtctagagaattttcagggggggtcaaccaagagggagccaaatatttgggaggttctctgggatttgcattctcagtttatgaaatggtccatttttctctggagaggtggcctcgtcagctctagctgggcggctgcagcagtccgtgtgccgggtccctgctaatcagtgccctctgctctgaatgcaatctcttctccctcaggcagccagaacttagggaaacagaggctcaatgggacacctccttccagacatacctttagtcattccatccccaggttgtatggagcaaagatttagagaaagcaacaggaagcaaagagggacagaagaaaagatccattcctttctcttcttagtcgggctgatatgaccggcaggcaggtccacagttgcttagaagcaaggtgggaacagctggtgatgagccaagtttccactttcctttggtgatgtggggcataattaagtcacactggtgagacttaggaatgtgaaaatcccaactgttaagaaacagtgcctaaaaatctaaagactcaagcaccgtgcctaaaatcttgattttctgaaataatgtgttctaagtaagactcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggaagcaaagagggacagaagaaagatccattcctttctcttcttagtcgggctgatatgaccggcaggcaggtccacagttgcttagaagcaaggtgggaacagctggtgatgagccaagtttccactttcctttggtgatgtggggcataattaagtcacactggtgagacttaggaatgtgaaaatcccaactgttaagaaacagtgcctaaaaatctaaagactcaagcaccgtgcctaaaatcttgattttctgaaataatgtgttctaagtaagactcagcacaggtggggaagagcatcctccacctcgtttgttttgtgttctcgcctgataaagaggcttagtatatgaaaaacacgaggcatgaacgtgaacgagttggcagtccctgccttccagaagggcttgctccaggtgagacccaggttgaacaagcaaagaactttaagggagtgataccctgtcaccatttggaataataacgggtctgattaaaaaatgaaaactgggctcacgcctgtaatcccaggactttgggaagccgaggtgggtggatcacgaggtcaggagatcgagaccatcctggctaacacagtgaaaccccatctctacttaaaaaaaaaaaaattagccaggcgtggtggcgggcacctgtagtcccagctactcaggaggctgagacaggagaatggcgtgaacctgggaggcggagcttacagtgagccaagatcgcgccactacactctagccagggcgacagagcaagactccatctcaaaaaaaaaaaaaagaagaaaaaacaaaactgaagctcttggcagatattttgcaggtgcctctgatcctgggcagggcattctgatcaaggtacccctctccccttaacgcatacacacactctccctcacacacacacacaccccacatggaaaggtgctgtgctacaggcgggccatggccaccttgaagcataaccacacatttgcactgcatatcactttgggatggggtccccccccagaaggagaagtgggcatctccccttgcccagcctgcacactgggctggcagcaggggatgagaagcccaggtcagctcccagggtgcccacggtcaactgcttctgggtcctgggtaaatccagcccggcccgggttccctgtggggatgtgaggcagccacggctctctcggcccaaatgtggatccgtggtggatgaagtccgttcttcttcaagtgctatcttgatttcttcccaggccgggttccctccaggagtggtgaacattgtgccaggattcgggcccacagtgggagcagcaatttcttctcaccctcagatcaacaagatcgccttcaccggctccacagaggtaaccctcctcacagggtgctggggaaagtgaaaggggcgtgttatttgacacctgtgagcttttcctttgacaggctttaatatgatttgtttttcttctaaatttgaccatgttttagtacataacaaccagttaaaaaaagtcactggtctagtttccaaactaaataaatatctaatagaactcagaagccttagaagaaaagattgagagataagataaagtagaaatgtaaaatattcatctgtcaaacaccataattaagattaagagataaataacaagctcagagaaaaatagtcgtgatgcatgcagtgctccaagaatttatatccgtcatatgcaaagtgctcctacaagtcaatgaaaaaaaaaaaccaaactgaatggtagaaaaatgggcagttcagagaatagaaatacgacgtgcccattaagcttaaactagtttgctggtaatcaggaaaatgcaaattcaaacaaaatcagactttccttttgcctgccagattgctaagaactgaaatgatactgctgagaatatggggaagcaggtgctcagcgacacttgccctaagatgcacagtgttttggtagcactcatccaacatttaaagtgaaaaacttttcgattcagaagctccatttcaaaaaaagaaaaaactacttagagaaattttctcatgaggcttcagggacatattttcaaggatattatattcattctctggaatgttttacagccgttacaacaaggaaagctgtccatgatctattgttgaagcacaaaacagcaaacggtagaaaattacccacaatattttcccattcgtagaggtgtgtgcttgtagaagtagaaattatctggaaggattcccaagaaatccttactgatggccacctatggggtgggctcggggcagagccggagggaagctgaaggctttctccctgtaattcacatacatctctatgtggaattacttttaatgagaaagtatttcttctgtacttaaaaaagaaaaaaacacccgctgcaatcagtgtccccatccccctccttagttagtccaagccctggtggatgctgttactctccttggggacagacactgccctgtggatggattccagacctcattcagccatcacccatgagcttgctgatgtttaaaatgcgctcacaccttagcattggagaaaacagtctcagacccggaagagcctgggccgcgccttgctagcttctggctctaggcctccgtgtctgcactggtctctgaggatcttcccagctctgaagttcgtggtgctgggctttacttgttgccctagataagtcaccgagtcatgctgggccagccctcccctccaggggtacagtgggcaatgggagagaccccgtgggggccttgagcatgactggtgagtggcttttctgctcatagcgcaccccttcactccctgcctgtctgcggcagcctcagtcttagagtgtgtttccagagaatcggctccttctcatccggaaggctggctgccctcgctacttctctaacacttggaggttccctcagatcacaccaaagagccacacagaaccaccgccctactgggctgttggaatttcagctgtttctagtgagaggtagaagagtcaccctgcggtccctgaagccctttaccagactggctggaccagcctgctgggctcagaaggacaggcaccaggacaggttagcgggtggcagccctgttcccagccagctgtgtgggcttccagaggctctaactcacacctgtaagtggagcggctcagaccaaggatcccaggatgtcatggtctggcatgggaggagatgctggcagaggccaggacagtgaagggacggcatcggggcctggagcgcctgggccgagagccaggtggtggcactgccacccgggcttgatcagaatgttcactgatgtttacgcctgggccaagttcagcaacatccaaggtaaattgtgatctgtgttctgtcctggaggttggaaaactggttaaagaagctgcgtcccggagcaatctgaagcgggtgacgctggagctgggggggaagaacccctgcatcgtgtgtgcggacgctgactgtgagtctctgccctcctgggctttgctggggcttcagggcatccatctgtctccccctacttcctggcctgaattcaaaaccaactgagagtaagatgtgtgcacacacagtggggacgcttccaccgtgggcatcctgcccacagtcagccagccgcagacaggcaggtggacatcaaaatgccagctttacttctagcagaaagctgccttctactgccaaaacgatatggcttgagtggcacctgagaggctgcctgtttctgcgccttagcgttaagtttacctgcctgttcctgcagagctggggtcacgaggagcaggtctggcttctcctccagagccccctgggaggagtggggagggcaggtgctgcccactcccagtcattcattctcccctccaagtcacatttcctatcatatgttttaagatccctgaagagtggaggtgctctttccttgtgtctcagacctgataaatcagaggagggcagtagcaactgatccttcaaattacccgctttgcctggttctaggcctgcacccctgccctgggaaagcaacctgcccagcagtttggggatagcttgcgtcttgacagccaaacgacacagcgttaaaatatatgctattgttggctgccatgtccacaagagggaaggaagggctggccgggcattcattcacctgctgacagggtcagctatcaaaaggtgtgacttcccaagtgccttgaaacacctttgccttaaagaatagcctcccagacctgtccacgggtgccagaaattcctgtcgtggagaacaaagcctttcacttcacactcagataaggttggaattgcaaatatccccaagaaaaatgaccctggcacaatttcttactaaggtgtaaatgactgatatcagttcctttctggcagctggctttcacaatgggagaaaggacaggaggaggacacaggctctcaggaaggaaaggggagctgggtgtgaagatggactttccatttcttgcctgggtcagtgttcccttgtggaagcaccattagtgctatgaatagcaagtggtttttggagccacacggagcatttctggcactgtgactcacatttggagtcccaaacagccaggactcctgttttgctttcctgtgccaccgtatctggatacgccacctgcactgaagttcatcttcctcctcttggggaggaaaactgcagctaaagcacaggactaattgtgtttggggcttggttttacttacgagggtcataaaaacatgctgtgtagccacctccttctcctcatcagggcggtgccagtccacaaattacatcctgacataaccagcatcccaggcaagacatcaagggtaacaagccaccattcccctgccccttcgcctcacccctagctccgtcaggagcaggaaatgagtctgttatctcggaggaggggcagttccaagttgggacctggcccagccagctgcaggggtcaagggtgcagagaggtacccccaaaccttatggtgctgtcctgctgccactgaaacttccacaaatgactcagctagataggagcagcctccttctcaaagccaagggcacagtcccttggagcagcccctgtggaattggaacggatcaccttccaatgcccagagccactgccagcctctatgcaaaggaaagctgcatttcttaagaaagcaatagtgcgggggttggtggtgatgaaaccagccaacggttgaacactagaaacccctctgtagatgtaaatgacatcccaataccattcttatccactaagcgtgtcccccaagatcttattctctaaataccctctggcttggtttgaataactggttttagttcaatgtcagctctgcaacttagtcagcccttctaagtcacacacatgatattatcttacttaataagacccttcttttactcaaggtggaacattttggcttctttagaagttctcgccagggggcctacatcaataattaccgaagtttattctataaaacattagtcctctagaaaaaggggaggggaggggagtcctctagaaaaaggcaagtgaaatggagggtgctatgactctctggacttattagcatattaaaggtactgagaagtcctgcagtcagggaattgatttaaccccaaacttggtggaccccaaaatcctttctcccttcctctctatttgggaaagtctgcaaacaaaattaatttctgaaatgcagccatcctggggcctgttttcttgtgtgggcaattagaattgcagctgtcaccagtcctgctttaacaacttaatcgcttcctctcgctctgcccgcctccctcgcccctccccctccagtggacttggcagtggagtgtgcccatcagggagtgttcttcaaccaaggccagtgttgcacggcagcctccagggtgttcgtggaggagcaggtctactctgagtttgtcaggcggagcgtggagtatgccaagaaacggcccgtgggagaccccttcgatgtcaaaacagaacaggggcctcaggtaatccccctggtgtgtgtgaaaccatggtgcttgtctaggggctgaagcaggcagtcccatggcaaccgcctacagggtccctctccgtgaaaggaatgctgacctgtcctgcccaggaggctttcttttctttagaaactgatcagaaacacaatcctgtcaggtcccgggggctcacgaaagggggcaggacacactgaggcatgggaggagggcgctattcccagggcagaaggccatctgcctgaaccctccactctccaggatgacctccctacagaaaaggggctgtaggctggctgaaggcagcagagtgcaggcagcgtgtggcctggagtctcagtcgcagcccgaggccctcaagcccacgtgggttacaggacaaggtgaaccatcagaaatcaaacaatcccagacggagagagcctggggcaggagaatgtatctccaggcagtaggaacatgtctctggaggatgagtttgggaagccaaggacaggatgaaaatgatcataaccacgagatttaatatcctctttaaaacggcacatcctgtatcactttcttactaattatgaagtgaagcagatggataaatatttaaaagagggcagcctgaccatcccatgcattattgaaatggagctcagcagtcactcactttgcttttagccaaagtcctgccccagccatgaaatttcaagtcacatgtccgtgacttacccacttgtgtctatcccgggaggctgccacttcccctactgtgacagcactgcatgtttacaggggaggctgctgtggatctgagctcagatttggccctgggttttatgaaagtcacaaaaacccttccatgcctcagtttcctcatctggagagtgggagtaatcaatgaatattatgagaatttcatggcacctaggaagtattcaattatgggcaggttttatttttaaacaggaggaagctttaaatgacaggttctccagtctaggtggcagtgagtgtctgtgcatgacatcaggctgtcctgtggggatgccctggctggggaagaagggagggcctcatggaggaaggatgcatttctggccatcagtgcccaccctccactggccccagtccacacactccgacgccacgtgaccctggcagaaagcacttcttgtggctaacattccttctcctcagtcattgcctgcccagcctgtgccccaaacccagcggtcagtgacacaaggttgtctaatggcctcggctggatttcagatctgaacgcaaacatgaccacaagtcattattgaatccgccgtgagttttaaagctaatccacaatcagtgggaaatatgtgaactgatccccatacagaagaaacttttttaccccgtcgttatttgtaagtctctttctgtggctcttttcttggcttatgcctgatgtctgagtcttgacttttgaggccagatataccgatttcttccaagagaacagatagaggcagaatgggtgctgatttcatcagtgcatttatgccaccgctcaaagtccttctgaaagctcactaaagccgtctaacctcagcatattattttagaatgctgttggggtttctttttcttccaaagtgctttttcatctacggtaataagattttactctgagaggacttacagctgtctaaatagtcctgtctgtctcatgcctgtaaaacagctagctgacctagatccgggtccacggccgggctagcgctcacaggaatgctccaaaatcattcaggtttatttggcaactgagcaacgaggcacataaacattatgcaggccacctggccgggcaggatccggcagcgtcctccgggcagagagccgagcacagccttgagccagtcctgtgggggccgtatttccctgtttctggtgttgtgccctgctgcgtcatctcacttcctggcaggtctctcttcctgtactgtaaggcaccagctgacatttcatggaggattattagatttaaacaatgtgttcctacgggctctccagggagtgtggagtttggatgtgtaggttttccacggggacccagcactgcctgcaggacaaacagggtctgccagatgacatatgcccagcagccagggaggacctgcggttgggcgaagcccctgtgtcccttttggcccctcagggaggggaagagcagctcagcagcatctggaactgttaacctgagacttggttcacccagagagaagttgagagaaccttgagctcttccgggatctgttgcaaagctgtttttgttactttttttgagtggagtacacatacacgggtcaaaccccaaaacgcctaaaaacgtctatagtgaaaggattcccgcccctcccgcccccacctttgtacacctggttcttacccttctccccacggtatccccagttcttagttcctcatgtttccctctagaatgttttcgtgtgcatgcaagcagatgaatgcaagtcctgattgcctttgttatttttacacggaagtttccatgatagtatatcatcttgcactttgtttattgttccctaaaaaaactggaagagctctttataccagtccatgggaacctgcctgattctttttcacatgtgtatggaattctgctggatgaagccaccagaatttcagtaacatcttctgattagcatgcaggtatgtgcagtcacacacaaggcctcagagtatgtgatttcacacacacacaaggaaatccctgggacagctttcccaaagtgggttgctaagtgggaacacatttctaatttccttaagtgttgctgaattaccttccatagaggctgaaccaacgtgtattcctactaacattctagaagtttgtctgtttctttaccctttccaacagaatatggatttttgcccataggagagttaaaaatgctatcttgtttcattttaatatgcatctaccgcttataataagcaaggtagaacatcttattatgtatttaaaaaccgtttgtatttcctttattatcaaatgtgctttgcgtatttttcttgcaagctgttaggcatttttcttatcacttctaagacctctttacatacatagtagagagattagctttctatgaatatgacttgttaatattttttccaagtttgttgttttgctctttgttatgataattttgcccccaccccattttttttacatactcaaaattatacatcttttcttttttggcttctgcattttgagtcattagaaggcactccaagtttgcaggataagtctcccacatataaaacttttatggttttgtttttcctggttatatctttgatctatttggagtttggcctggtataaagtgtgaggtatggatctgagttagtatttttaaactgggtttggagtttggcctggtataaggtgtgaggtatggatctgagttagtatttttaaactgggtttggagtttggcctggtataaggtgtgaggtatggatctgagtcagtatttttaaactgggtttggagtttggcctggtataaagtgtgaggtatggatctgagttagtatttttaaactgggtccatatttcatgagatgattggtcaagtggcatgcacggtttatgnnnnnnnnnnnnnnnnnnnnccaattgcaccactgggtttgcttctttttctgtttatgatcattggaatgaaaccagttttcccatctaaaaatcccagctaaagtaaacctagtaaagctttgtctctcccagccaaagaggagggagaccagccacagatcatgataaaggacaagattcccatagatttcaggaagaaggaccagtggagggggcagaaagagcattttccctcttgagcagtctcccaaaagggtgcgcttttgacaactgctcagtagcgtgttcacaagctgtgggtcaggctggtggcacagggcaaactccagccaaggagacgtctagacaagatagcaaaagggagagtctttctcatgagctgttcccaccaccaaccaaggagcagccctgccaccccacctggaggctcattctgctttgtccccaggggtgttgagtaaggtggttagcttttcttctcgcttctctgcaccatgacaggagaattccagtaactattaccctgattcacggtgccaactgagcagggcacagggttgccaggtgatacatggcacccaggtaaacatgaatttcagataaacagtaaatgcacttttagcttaagtatatcccaaatattgttttgggacatactaaaaaaaattatgtgtcatttttctgaaattcagattcactgggcatcccgtatttttatttgctaaatttggcaacctgagtagaatgtaaagagttgggagaagaaagactgtgaccacttcagacctgtgtcactcatggactaactttgctgcatggaaaagggagatagaagtgtaaatatgtcccaaacctccagaggatgagactagtctatctccccatctctcccctgctccaaagagcccagctctgtgcatcagaggaatatttgcctgcaaggctcattagttacatggatcatggcttgacaagaacatgcagagggaggatggctgatcatgttgaaggccactgaaaacatgagatggcagccactgcccagaaggaagccaggctgtacttcttgtttgtgtcttgcagattgatcaaaagcagttcgacaaaatcttagagctgatcgagagtgggaagaaggaaggggccaagctggaatgcgggggctcagccatggaagacaaggggctcttcatcaaacccactgtcttctcagaagtcacagacaacatgcggattgccaaagaggaggtacaagagggctgtggcaaggctacgacttgcggggcctttcaaacacgagtccttccctagggcccagggatcccagaaatccttgtgatctgagtgtttttttgtttttgttgctgttgttgtcgttgttgttttttctgtgtggtctttcccctctcctttggggtccctagggaagccgttttgtcctgcctctggcgaactccaagcatgatacagcaggtaccttgtttgttctagctagttttcactcatggctcaccctctctgggagcagcaagccctctctgattttctaacacacccggtccccgagtcagtcatgcagccgcaggtggagaactgttgccacctgtgggttttgccaggaatcaattcaagaacctgtggattcagggcccaaagccgccttcagtgcccctagactgaatttcaagtgttcactcaaggaacatgtcacagctggaatttttattgacattttccaccacggacgtcttgaaaatgagggaaattaaggagactcccccactcccataagagtgtaaatctttctctttcaactccactgttacactagacgggaactggttcccacacagcatttgtaagaggcgagctggatcccaggaggttagaccctggaggtggtattttggggcacataaaaggatgagtccctgccaagggctttctggggcaggtatttcagaggcgtcttccttgagattgttatgtgccgtgatggcatgaagctcagctccttaaacatccctgtgacgagaggtcctggggaacccggaaggtattttggcaggccaggcaccatcctgccggcttataattatgtctaatattgaatcaattacaagctcccttcaaaatcacctttaaatgttcaagccttagttcttccatttccttttctttgctgtgtcacaaactgtggtgaatattgtgtcattccttcccctggtagttattatggaaacgttctagggtgtcttccttggtagaaaacacagctccaagaggtaggagcacagtcttacaaagtgcctgcagatatccttcaggacaactccgaaaaaagttacctaaaggttttgtgttctgtgcatctatgggttactccaaggctctctggctgggtttctcggaaaccctgatgacaacaagacatcttaaacacaacatatattttttgttattattttttatttttgtttcatgttaatccttcccttcagtctccaatggcaatgcagctgaagcaatgtttggacgttctttcttctctaatcatcgtttttcaggcatgtgtgtgctctgggcatatgaaaaacatgtaaagagaaggaaatgcttgttcacagcatgcatttccattcagtcatgcctctcattgccattcttgcaattaatcatagattttcgggccagtgcaaccaatactgaagttcaaaagtatcgaagaagtgataaaaagagcgaatagcaccgactatggactcacagcagccgtgttcacaaaaaatctcgacaaagccctgaagttggcttctgccttagagtctggaacggtctggtgagttgactgtgtgtgtatttcagctctcctgagttgcttcttgctaagttcattattcttctattaactgagagtttctcattgtttacattgtatattatgtaccaagccctgtctcagtgcttccttccatcctcatgaccatcttctgaggtagctgccattatgtctccatttcagagatgagaaaattgaggcacagagagatgaagtgacttgcccagggtcacacagctagcagatggccgagagggctccagtacctgtgccggtggcccctgtgctgtactgcccctccaactttattttccattctgattctaaaagcagttcatgcccatctgcaaaatgtggatactagtctctgcctcatcagtaattctgcagattatgttttgtgatccccatattaaagattaatgaattgaggctcagagaggttgagcaataagcccagaatcatataaccaggaagcaggagaacttttgggtcagttctgtctcatttcaaagctaattcttattcctctacaccctgatttttctttttctttctttctttcttttttttttttttttttttttgagatggagtcttgctctttcccccaggcaggagtgcagtggcacactctcggctcactgcaacctccacctcccaggttcaagcaattctcctgcctcagcctccccagtagctgggactacaggtgcacgccaccacgcccagctaatttttgtatttttagtagagatggggtttcaccatgttggtcaggctagtcttgaactcctgacctcaggtgatccatccatctcagcctcccgaagtgctgggattacaggcataagtcatcatgcctggccctctcttcttttttctccccttatcatttcattcctatcccaatgaaacacactctgtacttgaggatttccaaattttagttgctgatgagaagaatgagaagacaaaagttgagagcaccctgtgttttcatcaaggaagctttggcaaaagactgtttattagacaatgccctgcactgggggctaagtggctgcagtgccaggagccagggggacttctccagatgactctgagctttcttccattcttttctaggatcaactgctacaacgccctctatgcacaggctccatttggtggctttaaaatgtcaggaaatggcagagaactgtaagtgtttccatcattctgagcctgccgtgggctgaacactagatccactagatttgcaggcagtgacacaggctccaatctgctgacaccccgtcccccccacaccgccgctctgtctgggccagctgtgtccctctagggttggtggggacccatcccttcctctctccagcccacccttcccacttacatcctcagcctgcccccctccaggcctcggcttttgtgtctgcccagcagccatcatgctggggacattcagtggatatttgacaaaagctccctggacggggacacaggcagaactgaaaaagtgtacttttgccagatgtggggtgtcattattcacacaactccccactcacagcagtgaagacaggtaaggctgacccaggtaaggctcctacctgctgggtccttttttctgagcctagtaggggacctcctcccaggaggcatatgacaacacctcctgctgggcctctgcggccctctcagtatatgcaagcctactgcaaatccctccacatgcgtgtgcaaacccactgcaaacccctccatgcgcgtgcaaacccactgcaaaccctccacgcgtgcatgtaaacccactgcaaacccctccgtgtgtgtgcaaacccactgcaaacccctccacatgtgtgtgcaaactcctcagtgtgtgaacccactgcaaactcctccgtgtgtgtaaacccactgcaaaccctccacgtgtgcatgtaaacccactgcaaacccctttgtgtgtgtgcaaacccactggaaacccctccactgtgtgtgcaaacccactgcaaacccctccacatgtgtgtgcaaactcctccgtgtgtgtaaacccactgcaaaccccttcgtgtgtgtgcaaacccactgcaaacccctccactgtgtgtgcaaacccctccacacttccttttttgtcctgcctgctgggaaaatgagttccctaggtttagattaatgggtggaacttcttgcgtctggcccacacccagagctggctagagcaacccgggagtggagatgtgtggtttccagccggacactgtcttctctccccagctcaggattttattagcctgtgtggacaaacattttgtaggatcagtgttcccaaggaaccatctgtgacaacaccccaggttcctgggacatctctagggacccaaactcttccttttatttcactagtctgtcctatttatatacaaatgtagtcccttgtttgcacttcttccagcgggaacagactcaaacgcttcccctcaccttgggccttggttggggcctttttgtggctctcttttgagattcttaaagatgctgtgaagggatgggcctggcttccatccccaaacagatgttcttgaccagtctatgtggaattggggtcctgtccccctcccacctcagtcctgctttgtagtccatccctgactctcagcaaatactccaaggcgtctgcacttgtgagtgaagcctgtccattagccttcccccttatccctgtggctggcttcgccttcagcggacatcagtaattgttgaccatgaaacccctttgcagaaattgcatttcctccctctagtggcctgtttgcatttgagttctgtgagcccctgcttcatcacttgttacacctgcccctccagggacaggcagccagggctggggtcaccagggtcccctcttgggccctccaacagcaacagtactggcaacagctgggatttgctgagcacagactctgcagcaggctcggttgagctctctgtgcctgttccttcataccatcctcacgcccatccatgagatgggtccagctgttttcagatgagaaaatggcacaggaagctggtaagtgacagtcagaaatgaatgctggcagcttagtccttggacccaccgcagtgcaggaccttgctcaacagggatcacccttgtccgccacctgttcatgaggccacccagggtttgtgtggtcatttgtctcctttcatctgctgccttcaaccagctgggtcattagggctggggaacccagaccccacacagtcctcctcccagaggccagacacagcctcacgccacagcaaggactccagtccccgaagcaaatgtccctgggcgtagaagctgcagggcccccaatccctggtgtgtactgctttgcactggtgattcaccctcattgcaaccttccctcttgccaccctaacagtgcttttggctccttaacaccccctcgcctggcacagagcagggcttggtgaggactcactggacacagcccatgtgtcctcctgccagttagcctccatcgggacttttttgaatgtctgttttttaggcccttggcctatattttctcaaggcttttgataaaatatttaaaaataattcacaaggagcctagaaactgcctggaaaaccaatttctgtcttcagttgtctctaattaatgtcttcatgttgcaagaagttccccttttttaatgctggagcatcgtgcgggggattccatggttttccccgtccccggccacctggactgggctggcttctggccgcccacccacgggcccctccgggagctgtttctgtgcgggtctcaggatggagcctgaaattcctcttcctcctgggagcctttcttctgaataaaaatgatatagtaaccaaaaaatctacgcaatagagatatggaaagtcaaggcttccctccctgaccttcagtcccatttgttagaggtaaacgttgttccatcattcatttgctcattcattcttttgttcacttggcaaatacttcttgagcatctttgattcaccaggcatgatgctaggctctgagcatactgcagtgaacaacacagccaccagtccctgtgcctcctgacattctggtgaggtttaacaggagtaaggctgggctcctggatagctttgaactgcaaagtggttgagactggctgagaatccattgaggagatgtcccactgggttgaataagagcagcaagaatttgaaccaggacagcaacttcagaaatgaaagaatgagaggagctctgtattgattcttaaaggaatgctgtaatcctactgcatgtgttagttatgtgttaattcaatctgatttcatcactttgtttgcgtttcttttctttactaacttgataaataattattggctttgaatttttacaatgcaacattgtattctcacttttagagtgtattgtgcattttatttgcatacaatggatttatatatgtgtgttcttttctgttttcaaatgaaatgggagcaagctacatttcgttattgagactgggttttggatatccttccgttctttttattgatgatctcctatgaggaacttttgtgtatttccaaggggttctgctattacaaaccatgctgatgtacttccttgtgcatacaagtggaagtatacacttgtgggagattgttttcagaataaattactaaaattgagtaatctgccacatgaaaaatgggctcaccactgttttggttacatttctttaatcatgatggcattgagcaccattttcacacttattggtaattcatatttctttttctgaaaactaactattcctgtcctttgttgatttttccatttgggtatttgtgtttttcttgttggtttgcaagagctctttgtatattaaggaaaatcacactctgattttcacacagtgttgtaaattttttttctagtttgtcatttgggagtttttaatggagtctctgctctacaaaaatagaatttagcattctgtttatggcttttatgttttgtgttttatttaggaaagattataaaataattcacttattttcatgggttctggaactatttgttttaggaaatgacctaaaaatctcaatggcacctaccattcattttctgcctaacacatagtaggggctctacatgattatctgtaattgttataattacaaggaggtgatggttttcctatttgatagttgatgaagttgaggctcagggaaggcaaagaacttacctaagcaacatagttctaagccagtggttctccaacttgagtatgcatcagaatcacttggaggacttgttaaaatacagatgtctgggccccaccatagagtttctgattcagtaagtttattagtcttttattgctcctgcaagaagttaccataacatcagtggcttaaataacataaatctattatcttatagttctgtaggataaaaatctgacacaggtctccctgagctaaaatcaagggcttcattcctttttggaggttctcaggagagaatctacttccttgccttttccatcctctagaggctgctcgcattcctaggctggtggccccatcctccatcttcaaagccagcactgctgctctctgaacctgtttctataatctcattttgctctgcctctcttcttctgccagttttggggacccttgtgattacactgggtctgcctggatgatccaggagagtctccctcttttaaagtcaattgattagtaacttgaattccatctgcaacattaattcttcactctgtagcccaacatattcacaggtttgggggatccaattttggatacctggggagatccttattctgcctacgatagtagggctgggggaggcctgagaatctacatttctagcaagttcagaggtgaggctgatgctgctggtctggggaccacactttgagaaccattgatctaagggaggagatgggattctgtcacaggtctttttaactacagagactccagtggccacctctaccttcatctcttcctaaacaagcacacatttttcttcacctgacagcagatcaagcgcttagaaggatttaaatctctccaaagctgcctcttgggtcttggaagggaagctaccctgaagacggcccatggtgccagggaaggatcacctgagccctgcaagatttaaagaaaggaactataccaaggatgtgaacccaaaagctgtggcctccccatgtccactctgtgctaacgtctgcttccctcatgccccctaggctggcctcactgcctgacagctggtccccagctgtgcactctgaggccagcttcaggcccttggtgttcttcccactggtcctctggccacatccccagccaatagctttgggcctctgcctcttctgtctcctcttcaagcagctcccaattgccatctaaaagttatcaacccagtgtaatttctgcccctccctcgttcacagacaccccaccgtccaccaggctctctcgttttgctctctattgccaccccagggaattcacctctttactttttttaaaatccccttcattctctaaagggaaacccttagtcctggccatttcaaaagcatcacacagaagaagaccttgatatttacatttaagtcacatatgcagctactgacacttactagtgctgttatagtcctggctattattccatgaggtcgtcacattttaaccttttgcataagcctccaacggcctgatggaatgatgaagcctcagaacagtttctacacaatggctaagggatgtacccattttgaattttcctcttttctgtgatcacagaggtgaatacgctttggccgaatacacagaagtgaaaactgtcaccatcaaacttggcgacaagaacccctgaaggaaaggcggggctccttcctcaaacatcggacggcggaatgtggcagatgaaatgtgctggaggaaaaaaatgacatttctgaccttcccgggacacattcttctggaggctttacatctactggagttgaatgattgctgttttcctctcactctcctgtttattcaccagactggggatgcctataggttgtctgtgaaatcgcagtcctgcctggggagggagctgttggccatttctgtgtttccctttaaaccagatcctggagacagtgagatactcagggcgttgttaacagggagtggtatttgaagtgtccagcagttgcttgaaatgctttgccgaatctgactccagtaagaatgtgggaaaaccccctgtgtgttctgcaagcagggctcttgcaccagcggtctcctcagggtggacctgcttacagagcaagccacgcctctttccgaggtgaaggtgggaccattccttgggaaaggattcacagtaaggttttttggtttttgttttttgtttttttgtttttaaaaaaaggatttcacagtgagaaagttttggttagtgcataccgtggaagggcgccagggtctttgtggattgcatgttgacattgaccgtgagattcggcttcaaaccaatactgcctttggaatatgacagaatcaatagcccagagagcttagtcaaagacgatatcacggtctaccttaaccaaggcactttcttaagcagaaaatattgttgaggttacctttgctgctaaagatccaatcttctaacgccacaacagcatagcaaatcctaggataattcacctcctcatttgacaaatcagagctgtaattcactttaacaaattacgcatttctatcacgttcactaacagcttatgataagtctgtgtagtcttccttttctccagttctgttacccaatttagattagtaaagcgtacacaactggaaagactgctgtaataacacagccttgttatttttaagtcctattttgatattaatttctgattagttagtaaataacacctggattctatggaggacctcggtcttcatccaagtggcctgagtatttcactggcaggttgtgaatttttcttttcctctttggggatccaaatgatgatgtgcaatttcatgttttaacttgggaaactgaaagtgttcccatatagcttcaaaaacaaaaacaaatgtgttatccgacggatacttttatggttactaactagtactttcctaattgggaaagtagtgcttaagtttgcaaattaagttggggagggcaataataaaatgagggcccataacagaaccagtgtgtgtataacgaaaaccatgtataaaatgggcctatcacccttgtcagagatataaattaccacatttgccttcccttcatcagctaacacttatcacttatactaccaataacttgttaaatcaggatttggcttcatacactgaattttcagtattttatctcaagtagatatagacactaaccttgatagtgatacgttagagggttcctattcttccattgtacgataatgtctttaatatgaaatgctacattatttataattggtagagttattgtatctttttatagttgtaagtacacagaggtggtatatttaaacttctgtaatatactgtatttagaaatggaaatatatatagtgttaggtttcacttcttttaaggtttacccctgtggtgtggtttaaaaatctataggcctgggaattccgatcctagctgcagattgcatcccacaatgcgagaatgataaaataaaattggatatttgagaaacattgtgctttttcatttaaagaccaaagtcatttgaattcgatggcaggcctttctctttctgagacctgtacgaaatggctgatattaaagcaggatcaataatgtaagcataaaattacatttgctcagtcagtcgggcccagtgctttgcctgagtgtgaaacccatttctgtgggcttgggggttgaccaggcaaggagctgggcctcagaggttccatgtcatagctggctgagtttcagctgttatctaagctgcctgagtctccttttatcataaagtagtgatggtgtcagtgtgcgaaatggtggggaggactgcatgaggattgacggacagcattgtgcccctgacggtgagcacaagtgtctgtttttgtcaccttttcctctagagaaatctagaggatctagagaaaggatcaatttgggttttactgacctcaagtttctaaagcttctaaccaagaagcctcaatcaccccgttgtgagctgacgctgccattggctcaagatcattgctggtactggggtatgtcctccaagctcatcccttgcatttgatgtggaaagcccagatcattttgacatgggtggcaaagcaccaccactttaacaaaaaagggaggctgggatcagatctctcgtaacatatgcacttatgttaagagaatttagacacattatttagagacatcccatttctcaatccaaatgtgagcaggaaactgtaggagaaggatattttccctcatttggtgtcccggaacatgactccctgaagggagccattctggggacaattggagggtgtggtatgcgtgtgcacacatgcatttgtgtgcctggtgtgcgtgtgggggttggcacctctctagaagtggaccctttgggatgtcctagcttctcctgctggtggatgaagcctttctaatggctttgctccttgctcctaggcatgagcttgaagggggataatgaagggcgtttaggaagttgctcaaggaagactgtctgaggaaactgcgtactgggctgaagaaagacaaccggaaaacactgaaggagcgctcagccactgcaccttcaaaaaggcagaaaagtcagttcagggaggtgcctcccagctaccccacccgcctcaggaggggtcattccaacctagggtgctgagaatccgggtgggattaccagcaaaagctagagaaccatgggtcagcgacccttaggaagaagtggaaaggagtcttaacttacctgcaataaccttcctatgcgaagctgtggctaacgcatgcctaatggctagaattaaatgctgggaatataacgagctcagcacaggttatccgcgtgtcagatgttcctgctgtcttctacagtggggacatttcctagcctattcccaggctcctttagaagggaagtggaggtgccccatcttcacctgccgcgtcccctccagcgtctgcccgggccctgggcctgcgctccctcgcggtggcgccaggtggcggggctgcgcgccctggaggagctgcaccgccgtcgcggggctctctcagcactgaggacaccacgccctgcaaattgctgggaacttgtcggtggcaatcacactgctggctcctgcaaactggtgtgaggccctcaggggtgagaacaggattgcagaactgcgctcacccttttggaaagtcgtccagtggcagaagtagcctcccaggagcagagcgaagctgctcggtggtcccctctccaaccagggacccaagaagccgctcaagggaacacggccccgcggcgtccgggaggtcctgcaggagccctgcggctgcccgggttctgtgaaatggcagtgagggtgggggagatgtgcgctaaatcctgggaacgtgcgagtcataactttccaggagaggggcccagggcgctggtcctgcagggcgtggaaccctctgctcttcctgagcaggctttgtccccgggtcgaca

SEQ ID NO: 15431 - DNA, 24393 bp, Human
agaagaaaacaaaagtcactcaaaaactaagcattgtaaccatctttgggtatatccttttttaaaatagatgtggggggtgggggcaaaatgggataattcgaaataaactgtctagaaacctgcctttctcaccccaaaacaaggtgctctttctcgtgttcttacgtggtctttttgttacatttccacaagtttggatggaggacagagaaaagtctcagcagcccctctgttggtttctcttttcttctgataaaattatggaatgtcttctccacgctgccctcatcccacgcccacagctgtcccgagggcagcgggccccactcctgcatgttcccagcaccccaagggccagtgccatgctgcatggtctcgctgcggccaccctggctggggacgctctgcgggacacgcgcacagcccagacgccctggcaggcttcctgcacccctgctgccctctgtaggagctgcctgcctgccccatcgctgcttcaccatccctcctctcctccccttctctgctttgcaggatctcacccaaggtggcagaaggaggccttctggagctgacccacccccgacgaccatcaggtaacgtcaacagccccggtaacaacatccatgagtggagttctctctcttaaccaggttggcgaaaagcactcttgcagcgattacagctgagttttgatgcaactctacaagccagaggggattgcccccattttatacatggggaaactaagcacacacaacagcagtacttggtagtagtattgagtagtagtactgagcagtagtactcagctggtagaaggcagaccggagatttgaactcaggactagtctcagcccaatttcctccactgtactgtaccccacgctgcccctggaaataaaaaggtaagaaggctgcagagtgtcagtagaatatcttagggtgattgaaggctgaaagaggtcatctaaaccagtggcccttagctgagggccagggctgggctaccagtataagaatctcctttggcagagcttgttaaaagtatagactcaggacttcctgcaacccagtgagagatgtaccagtgtcatcctcattttaaaagataggggcacacagaggttgagtgtacttaaggtcacacagctcaaaagtggtaaagtcggggcagggtgcagtggctggctcacgcctgtaatcccagcactttgggaggcggaggcggaggcgggtggatcacgaggtcaggagatcgagaccatggtgaaaccccgtctctactaaaaatacaaaaaaaaaattagctgggcgtggtggtgggcacctgtagtcccagctactcgggaggctgaggcaggagaatggcatgaacccgggaggcagagcttgcagtgagctgagatggcaccactgcactccagcctgggcaacagagcaagactccatctcaaaaaaaaaaaaaatgtggtaaagtggactgtgatcagaggtcgtaactcctaggctctgtcgtcttcacccagacacctccgtagtggggacacctttctccccattcagccacaggtggagcttctttcttgctcaccctggcgatggctagtatggccgcagagtgtgacaaggctcccaattgcatccttggaggcaaagttaaagattttatgattaagtacttaacatttcctgttggaagtttggtggcctcagatttctcctctgagcaggacatacaacagagggttggacacagatggccagagttgaagctaggccaggaaacatcgctgtgtctttggaaacaaaagtcaccttccttcctccaggagcaagggcgggtgagaggaagagggcttatagagagccttttcaagcccctagcttgtttatgggttattttgtttttgtcattttagggtgaggcaactccaaggtcctactctctttctgtgcctgttacccaccccgtcctcctagggtgcccttgagccgcaaaactgctgtccacgtggaccgggggtgacatcgcacgtccatctgccaggacccctgcgtccaaattccgagacatggcgaccaacggcagcaaggtggccgacgggcagatctccaccgaggtcagcgaggcccctgtggccaatgacaagcccaaaaccttggtggtcaaggtgcagaagaaggcggcagacctccccgaccgggacacgtggaagggccgcttcgacttcctcatgtcctgtgtgggctatgccatcggcctgggcaacgtctggaggttcccctatctctgcgggaaaaatggtgggggtaggtgctggcccggggacctcctggctgggtctggaccctgcaaaaaggatcctgcttaggcatttttctggggcaactgtaggagaaaagcccccctaaagactccagagggagcaccaggccccatttcttgtttcttgtccctttatcaaaagattcctgaaggacaattgtcctctgttaatgataccaagaaattcatctattcacctgcaaaaaatgggatgtatttcacatatggctttccttgggcctgtggttggctgtgggtcctgcttttgaggcaggtataaagaaatactggatggggacccagacccacgacactccctctaccagggcgggtcttgaaagtcttggggccacgagctctgtcttctttacctgcaggagccttcctgatcccctatttcctgacactcatctttgcgggggtcccactcttcctgctggagtgctccctgggccagtacacctccatcggggggctaggggtatggaagctggctcctatgttcaagggtaagtctgcagatcagggacctgggtggtggtgcccctgcccacacacacctcttgccctctggagagagcgagctgtctacccagaccagggctgacatcacatatccatccaccaggtgcatatctgagcagagtgagggctgttgcaaggggccaggtggcagatgacagtgctggtcagaaactagggaggtggaggtggagaggcccaatccagagtcccccgcacatcagcctgctctgtcctgttagcccatctatttcctctgcaagggctgggtgtgactttctttgcctcgtgctcagtgcctgacaggcacccaggtagatacgtggtgagtcatgctcactgaccgagggcctgggcctcacctcgtccggcaagctgagaccccagccctgcctgccaccagtctgcactgggccccagacatgagtcctggccccctggcttgtcagatgtacatgaccttcagcaagtcactgcctctctcttagcctcagtgtcctcagtaatgcctgtctccgagatcaataagattgtagaggtcatggaacatgccacgacagttcatgttaattccgtattaaatggacgcgtgtctgtgttccgctcccaggcgtgggccttgcggctgctgtgctatcattctggctgaacatctactacatcgtcatcatctcctgggccatttactacctgtacaactccttcaccacggtgagtggtccctttgaccaccccatccagcagaagccacacccagagcccacccttggcccaccacggccaccactctgctgacaaggccattcctccaggagtggggaacttggtttgtcttttgtgggccttggtctccccacaacagccatagcctcacaaatttagcatctcctgtgagacaggcactccttgcaggctcacatccaatcctcatgacacccctctaaagtgcgtattgttagcacattttatatggacacagacagcctgggttcaaatcctgactctactatataccagctgtgcaacttcagaaaagagacttaacctctctgagtctcagtgccctcatttataaaatggaaataaaattagaacctgccccagttcctcaaaaaattaaacatagaattaccatatgatccagcaattctgcttctgagtagatacctgaagaattacaagcagctctcaaagagatatttgtacactcctgttcacagcagcactattcacagtaggcaaaaggtggaagcaagccaagcgttcactgataaatgaattggtaagcaaaatgtggtctatacatacaatggaatgtaattcagccttaaaaggaaggaaattctgacgcatgcatcaacatggatggaccttgaggatattatgtcaagtgaaagccggtcacaaaaatacaaatagtgtttgatcttgcttatatgagttccctagagtaatcaaatttatagagacagaaagtagaatgatggttgccaggggttgtgggtagggggatgaggagttgttgtttagtgggtggagttgcagttttgcaaaatgaaaaaagttctggagctggatgctgacaatgttaggcaatacatttctcacaatgtactcccattgttaagtgacacatgactgtatttgcagaggtgtggcagggttcagggagctacattatgggtatacttaatgcttctaaattgtacaggcaccaatagttaagatggtaaatgttgtgtgtattttatcaaaattaaaaaatgaaagaaaacaaaaagtgaaacccacctcatagggttcttgtgaggattaaggagcagatatgtgtaaggaacttagaactgcgcctggcagagaacaagccctgtaagtgtttgctggtgtcgttgcagtgagagttagatgggcaaggtctcttgcccaaggtcacatggtggggaagtagccccggctgcagcttggaaggctgttctcacagtgaacaggttgaggttcaaatctcagctctggcacttagtagctgtgcattctcaagcaagtcactgtccctctctgatctgtcaaatggggatcataatgctacttgcctcccagagctgctgcgaaggggaggtgtgaggaggcttggggaccatgagggtgggcagggtgcactgggaccactcatgccagcccctgggagcccagcaggatgcgtcctcatgactgtgtccttgcagacactgccgtggaaacagtgcgacaacccctggaacacagaccgctgcttctccaactacagcatggtcaacactaccaacatgaccagcgctgtggtggagttctgggagtgagtatggggccatcaggggatggcagggacggggcatgtcagccagagcccggcaggagacagaggcccctcggaggggtaacagaagaggtggataaaggggctacagtcatgtgtcacatcatgacattttggtcatcagtggaccacatatgcaacgatggtcccataagattataataccatatttttactttaccttttctacgtctagacatgtctagtaccgaaatgcattgtgttacagttgcgtacaatattcagtacagtcatgtgctgtacaggtttgtagtctaggagcaataggccacaccgtatggcataggagtgtagcaggctagaccatctaggtttgtgcaagtacacgctatgatatgcacacaacaacaaaattgcttaagaacgcatttctcagaacatatccctgttgttaagtgacacatgactatacttgcagagttgtggcagggctaaggcagccacaagggatgctgaagaccttttctccccaaaaagagttggaccacagatagagccatgagacacacaaactctgacctttgatagcaaaacccagctactcacaaagccaaggtccagcaggaagaatacattccccaacatctctgcctctaatctcctgccagctcctcccaatggtcaaacccagctagaagccagagggcaggggaccagataatgtggccatagtcgtcagcatcctggggcctggcacagagtggtcaaggggaagagtggatcagagaggcaaacggaggggaataaccagcatagccaattagaatcacctggagaggttgaccacatcctgattcatcctgaaaaccagcctgatctacttacgaacctagagtcactcggaataaacatgcacacacactctggccatagtgaaggccgtgctgattgtatcttcaggggagtaccttgtagagatgtgtgtcgggggtcactgatgtgacacaatgaggtgctggggcccaaatctctctggcatgaaggaagcatccatgctggacagctcagaaggatccgggagcagtctagaaggtctcagagcaccttggataagctcccaggaggagctgttctcaggcactgtcagaatcagagttgcctgatctcttcatggccaatgtccatggttacactgtttctttacaaataaaaatcaaattctgctctggtgggttctgctttctggcatctcccgcatgctgctctcaggcacgttcggacttttcattcaaccatttattcagtaaacacttcttgatctcctactatgtgccaactgatgacaggcacggacatgcagacaggcaatggcaccaccaggcggccaatgcggagaggagggaagcccaggcagctgggctgcggggacctcagggagtcccctggaccaccccaggtcgggagtggcatctagaagagaaaactgcagggcaggcaggtgctggagagaaacagtgtgaaggctgggaggcagatgaggtcaggccaggcaccggcaaacagctgcagtgagtgctgagaggagagagagatgcaagggccttgaaaggctggccagggagtttgggcttcattctgagaacaagcgggtgctattcatcgcagtaagcagaggagtgacatgatcagacttgcaatttagaaggctctctggggctggagaggggatagagcaaaactgaaggcagggtcccactaggaggccactgggccatccagatgagcagtagtggtggctgactaaggccctggcaggtcctgttctctttgatctcttgaccaaacagcactttctactgattagtataatgggcctcacagtccccagctacctcttgaatcacggtgatgacggtgtcagcacagttctagggcggggatatcatctgtggccatgccctgggcacccctgggtcactccggctcccaccagctctgtgtaactttctcctccctccactgtttgaccaggcgcaacatgcatcagatgacggacgggctggataagccaggtcagatccgctggccactggccatcacgctggccatcgcctggatccttgtgtatttctgtatctggaagggtgttggctggactggaaaggtaagggatatatgtgcacagtggggacaggagggcactggatagaggaacaggtctacaaaggaagctctgcccacaactcccaagagtcccatccaaccttgaattaagcaggtcccttcaacactcggtgtgtccgtttcttttactgtgaaatgggaataataacattaccttaccttctggggcagttgtgaggataaaaggaaatagtgcaagtcaagtacgcagcacagtgcgaagctcacagtgagtcccatgggattccactgggcctaacagagtcatctcaaaacagagggcaaatgttgctcctggactgttgaacaaacttttccagagcatctgctctgcaccaaaccttgttctaggtgcagaaactccagagatgacagcttcacatcctgacccttgaggaacaacagagatgaataggttaatggttagattcaggctctgtattaagcagtccatgagttaagatcccaacctcaccatttactagctgtgagctcaggcaagtcactttgcctccctggaactcagtttccttctctgtaaaacggggctaataattatacttatctgttggtttattatgataatcagatgagatggtgcttttgtcaagcgctcagcacccagcaaggagagttgttattactcttgtttttattctcagcaagtgcagagcaaatgccaagctgggatgtctagcccagggacacccgggaggtggaaaactggccttactccaccttttctccctttcaagccctaccccaggagcctgggggcagaagatggcagtctctcactggccctgacctgaagggaacccggaggacaagtgtgttgtctcagatcttatggcaagtcaagggcagagaagggatttgtactgaataagatgggaggcaggaaggtcagaactacccaagaagtgaatgcaaggttctagaagcagtagtagaaatgaaccaagcagaaccttaacaaattccacacttgggcagggcagagctgatgaaaagctaccctagtttcatctagtgggaacttctggacccactgggttctcaaatccaaggctggtgtaaaagtatctctgatccattcctaggactagggacgccggaggagggcacaagtatctcccagtctaaatttcaggagcagaaaagtatagggcttatgggctttggaagggtttgagtctcagtccctgagcttctagctgtgtgcacttgagcaagccatttcatctctctgagcctcagtcccctcatctgttcaatggtcacaataacagtaccttacagggttgtcccaaagactgagggagatgagtagaatgcttagcatatgccttacacatagtaagcactcaatacatagtatcaattataatcattttggagtggtaattagagttcgtgctacattaggagactggccacttcttggggacagagagtagggccccctcactgcatatattgaggatgtcaaccaatccatccacaagcatttattgaatacctactatgtgcctggcttcatgctgaacacggaaggcacagggaagtacgagaccaaggtgacatataataagcctgcggcatgtcctgatgtgactgacctttctgagcagtaggtgtgactgtgcctgattccagacaagagaaagtgaagctaagagaaaatacaacattgaccctaagttacgcagcttgtgggtgacacagatgagtttgaattcccttttcctagctccaagtacaatgggttttctcttggattgtggctgccttccttaatcctgcagaatctcggggtcaagtcagggaggtgaagctaagccagtgaactgtccatgctgaccgggaaacaggctcacattagactctgagatacaaaggtcatcaaacttgaacattgctcttccatactagtgagcaaagaaatgcaattttagacaatgatcatcagtttggcaaaaaataattgtttaaatgatgatacctagtgctggccttgtgacagaaaggcactctctgtaatgccaggtgaagttccatttctcgaaagcaacaaggtaatatggatcaaaagcctgtgatgaatttattccttttaattcagtagttccacctctaaaaatttttcccaagagtggtataataattttgtagctgaagatttatatacaggggtgtttaatttggtgttatttagagtcacataaaattggaggtaacctgaatgcatagcagtggggaagcttaaaagagaatggtaggaccttctgagggactgttttgtgcaattaaaacgtcaaattgttcatgaggcaataaaacaacgtttagtgaacaaaatgggaaacaaacctgtatgtactgcgttttttttaactctaaacatgttacatggaaaggcaagtacctaatttgaacctcattttgtaagaaaatgtgattgcatctgcaaaggagagtttcagaggagcattaaagtaggaacatccctgcatttatgtgttcgtcagacaattcttgagtgtctactatatacggtggactgttctagacatggggatgtgaacaacacaagccctgccccccacataacttacattctaggtgctggttaaaggaactttcattttatgtgtgtgtgtgcatatgtaatttaaaagttttcctgtcaccacatgcaatacttggataatttagaagtcaaaaaataggaggggacaggggaagggaaaaaccaaatgtgagctggttggctcagactccaaggaggagcttcagataagtggccaaggagagcaaggatctgggaaggcttcctggaggcggaagaactggaatcaagcccagagccacaacagatacggatgtaggggaaatgggggaggaggaagcaagggtgtacaggaggaggggtcaccagtcacccactttcctcccaggtggtctacttttcagccacatacccctacatcatgctgatcatcctgttcttccgtggagtgacgctgcccggggccaaggagggcatcctcttctacatcacacccaacttccgcaagctgtctgactccgaggtgagtgcccctcccagcccggattctgagccaccacttagcagctttgagataagcttttgcatctttctgaccctcactgtagaccaggtttgttgccagggagagctggtgggcacatggaaaagttcctggatagctgcggctatggtgattacttttgacagtctttgataattctgcctataggtgtggctggatgcggcaacccagatcttcttctcatacgggctgggcctggggtccctgatcgctctcgggagctacaactctttccacaacaatgtctacaggtttgagaggacagctgcgggagccccttccttcctggccgagccctttgagtccacatcccacactcatgtgttagggccctctttggccactttgcactctcagcttaacctctccctgagccagtcgtttgtttaactccttctggagacacagacattcctgttgtccccctttcctgaccctgatcttctggctctgccctcctctagcttgctcttagggcctgtgcatctgggacctaccgtgtagccccattcccagccccctcctccgggccacccctccataaccacagccagcagctacaccttctgccagctgcaccctcctcaccccacccctccctctcttcagggactccatcatcgtctgctgcatcaattcgtgcaccagcatgttcgcaggattcgtcatcttctccatcgtgggcttcatggcccatgtcaccaagaggtccattgctgatgtggcggcctcaggtcagtgcaacactgtgtggggccgggctcctggcatgggggcactaaccatgctggcctttgccatcatcaccattaccaccaccactgtggctcactggccttgagcactccctatgtgccaggcaatgcactgagcattttacatggactgtacccatgattcttctcaacactttgcaatacacgctattgttagcccatttcatagatgagaaaactgagactcacctcctaagggtatggagctagaaagatggcagatctggagttggagcccaggtctggctgactcccaagcctgggctcttagtctcttggctatactagcatgtccagcacaatcctggacaatttggggagaagatccactcttgccttgggagtataaactttggtattgggggaaattcacccccgatatttcacgtaggttcttttctattttacctaagtgtcagctggtctgagaaataaagggaaagagtacaaaagagagaaattttaaagctggatgtctgggggagacatcacatgatgcccccgaagctgtaaaaccagcaagtttttattcatgattttcaaaaggggagggagtgtatgaatagggtgtgggtcacagagatcacatgctcacaaggtaataaaatatcacaaggcaaatggaggcagggcgagatcacaggaccagggcagaattaaaattgctaatgaagtttcgggcacacattgtcattgaaaacatcttatcaggagacagggtttgagagcagacaaccggtctgactaaaatttattaggcaggaatttcctcatcctaataagcctgggagcgctacgggagaccggggcttatttcatcccttatctacaactgtaaaagacagacgtccccaaagcggccatttcagaggcctccccttagggacgcattctctttctcagggaagttccttgctgagaaaaagaattcagcgatatttctcctatttgcttttgaaagaagagaaatatggctctgttccacctggcccacaggcagccagacgttaaggttatctcccttgttccctggacatcactgttatcctgttttttttccaaggtgcccagatttcatattgtttaaacaatttgtgcagttaatgcaatcatcacaaggtcctgtggcaacattcatcctcagcttacaaagatgatgggattaagatattaaagtaaagacgggcataggaaatcacaagagtattgattggggaagtgataagtgtccatgaaatcttcacaatttatgttcagagattgcagtaaaggcaggtgtaagaaattataaaagtattaatttggggaactagtgtcaatgaaatcttcacaatctatgttcttctgccatggcttcagccggtccctctgtttggggtccctgacctcccgcaacactttggctcaattcagacatgttcatcaccatactacaaagaccactaaatccatgcttttgtctcagctccaaaaatgttctcgccaagtgggccatgcccactctgctcaccacacagtcatcaatgccacagaacccaaggaaaaccccagacagcccttcgctgcacagccaggcaagcagccaacaggtggaacccactgtatgcagggcagaggcccctgaggctcatggaggccacacggctggtcccttgaagaagtgggctggttccgtgaaaggagcattctctgctccggttctaatctccccttcaagggcagccaccatctcgtttctctgcaattccccaaccattcccccacccccatccggagccagacccagggaggttacaatctctttccttctcattccgagatttcctgatctcttagacacccccaccaactactcaaacacaatacatgccaaacaaggctccaaagccttctcctccaccatgctccccatcacagaagggtcccatggtccagtgcccagggtggagacctcagcattgtcctggactcttccctcaccctcatcctgcaaaccagccaataccagcacctgcccctccatcccctacatatctctctatctggttgcctctctgcacctgcactatcctcactactggccaagccatgccatcccccatcgagatgatggccacagctcctcactggtcctcttgcctctgggcacaattactatggccccacatcccccaccctctttctgcacctggaaaaaggggctgaaaacactcactcaaaaggttactctgaagatgaaatgaaataaggcttagaaaatgggcagtgtgctggaaaggctgtaggtgatgagtaccttttatttttcttcttttttgcacttctctgttcaggccccgggctggcgttcctggcatacccagaggcggtgacccagctgcctatctccccactctgggccatcctcttcttctccatgctgttgatgctgggcattgacagccaggtgagggcgccccccccgcaccccaggagctctccatccccagactcctcagtccccgagtaaacagggagaggaggcaactcttaggctgccaagaagatgaccaaaaattccaggtccctagaatgttccactgcatgaaatttcaggaaacagctcagccaccttctccattttccagaaggggaaactgatgcccagaggggagggactctcctgaggtcacaaagtgagtcacaggcagaatcaggctggaccctgggctctcctggctcggtgctgctgggcctcccgtccttccttagagggccaggctttgggtgggttggggctggggctgctgcaggtggctgacctctgttcccacctgaagttctgcactgtggagggcttcatcacagccctggtggatgagtaccccaggctcctccgcaaccgcagagagctcttcattgctgctgtctgcatcatctcctacctgatcggtctctctaacatcactcaggtaagctcagtaagcacctggcactcccccagcactgcccagggccatgcccagggcctcctctcccctcctctgttgtatcccacctttcctgccttcattgagcatcatctctgtgccaagctctgggcacataacagtgagtcagatggggtccctgccctccagaggctcccaggctggtggagacacaaacattgagctaagacatataggacagagctagagaatgcagcacctaactggactcggagcaccagggactgcttcttggaggaggggatgtagaaattgagctttgaaaggcccacagaaggcctggcatggtggctcatgtctataatcccagcactttgggaggcagaggccggcggatcacctgaagtcaggagtttgagaccagcttggccaatgtggtgaaaacccgtctctacttaaaaaaataaaataaagtaaataaataatacaaaaattagtcaggcattggggcaggtgcctgtaatcccagctacttgggaggctgaggtaggagaattgcttgaacccgggaggcagaggttgcagtgagctgagatcgcgccattgcactccagcctgggcaacaagagcgaaaaactctgtctcaaaaaaaaaaaaaaaaaagaaagaaagaaagaaagacagaaaaagaaaagaaaggcccacagaaattagccagaaagtcaaattggagttgagcctttgaagttgacactgcccaaagctttctttcattcccatttttcttttgtattgacatgaatgagaaatgctcacatagctggtgaattgtgcaataaatataaacgactctagcaacatgagttcagcactgcgggtctgatttttataatccacaaatcacccccaccccccccccaccagatccaaatgtagttctgctccagagttagtattcattcatcccttcattcatagttgtcaaatacctactatgggcctggcatgaccccagaaatttggcaattaatgtggcagatactaccatgtctgctgtcttggagcttacattttggtggacaagactgacagacaaattagatgattttggagagtgtcaagtgccctggagaaaagaggacagcagcacagagaatggccagtagcacaggaggggcgctccctcagacaaggtagtcaagggaggtctctctctccaagaaagcgacagttgagctgagacttaaatgatgagaaagagccagccagagaaagatctggggaaagagagcagagtaggtgcaaaagccctgaggcatttgagggacgagggaagccagagtggtggaggcagagggagtgaggcagtgggtgggagacgaagaaccagcccatgcggaccttgcaggccaagacatttgggtgggatgggatgggatgggatgggatgggatgggattggatggcatgggattggattagatctctctctgcttatttatgtgttatattattgtctcatttaagtcctgaaaggttttaagcaggggagagacctgactgatttacactgtaaaaagatggccctggtgaccaactccgctttctgccctccaaccttaccagaaattggcattttcctctaccacctggacatttccttcccaatgcccggactgtcaatgtccacatcctctcgtggtcacaaagccctcagtgcttcatctaatctaccctgaagcctaatcccagccccatcagcctccagagtccatgtggtctgtgaactggatgcagtgggcgccggggacaatgcacctgttctcacctcttttcatcttgcaggggggtatttatgtcttcaaactctttgactactactctgccagtggcatgagcctgctgttcctcgtgttctttgaatgtgtctctatttcctggttttacggtgagtatcagcccctcatcccttattcattcactcattcatccattcattcctttcttgagtcatcattcaacaagtgcaatttgaaccccaggtcttctccttacatttatttatttatttattcttcacattacaattcaatgaggttagtccaggagtcccccatgtttagaagatataagagcagttaaatgaattcatttaaaataagtggagattttatccagaaaagggaaaccaaaactactttttaaagttttaaagttatatatttaacacagtctaggctgtaattaaaagtgtgcactatcttaaaacaaataacaaaagaaacattgattttgtttattttgtggcctaagtttcttgagccaactgcatgatagtaaaaaatgacaacatcctttcctgcacctttgattgtcccatcagagcaaatgtttttaaagaagcatgatattttgtgtccccctttgcaatatctgccacctcatcctccttgtcattgtcccttcttttttgtttgttttatatgtataaatttaagggacatgagtgcaattttgttacctggatatcttgtgtagtggtgaagtctgggcttttagtgtacccatcaccacataatgtacattctttttttatttttatttttatttattttattttattcatttttttgatggagtcttgctctgtcaccaggctggagtgcagcggtgcaaactcagctcactgcaacctctgcctgcctggttcaagcaattcccctacctcagcctcccaagtagctgggattacaggcatgtgccaccacgcccagctaattttttgtattttagtagaggcagggtttcaccatgttggccaagatggtctcgacctcctgacctcatgatccgcccacctcggcctcccaaagtgctgggattacaggcataagccaccaagcccagcagtacattctacccactaagtaatttctcatcatccaccccagctcccattcccccacccttctgagtctccagtgtctattattccacctgtgcccagtgtttagctcctacctttaagtgagaacatgcagtatttgacttcctgtttctgagttgttttgcttaagatgatggcctccagttccatccacgttgctgcaataggcatgacttcattctattttatggctgaatagtattccatcgtgtatgtataccatatttcctttatccagccatccacggatggacacttaggttgattccctatctttgctattgtgaataaacacgagtgcaaatatctttttgatataataatttcttttcctttggatagatagccagtagtgggattgctggatcaaatggtggttctatttctgattctttgagaaatctctgtactggtttccatagaggttgcactaatttacactcccaataacaccttctctctctaactgttccaacacggtcagatcctcactggtcagtgactctgcttataatttgagcagtgcccgaagccgctctggtgaacttcaagacaccagtttggggtttggggtttttctttttcatgagatttgcagttctttgcaattgattgtcaatttctttttctttcattcattcatttatttatttatttatttatttatttatttatttttgagacgaagtctcgctcttgttccccaggctggagtacaatggcacgatctcggctcactgcaacctccacctcccaggttcaagcagttctcctgcctcagcctcccaagtagctgggattacaggcgcccgccaccacacctggctaatgtttatatttttagtagagacggagtttcaccgtgttggccaggctggtctcgaactcctgacctcaggtgatcctcccacctcggcctcccaaagtgctgggattacaggcatgggccaccgtgtccggcagattgccagtttcttatagcatctgaccatcagggagaaacagcccctgcccaggaaagcctttgaaggaatggctgggatagatgttgagtgggagggacattgagagtggcaggggtggaggggatcatcatgtcagtctccttttgttggtagatatcttcacattaaagtgacttgctcacctacacaacccacttgctgtgagaattgggctattgaaaaatacttggtaacgaggacccccagagcataacccccatggtacagacaaggaaactgagactcagagaggttaggtgacttgcccatggtcacactgtgagaaagtggtagaaccaggctttgaccctgaagcacccacagctcatccatccctcctgctcccaatgtcacaggtgtcaaccgattctatgacaatatccaagagatggttggatccaggccctgcatctggtggaaactctgctggtctttcttcacaccaatcattgtggcggtaagaacaaggcctgactagccctgttaggatgaggctagaccaagccctggggggactcaggtccagggagaaacttctagaggcagaggcaggtgggagaggcccccagaaaccctgttccttaataatacttctctctaccatttgttgggcatctattctgcaccctgcatggtacaagacacattatatcatcctccacaaacctcagaaaggaggcattattgtcccactttaccgctgcaggatctggggctcacctagccagcatcacccagctagtcagcactgggattcgaaccaagcccagtctcttggcacttggagactctccttctcagggtccctcatccccacaagcaggagctgaagcaggggcgggcctgggaggggccacccaaggttcttgaggtgggggcagagccactgcatatgttgtgtccacataaggggaccctgccaatggcacattgggagctgatacctcacccttgctctgcttttgaagctggggaacttggaggaaggggttcccttttctaattagtctccctagaggagttgccttttcctactgatcttccctgagagggtgtctttttctattatgcacaaaggcaccttatgtgctagcagcggtgctgagtgcaggactcccaagaccttgggcctctgtaagggtcagcctcggggtgagggtggagggcagtcagcctgctggcttcagggtggttcatcctgggtgactgactcctccccctccctcccctcccctccaccctctccagggcgtgttcattttcagtgctgtgcagatgacgccactcaccatgggaaactatgttttccccaagtggggccagggtgtgggctggctgatggctctgtcttccatggtcctcatccccgggtacatggcctacatgttcctcaccttaaagggctccctgaagcaggtaagcccttccccacccttcaaattgccagtgcccttctcccactgtgtcaggcacagccccaccccttgtgaagctcacagtctagctggggaaacagacaagtcaatagccaatgacagtagagtattagagacactgagattagggaaagccaagggggtgggagcaaacagcctgccttagccctacttgggttaaggaggattaaagaagcttcccagaagaggggataacaaaggagaggcctggggataaaccaaacttaaaagtagaagcagaaagtatgtttctagaagagggaggggaggagaggttggaaagcatgtgcaaaggtccaggggtataaactgcattgggtcaactgaacggagatcagtgtggctggaaggtaaagtggaaaggggtgcgaggaggggacatgacaagagatgaggttgggatgtaagaaggtccagccagatcatgaagggctttgaaaaccaggacaagaactttgaactttatcctggcagcaatggggtgtcatgaagggcttggaacagacggagggtgggatcacatttgcccagggctcactctagatctcatttgtagggttgatatagagaaaatgtggtcttacccacaaagaaagacaaagcacaaaagacctgctgcctgcagcaggggcctcaccatcacatagggttctctgtccatgcccacactttgttaaattgcactaaattcttgagggaagcaaagaagtgctggaggtgccaggcaggtgcctcattgatgaggtgtgtgcaggctgaaaagatgccacggggagaagtggagagtcggagtgtgagggctgccccggaaggccctggatgagttgctgtccactatagttccctgggaaatgcacctgccagacccaggggaagcgctctcaggtctgagatacagggaagcctggctgcaggttatgtgctgccgtggagttactggcccatcttcctccaacctcagatgaagaaactggggaaccacaggggttgagtaagcaggttcccagctcaggaagctgtgagcagagctagggcttgcagccctttcttcccaatgcaagtccaaagctttcattttccatgatccactggagagcctcaaacagcagctgggtcttagcgtggcaagaggttaggggggtgcccttgcagaaaacagcacagcttgtgcaaaggcccagcggtaggaagggccaagacatacctgaggccagggtgtgagctgacggggcaggatggcgaaggcagtagggggtccatccattcagcacacatggatggaaccctgatgatgtgccagacactactgtcagtgctggggacacagccatgaacaagataagcagaaattgcaccctcctggagctcccattcagggagaggaagataagcaactaacaaaataaaagcacgtgaggtggcgaggagcactatagagaaaaatcaagtagacagggtgtttagggagtgccagatgaggcctcactgagaaggcgaaacatttgagccaagacctggggaagtggaaagcgagctgtcgctatctgagaggaaggctctgccagacagagggcacagcctgtgcaaacgccctggagcggaagcgtgcctgctgtgtttgcggggcgtcgaggagtcctatgcagatgaggtggatgtgcgaggaagaggggaggacactgaggactgggaggtggcaggggccaggtcgtgtagggccttgaagaactttggctctgcctcttggtgaaatgggagccttcattgggtcctgaagagtacaggggcatgatctgagtctggttttcatacaactctcctgctgctgtgttgacgacagaatgaaggggtgagaggacagcatgaaagtgggagtggaagctgagggctgattgggagttgttgcaataacccaagtgagaggggctgtggcgtggcccatgtgggacagtggcaggggtgcaggaggtggggatgtggctggagtctgggtgtagtttggaggcagagcagacaggatgcacttgaatagagagcaggagagggaagcggccagttcctcaccatcccaggctgggattttccccagagagcctcacaccttcctccccggtacccacagcgcatccaagtcatggtccagcccagcgaagacatcgttcgcccagagaatggtcctgagcagccccaggcgggcagctccaccagcaaggaggcctacatctagggtgggggccactcaccgacccgacactctcaccccccgacctggctgagtgcgaccaccacttgatgtctgaggataccttccatctcaacctacctcgagtggcgagtccagacaccatcaccacgcagagaggggaggtgggaggacagttagacccctgggtgggccctgccgtgggcaaggatacccggtggcttctggcacctggcgggctggtgacctttttaatccaggccccatcagcatcccacgatcggccttggtaaccgccgcggtagatcatttttatcccgccagggagtgtgatgcaggaagaccacatgcgctcctggcttttaaacctgttcctgactgttctcttactgccgaaacccttgactgttatctcggactttgcaggagttcctttccctccgaacgctgctccatgcacaggaaaagggcattttgtacaatggggacttcccgggaacgcttgctcttaagtaccagaagccggcggagctctggctttcgtgtttttggttttctccttcccaaggcagctggattgaaaaaacaaaacaaaacaaaaaaacccaggggcgtcagtcgatattcccagggccgcttctcctgcagtctgtggagcgtccttgtccccgccgccggaatgaatgagcattctgcagcccgatgtccctgtcccctcctcgccgggccattctgattggacctggcccagtgcaatctgtccagacaagccctgcttgctggaaaactgccacaagcacaattgatctctttttatcgccattccaggggcctcaggtcctactggggaaacttcctataccggagctccagtttctcttaagctgcccaatttcacagagtacaaaatagttgtaggggaaatcaaggtgaaggatctgtccgacagtcaagacggatccacagtaatctttcggtctccttaaactaccaccctcgctgccacccaccccaagctgctgccgcctcaccttccttgaaatttctcagcgggagtctcctcactgccactaaaacccacccagcccactaactgaggagctagtgttaatccagagaaccccccgcaatgtgcttccgagattcagactgcttcattgggaagtatgatttgttcctttctggaattgggctccgtggtggcggcggcacttcaagcaaagacagtttcttgcaagctccagtagctccgcgtgtctcatttgccaggaagatgggttcccacgtagcaaatcgtacattgtgccctgtagctccttagctagttagctcacaagccgtgttttatgactaatccttaataactatggtaaataactgtgactgtggggtttttaatctcttgtcattctcatccaaaagtgaccagcataccagttcttgcaataagatattaccctcagaatattaagcacattattgtagagaaaaaaaaatatgtgtacacatatgaacgcacaacatgcacattcatcctcacatgtggcacgtaaggtctcatttgatattgtgtaggaaatctgaagccttttcctgaggtcatctgtaaaatagtctcattgccaaggcatccccagtgccagctggtgaatccatgatcaaaatgcatacgtattgttaaatgataaggtttagaatgacaggaacccatcactgtgtctcatggtcccacttccccatctgtgtgtgaattcctttagactaagggcaggaagacttccagctttctctttgttcttcaatgtgaaactgagaccaagtctctctaagacaaatgcagtgtatttaatgtttgtaagcaattctaagtgagatgtttggcaagaaatcccctaactgatttccatccaaacctaccttatagagcacaatattaagtgttgtacaattactgtgagaactgtgaatatgtgtaacttttttttagtatttgcccggggggaaaaagatattgtattatcatatatgcttttttgcaataaggatttattctcagaacaccaagtaaatctatctctatataaaaaatatatgtaatatatacatattcaaagtatatacagagcctgttttaaaaaatacagtattatttagtaaaattatctgttctatggaccaaatgtaaaatatttataaatgaagatgcattttaaatgtctataaatggtgtcataactagagcacgggcgttatgtaagtttctaagaatttagaggataaataataaaggttctatgatatacaacatcagaccttcaattctttggggtgggggcacaatatcctctttcatcacaacaacaacacatacacacagaactatttttccccagcagacagagattggggctcaaaacccaacaaaacggagctggacttccccagagtcttaaagtcatagaaaatgattgtgtgctgcacgagggaggtgctttcactgtgcatggggtcaactaaataaagatctaaaaccacaggagaccaggagcacatttagtgaacaacagcactcgttcattcactcact

SEQ ID NO: 15432 - DNA, 67899 bp, Human
attgtcctttcatttgcaagtgtgaaagtaatgtacatttaaatgctttcatgctgttgtcaattgtgggttgtaggtacaagaaaaacaaagcatcttgagaggaaataaaaatttcttgagcttttctgccagcatcaacatggctaaggagattgctttacactgagtaattttccttgttaacatttttattaagttgtcatgacaactttcttattctccataaagtggaggaaagtaggttttaacccataagtcaactataagaaagaagattggacctggaagatgatgaaatattcaggtattcatttatccactcagcaggcattttagtgaatcccgttatgaaccattttcattactaggaaattaggctgtgaagattagtatttccctaacaacaaggaactcttgttacttttttagagcatatcaaacatccagattacagaatgtcttttgcagtcaccttttggtggttctagccacccttatgtttagattggttgcttcctcttcttacccattgtctgacagtcagaaaggatagaggaggaagaagacaagacactatccagttgagagtctactcttagtaaaactcggtagctcctggcagaatgtactggggtcaaatgcaatactaatcaaggagtttggtgtgccataaaacttgagaatggtaaaagtagaaattaatgggttaaacaagtcattttccagaatgaaaggaatattggtaatggtatcaacagacgaggacaacagcaacaacaaagtctttatacaagcctgcaacacgtgacaactgcggatcaggcatctgaacccggcctatctttccaccgtatcttcctacacttttctttatgtactttttatttctaccagatggtattactccttgtttcttgaataacagtgtcatgcctttccaacctctgtatgtttgctcacaagtttccctctgtcagagaaaagcaaaaacaacaaaaaagtcctctattttatctttttccaaacataaccaatccttcaagtcctatctctagtactgttcctttatgaaccctgtcagacaatatctcattttcttctgaatgttcatagcatttacttaaaaatagtatgacttccctcttctttttactaatgaattactgtgtattttttaagtttccttctacatctgaagttctaaatattcttagtacaaatgtcctactgatctaagagagtatcatgggttaaatgtagaggaagagaagtttctgagatggcaggaaggcaaaagtttctgtgactacctgtgcttatattgctgactttcttaactgttcctgacttatttaaatgtatttttttcctgattctgattaatgttcactatgaggcaagcacagtaggcaagactgggagaaagtttgcaaatgtgatgagcttacaaatgggaccagattagatggtgtacttgggggagatataaaagaggaagataaccatgaattgaactgaattgaaaatggatcacataaagatcatgattaattgttaattcacaatggaacagcatgatgggatttttttaagtcagaaaggtgactaaaagcataatatcacaacacacacaacggtaacaaatataactaaatgcactgaaccaggcagaagccagaccttactgaaaagatgtaaaatctctgtaaccataaaactgcatctgcaaatgagtagattggcttcaaatctgaaaaccaggacaagagagtcatcagcgcagatgtcaacttccccagcagaaatgttggagtttttaactgtggaaaactacagtttttccacaccagtgcatagtggagaagacatgtttttgtttttctttttaagtgtgccaaattttcctggagtcccctccaatttttttctttctctctctctctctcttttttttttttgtcccctgcccctaggtctctgtctccacacagtgatttctgttatggcgattgggcggctgcagagaccaggactcagttcccctgccctagtctgagcctagtgggtgggactcagctcagagtcagttttccagaagcaggtttcagtgcagagttttcctacacttttcctgcgctagagcagcgagcagcctggaacagacccaggcggaggacacctgtgggggagggagcgcctggaggagcttagagaccccagccgggcgtgatctcaccatggtgcgttttggctgctactttctttttcagtctttcggtgcggagaaggggaggaggcgggcagaggtctgaaaaaatcgaatgccttatggaaaggaactgcaagggttcctttggggtgatcaaagagggagacacagacacagagagacaaaggcaaggaggactgtctgggagccacgcgggcgatacagtttccgaggcacgccgcgtcccgcctagcctgttgaacaggtagacatgagcgacccaagcgtaagtgccgctgccgcgagtgcccagggtgcactcgcgcggggaccgacaggtgccactgcagggtcccctctcccgctcactgcctgccacccctgacgcctgctctctttctccattcgcagtgcggatttgcgaggcgcgccctggagctgctagagatccggaagcacagccccgaggtgtgcgaagccaccaagtaagtggtcgctgcatccccacgcgggtgcggggttcttcagacaggcggtccctcttccgggacccccgcttgggctgggtctccttcctctcctgagaaaccttcggtacgctcccagttgcccagccctgggaagccagcatcgggttcccacgctggggaggagcgagaggaaaggagaggacgcccgaggggccggcccagggcccgggggacccgcggcgcccgagggaggagcacagacgggggtgggcgccgagcagcgccgcgccggctgctgagctcgcggggccgggccgtgagaacgcgcggggcgcgccggggccgctggtctcccacggccagggcgcctgggccccagagcccatcagccgcgtgcagcgctgcggcctccggcgcgccggcaggcaagcgagcgggcgcagctgggggatgcctggaccccggaggcagcagggctggaggcggtggcgggcttcagggcaacttcacccggccggctgcggcgtgggtaagaggcgcgtcctcctccacagcaaaagctgcgatcgctgggctgcccagagaaggcagccggctaactgcccagcggctccacgaggtgtgcgcgtgtgtgcgagagagacaaatgatttactgcttagcagtcccatttctgttttcgttaggactgcggctcttggagaaagcgtgagcagggggccaccgcggtctccgcgcctgtctgcaccctgtcgcctgagctgcctgacagtgacaatggtgtgaggggctgcgttgcaatgtggtcatgtgatttcaggctatggatttcgtgcgtctttctctgctcactgattttcacatggttattctttcattttgcactcgataaacagtttacatcttctgaagtaagccagaagattgtatggctcacttaacgatgactggttgaaggcatcttgatttggaacctatggaaacagtgctgagttttaaataggacagatttttttttctttcatttgaacttcatttataacatatcaatagtgatgttttaggatcagttctcctatggtaatttcactaaatgcctatttaatgaattgatttgatttcatacatctctaccacttactagaactgtctttgtacaaacgtcaaactttcctgttacatatgggtaagcgtagaagcacttgatataatttttttttatcttggttcatagtgtagaagtggtctgttgcttttcctaaaattgctatacatattttttctttaagagtgatcatttcaggtaccctattatgtacagtggtaaaaagtaaactcgttatgatagcaacgacgatgtaaccaaaataagcaacacttaattggtctgaaagttatacatataagctttattattgcttcagtggaagttgtctatgcattctgtgctttgttcagccattaaacaactgggtccgtgatcttcttcaaggggccgtgaagtccctaaaattgtatttaaacattagagtggctgcattttaagggagatagtacatagtcaaatatccaaaatggacctgtgtcctaatagaaaattaagaaccacggggtaaaaacacgtaagccatactttttcttatcaaaacaacaggctgtctacatacagcctgcagacataggctagaaggaaaattctagaacaattaaatggtgttacagtagttaaatatttcacataaaatagaccagatgtatgtattttaatgtattaggaaacaggtctgtgaacgtatttagtagaaatttgtaattaatagatgggtaccttatatttatatttataaggtatatttatactttatattgtaagatctctttctattatacgacagaaaataaaaattatatttttgtctttgaaatccaatcaaaatataaagtacttatgcttggtatagtgtctcatagtgtatgaaatataaatagccccttaaaggtcttgcttctagatattcaggtattaaataacatgattaaaatcgttttctgtcattcggagaatgaggaaggaaatataaaattattttatttatttatggcaataccaaaaacaaaagtgtgaaaaacttcacaatgcttagtacttataactcttataattatgtcttattaagggatctttcttaagacattttgaaaagctattttaatatttcactacaaacaagtgataatattaaaattaaagtatatctattacaaatacatcagtaaaatattttgtgaccgaattttaagaattttgttatatttttcaaatgaaattgaaaaaaattaaatgtttatctaacatcacttttattgacacattgatattgcataactttgaattttttcagaaactatacaagggaaattaaatcctgcatttacatttgctagcaactaatgagtgtggactgaggataatatttcttgctttacaggttagtttaaaataacacgatctgcacccccataatttctaattaaccttttttcagaactaaataaacatcaaattagccatcagaatgaatctctacaagtaaggggaaatggaaaggtaaagcaacatttcagtaatacaagccaaaaagtatgtgcattaatgggaaaaatttttggaggaagctgttactgagaatgactttttctgtcagattcactaagaagttgcttggcttttatttgtgagaatattccattttgaaggcactatttttacactggttaattaaaaatatttacccaagccacttttcttaaacatttctatttattacttttctgcacatttgtaaaaacaaattttttccccaaagtattaataattaaaaatatgtttgtctcttgaccatctacattcattctgcaatagtttgttttgggtgtctacatcttgacttgatataagaagagcttttgtcaatgtttagttactagttgatttactttgggtgaagtaatttcctggctatcctgaatcatatctgcttcttttattttctttcagaacattttgaaatgtcttacctattatatatgtaatttttcttcttccctgggttcatgccaataggcttcatcttcctatagcctcgaaggcttacagaggatgaacagagttattttggaggggtgaaagaagagctgtagagtgggcttccctctcagcccacagtaggagagaatggctacatcttaaaacttgagggactctggagcaggctcttccttgccacaagaatgtgcctcacagcctgtagtttctaacttctggtatgctttctggccattaaacaatatttcattaaaacaaatcctccattttaaaaattgaggccaagtcaaattaattaactcacataccaagtcatctatctcaccatactaagaattagcaggaagtcgacacgagacaatggctttgagagtgaacaccttcttaggggggaagcaaatggggcagacccatttcttaatcctgacctttttttctaggtccagcctatctatttatccccttttgctatgtcacatgacattgaaagtacctgtttaaatgtctgcatctcccattaaactcaaatctccttcacggtatccaatgttggatccatagtgcttggtgcatagtaggtgtctaaagagcttaacattgttgtcattgttattcttgaattaaggcttgtttatgctttgatgctaccacatggagctatggtcttggtgacagagacccttgtgtgctcttccgtcatatagtttgtggcctcttcagaattgcttgtaaactgttatttatttcaccaacaattttaactctgctccaacccttaaatctcttgccactagacctaccagaacctgccttcccaatgtcagcttcacttttaatgtttgctttaccttccttgctgttgatttagctggacaaagagagacataactgtatcttgtagccaactaccaattgcttcactccaatgtcagcttggaggatactttgtgcagctattttattcttttttagttaatgtcatatcaaattctccatggtacatattctggatttttccaggttttctagtctgcccagattatctccagactcttcattcttagcagaggaccatactttttaattcacagaggatgttaaggtcagtttgggcaaattatttgtcaacactcatcttgaatacagtaagcatttctttgaccagctgtgagcataagaactcttttcttatattcagctatcgaatttgtctctataatatttatatctttaattttttacctcttagagtatttatagaaaatgcttttacatctaacaactcttaatagtgtctaagataatattcagtttcttcaacccatgcttatttaccatgggttgagagtctcattgttaccagggcttttctcttttggatgcacttctgtttttattaaagtgtgatccccagagtttaacatagaggactgtcctctgatatatttatcttctctggatatcatgtagtaaatcaacctgaaatctattctactcttcccccctccgttttttttttgcactcatacaacactgtttaattatgtatcttttttgcacattcttctgcaaatacacttattttccccatcgaattttatgtttggccacttgatttgggacttttacaaatacttactgcaattaaatttaatcattacctttagttagcctgttgttccagaaagtcaaggtcatcttggattctgagtccttgatacagaatagccattttcaccaatttagaggaattaacagatttgatcaggatataattaacatcttcatccaagtaactatctacaatgctgaactggaactacctttggcatattcctagacaccgtcctttacgttagactcctgctttacattagtccataaattattcctctttataaggctgttcaaccagttatatagtcaaataactctctttgaagttgacattcctttgtgtgacttaagagagtatactgagacagacttggtcaaattcctccctgaaatgagtctccactttctgcagaatagatgtcaagtaactgctattaaaaacaaaaggagataactaggttagttgacaaggataggttcctgtgacctctccttatcttgtagataacagcacttcacattttgaatgcttgcatgccatgtttttaatcatctctttggaatagtacctgcaattaatgtccagctctctaaattatagctgatggaatccaccttcccaattttgaaaattgaggcaatggttggactctgtcaacacttctcttcatcacaatatttttaaagatgactttaacaattcctttattttatccacacatgctttcaatattttgtagtgtaatttctccaaattaatggatttaaactcatttagaatatttgctatcattctacatgctggacctttgttatttttagttttgttctacttttataagtatggatattgttttcttaaggaatggatatgaaacaaaacaagagcagagtagttctgcctgtttgttcatgtactgtgatttgaatatctttatccagtgtgctcttcctatatctaataaaaatgccattatcaccactttatctggcaatcatagcaagaattaaaaggacattttttcttttttttataagcttcaacttattttatgtcttatattttataacactcttcttagagactcagccactattttgtacttctctcaataaagtttattatggattatgcttgtcactgaggaagatacaaagcaaagtttatgacacacactccttgacttgaaggaatttaaagtctgcatgaacaaaaccaagaaatagtctcagaattatacatgtcagcacttaacaatgagcataatatttgtagaatagttttaataagttttaaagaagttaggagaaggaagagagttcggtatgatggaaatattgagtaaggctttccagaggaaatctaagacttagctgaggttttaaaacaagatcaggatgttggacatcacaggacctgtaggatttaaatgtggcaaacagtaggaagagtattctagacagaggaaaggaaaggattcactgcagggatcagatgtgtgtgtgggtgtgcatgtgtgtgtttgatgtgtgtgtgtgtaccctgtgtgtggcggaacgggtaatgctgagccttcccaggccatagctttgaagtatttatttgtggagaacaccacttttccatttctagcttttcgtttccccttgttcaatctttgtggggcccacacctacacatcttgtagatctcaaactaagctctgcttcttaaaacctttccctgaacttccaagcctaaattgcatgccttattatgttttcctgtaacacattgtgcttcctttgtagaattattatgatatgaataattacttgctgaatttttactattatactgatacttgtggagagaggtaccatttctgtttagttccccattttatacacagtcatctaatacaagtgctcaatggctcataagcactcagtgaaaacgtgtgctatggccgggcgtggtggctcacacctgtaatcccagcactttgggaggccgaggcgggtagatcacaaggtcaggagttcaagaccagcctggccaagacagtgaaactccgtctctactaaaaatacaaaaaattagccgggcatggtggtgggtgcctgtaatcccagctattcgggaggctgacgcagagaattgcttgaacccaggaggtggagtttgcagtgagccaagattgcgccactgcactccagcctgggcgacagagcgagactccatctaaaaaaaaaaagaaagaaagaaagaaacaaagaaacaaagaaaacatgtgctatcatgagcctacttggaacagtgaagttatgtggagagtacttgtaaaaaaaaaatgtttaaaataaagaagggttagattacaagtccagcatcttcgttctttatatgcttattctaacagattttttctatttttaaaatttatttctttttacatcttaagcttttttattaaaaataaagacaaaaacacacaccttagcatggacctacacaaggtcaggatcttcagtttcactgtcttccactgccacatttctcactggaagatctttagggacaataacaagcatggaacagtcctcgcctatgaatacaatgccttcttctggaataccttctgatgaaactgcctgaggctgttttacggttaacttatttttataagtaaaactagtaccctctaaaataacaataaaaggcataatatagtaaatacataaaccaataaaatagtactttattatcactatcgagttttatataccgtaggtaattgtatgtactatgctttttatatgactggcagcacagtaggtttgcctgcacgaacatctccacgagcatttcagttatgcattgtgctatgacattacaatggctatcagtcactaaggaatgggaatttttcagccccattataaacatatgggaacatgattgtgtatgtggtccatagctgacagaaacattgttatttggcacgtgacagtatatgcactggaatttttagctgcttatttttctccatttgcaatatcactttgcagcttcaaatatgctcattataagcagttaaatgatatgtggtttttattacattattaagttaataaaataagtgacaaggagtttcagtattccatagtataacataaacttttaaattgtgtatttgtgagcataaagttatatcaagatctttagcactatatatgaagtatttagagagttacaaatgtagcattgaaggaaatttgggtaaatgcaataaaattgtcagtacatgagttgtaaagcaagatatccatatattagattagcactatacatttgtaaatatgattagcaaaaggcaggcttcccagcgaaaacaaacgtctttgggtaaaattctatttcttttaatgttttaaaatatttgtagtcactaattgtaagtcatattcctctttgtccagctctatcccaaataacaatttaatacaccgcagcatctatttctgcttcttttctgtgtcactggctcagaataattcataagcccttgttgtttcatcttatgctaacaaaaatccagcagtggtatgtaggagagctgtgatatgccctgataagagtttatactttggagaacaaattatcctaattaaagtcactgcttttcttctcttctctctctcctcctctttgaagctgtgagagtttatcttaacctagactggttaccacctatggctttatggcttgcctgctggcttggctgagagcaagaaagttgtatatgagggatatcacaaggccaccttccacaaaaattgctctcccacttggtcctgtcctaaggcctaaatctcctttgggttgatgcaatcttttggagtgtctcctggagtcaataagatgcctgttttaccgtgaagagcagcacaatgaagaggttgcccaatagcagtggttacttttattatgttgtctttctgccttcaatcaagagcatgacacttggacatagctttttaaagtaaaaaggaaactgaaaggctcagtatgtgggacatagataagaaaatgagacctaaatagggtgtattgggcaacaatacagggcttaaatagaaagaggaagaccaaaagaaagcaaagaatgtcctaagaagagctgggtttttttttttttttttttaacaattttgttgcctattagttttcttcattcctggggatggttgggacatttttccacatcggcatgttatggccttgattatctacctaaatcaaaccagaggaaaatcattttagtttatttttatcttaacattggatctgtttcagcgcgtcctggaaattagtagttgcatgttgtcaccgtctattttgtacacagtgaaaaggtatttggctgtgtttctatttacattcactgtccttgataaatactaattggccagtgattgtaagtctcaagaatttttgctgcagagcgtgtgttaaaactcattttaagtggtgtaggagtcatgcagtgtttatcacttaagtgggtaatctgacagctgtattttactgcctgactgcagctttattcttgatcattctcttccttgagtagtgtgttatggtcatgttgtcttagctgcaattaattcccaacctttttttgttttccagtctttgtcttttgcatttatttttctgctcctgcaatgccttactttgttgtctctgccttgctatttcctatttattctacaaagctcaccttaagtgtcacgttttcagggacatgtttgccaatgtactgtacaggggcacatgcagattcttcatgtccccatcacaacctgtcatgacatcacactgaactgagtttgtgtggtctaagtctgtccgccccaacctttactcaaaacgttccttaaggaactaggattggattgtttttatttctttgtttttgtttttaatccctgaaatttcgtcctttagaatgtagtaataggtacctaataaatatttttggcatatgtgaatgaatgaatgagtgaataaataatcagattagttgatgaaagattctaagggaagattaggtagtgtgattataagagaaagatcctgaagaatgcttgggaatggatcctttactcatacatgattttgttcatcagcttatatgtaggatcacagtcatttggaaaatattggtccattgaaatttatacattttccaaatggtgacacacttcattatacagtgtcaaaagttagccttcatgactatcaccactgatctcatcaggaagttttaagtattggatagctataagctcacaatggcagtcctagatagtgcagccgtggattgaaaaagtgttctagtttcctctttttaagccaagaatccatccttaaatataagaagaaaatcaggccgggcaccgtggctcacacttgtaatcccagcactttgggaggccaaggtgggcagatcacctgaggtcaggagttcgagaccagcctggtcaaacatggtgaaaccccatctctatgaaaaatacaaaaattagccgggcatggtggtgggtgcctgtaatcccagctactttggaaactgaggcaggagaactgtttgaacctgggaggcggaggttgcagtgagccaagttcgtgccactgtactccagcctgactgacagagcgagattccatttcaaaaatatatatatatgtatatatatgaaaaaatcaatagacttggtcttagaataaatattaaaatctaaaataataagtttatataaaaaattagcaaagtggaattacttcttatgtttacatttaagaccaagaaaaacttcaagatttcaaaataataaattattagacaataatgaaattacaaacattataacaagtatactgatagttaggaaaaataatagagttctgagaacaaactgcgttaatctccaaaaatgtacacttatactttaaacctactaatttagaaaattctacacaaatataaattccattagaatgattacatcatcacatgtcatgtagtctctggagaactctgctgcaatctgtgagagaatgagaatgaaaaaggtgcataatattagaatattgttatgaaaatagttctgaccatgcatatcctctgaaaaggtctcaggacatccccaagagtttgcaaaccacatttcgagaaatgctgctttaactcaaatgtgtcttgaacaaggtaaacataaaggtttttacaataattttatatcaagtccagtttataatagtgaacatttcttaggtacattttacattccaagcattaatacaactgcattactttaatcaaatcccttgaggaatgttctattctcatcactgttctacagatgaaaaaatggatgatgcacagagtagataagtcacttgcctaatgtcatacatttaattaataatggaaccggtatttgtagccagggagggttcacacttttacttactatggtaattactatggtaacctttctgcccacattgcaagttttcctgatgatttgtgaattacccaagttttgcttataaacaatagcatttgttgaatgtctagcattttaagaaactgccaaactgttttccattcccaccagtaatctgtgagatttccagttattccacattgccaataactcttgacattgctgaactctagaattttagccattctaatgggtttttgtttaataactaataatattgagcatatgaagaaatgtttatgactgtttatataccttctttaatgattgtctattcagatgttttgcccattttaaaatggaattgtttattttcttactgagttggaaaactgtatattctgaattaaactcccttgctgttgtgtgttacatatattttcttctagtatatgacttgtgtttttgtttatgtaataatgtcttttgaagagccaaagtattttttttattttgatgaagtccactttatcatgctctttttaaatatttcatgttttttttttcaaatttaagcatctttgcttcaaacctggtcacaaagaatttcttttatgttttcttctgtaagttttatagttgtaactttcgtacttaggtttacgatttgtcgtagtctgtttattttgctataaaagaatacccgatgttggataatttatttacaaaagaggtttatttggctcaatgttctgcaggctgtgcaggaagcatggcaccagcatttgcttctagtgagagcatgaggctgcttccactcatggcagaaggtgaaggggagccagcgtgtgcagagattactgagagagagaggaagcgagggagagagagaggagacaccaggcttttgtgtaacagccagctcttgaaggaactagtagagcaagaactcactggctatcgtgagaacggtgccaagtcattcatgagggatctgcccaatgactcaaacatctcccatttcactccacattcaacactgaagattagatttcaacataaagtttggaaggttcgaatatccaaaccatggcatggtccattaagatttaatttttgtatatggtatgatgtgtggataaaagtttatttctatttctatatggatttccagttgttccaatggcatttttattaaaaaacaaacaaacatattttctttcctgattttattgccttgacacctttgttgtaaacacaattgtggatctctatctcattgatctctttgtcacccctttcaaactgatacctcactttcttgattactttaactttttaagttttgaagcaggtatataagtccttcagtgctattttttcttctttaatattaatttggctatcctatgtcatcagtgaaatcttagcctcattttttcaatttttactaaaatgatggctgagatgttgattggaattgcattgaatctataaaccagtttagagaaaatttgtaccttaacaatattatacatggtatatatctctccatatatttagaccttccttaatttatctcgtgaatgttcgtagttttcagtgtaaaagtcttgtaagcctttggttagatttattgctaagtatttattaacagtatcataaatgagtttttaaaataattattttccagtatttgtggctagtacagaagttataatggaattttgtatatcagtcttgtatcctgaaacattgcttaatttacttcttagttctagttattttgtatatccactgggaattcctacatgaacaattttaagtatatgtgtgtgtgtgtgtgtgtgtgtgcacatgcatgtgtatgatccttgaacaacacaggggttggggcactgacactcctgcacagtcaacaatccacataaaagttttgactcctcaaaaacttaactactaatagcttactggtgactggaagctttaccgataacataaacagttgattgacatgtattatatactgtattcttaaaataaagtaagctagagaaaagaaaatgttacaaagaaaatcataaaggaagagaaaatatatttaccatttattaagtgcaagtgggtcattataaaaaatcttcaccctcgttgtcttcattttgagcaggaggaggaagaagaagataaggggttggttttgctacatctgggatggcagaggcagaagaaaatttgcatatgagtggacccatggagtttgaatctgtgttgttcaagggtcgattggatacacacacacacacacacacacacatgcacacacacacacacatgcacacacacacacacgtgcacataaacctgcaaccttttggccttttgtttaactgattgcaatggctaggacctaacttctgtacaatattgattagaagtggtgagagcaggcatctttgcttggtcctgaataatagtggaaaagtgttcagtctttcatcatcaagtatgactcaataattatagttttcatagatgctttctgatgggttaaaaaaattatgattgcagagcttgtctcacttgttctcattattagtgttggagtgggagtctcttgtgactttctgcaatttaaccagaagtcaaagaccctgtactttgagctaacttttgtgctctgtatagtaagtatttctatttacagaaagctacaaatataggtaacaaaagaaaaggatttcatatcctcacaatccttctttcaaacttgctgtttcccaatccacagatcttaatgtaatctgtactcagttacagtgtagtactttatcactataactccttattttcttccactttcagtctactattcttattcaaaattttgccttaaaagccataaacatctttctaatttaaaaatcaaatgatattttctcagtcctccttaccctcttcagacttgtgacatacacttcttttcgaacacgtgtcctctttcatattcattctcattgtacttttctaattgctgcttctctgtcatagtcataatactttctccagtccttaaacatgaggattccctggagttctaaatttggttatcttctctctatatatgtagcctcttgatcttaaacagttttagttaaactcctgactataatggtttctgctatggggaggagcacaaattcatctctaatctgttacacatttctgaagtaaatactccgattttcaaaagcacctccaccctagattccctgctacctcagttcaagatccatgtatctaaaacaaattcaacatcctttctctcaggcctactgctctgtttctgttacctgtttccatgaacggtgctatatctttctacacaaaacttcagagtcattctattcctcagatctagtgagttgccacatcatgccaactttaattttataatatctctagtagccatcttttcctgcctctttcccacaatttccttcatttcttgctttcacttacactgttctttctctgtggcgtgccccttgccaaaatcttaattttcagaacttagtcatttaaaaaaataagctcaaattctgtacattccaagaaggcttccctgatgattcttttgccaccaccgcctaaatctgatatttcttataaacagttttaactctctatctttacttattctccctttttattgtagccattagctatttaataaaatttcttatatatacataagaaaattcgactgggcacggtggcttatgcctgtaattccagcactttgggaggctgagcggggcggatcacgaggttaggagttcgagcctgaccaacatggtgaaaccctgtctctactaaaaatacaaaagcattagctgggcgtggtggtgtgtgcctgtaatcccaactacacaggaggctgaggccggagaatcgcttgaaaccgggaggtggaggttgcagtgagccgagatcacgccactgcactccagcctgggcaatagagtgagactccatctcaaaagaaaaaaaaagaaaagaaaattcagtgtgtgtgtgtgtgtgtgtgtgtgtgtgtatataccccactcatatcaggctttgaagaaaattaaagaaaggaatattttttgtccttttatgaaacagtaaattttgattgaattataaatggatctactgacaactcattttaaaatgtatttccaataagcaagacattttagaaactctgatttagctttcttttatttgtattttatgttttttctggttcatgttttgccccctatattgattatagctaatagcctaatattaatatattttattgagattagttaatattaattgagtggccaaatgatggatgattctgtgctgagtgtttctgataaggcagtcaagtatagaaacatggatggtttttcatttagctgatttcacagcaaagtgcaaaaggaggataggaaattacatgagcattgttgatttctttatcaagcacagaccttggaaatgcataaactctatgtatagtgagatttcactttttctgaaaaaagttgaaaaacaacactaataataagtaaaatagaaaaagagaatatataggaaaacaaaaaaaatggcttgtcaaattgtgtgtcatttacataggtgtgtttgtgtcttcacatacaaagaatccagggaaaataaatggaaaaaaattgaataaatttaataataacaatttagttagcctatctatgtcacttccgtgtttataccagatgactcagagccagtagttctttcaatttcagcagaaaataattattggcagtcccaaagttggataaactgtgacctgcattggctggtttgattaaggctggaaaatagcaaacttgattaagtgacaaagacaagataatgaggaaagttatttagaaaatgtgtttagagatttgaaaagggactaaaagatagtttctcaagaaagtgcaaaagaagatgagaaaattatgaaaaagagtctggggcaacattttaggaactgtagacagtgaaagcaattttataatgtatgttaatattagcatgatatatagacgaaaggtaatcttctgattggtctgagatgaagtagttatgttaaccctcaaaagatgatgaagtgtgaaatttgaattcagataactaagttttcaagttttctcaaagtattccctgcagtggctggtggtccacaaagaaaggagggcttctcagcattttcagtagaggaggtcatcagggtatattgggtgaactcaatacacctatacacctcctgagctttggggtttgagccacatcactgaagtctgcactctgtcatctgcaaatggaagggactgcaataaataatctctaactcctcttccagttctaaactcctattatgcaaatgactctgtctttatattgacttttatgtaagaggtactgaaatgaataggaaaaattgtttggtatttctttaaattttctctattttgaatcaattagatggcagaggcattaaaagaatatagttgtgggtttggatttaatgggaaaagactcagcctttctcaatatggactttgcaagcatccaaatatatacctgcaaagtatatgttcagaagtccaaattcatttctggtaatgattcttctaaactaatcattatgtaaaaacttggcagaattgagtttgtgttggaatttgccacatgtcttttgctaacctgattccagcataagcatcaaggatctgtgtcccagtgttatgacaaaagttcatttcctgtcttaagaatcagaaagagctttactgctggtcagaaaactagaaaaggtacctgactacccatcaattactaataccttagtagcctggtcccctgggccacctccaaagaaacatctgctgagtctccaggcctcgaatctcacacttcacttttatgagccttttctctggggtcataaaagaaaatttctctgagaaacgtactttgccaaagtttatcccttggctttgttgtaaagatcctttaaatgtggcagagacaccaacagcctttttagctgcctttcaattcttctctgatgcctaaaactagagaggctcaaagtgaagttttcaaagggagtctccttagagttcactgggaccctggaagcatctctcatgccttcattttgggaatatctaaacttcattaccttaattgacatgcccaacaacctgatctttcattttattctgtacactaatttaacagatacaatttagtctttgttttcccagattacattttttagtaggggaacttgaataataatcaccatgatatgtcaaaagctcctggtttctcaaggcagctccacagcaggagctctgtagttagatagggttgggttcatttcctgtttctgccactcaccagctatggccaaggacaagttacatgatcgatgtttcagattcttcttgtgtaaaaaatactaaaatacacaaacacacactcacacacccttcccataagattgttgtgaagattaaataagataatgtatgtgatgtccccaacagctctttaaagcaggagtcagtcaacagaccccatcaaggacaagatagtagctacttaaggctttgccagtcatgtgacctccatagcagttactcaactgcacagtttgaacacagtagccatagacagtgcataaatgagtgggtgtggttgtgctccaataaaagtttatttatggacatagaaatttaggtctcatataatgctcatgtatcactgagctcctggtgttctcctgcatgacagcttagctttgtctgaccctctcagccccgctccagcttccgcagctcctccaccgcctgaaccgcctccattgatgcatctgttcttgttctccttgtgttttttttttttttttttttttttctctttgctgttctttctgtacccaggcctatacttctccattaatgggttcttgattaggttgggtaaaattctatctccagcattgcataaatgtcttaatttttcataactgtataagtttcttgtcctttctctcaaagagcttggaaaaatttccaaaggctggattagaagaactgtgaaagtcactagtgtctcttattccaaaatcttctttccaaatatgacaagttagagtccacccagtttgtctttcccctaccattcggtgagttctgtactcacaaggtcactccttccttcccatcaaggatgaattgaccttggtatctcctcattgctcagaaaggtaattcaagtgttccacaggtcaatcccagagtcacttcacttttgtcaggaatccctgtgtctcttactttaactggactctgggtgacctatcttgtttgcacaaatatcttaaagtgaacatgccaattagtgtctcacctctacctgctcacaacctaaacctttccaccaaactaacattgagaaagtaagtagataaaagaattattggccaggcgtgatggctcatacctgtagtcccaacactttgggaggccaaggtgggtggattgcctgagttcaggagttcgtgaccagcctgggcaacacggtgaaacctagtctctactaaaatacaaaaaaaaaaattagccgggcgtggtggcgtgcgcctgtcgtcccagctactcaggaggctgaagcaggagaatgacttgaacccgggaggcagaggttgcagtgagccaggagtgtgccactgcactccagcctgggctacagagcgagactccgtctcaaaaaaaagaattatcactgaatccatatttagaagaacagttagcttataaaagcaataattagagacaggattccttgtataacaaatactaatcatttcccaatatggcattctgggaaaataaaatcagataccacaggatttctatttaagtttggttgttatgagattttgttttgttttcaaatttccacattgggaataatatgaattaataaaaaatagtgagtagtgcaatggcataaggcttgcttgatttataaaatagttttggcttaacgagtagaaaatgaggtttaaaattcaacatagtcacccagtttttatattctaatatttcattaaaggaattagacatgcaacttattatataatagaattagataagataaaaccaaaatagaatctttctgctctaagctgtgctgcaaattctataattttttagttcaataaaaagaactgttgacttagatataactttcttggtatattctctaatgctcatcaagtaaagattgctttctatatttgtaggataatgagcattggatatattattagagttcccttaaacaagctttgatgcatgaaaaaaatggtttcataagtataaaacattaaggaatctttctgagaagctagaataaaattgtcaatcatttatttaataacttatgtcagcacaattttcttgtagtatgcaatgagcatttacatttggttgtatgtaccaaaaaaaaattttagggttgctctgaagttatcaaggagacactgatcatttttttcctgttataaaaagttgcctagagctctagtagaagaagcatcacagctttcgtaaggcaagtgactgaagacttgatccaagactggacttttatctttttttaaaaaaattatggacctatggatgctaggcaagaccaggcactttatatatattattccaaattcttaatttgaatctgttacatcatgactttaccattttatgtgtgaaataacagaattcatgaagttatgaaacttgtccaatgtcacactaccaccgagtagcatttgtgatagtcaacatgtattcctcccatactgggtagcagtgcttttctaagtgctttctatttattgctttgtttaatctcacaacacatttatgagatagttgctattattatccttatttttcagatggagaaaattgaggtgaagttcagttaagaacttcactaatgtcgcagagttagcacatggtagacgcagggagcaaacacaggccatctgttcatgtagcctaagcttttaactgctacgccaactccactgcctcagggaacaactgggcatggcacctacatttatgtgaacccaaccctccaaattatgaagtctctgtcatgctaattatctgcatgagacatgagacatcaggcacttaaaaactcaccattacagggccgggtgcggtggctcacatctgtaatcccagcactttgggaggccgaagtgggcggatcatgaggtcaggagatcgagaccatcctggctgacacagtgaaaccccgtctctactaaaaatacaaaaaaaaaaattagcctggcgtggtggcgggcgcctgtagtcccagctgctcgggaggctgaggcaggagaatggcgtgaacccgggaggtggagcttgcagtgagccgagatcgcaccactgcactccagcctgggcgacagagcgagactcctcaaacaaacaaacaaacaaacaaaaaaaaaaactcatcattacagaagagggaaaataagggtgtgtgtatgtaagtatgtatgtgtgtgtgtgtgtttatgtatgtctctacatcaaggatgtagaggttttactttacttccaggccttcctgcctgaccaaaatttaaaagaggagaaattatgatgtcatgtaatcatcaagttcattatgtcacctaaaagaaatctatcaattagcccaattatttaatcaaggatttgttgtcactttaaaagtttcatcagattattttacctaaattataatgtactctgtggagtctcagaaaatgtgatcttgttgagtgtttcttccaggttggtaggttggcttttcaccttatatgcaaacttaaatcaaacattgattagtgtagaagtatttctgatataacacagcatagatgttcttggaaaacctcatatgcttcaaaactgtgcactaaaaataaaaggacttagggaaaaaatgtgtttgagtgaaatcattcaatgcttacgagcactaacaaaagcaaaaaagaaaaaaaacaaaacaaaacaaaatccccaaaatataaaagtttagttaaaagatacattgaattctaatgaatactgcacctcagcaattgtaggccttgacctaaggggaaaaaagtgaaagtagttggtaggaaagaactataagacagccttgagtctgctgagttatggagacaagagaaaaatacaggaaaattgtccaacagtacttctacgacagagcatatggtcagactgggctaagaggaagaatggggagcaaaggggatctagcatgcctgcattttatcctgacattatttccctagcgatagatgtgcctgagccaattgacattcctgaaatgtacagtacttatttgaaaacagataaaaacaaaatggctttttacagagtaaaaaggaattacatttcttccttaactcatttcataatcattactatattttcagtaagtatattttaaagtgactaagcctctgcaaggaactattttagcaatgtaactatgatgagaatcatagaaaaagatgcaagaaattgttttatatattttagggaaaattggttgaaaagtttatctgatttcctcatgatcagcatgatgcatcataagtagtgatgatacttaatttgaagatgtttaactgcatgtattcaaattgtagtcatcacacgggagagtttttaaaatatattttaggatttataatcccaaaggtttttctcttaaattagttataaaacattctgtaaatactttgataaaaactgagaaacaaaatgtgaatttgaatacttaaaatctccctactatagagttgagtgtactgaattttgctattatttcaaagatgccacagaattgcctcttaaatctaattttaaaagattgtagattgcactcatcttattttaaataaagatttaatgcagcttattaaacacaatttgtgtccagtactgtagttttatcaaggcggttgccacccggcgagtcggggggcaggggcactccaatatgattattgaaagtgaggttgccgttgtctttagagttgacctctctgttttgggagaatcatcagtatgggctcttgagttacaaaaatttaaggtaagcatcctcctctttaaaaatagcttgagacagctcacacttacatgtagatgcagtccgttaggaaggtgaatgccctactcagtaatagaaattggagtgaacaattactgggcttttgaacaaggagaaattgcttcccaaaatgagattttaacagaagaattggagtaacctaactcccacaaggtgttatataatattagaaatccaagctctaggcttggttaagattgaataaccagagtcatgggaaatgtattatggactattttgattgtgcactatggtccctagagtttttccttggctgggatattgagaagtaaagtcagaggaatgtgtcttccctctgctttggtccccacacccagtcagtagcccaggcctgcggattctctctcagaattacttctgcaattgattcattttttccccccagggtcctgtttttgcccaacccagatctaccatctgtcctactctgacccatttttcattctacattccaaataatcttctaaaaatgcagtctaattcacttactctcttgcttattagttatttagttgattgcccttagaatagagtattatcttgtttaatgcggtttgtagaactctgcaaaatcctgacctctgcctattttgtctctcaccaccattatcttgctctgtcttaacctcattcatgcctttgctacactggaattacttctgttcctagaacattggctcccaagcatgctgttctttctggaactctcttggcctgacgcagctcagatgtttctgagaggactaggttcagatctctgatttacattcccagagcgctatatccctcccctttttgcagcagaggccacccttggaactgatacatcagaaatagttttcctcctggattgtaagttcttgagagcaaggggtgttctttacacatcactctgaccttgtgtctagaaaaatgcctggcacagagcaagaccttcgtaaatatttgttgaataggaagaaaaatgaacaagtgcatgaatgcgtgaatgatgtagaagacaatccagtaataccaaagaatctattggaatcaaaattattaaaaagaaaatgcagatgaatggagaatttatgttaaaagccaaaagagtcttgagctttgacttttaggcatcatcaaatttaataaagagatatcagtaacatactaaagcaaaagccagatggttttgaacttaagaataaatatgatgtaaggaaatgaacacagcccataaagccaacctttcaaaaagagtaacaataaagggagaatggtagtgctagagaggaatgatgggatgaaggagtctgagatttgtttgtctctttttaactttgtggcagagagaattggacatgctcaccaatttttctactactttgtcctgctttcctgatataccacagggaaagttctataaacatttcctactacaaagtgaaaagaaacctattttaaaagactggtttatgggattttatgtaatatttttcaatttttgagtaaggaaaactttctaagttttcagtctacctgaaaattaagcctttttccttatttatgaaaatagttgttacaatttgtactgaagtatacaaactttatccttactaaggcaatttgcttttaagttttctcctccttttggctactcttaaaaatctggactttcaagtttaatcttaaaaagctcatatctttttaatcacagatattggcatgtccaggtaccaggtatgatggtagacatttgatacagctaattgcttttgtgatggatacataatttttaggcttgcctcttccctgtaacttttttcgatttttttattatttatttatttcaacttttattttaagtttaggggtacaagtgcagtttgttacataagtaaacttgtgtcatgggagtttgttgcacagattatttcatcagccaggttttaagcctagtacccattagttatttttcttgatcccctccctcctttcaccctttacagtccaaaaggccccagtgagtgttgttcccctctatgtgtccatgcgttctcattgtttagctctcacttataagtgagaacatgcggtgtttggttttctgttcctgggttagtttgcccaggataatggcctccagctccatccatcttcctgcaaaggacatgatctcattcttttttataactacatattattccatggtgtatatgtacgacattttctttatccagtttatcattgatgggcaattaggttgattccatgttttactattgtgaatagtgttccaacaaacatacgtgtgcatgtgtctttataatagaatgatttatattcttttgggtgtatacctagtagtaggattgctgggtcaaatggtatttctgtctttaggtctttgaggaattgccacactctcttccacaatggctgaagtaatttacactcccacgaagagtgtaaattaaaaagcattcctttttctccacaaccttctcagcatctgttattttttgactttgtaataatagccattctgactggtgttagatggtatctcattgtggtttttgatttgcatttctctaatgagcagtgatgttgagcttcttttcacatgactgttggtcacatgtatgccttcttttgaaaagtgtctttttctaacttttcatctgctccttaagacctgcttttggagaaaagtgtatcagtgccagagagtgtggtaaggggtgttttccttacatgatattgttacatgtctacatgatcttgttacatgtagtaaacaagatgttcatgcctaattgaattctaggatgggcatggtggctcacgtctgtaatcccagtgctttgggagactgaggcacgtggatcacctgaggtcaggagttcgagaccagcctggccagcatggcgaaaccccatctctactaaaaatacaaaaattagctgggcatggtggctgccacctgtaatcccagctacttgggaggctgaggcagaagaattgcttgagcccaggaggcggaggtttcagtgatccaagatcatgccactgcactccagcttgcatgacagagtgagactctgtctccaacaacaaaaaaaaaagttcatgcttcattaaattttaaattctagagtttaaatgattgagggttgccttacttgcacaataatctgtccctgttattaatactaggccagtagctgggtcattattctcaccacggcaaagttaatcactcactagtaaaaagagagtgagcattaagtttatttggaggctgtttaattatcaacttttggaatgagaagtacctcttcaagtttctgagaacatattattccacttcttgccaaggcctgtcgccaaatttattattttaatttatttgtttttcccttaccatgttactaccatctctacaaccaactatgtactgaattcacccactgaccaaaccatttctgaagttactgctaacgttacccataaaaatcatcactagtttacttgaggaacaatcttttgcctgccaggaatattctgtattctgtattcctggcaggcaaaagcaagacaaacaggtttccaaggtatcaacactgcgtgcatctgcttcatagtgtaatttcatcagttgagcagatgaagaatgctaattagtttgtttatacatatgtaatttaatgagactaaacacttaactatcttaaagtaagcacaacttacttcctgttggctgtttttgctttaataaaaaacactgttcggcttatttcctggaaattatagtaccgtgcagtacaggaaaagaaattatttcaaggaaggttgactggtcaattgtattctactgcagctggattcagtaggaagataagaattaaaatattgggcttgggtaccagcgttgaaatccaatgtgaatgagagagttaagtttaatggaaagatctattataaactatattatggcaaacttctaagtccaatactaaaattctaatatataccagaataattcgttttagtaataattctatgccatcctcagacctaacctataatcttccatttcttattgtcttccttttgtttttatgtacccttttttgctagttattgtagttagattttgatataactgaaatagtggcattcagttaataaagctcttttccctgaaaattaatacaaaatagtggtactattatttgtataaatagttatttagtattatctattacactctttttgattactttgaagttgttcaaaaactggatcccagccaggcacagtggctcatgcctgtaattccagcactttgtgaagccagggcaggaggattgcttgagcccaggagttacagaccagcctgggtaacatagtgagaccttttctctactaataataatgaaaaaaactctccaagctccccaaccccaaccaaaactggacctgcgtaggctgttatttttggagaggagtgactagaggagatgaggaaataactttgctcctatagtcaaaattatattttaattaaaatgctttagttaatatactcggttttctacaaccaggggtcagcaaactactggctatgttcacagtctgcttttacaaacaaggttgtattggaacacatctgtgcccattcatttgtatatcatctctggctggcttcacactgcaatggtagggttgaatacttgcaataaagaccatgtaacctgcaaagctgacagtatctattctcaggccctttacagaaaaggttaaagcacttttaaagcttaaagctgatcattgatttgaagcttaaatcagaagagaagttattaaacaataatagaattatgttgagatgtagtaaagactaagaaacaaatatttattacattaagtcccaaaacaaatgtgggtaaaattattagatatttaggttttgtagaacctaagtaatcattccccctatagccatattacctttggaccacttcagtagtctattgaggtagaccgcttccattctgttctggcagaacaaattttctactcataaatgcataggattttcttttgtcccttcttgaagttccataaattatatatgagcatagattttgtttataactttaggtaacagagccttggcagcttcttctggcctgccagcatccataatcttcctctatacctaatgtcccatgacatcccatggggatcagatactgaatttagcttccttgtttgtcccagttcagaaaatgagttgttcattgttctaaacttattagatgacttacatgtgacaatttacaggctgttgcttatgggaacatattaagggcattgaggagcatagaaaataaaaaaaaaaaacctaattgaacttcaactctaaagattcaaatataaggctgaatcttggatgtttcagataccactagccaatgaacaggaaattatgttcctcactgaattttaatataaatttgtaaaccatattttgaagataaaaatctaagttgattaacaaagcccgattgtgtagaaactgctctaatttagtaatattagtttggagttatagaaaacacattggctttggagtcagctgaatctgcatttgaaccctagttcagtcattctctagcatttgaaatgagagaaaactacctaaacttttgagcttctcacccattggggataataatacctgtgttatgtggttgctgtgaggattaattgtaaacatagagttcccagcactgtgtcaggcacatagtacttagtacatgtggggattagcaaatatgggttcttttccactctttgtttttcttccccaagagtaggaaatagctggtagacccagttaatcaagataattagtattgttgatgaactgaattcacaacttgacagttccagtaacaaatagctaatgataaatgggttgtgaattgtgggagaatttacaaccacagcatcaacaaaaacaaaagtactgggggaaatatgctggaatggcgatgcttatgatttcagtgggaagtggggtagtctttgactcaccgcagtctagatttgtttccagagacccctgcaaatcccatggtatgttcttggggatcaggagttctgatgtttttttcattttgatgataatatttttaaattgctttaccatttaaagtgataaaatttttcttttgccataatcatcttcattgaactttttttcattgaactttttttttctaagttggtgtttcaaatctgaaaacatatacttggggatcattatacatattgttttgctttaggtatttttggaagccattggtttttactgttctgacttttcagaaaggagagcataatgagaatgtagtagtacaagcatgaataaaacataaacttagatgtggcttttgtcataaaaccgtggtgttccactcttgtgaaatcaaactggaccagatgagtgtaaaaaatggaaatcagtagttgatgctaagaacattttggaaaaatatattttattttaaaagttaaaatagtaagaggaagtattttgctaatattgtgaaattcacacatattaagtaaagatctttgccaaatgtcctgctcattttataattggcatttccagcagaatttttttaacttgagaatgacatgactattgcttttgctcacctgtctttttctgttttcatccgtgcataaagtcactcctctttctgttctgactttttgctgtccatagacatcccagttaccagtgtccttgaattgatagtggcttctgtttgtcagtctcatataagaactacagctcatcaggaggagatcgcagcagggtaagagacaccaacaccatgttctgcacgaagctcaaggatctcaagatcacaggagagtgtcctttctccttactggcaccaggtcaagttcctaacgagtcttcagaggaggcagcaggaagctcagagagctgcaaagcaaccgtgcccatctgtcaagacattcctgagaagaacatacaagaaagtcttcctcaaagaaaaaccagtcggagccgagtctatcttcacactttggcagagagtatttgcaaactgattttcccagaggtgagtgcgtgctctttagattttgaaattgtaatactttgaaattgtagaagaatgtttttccaaggaaaatttaaacacttcctttctcactttcaaggctacaataaatgtagaatattttcttgaaacacataaaaatattcttttaaagcaattgtgttcttaagttgtgttttatcttaaaatgtttatgatcttgaattcttttcaaaagaacactgcagtctgacaaactttatgattttgggcaacaggcttaatgcctctttacctcagcttccttatccctaaaatggaaataatagtagtacccaccttctacagttttaatgagttttaagtgaaaccatccatagctcttgccataacataagtgatcagtagttgttagctattatcttaaaattaaattcttcaaagaataacttattttctgctcaaattttctctcctaattttaaagagcatcatacgtcccctgccagttttcagagttgtgaaaatctcccttggccacttgctctgattctgaagttctgctcaagccagtcttgactttctcccttgggtcggagtcatgagcctgtgattgcctacacctgcgtgttattaggtctcacacttcttcatatagccctgcaagctgcatagcatagtgtcatgttgagatctagagcaccttctgtcaatccaccttgaaggaaacttctgggaagaggacacagacctaaataaatagaagagcagttgaaggtcttcatgatgtcttcctccctctgtcagtcttcatagttttatatagatttgcttaacctatgaatttggctggacattgacttaatcagacaccagctaacataatacattgataatttttaattgactcaataccaaccctctactgtgtgcaaagcaccaaagaaacacggactggctgattttcagaactgaaaggaatttaacagataatcttgtttcactcccaggaagtgctagggaagttcagtgacttgaccaaaattacacagctttcaaagggtagagcaattaattcctgctgtaaacagtccaggctggaatgactgagaaagaagaaattgaagtttgaaagatggataaattagacttagcagaaagttgagggagtttatttcagatataatattaacacaatagtactttggcagataacctttgaaatggaaatgtttaattattcttaccacactctagttgctagacagccagcattggctaggataaaggatatagccctcctcagggagttggtttgtagcacagtctgggaaacaatcggtgctctcatttcaaggacagagtgaaatgaacagaaatgaaccaaaggtgatgatgaggaagctgagattgcttctatgttttccctgaatcctgtccttactatgttggctttatcattttgtttggtaaattttgaatttctgcaatggaagtcatacacatattggactcttttttaaaaaacattatggttcacctccagcctgggcgacagagcgagactctgtctcaacaacaacaacaaaaaaattctggttcacttgatggtgccaccaaaagttccacaggcttccttcattctttttcattcattcttctttttgcccttctgactgaataacttcaaatgacctctcttgaatttgctgattctttggcttaagtctgctgttaatgctttccattgagtttttcagttcagttattctttcattccagaatttttacttggctctatttttgtggttatctctttgttgatgtttacattttgctcatgcatagttttcttattttatttagttgtctgtctgtgttttcttataacccactaaatttcattatattgaattttttgtcaggtaattcattgttcttcatttctttagggctggttactgtagatttatttatttatttatttatttggttgtatcatatttccctgatttttcgtgtcccttgtagctttgcattggtgcctgcacacttgagtatgcagtcacctctttgcttcttttcagactggttttcacaggaaaagacattcaccaattggctcagctagagattttgagagcctctcaaacattttctatggatgtgcatgttccattcctctcttttcctgctgagggagaagtttctgggtggtgtgccttctcctgatcctgaagagccatacaggctgctataaacttcccttctctttttcctaggaaaatgtactgaaagactaggatgcaataccaaattaaaattgtatataaaaaatttagtagtctatgttgtttgttcatgagtttgtaagaataagcattaagatttgactacagtgtcatgtaacagagagggcaagactataggagatggaagaggtatgtttggcattagtaactaaaactcctctccaactgagatattatcgttatggcagtaaatgttccagtgttgaatacatttgagctgtgtagtcctcaatctagatgacttcaaacatctgcttatctttgataaatacttgttatgtttttttactgattatttgttaagtttatagatttaatgcttagactgctatttagtgtcagttgtattaataatacaaaagaagatatttaaaatagcatttgacatcacaatttttgttttagataatcagaattaacttcctggttatatttttattagtgaacaggcaagtataaaaatgtattatccttagaaaatgtaacatgagagaggtcgttctcaagtaatggaatactagagctttaaaaagtcttcttgatcatctaatgcaaacttatcatttctattttaagaaatagagacacataaatttagatctcttgcttaaagcaaaagataactggagaaatggaaaactctctgcatttcattcacaacccattgctcttcataatataatattgtttgctcttttttcatgggtattgtttcccaataattctgtaagctccttcaggcatactgtcttgaaggagcttttaatggagccacagtcaaagcaaatcagaaaccacttactgaattgaaataattgaattggatatgcttacataaatgataagatcccaaatcaagtacctagtaagagtaggatttgaagagaatcacgaggtctgtagatgtgttctagaatattaggttgaaagaagaaaaagaaacagtattacaatttatcttatgaattaaaatattattggtctagaaaaacgttaagcactgtaggaaaattaaaaagccaatgaaaatagtgacttatccataaaccacaccaatgatatttttattaaaattcacattgttgacagcaatgttgcatcaaatagcagtttttcctgaagtattcatatatggtatatttgtggcaaaagtacttgttttaataatttaatcagatctattctttatgagccaaaagataattgtttagtcaagagaaacaaacttgagagcactacaaactatttgcattggggaacaagtgtcccctctgtgaatcagaaagtccacaatctacaatacttcaggttccagtgattgtacaaataagaggatctgttcccccaaaattcaaaataaaggctttcccaaatagtagggtgttttagtgatagacaactaaaagatttacaaaagactgctacacaatgtttacatatattgaactgtaaggaatgaatttggaaggaaatattggatttagttctaaaatctgaaaccaaaaattaatatatagaattgttggggtatggagcagtcctgaagtggttgattttatgttatgaggccctgaggttggctgtgtgtgacagatctcacttatagttgaatcctgcttataattttattgtggactcatattatctcagggtcaggatatatcacaggaagtacagcaccaaggtaggaaactcgatgcaccagcagcctctaccaataaatattctgcctggaaaacatgtgagttctgtctcttatgggttttgttttgaatttacaaaaattttccagaagagcaatggtataagatgaatgtcaatttccataaaagcctattcactcataatattggtcaagtatgctactaatgctttgcacggactttattcctttttttctttaggaaaataagttttgattcaaaatggaaagccaaacatacatttgctccaccaaccttagcaattggaaggggaccatttctcctcccctcttacaatgatagtgtatacgttaggaggaaaagaccagaaaaagacatttctggtggcagtaggaaggaaatgaaagacaaataaacatcttgactaaaaaggtaaaagagtatacccaatggcttaatcagagacataaagaggagtggagtatctccagtagcattgaagaggaagaagaaagcattcttcagtggcagaattggttgggttttctttctccctggcccacaaaatgttcctggtcagggcgagcatggtggctcatacttgtagtcccagctacttgggaggctgaggcaagaggatcactggagctcaggagttcttggctgtagtgaactgtgatcaccactgcactccagcctggatgaaagagcaaaactctatatccaaaaaaaaaaaaaaaaagaagttcctggttcaagaagcaattaatatatatataaacaaatataattgaaatagtttacattggaaacaacctaaatttgtttgtaaacaagctaagagagtaacacctctatatctggctttatcacttcacagataaaattttatagattaagccttcaagactttgaatagctggcaggtggacatcattcattcattcattcattcattcattcaataaatatgtattgaacatctcctatggataggtaccattgtaggttttggatggaggggtaagcaaaaccgacactctctgcccttttggagcttctgttgtaatggaagagacagattatgaaaaatttacaaagttggcgagcaaatgctatgaagaaaaactgagagctcaggcacaaaggcagcaacccttattttattaaagacttcttttttcatatgaatgtattttgcaggaacaaataattcatagccactcatgctttcatggatttgtatccacattgatactctgttaactggagtaactttctactgtaccaagtagatggttcttgaaatatttaaacatttcaagcaccctggctgatttacttcatgtatagtgtcactaatttaatgttaccttcctttttccttgatgagaaagatgtctaggaaatatgcccatagtttctttcttgaacatgtttctcaactgccctttgcctttacatagctcaccaagcccgactcagaatctgccctctgggtgcgtcttccaccagcttttctttcatcctgtggcagatagtatcctttctctctatatctgaacagtctgaaaaattgttccacattgtaaatttaaattctctttaattttttttcagcaattgtgttttctttcaatacatttttaaattttctttctaagctttgtatgtgtatatttaaaactaaaagcccttttcataactcatgtcattaaaacagaaccttgatctattttggtttactccagtacctcacttgactggtggaaactctacaagagatataaatagtttttaaggaaaaaggaatttcttaacttgggacagcaaaaaatttttcactttcctctggggaaactatagaaagaatcaatggttctatatatataatatatagttttatatatatctctatatatacacacatatatagtgagagggaggtacatacatagatacatatgatttttacatggaatatataaaaatggacaacactgcttatcaatgctctactttccacttatttattagagacaatcagctgttaagataaattaatagctactcaacatgtatttattaagtataaaagcttacatacaaatgtcttgcaaaataaggaaactcatgaaattctcagaaatcaataaaagaaaataaaaccataagtatttgatgaggattattagttcaaagaaaggaaatcagtgtaagccaaggtaaacccaaggctcatttcaaataaatgatcaactaactttggtgacagattggatttaagagatcaaaaaaggaagagacagagataactccagagtttgctagacaagaagatgatatgaatgtatagttaagggcagagagtcactggggcagctgggtgtggagtttgtgaaaggaacagaaatttgcttggcttggtccatgctgagattgaagtattggccgcccgtccagagggatttcctgactcagaggaagtgatgcccatggaatcctatattgcagaagacctaacactaccaaactgaaatcttctgtttgggttcacactcagctcaactattctgtggctgtcagtgagaccaccaccaaaggctaaacctgtgggccacaacacatatccaatctcagattagtctcagcacattgcttcctctccagtttgaaaaacacatagaaaatcacttccagtttccaaagtgaaaattcataacatttatcattcaagcaattgtataatgtgctttattctcgaaaataaatcttcaggatgcatttttaaatatataattccaaacaaattattatataagggaatgtttaaaacatttcttttgaactttcagtttgaacggctgaatgttgcacttcagagaacattggcaaagcacaaaataaaagaaagcaggtaagtcaaaccactttagttgtgtgaacctcttattacaatgactaatactgctactaatggccagcagttactgaatgtgtcagccctttattgaatcattgtggtatgtcagaaactggacttagtactttagctgatactaatttcaaagtaagtgcatctatttatcacattttataaatgattaaactcaggtttatatgaagtatttagaattttatagccgtttaaggaaaagacagagctggggttcgagcctgggtttttcagagccattattttaagcatgtagttataaactgctgctttaacaagctcctgtaaggccgattcttttgtactaattggtaacttctaaaatatttaacaacaggtaagtcatggatcccaaacaatcaagacttcctgcctgaaggatgctgccaaagttttgagcagggtcccagcaggtaccccatccccaacacacatctcaacaacatgttaatactttagtatctgcatcaggaggaggtagaaggatcaagtgcttaagaggagggggactcagggttccggggggtagcagctgtttattaatccttagggaagtgtttctgtattctcctaactagtttggttgcactgcagaacatcagtttgtttatactttttttctagtattctttgaaattttcctttaaagcatttctgaagaggcttaatataaagttactttttattttttattttttttttagaaacagggtctcactctgtcatccaggctgaatgcagtggtgtgatcatagctcactgctgcccagaactcctgggctcaggccatccttctgcctcagcctcccaaaaaactgagattaagggcatggacctaaagttacttttttaaaatttatttttatttttttgagacagggtcttgctctgtcgcctaggctggagtgcagtgcaatcttggctcactacaacctctgcctccctggctcaagccattttcccacatcaacctctcgagcagctgggactacaggcatgtgccaccatgctcacctaatttttgttttggtttttgttttgtagagatggggtttcaccgtgttgctcaggctggtctcaaactcatgagctcaagcattcacccgcgttggcctccaaaactgctaggattacaggcatgcgccactgcgccttgtctctaaagttacattttttaaatctgatttatttagtgaatcaaatacaatttagcacatttactgctgacagaaaatgtaataggggccaggcacggtggcaaatcccagccctttgggaggtcaaggtagacagatcacctgcggtcaggagttcgagaccagactggccaacatggcgaaaccccgtctctactaaaaacacaaaaattagccaggcatggtggcagatgcctgtaatcccagctaatcaggcaggagaatggcctgaacccaggagacagaggttgcagtgagccaagattgtgccactgcactccagcctgggcgacagagtgagactccatctcaaaaaaaaaaaaaaaaaaaagtaataggccccgtttttgattccctgaaatttcaaggtttatttggtctataaataatagaataaatactggtgttgaaatttgcagaactgaacattggagttttacaaaccagcactattgtcaggaatgttttaacaattcattcatctgtctcctactcatgagtgatcatctgctctgtggatcatatgtgcttgattttccttgctgactagctggtcccagactgcaggcagcaggaccaagccaagaaggggtcatggacaggtccagaaggaaagagtgtgaatctatgtgtctgacagaagctttgtttacacgagtaacatgagaagcattccagaacacctctgaccttaataaccagtcaagctgataagatagtcttaagtctctcactgtgctactgtgtctgtctgcttaagtccttggcagccagtttactcaaaatttattctcagggctttgtgttctgaatcgttcctacagcttcttgcaatactcagttatgatgtgtttccagcagtgtgcctcttaaaataatctcaaaacttaagccaacaataattatttttttgaaattttgaaatttttgtttaccacttccctgatgtccctaaatataaaaaaaagaaatctgattatacttttaaattttcttgatgagaactattcagttgttgaaacaagatttttgctcataagcctgcctgctgatatgttaagtggttcctctgtgcttttttagttttggggtatcctcttgtttaaagattttttacttcactttcttattggtaagtcactgccatttttattgctgtcagtttgccaactgctgaacacaacttaactcttttttgtgctgcttattctcttctacgaattgacaaacaaaaatccaatatatcaaccaataaactgcccttgaatgaaggactagagctgcccccctcctcttttttttttttcagtgaatgagtgttagtatagccatcatgtccctcaggattggttgcccagagagttcttgcttagtttctttttctgggatcttttgatcacatcattatatgtatgaactcatgctggtgtgtgtgtgtgtgtgtgtatttgtataaggcacacatgtgttggctggtgcatgtgcaatgcttacacccacttgcattttttgaaggtgagggtaggaattgtagtttgaattgcactatgtgctgtttggacaaactaagcttcgctcatttggcaaattttgtcataatcactcatcactatcagaaatcatcacaaacaattaggcaaacatgaatcaacaagtcgtgcagttaaaactgcaaaaaaatcttatcaataaaaaagcatgctattatagtctcaatttctatgctgtaaaacaagtgcagtaattgcatgaagaataggtttctttcattactaattttttatacaaaatcaaggattaaagtttaatataatgatatctgagagataaacacagccttaaactaagaagcaaaagattctatgtatttgctttaggaaaatatataatattacttaaaagtgaattctatctgtatgtaggtttttcttggttatcagaattaccatcctcttcttggccacttcacatttgaggttgctagccagggaaggttctcctgagtacagagtctccttgacctacagtggagttacgtccagataaacccatcgtaacttgaaaacaccctaagtggaaaatgcatttaacacgcttaacctactgaatagcttagccttgcctaccttacatgtcctcagcaacttaaagtagcatagagttaggcaaaatcatctggcaacacagtgcactgtagagtaccggttgtttaccctcacaatttcatggccacatgagagctgtggctcactgccactgcccagcatcacatgagagcattgtactccatacctgtagcatgggagaaaatcaaaattcaaactttgaagtacagtttccactgaatacttacagcttttgcaccgatataaaggtaaaaaaaaaaaaaatcctaagtctgagactgtctgtattagtctatgtaaagttcactttaaaggtaaatatttcttatgaagaataacaaaacattctatgtcatatatattttggggttttccaacattgttctggatggtatatgtcattgctcctttctcataaaattgatagtcaagatttgcttctacagaaaagggaatttaaactattttctttctttctttctttcttttttttttttttgagacagtttccctgtgttggccaggctagagtgcagtggtggctgatctcggctcactgctacctctgccccgccaggtcccggttcaagtaattcttctgcctcagcctcccaagtagctgggattataggcacacgccaccatgcccagctaatttttgtatttttagcagagatggggtttcaccatattggccaggctgctcttgaactcctgaccttgtgatccacccacctcggcctcccaaagtgctgggattacaggcgtgagccgctgtgcctggcctaatttaaactattttctatcattgtttctgtatattataatctgaacttttagcatgtatttataagtttataacttaaaatattgaaatatttccaggaaatctttggaaagagaagactttgaaaaaacaattgcagagcaagcagttgcagcaggtaatagaattgtttatgtaattagaaagtatgccatatacctgtagaactcacattttctccaaaaatattcatatttatttgttggtgactcccagtatgaagtgttcaatattatgtattctgttaacgtaaagagtaactctttttgatactatatgtttttgtttgacctaaaacattttctctgtttatgtttacttgctgaggagtagataaggctagatgggaagctgtctcacagatattcacaggctttgatcttgaacctaactaactgttcctcatttatacatcaaaaattctactcaacaaggtaaaataaagaatgcttttaaaggttaggagcagtcatgggaaaaaagttaacagtattctcacattaatgattagtttgagagaaaaaattgatatgtgactttgtcttgctgtcctttccaaagtttcagtacatgaaccacgaggttgcatctttctaaaagtataagatattgataataataataatgactaacgtatattgaggcccccctaggagcaaggccctattctgaatataagccccacaacagtgctatgaagagggcactattctttttcccacattacagataagaaaaaatgtggtactcagagtgtaaagattaaaggagattatagaaagggaagatcatacagagcacccttgacataactaactccatctttaaaaaagactccattttgtattttgtagggcattttgccaacaaaaatagcatgttttatttaataaacaaatttaaaaaaatgaaaactacatacaacaagataaaaacacaaacacacttttccactatcagttctcaccagaggactctgtaactataaaaaattaaaccttcaacaactcaaaacggtcgtcctaactgacaccttcttacattcactcgtgataaaaactggacatctgccaccaaaggctctgccatctcaaagagtctttcttataagacggcctgacccaaaccaagactccttttgtcttcttcaccatacccaccctcctttgttaattctttctcctatctctttttccttttgatgttaagtgttactttgttacaaaatatttaacctataacatttatattttctatattaattaagcatactattatgtatcgtttacaatactaactgatttgtggagtgacttgagcctgtgtgcctgcagctctaagaaacaagtaaacagaaagtactaaaaaaactgcctcttggcaaggcatggtggttcacgcctataatcccagcactttaggaggccgaggtgggcagatcacctgaggtcaggagttcaagaccagcctggccaacatggtgaaaacccgtctctactaaaagtacaaaaattaggcaggcatgctcgtgtgcacctgtagtcccagctactctggaggtgaggcataagaatcacctaaacctgggaggcagagcttacagtgagccgagatcgcaccactgcactccagcctgggcgacagagcgagactctgtctcaaagaagaaaaaaaaaattgcctccttaaaaacttcatgtaactcatggcttttatgataaaaaataatattaataaaagcctaacattgtaaaaagacacagacatacagaggcttatttctaaccttatagcactcgtgaaaatgctatagaaagtaaattatatactccaagcagacattcattcagctaacactaaacaacaagaatgcgatttgattcaggaaaaaatgctttgtaatcatttctagacaaaactgagtttcatgccagtaattttaaattaacttccgtgtctgacccttttgctgctggaaaccctcatagaggaagatcctcttcatgaggatggattgcttttgttgttaacagaaagattggaggacttttgccaaaatgtacttaatactggaattcaaattattcttttgtagttaggtttcagggagataaaaagttgtgtattatactcaaccggtcattcttttttaatgaactagtttgggatttttcttcagttactagaattttagaagctaacctaggtagataatttggatataggggtttcattttggttggaaatgttattagcagatataaagggagctaaatcagcaaataacgcaagttgaaaataggaataatggcacagctttaccaaggtggcatatttgatatggcagaacatgtattatgtgatttcaggagttccagtggaggttatcaaagaatctcttggtgaagaggtttttaaaatatgttacgaggaagatgaaaacatccttggggtggttggaggcacccttaaagattttttaaacagcttcagtacccttctgaaacagagcagccattgccaagaagcaggaaaaaggggcaggcttgaggacgcctccattctatgcctggataaggaggatgattttctacatgtttactacttcttccctaagagaaccacctccctgattcttcccggcatcataaaggcagctgctcacgtattatatgaaacggaagtggaagtgtcgttaatgcctccctgcttccataatgattgcagcgagtttgtgaatcagccctacttgttgtactccgttcacatgaaaagcaccaagccatccctgtcccccagcaaaccccagtcctcgctggtgattcccacatcgctattctgcaagacatttccattccatttcatgtttgacaaagatatgacaattctgcaatttggcaatggcatcagaaggctgatgaacaggagagactttcaaggaaagcctaattttgaagaatactttgaaattctgactccaaaaatcaaccagacgtttagcgggatcatgactatgttgaatatgcagtttgttgtacgagtgaggagatgggacaactctgtgaagaaatcttcaagggtaaggaaaacataatactatcttgaatatgaaagctatttcatatttaagagcaagaaacaaaagggtaaaaatatatgcatcacttcaaatgtttgataaaacatatgtaaaacaatggtaaaagaattgtaaagctgtaataaactgaaaacaaaattctttctgcatttgtttgcttacttgattcattactccaaaaatatttattgaatgcagtctgccttttaatatctttatggaatgttttataatgaaatttgataaatgtttatataaaaatgttttcaattatcaaatagctgacttaggttgaataataagaggtattgttttacaacaaacaaaagtcacttgtttcttgtaggaggcaactaaatggatttttaatcaacatttaatagacatgaaaaaaacaaataatttatttgattaattgttaccgaatgtggaagttaaaacatattctgtcatctcatggtagagagctttggtaattatttagtctcaggaaagaaagtttgctaactcatagttgataatacaagcaaagctaagagagaagtttcacacatgtataactttaacagaagcaccatttgttccccaaaaggaaaacagctttattattgcttttctatcataaaaataataaaatatattgagatgtttaaaaaatgagtaatattgaaaggtgtttattgtagcaaaaaaatgaaaaactaattatatacattttttgtttaaaacaaaaaaatgctattttacaactgcttttatcatgaaacagtgtattttgtgcatcctcccatgtcattagatataggtctatttggctttcttggagtcttagtggtatcccatcatatggttgtgctctattttattttatttatttagactgcgtcttgctctgtcgcccaggctggagtgcagtggcgtgttctcagctcactgcaacctccaactccggggttcaagcagttctccccgcttcagcctctcgagtagctgggattacaggcttgcaccaccacatccggctaatttttgtattttttatacagacaaagtttcgccatgttggccaggctggtcttgaactcctgaccttgggtgatccatccgcctcgttctcctaagctctactttatttaactagtaccctactgaaggatatttgggttgcttttggctttttgctgcaagaacacacatgcacatctttgtccacacatgtgcaagtaaaccttcttgtggtccaggatgatcacttgaagccccatctctctcacgacagaaaaaaaaattaagataaaaatcttacctttggaggctttttcacttccatacctgccagatggagcaagtacttatgggagaagtggggaagagaagagaaacatgctaaaagagaaggaagccaaaaaaatagaacaaagaaaaaagtaagagggagggaagaaggaagaaagaaaggacacattttcctgactaccatattatacaaaaaatagaacttcagattaatcaagtgagaccattaagaagaatatagtagcaaaagcatcagcatgctgcttagtgagaaagccttgaagcaagagcgttttgcattgttcattgtaaatcttgatttctgtgtagagtatactctaatatactcttcaaacatctgcacgcattttagaactcatagaaaataggaactataagaaagcaaattgttccttttcagcaggtttaaacacaaagggtttattactgtatctacttccccttcttttgtctcagaaagatgtgggaaacttgaataaaccacaattggttatcctttccttcataggttatggacctcaaaggccaaatgatctacattgttgaatccagtgcaatcttgtttttggggtcaccctgtgtggacagattagaagattttacaggacgagggctctacctctcagacatcccaattcacaatgcactgagggatgtggtcttaataggggaacaagcccgagctcaagatggcctgaagaagaggctggggaagctgaaggctacccttgagcaagcccaccaagccctggaggaggagaagaaaaagacagtagaccttctgtgctccatatttccctgtgaggttgctcagcagctgtggcaagggcaagttgtgcaagccaagaagttcagtaatgtcaccatgctcttctcagacatcgttgggttcactgccatctgctcccagtgctcaccgctgcaggtcatcaccatgctcaatgcactgtacactcgcttcgaccagcagtgtggagagctggatgtctacaaggtaggagtggaccagggaaataattgttttaccagcaaactcactggggaacaagcactgtgcctaggacctgaattataatgcaactgaaaggccacctctgtagggtcttgcaagcccagtcctgggagcaggtatggtgcattcattatgtgggtgttttccagccagcaatagctctgaatctgcccagaaacagagataattgttctgggaggactgccacactgtcctctcaaagaatgaggagagaatggagggaggatagggtgctcaaagaatggaggatggggtgtaggacctgtgaataggagaagtttaatagtgaatctgccacttcactgtggaaaccgagttgaattattaagtgtgagataattcaaagtatggcttatacaaggaaacattatcctttgtatctgtaagagtaaagacacatgaggattataaaaattgcctttaaatagattacttcaatatagagttaacatgatacttttcatggccagttaacagaaatcaaaatcacctacttaaggcatttttgcagcttggccaagggcagagacatttgaaaaagaaagacctatcttcaaatcttgttctctgccttacttgctttgtaaactgaccaagttaaaaaacctttctcatcacttctaagacagagaaaataatattcactcacagagtttatatgcatgaataacacacattatctcccataatcttcatgaacaggattgttataaagattatgttaggtaatacatgatattcatcagtcatacaggatgagccaggcatcattgtaggcactggggatacagcagtgaccatccctgataccttttctttttaaacgtaactactattagtaagagagctaatgaagagatttcaagttctgcctgcttctttagaattaaaagtttttactgatttaaattactttgctttcttttagacattggcactaagaataaagcgtatttctcatttgtatggcttgaatcatcttctgaacttgccacataacaatctgacatttcagagctgaacccaacaggaaataaataaattattgtggaagaaacgaatattattcatgataatacataagctcttgtcttgttttattctagatgccagaagtaaaaccttacttttaaaaattcctaacaggaaagtccaaacagagccatgattcccttggggaaaaagaggtccatgtatacttacagaaaaaataattggcttcagttacgttaagtttgatggcctcttgtggaatttactatatttatttgtagccattttctatcttgagacggtctcctgtcttagaattgtgagaaggaagtctctcttccttgcaaactgctgtaattgctaacagaagtagccctcttctacttttggttatttctatcaaggatatagggtatagtttttaagtatcctgacaagcattttgaaactatgctcctcactgtaaggtataaggacaacagccacagagttccctgattaatctaactagagttgtaactagatagtaaattaccttctatgccagccctcatttctacttttttttcacttctgattttgcttgagattacttcgagatagctgaaaataaatatagaagggtttcagatacacaaaatgtataatcgtagcctaccctatgagtgccaatggctttgaaagaatagtcagcgttatttattccaagactggattatactagggctttatttaattttattttctctctgtctttcttgggtttttggccatttttctgtttctctctgtgttcatttacccattgtttcagcgaatatgtactggttatccagcatttgccagcatgggtgcgcagtggctacagagctagagggtacaatccctgtgaggaaagttcacatatggagagggagaagagggcacaatggaccaatgccagatttccatatgacgtgacgaagggatgcagtatgcacaaagggctgcaaaagcagatatggtaggcccctaacatcaggtaggggtgggtgtaggacttcttctaattagcctatttattgagcacctgtgatggccatcatgatgagcacttcttatgtactcattgctgagaaaaagcttatgggtggcattgccacctggttcattcattactgggcacaggtaatgtaggagtcaataaactagacaaactcaaagggcttacatatgattaggggaaacaaagacaataaacaaatgagtaaatttatagtatttaagtcagtataataatgtgaaagaaaaataaagtaggttaaggggaagaagaagggcagtgggtaaggggtgattgctatttcttagagggtggtaggaatcagcttttctaataaggtgaggttttagcagggactgaaggaaaggagggacaaccacgtggttatctgcagagagattgctccaggagaaaggaatagcaagtgggagcatgtttgatgtgcttaaaggataatggaaggcagtgacattggaactaagtgagcaatatggagaataagaagataaagtcagagattaggagaaagacaggtaaagaagaaatctggagccataataagggtatcagcatctactctgaggggaatttctgaagatttgtgcctcctttcttttttcctttctcaccctcatcctttcacaattgaggctttgtgtaagaataatagggtcttatagttacaataaacatttggagaagaagaaaaatgaagctcttagaattagggggttatttctggactaaaattaactatctgctttttgcagccagcatcacagacagataaaaattgcctgtaacgacaacaataatgatgatgataatgataaggttaatacttagatttttgataatagcttgatttccagtggtctttcaaacaccaccgttgtttttacctgctggttcaacatcttggtttttataattgtgattagtatccattagatatgtaattgctatgaggaccccaagggtcctttagaagaaccgtttctctttactcttatgactattaatatcttggttttacattgcacaattttactgcattgatgtgacatttattgagtagtgacttgaggcaaaatactattttatgatgaggaggatataaaacgagtaaatgatcccaacatctttaaacaatttattataattcaaaaatatattgtttctacaaaaactatcttatatggtgaaaaaaaagagatgaaatgatatgatgagtcagtgtgcaaatctgggagtagaagtcaactgttactgtgttcataggactgtactgcctctcagtgcagtgcctcaatgtaatgggtctaaaccttgcgcatttcctgaaaaagaaagccatttctgggcgtatctgattaaccctgatcctccagaaggcctgagcaatgagaattctgctatatgacttaatttcttctatccgatgtaggctgtgattcttcctgagcatttatttatagtatggaaaatatattatgtctaggtggagaccattggcgatgcctattgtgtagctgggggattacacaaagagagtgatactcatgctgttcagatagcgctgatggccctgaagatgatggagctctctgatgaagttatgtctccccatggagaacctatcaaggtaaggcagatgatatattgtccaaaagatgtcacaagagcaaatgcgtatagttgattaccaaaaccatggtgtatcagttgggggttagttgagagagagagagaaagcaaaatctatatagagaacacaatcttctctaacttgtttacattggaagaaatttattatagggtattaaatggcttacagaatcattgagaggacagaagaacccatctataagttgggctttcaaaaaatgtttcccatagtatagggattttctattgtcaaagtaaaatggcttctaaaggcaaacttcagaacaactgcattttcaaaaatctggaagctgattccaaaactatcctaccaaagccacagtcaggaaactgccatgttcagaaagctgctgcctcttcaaaaccacatctactgtaataatcagcaagatggcaatcctgcatcatgacttacaaaatgagtgatgggaaaatggactctctactaagcatgctatagaaaacacaaaggcttccacaattgttcttgagttatagtggagattgtgcctgccgaatctcatgcaactgtgcatctgatttaccaagcctaactgcatttagaagctgcaagttagtttagaaaatgtagttttagttttccagcccctggaggagaggatattacatttgaatggatgttgactgttaattcaccaatattttccaaggcacgtgacatttcaaaatttctagatgagccagattccagactaatatctcaccacacatgaggaaataaagttaacatggtaggcattggtttaacagatagaatataagcagattacctttgtctcacagtgaatctgccccttaatttttataggacagtcctcagttgactaccttcagaaataagcctttgaggtattgtaaaatcttatccggtatgctataaaacatatagagaagaaagaagaaatttaaaaacaaaactatatttggagatttacccttaactctctttaaccttaatagaagccatatgtttaagccttcgtaactattttctaagtctattgtcatcccatttatatgtttctgtgcaacatacttttctaaatttaatggtataaaatcacaaacttttattatgcgtggattctgtgcatcaaaaatttggataagtcatagcaggaatacctcgtctgtgctctacaatctatgggacctcagctgggaataccgaaatgggtgagggtgcctggaatagctgggattgcaacgattgaagctggaggattcattccaagactgctgcttcacttacatgtcagattccttggtggggatggctgaaaggttgggttcagctgggattgttagcgttacatgtgatgccctaatatgtattttttatgaggtggttcatgtcccactgaacaagactggtggaagctgcatgacttagtcttggaagacacaccgcaacacttccactgcactctatcagccagagcaatcacaagtctgcccagaagagagagggctcagagcccaagaatcaataggaggagtgtaaaataatttgcaagtatgttttaaaagcatcacaatatctgactttttcagatttattttcgataattgcatttttttagaggaggactatatatttctttctctttctaatttgtttgagggggcttgtagcatcaatgtaaatgttaaaaatatctagactattaacaacattttaagtgattttcacacaaatacattttataattaagatgtgtatgtttggggtgggggaatttatggcatttttgttatttgcagaaatgtatttttagatttttctaagttggaagaattatttatagctagtttcaaagatagttacctgggtaatgatagattagtttaaaagacctataaagggaatcattaatcatacctttttatgcatactaacctgcagccctgggaaatatctgacgtccctaaaagataccggtgaaacatcacagaggcagagtggagagtatttttagtagggaaactttaacatgtatcagaaaggagcatattgtgacttaacatcgtctcatttaatccttataataacactttaaagaggcatctacactggcagacacgagcagtcaagtctcctatgtgtcagtatttggagtcatgtccatgtgacttcaaagcccaggctttttctgcttcttgccctgctacctcttggtatagaattgaagtgaaagaatagaaaatattttctttttttatttttcaaactctatgctttcctttagcacgtcacatgtgcaaatcattcatctattcatttattcccattgatttcctcactaacatccatccagtcaggcttagaaagcagcaggtgggttggtgacagagaccagtgggctgagtgtaaccgtgaaagtcagtaggtgacaagtgaacacggaagcaaacttctagtacccctcctttcctaagcctagaagcttatgatgagaaatgggctatgccacaagtggtctcaaatagaagatgcccttagtaggttcccattcaaacttttcccgggagccagaattctgcctttgcctttcattatttcacagggaagtctgttaccagtgaaaagagatatgctcagggcacgatgtgtgtcttaaacacgttgtgttttaaatcttgctgatgaatttgaaaagctctgtaagaaaatgttagggttgagagattcaaaactggagaaggggaggaaggcagcacggcatggaaggactaggagggacacttgccttgtctgcatcgtttcggtttttacgagcagaatatatttacattttaattatgaaacaagataaaaatgctatggtaaatttaatatataataagctggagtaactaagtataggaagaaaaactggtttaaccagaagagtgctcacagaaagcaaaaattcctcaatctaaatatgctgaagtcatagttgatatttatgagcagaagagctttattctatctatctatctatctatctatctatctatctatctatcacttgctaaatgtgtaaattaatattctcctaaaagagacaaagccagatatataacagacatctaagttttgcttgttaaagtaaaactttgatgaagaaaggtctttaaaaataatcaaacccctgcattttataggtgaaaacatgatcggagggaagtaaagagacttaaggaagccagactaccagttactagtagagcttgttagaatacaaagttcctgattcacagtctagtgcttttgtttgaaaattttgtagaactcatatgacatcttaaaagtaaatgagtctggaaagtttctagcagatatctgaaattagttattaaaactagacataactgaattcttctgatttctaaattatatccaagttactgagttcttggtcttcattcaaaacgcatacatctaatacaactttttaaaatggttgagtaaacaaagagtttgaaaataattaacatggtatcatcatcatttaaaatatctccactttagcttgttttgtagtagcagtaatttaagtgtttgtgaatcttttaagatcatcaagtaatcagacctttgaagattccattgttaaatatcctgctttggctaggcaaggtgacttacatttgtaatcctagcactttgggaagttgaggcaggaggatcacttgagcccaagagtttgagaatcagctgggcaacatagcaagaccttgtctctacaaaaaatttaaaacttatccaggtgtgatggtgcatgcctgtagttctagctactcaggaggctgagatgggaggatcatttgggcccaggggttcgaggttacagtgaactatgatggtaccgctgcactacagcctgagtgacagagcaagactctgtctctaaaaaataaataaaataaaacattctgtctcagtggctttccaaatcattggagacttccagaattcctaaaattttgccacaacacatcccagactgcctcttatatctaggcatggcacaaatctgatctttcatcagtatggatttttaatttcatgtatatagacattgtcatcgtcattggactcaagtaccttccactttctgcttcctctgtcattttctgcttaaatattacaatttcatttcctcagttgtaagtcattagaacagtgggatagtgtttggtataaagctattttgaggtaaaatgtctaaaagatatatttaatatccttagagctagcttcatttgcccttctttgtcagtgtttgggaaaatgattccaggagtccagaaattatgtctatctcacttgaatgagaggtggcagtttcacataaacagctcatatcccccttgctatgttgctgtggttactatgatccctgtgcatggaaacttgtttcagatgttgaagacagacacaattaagatggtttgtgtaataaacctaaatggaaaagagttaagaagtgtgactgttgattctgcactagtaatttttaattgcatgtgaggagtagagggaagttggctgaaggttttgaggaaaggggtggtgtcctgagggtgaatggtaaaataatttagacggtattcaaacgacactgacgagtaggaagtgttttaccagtgactgggaacatcatgttattttttgctttcagatgcgaattggactgcactctggatcagtttttgctggcgtcgttggagttaaaatgccccgttactgtctttttggaaacaatgtcactctggctaacaaatttgagtcctgcagtgtaccacgaaaaatcaatgtcagcccaacaacttacaggtagtaattatgttaaacacctaaaatctcttgtttttatttatatacaattgccatttgccccactgatttgattcattcttcataacttttttcttccttagtcgtaaggaaaaaagaaacgtgataacttttatcatcctcactttaacttttttacactgcttattagcctcctaagaatgacttgcctgaggtgtttgtggcccagccataaatccatgacagatattacatagtcttccatcattcttcttttagaagcacatattaatactcttagtatgttgataggtgttctgacatcaactagtacactgcagtgcagttctggcagtaaacacccagactcagcacagtcataaccacaagttacagggcacagaacccaacaagcctgcccttaattcagatgccagccacccttcaggacctaagtatgcatttagacgactgagctacaattttgggggttcccatgaacctctcaagttagataattatctaaaatgactcacaatacttagggaattgctatacttactattacagttttatttcgaaggatacaaatcagaaccaaccaaatgaagaaacagtttgggtaaggtttgggagggtcccaaatgcagagcttccatagaatcagaacttatctccctccagccacctcagtgggttcacaagccaggaagctccacctgattgagctttgagtttggtgtatggagtcttattgttttcattatgtaggcatgattcgttgaatcattggccatgtgattgaactcagtcaccacccccactctcctccccagaggttaggctagcacaaaaccccaaccttctatccacaagattgatttttctggggccctgcccccattctgagtcatctcattaatataaactcaaaagtgatccaagggcctcatggaaaacagatactcctataactcaaaaaatccaagagttttagaagctccctccctgcaatcaaggacaacagccagtcaaattccctatcatacagggaagaatttaccagaggaaaactagctggtcatcgagcacttttcaaagattgcagttttatggactggcagcaagtgttaacacggtcagaggagccacgtgtcatctagcatcagaagaacctttattttcactgtcgccttgacaacatgtagtatacagcctgagtcaataaaatctaccattttgttatcacttatccacctttaaccggaaaataaaccaatccgtggtaactagaaatatatctttcatgtacattttgtctcattatattggaaactcttaagtaacaaaagagtttttcagatctatacagtagctaaattatactaagcaagttagctttcctattctcagagataactctttaatagcatcttctcccttcttcttctacatttatttatttatttatttatttatttatttatttatttatattttttgagactaagtcttgctctatggcccaggttggagtacagcagctcagtcttgcctcactgcaagctctgcctcccagtttcaagtgattctcctgcctcagcctcccaagtaggtgggattacaggcgcccgcctccacgtctggctaatttttgtatttttagtagatactgggttttgccgtgttggccaggctggtctcgaactcctgacctcaagtgatctgcccaccttggcctcccaaagtgtaggattacaggcgtgagccaatgcacctggtcttctcccttcttaaggcaccagcatcctttcctttccagcccagactctcagttgataatcttgcctcatatttcaccaccagaatagaagtcagacaggagctttgccatctttgtgctgtaggttctctcagcagagctaccccagtactcatctcctccttctttgttcccattacattgggccagctcccctcctgcccctggttgatacagttttactctcagtgctatttcctctcaccttctcaataacttttctgtggaaattaactctctatgatcaatttctctttgatgaaatgattattcccaacagaatacaaccatatctattaaagctctgaattgaaaaataaaaaattccttgtttccaagtccggcttctgctacaattttcaatttctgctctgttttatagcaaaactgaaagaagttgtctatactcactatctgtattttttccacctcttattttctcttcaactcactccagtcagtgtttactccactcaaccggttcttatcaaggtcatcattgtgccctgctaaaataaaatcactgtcagttttctctccttatcctctcagaagcatttgaataggctgagaactccctcatttaaacattttcttctttaaatttttggcaccacattcacctagttttctcactaccccatgtctacaccttctcagtgtcttctcttggtactccttccctaccaaacctttgttgccgtgctcagagcctcttttcctgttatcttctgtatctgaacttttatgactctaactattttttaaaaaaaatctttcgcccatcctgtgattctctgcagagctacagactcatatatcctattccatatttccacttggatgactaattcacatattaaaatgaactggaccgaattagaatgagtgatttcccacacagactgatgaaatccacttcccacccaggcaagcttaccaatcaccttaaaatgatatcaccatccacctagttactcagaccatcgaccttacagtgatcatttcttctcctctctttaaagagacactccttaactatcataactatagcaacaaccttctcctcacataccctctcattatcctatttcatcttctcagttcacacctgtatctgaaattgtcttatgcagtatttatttatgtgttgattgcctgcctccctttttagaatgttagcttcctgtggtacacattccatattcccagctcctagatcagcgcgtgaaacacagaaggaaagcaagaagtatttactggttaactgttgactcctgggtatgaaaacaactcagtataacctgagaattggaaaaatccctggggttcattgtaatggtaattggcctatggtcctactgggtataataggtagggataagaatccatgccttgagataatatgattctactctctctgtaggcattaagaggaatcatcctattaagtaggagtcagttgcccatcctttcactgacacctgtgtttctctttcaatgttaagtgatgtgttatgtgtatatgtgcatactgaggaatcctaccttaaaacaaaactgctacatataaaaagcatattttcctttttcttctatattgattgtttttaacagtatgaaactaaactttttaaattcttgcattttgtatctcaaagtctggtggtcttgagtcatgttagggggcactgatattagctacttatttttcttcaaaatataattcaggatctcatgtatttcagcagaggaccacaacatgttgacatatatttctgacaacaggacaatgctcatgacttaagtcttagattcactgtattggcaatgttactagaaatgcacatataggtttttatagcatagatggtgttatcttttaaataaattttttattactgtggtaacacatgcccatttcagaaaatttacaaaattagtaaattataaagtaagtaataggaataagtcataatctcattacccagagatagtaactattaacatttctgtctttgtttcagttacgtttatatacacatgcatgaatgacattgaaattttaatttaatttatattgaacttcagctcatttgctgaagtcatttctactttttatagacaaatatgatatagcttttttccttttgtattgatttcaataatagtttactttctttttattctcgtatatgagatatttatgccttgcctaagggaaagcagtagttaatactgtcttatttaggcaaaatataaatacttaatgttaaatacttttaacaacattttaaattcctttctttcagagatacttcacttttcttccatatgctgggaaaacttaaaataatataaataaatttcaattaaacatccaatgctttgggaaatttagtcaacggtaggggcataattttagttttactcaaactatagtacaagaagcggctgctaaagaaggtgtacaagcacaaaatgcagttttctttggagagctttattgatgatacattaaattctggaatgatatttctttaataataaaataatctgtttaatattgaatgtagcttccatgatatatttctgaaatacaggtaaatttaggacacagaatacatacctataccaaaaaaaaacctgtatcttcaaatttccacttccaaattctaatcagtgattcagaatgtagcagtgtaatgacagttatacactcctgttttttaaacattgtcaggagttttactttaattttaggggataatattcgacattttgtttgcattcttgaagtaaggaaaactaatagagactagtagagactacattagatcagtgagtcagtggatccaggtctactacattagttccaggtcagtgggtcaatgttagaggattatgtggtgatccagggatcattagaaacaaaaatggcaagtggggaggatacatggatgctgtccagtttgtggggtaaacaggcctagaatctcttatttgtaggacaagtctgagcacattgtgctagagaagcaagaattgacttctgtaagaagaaggaacaaagtgaataaaggaatataggaaagataacagagaattggagcattgatgcagtaatttgcggaaaaatggtgtctggtgaagaaggtgtagagaaaaatgtccacctatgaggacatctgggctgttgctgccttttttgggtgttgctatcatcaagctttcatcgaaatggtttgtttttctaaatggtttttcttatatattctgattttttaaaaagacaatataatgaacatttcaaactccatagcattctaattatgtttgtctgttaagtgtctttaaaaagcatagaagttgtattcagaagacatgccttagagtcccacaaacagcacttaccagacgtgcaatctagagcaatgcccttaataaattcaaatgatgcactttaaagccacttctaaaggctgaatatatgtatataatacatttaaataggagattataattgtcattaccgtatttagtaggaaatgttgagttgctgtagatagaaaaaataatagataaatttttttaatcacctatagttttatacatttttatttattagactcttatagttgcatacatttttgtatttaatttttaaacatataaaaaaacaaagcaaacaagatgacactcatgtagccaatactaatatttaagtatcaacattttgccatatttctttcaggtttctgttttataaaaaaataaaatgtaaagtaaatagatattaatataataaaatataaatagaaactcttacatggtccctgttacacgctctgacacaatggatcctaagtgctttatagcttgtaggagctgagaatatgtactctctgcagacagtctcccaaatacagatgcatgttcagcagcttctccacaactcatcaataagatgtcacttctgctttccaggaaggaaaatgggtagagagaggcaggaatatcactttcatttaggtcctgccagatagaaaaataaagccagaggaaaatagattcccagtgaacatatccatatccttttaagacttgccttgaatccactcagtattatgtttctgagatagtttccttgataaaatgtaaatctagtcataaatctagattattcattttaactattgctaatggagtggtttgctggtaaaccagctttggaggatgaggtagagaatccatgattccagcatttgccaatttctgtggtgttactatgtccactctggcaggtttcaggctatggatggcttaactgtcttacaaagttcctgaattttaacaattggctctcacaagccagtatgaaccagatctagcatgttactatatgtgcatgtgatataatgtgtattctagagtatgaatgagccagactctatcttctacctgtgggtaattagagtgtgtccaatttttcattattacaaaaagtgattcaataggtatctttatacatatgtctttagataatataactaaaaatggtattcccagaccataggctatacccagtttcaactttaccaagcattaattagctgttcaaaatgattttaccaatctatgctccaccagtagtgtatgaagtgtgctattctccaaggtgatattgtcagacttactgttaccaatatgataggtgtggtgtgatttctaattgatgcttagtcagtttttaaaaattgatttattcaattttcacaactgtcctaaggaatatgtactattattatccccattttaaaggctggataatggacatctgtgctgctagagctatcagactttgaagcttatacttttaatactgtctaattctataccttttcattatgtattctcaaataatagtcactcaaaaatatttataaattcatgactaaggcatcattttcattagttttattgtttagcagattacatatttattgatgtactgatgaaaattaaactgtcattcttgagacagatttctattcagttggtttcttcaatacatagatgttgtcacagtaccaaaatctaattcaacatcatcattctatttaatgtagacatgacattacagactagtgagtagaagaccatggtctgtttgggtaaatataataaatgcttttctgtagaaattggttgagaacccacagccatgcaacatttttcatctatggcctgaatattaggttagagagaaggcttattaagttctcatttgatggaaagctagggaagcaaatggaaagagatgccaatagcttaatcagtaagattagaatttgaaataggtttagcataatgaacaagtagtaaaatagcaaacaatataatgtggtaaacagatgaatttcaggagaaaaaatattgctaataacaattagtaagtagagtggtgatatgtacaattaaatctcatttgagtcctactaatctagaattcataaaaattctattgaaagattcaaaagttgttctcacatcatttttgtcattgtaattttggttcactatttcttgcccatgattacgttttatgcccacaattagcataatatttacaaaattaatgaattgataaatggacatcttacctctttcaactcaggaaatcttaatactgttatggttatgtgtgaatactttgctactattaaatctttggattattttttcactactgcaaattgcactgttgtgtggatattatttttgcaaaaatattttataattttttccagtgtaagtgaaatacattaattgacacaattttcttgttgtgaattgattcttcattgtacttctgggaagatgtctgttaatctcgttagactttttctgtcactcacacctaaaatcactggtttataaatattctcagtaacattcagttagttatgttgtgttctttttttgagtggacaaacatttatgtcagtattatattttaatattttcagattactcaaagactgtcctggtttcgtgtttacccctcgatcaagggaggaacttccaccaaacttccctagtgaaatccccggaatctgccattttctggatgcttaccaacaaggaacaaactcaaaaccatgcttccaaaagaaagatgtggaagatggcaatgccaattttttaggcaaagcatcaggaatagattagcaacctatatacctatttataagtctttggggtttgactcattgaagatgtgtagagcctctgaaagcactttagggattgtagatggctaacaagcagtattaaaatttcaggagccaagtcacaatctttctcctgtttaacatgacaaaatgtatgtactcacttcagtacttcagctcttcaagaaaaaaaaaaaaaaccttaaaaagctacttttgtgggagtatttctattatataaccagcacttactacctgtactcaaaattcagcaccttgtacatatatcagataattgtagtcaattgtacaaactgatggagtcacctgcaatctcatatcctggtggaatgccatggttattaaagtgtgtttgtgatagtgtcgtcaaaaaaaaggtttttgaatagaaattacattctttgacaccctcagttctttcaaactttcaactctgcattttattgcattttctcatttaactgttagtatatgtttgaatataggctgactttttttctctattgcactttcttctttttttctttttagaaaataagcaattaggggttagatgcaatatgaatataaaatagttctgtaaataccaaatattatttttagttctggaagttaaaaatactctccatagtaacgtgtgttataataataaatatttcttttgtttgacttttttaaaattctacaatggtaaaagctattttaatccatgttagcaatttaattcctattaattcattttactatcataatagcaaagtattcagaataaaagaggtttatatcttctattaaaatgcagtaatactattcaaatctaatttagctggaagcaacatgggagtaaagtaatcatccaggggacccaccataaaggacattggtaaaacatttacacacgtaaacacacgtgcaggcacacttggaacaatatggacccacttcagcagacatcttctattgccatgctgagctgtttaaagttttaagaagaaaatctaagtatggaagtagaaaataagacttgttcttttggtggatatctcatttttcttgagtatttgtgctgaacattttggtgtatgtctatgaactaagaatcaagtttttgtctcattaaatatacatatatgaagtgtttttattctacttgaaatatcttgacttaaaaaaaacgactgttagtattgatgaagcaaatgaggcagtgactacattatggaaatgtctaagtattttttccggaacttcaactttttctttttgttttacataaacatttaagcagctaggaacttttagttttaattaggtcagttgaagttctctggtgaactaaaaaatctacattttggttggggataaagatttgattttaaaaacagcttgaatttaaagcaagaaaaagatgaacgttatagttttaaaatcaatattagcagagccatagataggctgagctcttatttggggttctgagaaataactcagtttaaaacttctttaactgcctcccttagtacccaggctagcccatggtgacatcagggatattcattactgattggcctctagtattccaagggtactactatagatattacaatgatgctgtttactaagtgataaccccgtatcttacaggactgactttgactcaataaaccactcagcctattattggaaagtgccataggccttgagaaagtatagttacatcctcacaaatatatgaagttaagtcactacttacaaggaaaaaaaatgtaaatacatttttctttctggaaccgaactcttattatggggaaataatagaaataaagaaaatgtaaaagcatgaaatggaatgtagtcttgatcaaacatttcagcagacctcaatttgcttacaatctgtactcaaaaagtttataattcaatcagaattcaaaaagtattttgtgtgtttgtgatgtattagcatatacacaaaacaaatgaggggaatgtatataatcttggtgaaaagttgtatgggagttttttgtacgattcctgcaacttttctataaacgtggcattatatctaaataaaaaattaccaaaaaacatattttcacagtgaagttaaatcatctgtgataggttccccagaccagcctacaaaggcccattaaatacagaataatttgtggatcttcaaagaggatgaacatacatttccatgacagagtccatacgaaattcacaatttagatgctaaaaaatttaaggaatatctttttttctctatcttatctgctttgaagcatagcgattagcgagaaacttttcagatccagaccactgatggtagccagagtagagaccctggagcatagat

SEQ ID NO: 15433 - DNA, 51849 bp, Human
  misc_feature (1)...(51849): n = A,T,C or G
atgtcctttgcatcaacatggacggagctggagactattatcctatgtaaattaacagaaacagaaaaccaaataccacatgttctcacttgcaagtgggagctaaacacggagtacacatgaacacaaagaagggaacaatgaccactggggcctacttgaggatggaaggtgggaagagggtgaggatcaaaaaactatttgttgggtaccatgcttagtgcttgggtgacaaagtaatctgtacaccaaacccccaagacatgtaattggcctatataacaaacctgcatatgtacccctgaaactaaaataaaagttaaaaaaaattcagttatgtaacagtaaagaaaattcatctgtgtagaaaaataatcaaaagatacagaaagttataaaaagtaagagtcatggccattccagccactggttctaattacagacgatagccatatcaacacttcctgtgtttcctcccaaaccattattcttacagcaacatgtatgtgcctgtgttattacccacatagcaccttactgtatactaactctaaaaaatggaaaatgattacattcttgtggtgttttgtaaacctgacaatacttttctgcatcatcattttctagtcaccctcctgctttttcatggttgtttaatgtgccattttaatggttcaaaattagtggttaattgttgttaaataatgattaatgttttaatagttgtttaaaacaaggtgttagattgtatgaaaggctgtaatctatttactcattccaccaataatggaaatttttaaagtaatttgttgttttgtttgtttgctacatgccactatttctgtatcagtttccttcatcatagctctctcggtgctgatgtcagcacaatcttattgttttgacatttttctctaaccatattgagactgttctcacaacaaaatatgcacatcttaaaataccatctggcttctcaggtccacttgagactggtgacctcacttttgaccttgccctaaaagtcaactggagtccatatacctcaggtacaaacagcttcaataagctgccacttcctgttcctctcatcttctctctatggcaggactcagagcattaactaacctaagggcctggtagaatgtaagctggaggtagagtagttaaagtctgtgcattttgtactggtcattttccagttcgtctgttgctaagaaacagcaacagaggcccgctctagagggttacaaactccctggaattatggctcccggacatggtgtagggaaaggtgtcccacagggatcaagcctagaatatcgctggatcttgtacagtttagtaaagggcaggactggatttaacataacgtccaccaaactacattactgaaaatttttggtgcttcactcaactagtctcattgactagaagtgaaaatatgtttttctcaatattaccagctttaaatttgccataaactgttgtgggaccaagccacagaggaaatgtttttccgctagacaaagataagcatgaggatgccagcaacagaggatattccttttaaggtctgtccattgcaaagtacacacgtacacgctcacacaacaaacacgccctgttgccttttgcttgtgttaaccactgagggcagatctctgaataataatacatttagtgggtccacaagagctgcatttcctctgctccagaattcatgcaaggagcacggctggggcttctccactgtcattgttatggcctcaaatgaaggccttgtcaccaggcgggggcgggaaggcactggagcgcagcagcattgagagcatccgaattccctcctctgtccctgattggttgaagaactggggagcaccgaccagccccctgcggctcgactcgccattggctgggaagaggtggcaatcagggcgggccaaggcggctgttctcgctccagctcgatgctgcctccccggcccggttgcgctgtagccgctgccgcctctgcctgggtcccttcggccgtacctctgcgtgggggctgcctccccggctcccggtgcagacaccatggtaagtgctctcagccgggtgcggcccgaacctcacccctcctctgccggcctggcagcgagggaactggccgcgcagccggagcttggctcgggggccctgggcgctcactgccggccacgggagcagcctcactccttgcccgcgcccagtcaggggaggtgggaacgccgcgagtcgtggcgggggcgatcggtgcctttgcttcccaggcgggtttgccgctccacaccgcagcttcctgagctcgggaaggggaggtgcggcggaggcgtggggtcttcccggctctggccggccccaccagtgtgggaggctgagcgccagcggaagggaaggctccgggttcgcgtccccgcgctgcccccgatgcccagcctctcccggagcggtgacaggtgaggagggtgggaagatagcgtgggggtggggcggatggtgacggggagaatccaccagggattggggggttgcgcccccacgatccgactcctttagtgcatagtacccctaagggagaggagtcaggggcggggtgaaaggttaagccagcgccatgggagcagaggcagcagcctcgcccccaagccgcttctcaggtacagcgggtccctgacgctcaagtctctccctgtccccgcagtacggatttgtgaatcacgccctggagttgctggtgatccgcaattacggccccgaggtgtgggaagacatcaagtaagtggccggctaccctggctgtggcccaggtcggcgcccagtgtgggaggccccccgcgcctcgcctggtcctcagcctgctggccgggtcgcgggcgcgcatccttggaggtgcctccgcgcctcgctcccggctcgctgcagctgcgctcccacgctccgggactggaaccaggaggggaggggcggctggggcggggctgcgagggcgagaaccgcggaaaggagcccctaggggtcaccacggcttcccgacccggcctgagcgtgggaacgcgctgccggcgctcccaggctcagcaggccgggcagctcccacgcgtgcagagccccgagggaccacacgggcctccgcgaggttcctgcgcccggaggccttagaaacaaacggaagactttggctcctttatgatttacacacctggcgtaagttaggcctttttggtatgctgaaacacgcgggagattatttcttgagcaacagtgaattaagcgcatttattcatttttaaataaagtgaaaattggaagttttttgttttccccaaatcccactgcccaccccccccgccccaacccctatcccccgtttttttctactgtgttgaagacttacagttctaggaggcattctactttcagtcctggagctttgagcccagtattggggatgtgaacggaaataccacacccacctgagagtttaaacctgttggaatgactgatgggtcagcatgtctgcaggcaggttgactatttcactctaataaagttgtctctcctttttcctctcactctcaaaaaatttgcatttaacttatggtacagctgaccaccaccaactagctactccaaaaccctatttatggattttcatattagagcaacagtcagactatcacattgtaacaaaggtggaaggaagggtttcctgggtgggcagatgggaatacactgttattattcactctgatttcctgtacttagtgatttcattttgttgtctcaggtaggtgaggcttccatgctgtttttccctaagcacattacaattattagcaatcaattctaacaggccttattatgcagttacatgatggtgatttctcataacgatctgtttccatagaaatgaccagggttatatattaagcacgaaaatgtaacttttctttcccctggatctgtatcactgagcgtttctttcatgtttcagaaaccatttgtattatccacagggcatattacctacatattataaacagaagccgagatttggcaagtatgtggttgaatccaatgagaacataggcaccaaaagttactttaggatttgaattttctggccatcttaataccattataatttttattttgcttagtagacagatatcaacaaggcagacatcaaaaaaagattgttaacagtataacttaactaccgaattatttttaagccacttcctttgtaaatttataaatgctatatatatatatattctccatatgatgcttttgcatctgtaagatagaaattcccaaatttgctggtagatatgctatgacaatgaatatgcttagaatttttagagcagaataaaagatggctattatgattaaacagtcattatgtaatttaaccagatttagattgtatatcctagccattatcagtttagatcactgttaaatacagagatgaaaaataatactttatagagtaatgtatcagacattttaaaaagttaaaattatccagagatttgtttatattgcttatattttcccagaggaagtccaaatatgtaaagattcaattgacgagaatttaactctgcaaaatcaagctgagaatattgttccattctactttaaaaaattatttattaacttactaatttatctttaagtagcttccaacagtattcataatttgtctaaaggataaaaattccaatcatccacaacacaatttttctggtaaaaatgaaacaagttatattggtcttttcttaaataaaattgcctcaaggttatgcccctgcaagggaaaaactgttagtcacactggtgttggtaatccaggtgttagtgttgattctttatttgtctaagcatcttttggtggaccccagctgattttgggtgtggtttagtgtctgggctagagaacatggttgaactctctgcactgagggcattaaagctgctccttggtttccaacccaatacccctgagtaattactaaatgctccctgggagagcatttgctttccacagaaaagaatcttgctgcctggggagaggggaggagaacctggaggagtgtaattgaaaaatgctccttgggtgattctggttcctcctcccctccctaccctctgcttcagggaatattaaagcagtcattggtccaagatgctttcagttttaacttttataagaaattgaatataagaggaaaaacatttttttttgtctcagtaagtaccaaactcttattttttcttttggtctttgagaaactatctaaattgatgtttatacaaatttacattatacttttttgcttcactaggaaatggccatccatccttcatgagaaaggatgggaaaagatgccaaacatttaatgacaaataaaaccctaagtaacagattccagacagcagacagaaaattctaagtggataagggccaaaaatgcttcattgtaaactcagtatccacttacactcttaccaacaatataaccatttcacaaaagctttgaattcctcttaagaagaagaaaaattgtctagaccaagggccagcaaactttctcttaaagggccagatagtaaatgttttaggtgttacaggccaaggtaaaactgaggatattatgtaggaatcaatataactattaaaaatataaccacttaaaaatattaaaaccattgttagctcttggaccaggaaaacgcaaacaaacaaccaaaccagacaaagtgggctacatgtgatccatgggctatagtttgatgacctctgatttagaccataacaaatgtgaaaaagcaaaagagacctctgaatccatttcaaagttttttttgttgatttcatttcaatattcaaatagtccttttaagaggctatgatttctaagtaatgacaaaaaaattatcagggtagaaaataaataaagttaggagtgatacatcctagaaaagcacctaaatacttgatttcccatctctgttatccttccatcagccctgactaaactcatcattgcgtcaaattactgggtttaattttagattttttctctgctttctttccatattttttctgggtagcagcggagggaagcagttagagacaggtcttgctgtgtgcccaagctggtctcaaactcctgtcatcaagtgatcctcttgactcggcctcccaaagtattggattatatgcaccaccacgcccagcccaactttagattttttaacctcactgaaacatacaaattaggaagatagatccaaaacactgaaaaatcccaaatgattaaaagtctgtaaagaaagtacactgtcctgacttaaataaatcagataaaacgtttatctttaatgagtatagtcaagtgttttaggcactgaggatagaaaagcaatgatgtaatccttaccttcaaaaaaaaaattctagagatttcatgatattttagtcttattattttgtttttattttcctgcctataactcaaatacggtaaccttttgtctgttggatagcatatacttccagttttgaaattaatgtgtcttgttaaatttgctaatcacaaattaatcattatggttcaaataaggaaacactttgctataaactagttatgggactttccaagttgcctaaactttccaatcctccattgcatagaggaaaaaataatacttcacagagctgatgtaatgcattgaataatgtctgcaaaatgcttaacatagttcttgacaatagcttaataaatgatgatttttttttattttactctagaatcagagtttttaaactttccgttccccaatttacttgaaagatattaagccctcctttaaaaaatattattgcagtctatattctatcagtctaaatttttttatcactctaggataagtaatcatcatcatcatcatttttcatcattttgttttgaaatgcaacaaatgctcttaatatccattgtatcaaagcaaattaaaacaaacaaaagagcacatcaccatgttttgccgtgtttattcagattttcatatttttgaaggtgtgatttaaacttctatacctttctgtagatctgcttaagtagtaatgagcctatgtatgttttaaagtagtaaggatactttatattataaagcaatttcaaatttccaaagttttgttctctctataattttggttgactgctacaacatccatttgaaataggaaaggactttacagctcaatttttttaataacaaagttgattttccaagaggttaattcccatatgtaattacttattgtcccagagaattacatataggaaactgaaaagtcagaacttcagcccttgttcttctgttgccaggtttaatgcttcttttaagatataactgtgaaataggaactaatgtagtatacatacaaaaatgaaaccacatttattttcttacccagaaacttcctcagtacaaataaacacattaatatacagactaaggaaacaagtaaaccagatcattgttaggatcaggatccttttctgtagaaagatctgccagttagcctgaaatacagaggaaggcgttgcattgtattgtgtgttggctgttaagcttactaatgtttgaagttatcttttgcagctggaactggatgcccaagtgtatactccatcacatacctgctattgagctctttgcatagggctcttccagaacctggaccatgtctgtgagcagcatggcaggcacctaggtgataaggcgggtcatcacatgatctcagggagtttgtgggtgtttcttttgagttttattttggttctgatgatctgaggtatcccccagaaatcaagctgggtcttggagtctttattttccttgcattctgtgatttttgagaattaaaaaaaaaaatcagaggagtacatcacttaatttggcgtgtcggaaggatctttgcacattacggtgagcatcagaaatcagaaaatctgtattctcactcttaatgtacccagatctagttttggcaaacatttactaagcattgttatgatttgcaagaacaaagtcctttctactttcttgcctttctccagaataaggggctctagcaaatgtttctctttaatgtgttggaaaactatagttatgggttgatgctctgcagacatcaataggaaaacacacttaaggaaatgaatgctataaagaaatctaactggctagatccgagggtgacagctcagcagacgtgagtacttgcagctttttcattctctcctttgcctccttgttcgttaaagaggaaatggtgggagaaaaaatgtctttattgtttatgtctagcaaaatgaagcatctttttctgtgtcaaactatatcaaaagatagtgaagttaaagtggattttattccaggtaaaagtagacattctgaagtatttattggacctcctcgttactgtggctttggttctgttgcatattctggtctacttccccttcattgttgaatcatgaaatatgaaattgttaaatttattgaaattctttgtggtcaatcttcagataacccaaacatggaaacctttcactcaacttgtcctacatacccttagcattccagccccatgggcctgtttttagtttctcagccataccgagccttaaatgtgtccgtttaacacctgtgcttgctatggtctccttttcttcaccctcccaaccctcctgtaaatgtaaacacctctcagctttgagatgtcaaagcaaatgtcacttcttaagggaaccttctctcacatccaaacttttccctttccttcatagtgctgtaatgcaagagtttgtacttagtatttgtactactgattaatgtctatcctccatgacaatagcctccataactctttctagagtgctctctctctccctctctctatgtattcaataaaatatcaggctctctttctgtaataaaaatatggatgtttatatgtgaatgaagtatctttcacctttttcatttccaaagaatagagcacacacatatttttatcaaagattcttctctgcaaccagaatttatgtcagcatggtgacatattcaactactatttaaatataagctgttttcaaatagacatttctttttctccaagatttattgagatataattgacaaataaaagttatatatatttaaggtgcacaacttcatgttttgatgtacatatacattgtgaaataatcactgtaatcaagccaattgccatattcatcacctcacataggcaccctctttttttgtagtgagaacacttaagacctcccctcttaacaaatttcaagtattcattatagtattgttaactgtaattgttcattgtaattgttaatagtgacattgctgtgccaaataaacatttcttatatcagcaaaggcagaagatagagcaatatagcaatacataatagcaattccttttggaagtgtcagagttcttttatgttttctcatgtcatgtggatgtattggaaggactaagaactctattgttagaatgacaatttcatatgtcaaaagacaattactagattggattcaggacatgattgaatcctttagcaagtttctaaaaggcagggatgtgtggtgctgtttaaagtcagtgtcatagactgtaactcagtatttagaatactgaaattaaatttgaaatccagctgagctctcaccatgtcatgctatttcgaatgtaatatgtcacgtatattaaacacataccatatggttctgcagtcacagtcctagatgctttatactcattatctcagttaatcctcatcaccaccacagaaaatagattccttcattatcctcattttgcaaatgagagaatagaggcgtaaaagaaagcctgcctcaaacactcagctattaattattagagctgggatttgaacacagataaagttgtaattatcatgttatgtgttttcctccaaagagaaagacctataaccttcttctttccaaagacaaccaatttagcaaggacatgtgccatgtttatgtgtattagtactgcctgctgctttttcttttttcttggaatgttcaagcatgcgtacaggtgatttttgacaacaatatttttaaaggcgaattgacatgaagcatatacacaagtgtctaagtaaattcatttgtctgttaaagctgctgaaaatggctcagcagctcaaatgaagatttgtaagttttgtggatatgttttcaaaattggagaaattaccattaagggtctcttgtgactcaaaattggagaaattaccattaagggtctcttcctgacaattgcatgtcaggaagaaacatgcaattatgtatcaagactgttgttgtttcccctaaaactaaggtatgggtgtcactcaggagagtatttattgttactgtttacagtgattggatgagtgagtgaacacattgacatgaaaggactgacctttactaactaaaagggggttcaggcaggaagtcgttactggatttaaagggcctgtctctccacttggcagctccctcaagccagagtctctcctttggggttcaggcttactgagaatcattagattaggctattgaaaacttagaggctattcatgctccacagccacttagaaaaaagcaatataaagttttacttttttagatgttatatatagttactatccacagtttatagtgggagattttagttttaataatggttggggacaatgcaacattatggtaccaattcagctcactacaatggaccattctaggatttattatcaaaacgacacctacgtactgttttttaatacagcatgtgttctgataatgttgtttatgggatcaatagtatcttggagctgtcattggtcagtttgattgtttgatcctgattgaccttttctgcccaagagcagaccttgtgttgagattatgttttcaacatgcctgtgttcaggctctcccatttcaaaatactccatggaaaacttctttaactgaaatatagcagtcttgtcatattcttaacttactctaaaaatgtacagtagcaggagctcagggtcagaatatgaattcagtttttctgtgttcacatattgtagttaaggaatatctccttgtatgtgaagttataagaaatgttacctggatattttggacaaattgtatacctagttttaaaaaataaataataaaaaatattctttagtttgaaagcaaatgatggacttttgttagtaatgtttgattacttgtttgttttttttttttttttgtagggagcttggaaatgtgtggggaaattgatttcattaattcattcactaatttttaaacatgtatacctttattaagcacatgtgcacctttattaagcacatgtgcaattccaggcacctgggttaggcaccagtaattacattaaagaaaaaaatcccaacttaccaaacaccaccactataaaaataccaactacctctttgtgaaaaggtaattagtataaataaaggatctgcttaaattccaacaaataagagtaagtaggaagttgattgctactgggaaactatttcacttatacgtattcaacttctaaacagttactgtggctacagatacaaagaatgtgattatttctgattttgttgccaggtgagaattcgatctttatttttaaagcccttaggggcaacagagcttgtttgtttcttggctattttagtttgtaaattctatcagcaaatctgcatactaagtgcaccttaattatttgattctgactaaaaatgactaagattttgttgtcattcttcccttctcttcttccacttgccatttcctctttctcctttttcccttcttccttcatcttctccaactactataacttaccagttagaggaagtatcaggcattaagtgtgcaagaagtactaccctgagatttttgcataggttaattctgctaaccaacacaatgaccggaggtaactgctgctgttagcctgttttacagatgaggaaatgaaacaccaagagttgaatctgcccaaactgcacatgggattggcttagttgtttattttccatactgtgtgaggaaagactttgacttatgacatagatgaaatcaagggagtttctctttatctaggtttacttgttagccaatgaaagtgcttttaaacttgaacctctctaaatatttattattgtctgctgacctctttcattgagtaattcactgaatagaaaaatttaacgcttaagccaagcagagtcattgggtatgtaaatatggcaagtcatagtatttgaaaatagtgaaagactatgttcacttgggatttggtaggacttttaaaaataaaaataatagtagtaagcagcaacagactgtaatacaaactaggaggcatgaagattgtagtgctgttggttattatttgatagatgagcactcttgaacacagtttaatccaatttacttagagtttatatgatattttttgtcatctaagaagcattgaaaaaaatgacagtatgtccaaaattttcagaaaaatcttaaattgtggttctcagggaaacctgtggtttttctcacatgtaaaataagtacaatttaaataataaggtaattgcataatttccctattatgtaattatataattacataataataatgtaacaatgtatacataatgcaacaatttaaacaaaattggagctcaaaaaataattctgaaagaatgaatgagtctataaaatttggtgaatgtacttggctgaatttggataatttaagcccatataaattctacttgtcacaaaaataaattttaaattactagaagtgttattcttgcctttgctcttgaggaaagaacttaaaagttatgggatagcaaagtgggagatgcagaattatgagataatattacttgaattatgtaaattgtttatgtaatctgaatattagcttacttcctaacttttcttaaatttactggtcgccctctgtgacttcaggtagcagataaaaaaacagccctaaagctaaggagagaaggaagcctgcagtgtgggaagggaagccattaaaactttcctcaaagaacagtggcagctatattttgcagagtgctgggaaatggttattatcacatctctgtgctttctggaggttaaaacatttgacagcatgaagtccgattatatataaatttacctaaaagttagaagaaaagttgtattgagaattgagagacaacagagaaggcttggttgattcaaaatttctactagcttcaaaggccatattatctgaaattaattctcttagttattattccttcattgtatattctccatctcagtttagtgtattaaactgcttcatactaaagagtttgcgatacctccaattaacttttgcagtatttccaattagcttttcccctgaaaggaaagaagatgaagaataggctagagaaggaaaggaagtggccccagaaaggttaggtataaggtggtaaggatggaggtttcctgctcaagtccttgctccggcgtcactgtccccatgaagcctaccatgaacacctatgtatattatcctcatatgtatactgcatccagccccttcctcttgcatttccactctcatgtctttatccagagctacctcttcctgtagtatctattgcttcataacatattatatcattttgttatatatcatgtttattgcttattacttgtatctgtcagctaaaatataagctttatgaggacagggatctttacctcttttgttcattgatatattaaaagtgcttagaaaagtgcttggacataataggcatccaaatatttgtggtaaaactgttccataagaaaaaaagaaaaagaaaaagggtagccccacattcccaaagatgtaaatagagtcctaagtactttgaataattcaaaggaattcagagtgaaatttttaaaagaagattattatttccttccatgtactactgtttaatttctatttcagtccccactggggagcattgacactggtcatttcaggaagtaaagctttgatgataagggagcttattttaataaagagagagaaaggaaaggaccaatgcattgacccatggttagggggtttctgaggaaatggctgttcccctgttttatgcagagggactgtggattctgcttgtaccttgtttatttatgggttactagagattggtgagtgtttcaaataaacagagtttattacagaaatttatgtgatttgatttattccaattggaagaaacagaatggtgaaacatgaataaatttctacttattgtatctttaattagaatattctgtcagagtctccaaaattttaatctatagatcagtgttgtttcaaaataaaatgttaatagcaaaatgacaaaacataaggtatccatatccgtcaaactatttatcccattcctaggaatttgttctgtttttacatagaagtgtaagaagctataaagatattcataacattttttatacttgtggaaaaaataaaaacatctaactacctaccaagacttcaatatgtctacaatgcaattttatgcagccatggtatagaagtataattatgatatgaaaagatatccatcaaatattcactcaaatgggttttaaagcagtatgttctatatataagtatattcaagcatgaacaacttgaaaattataatagcagtgattatctcaggatagtggaggcttattttctctttttagtttttcctttcctgtactttatatatatttttacaattagaaattagaatgcagaaaatatatagtagcatttatcagaggataagacaatgtttgtatattacgttttcataattttttgatatctcactgacttttggtattaaaaagacttgaggtcttcgaagagttgtgttgcttttgtttaacagctgtttatgtttggaaaaagggagaagaatttaatattttatgtacagtgctataattgtttgagtagacatggggagtgctatattcactgggaatatgtatagtactttaactgcttagaatatacttttgtacactttatctctttactgttgtgaaaggtgaattatctgttgcttccacttcagaaaagagaggttttgtttgtttgtttgttcgcttgtttgttagctgagtcaggatctggctctgttgcccaggctgaaatgcagtggcaagatcacgcctcactgaggcctcaactcccgaggctcaagcaatattctcccacctcagcctcccaagtagctgggactacagacttgcgccaccacacctgcctaattttttttttatttctaggagagaagaggtcttggtatgtcgcccaggctgttctcaaattcctgagctcaacggatcctcccacctgggcttcccaaagtgctgggataacaggcatgagccaacctgcccagccagaaaagagagattttaatgcttatgtgctttatgtgatttgctccggttcatttagctggtaaagcctgggctctgaaatgcagatctctgtgcttacagaaaacatgcttttaaaaaaaaagttatgaataaatgcaggcaaataaattataagctctgaaggacagaggatgtttttaagactatctgcatactaaggtatggatgtaagacataccaccatttggaatttttcccttgagcatacacagatatagtcatgagtggcagctgtgatagcacagcttctgaaggagagaaagcaactaaggactgccttgaaaatatttaaggagttatttgagctgctgtgttgcaagttcgcctaattagagtggctactttcctttgtattctcttggcaatgtacagggattccgatgaattggattgagagtaagaggttgacatccaagctccatgtatttttgtgaagttaacattggcaatgatatctggaacttagttcttttctacagttggccatgtgggtttttttatttacatacatttatgaggtacatgtgcaatttgttacatgcgtagtaggtggcagtgttttaaacaatggatttcacctctcctttgaatgcttgtttgagaaaagtaattcaaatcctatctaaataaatacatttatataatcatgacaacttttaaaaacaattataattttctttcactagtactgtgtatgttttgagctactgtgtttaataagctaaggatatatttgaagattttatcagtccacttggcatctcaaacttaatatgtttaaaaacatctcaaacttaatatgttgaaaacatagctcttgaccttgaccccttgtccgcctccaacaagtctttcccaattcagctactggtgacaacatccttttagttgcttagaccaaaaacctcagtgtcctccttgagtcctctcttttcacaccctgtgtccaatccatagcaaatcatgctgaatttacctttagaatatatatgagtttgaggcatttcttacctgctccacgggttcacgccattctcctgcctcagcctcccgagtagctgggactacaggcacccgccaccacgccaggctaattttttgtatttttagcagagagacggtttcaccgtgttagccaggatggtcttgatctcctgacctcgtgatctgtcagtccccgcctcccaaagtgctgggattacaggcatgagccaccgcgcccagcccaccaacacttcttacctgaatgttggcagcagcctcctaactggtctccctcctctgtcttgtacccctttagtctattttcaatgcagtagccaggtgaatccctttaacctagagcagtttatatcaccactcatgtcacaagtgctcaagcccttcacctctttcaagtaaatggcagttatcccaacgtccaaccaggccaagcactgtagcctcatgttacctctcctacccgttccctgatagctacttttccccctcctctgttccagccacattggcctctgctgtcctctgacaccccaggcatgctcctgccttgccctttgcacttgctcttccctctgcccagaacacaatctctctaaattgctcgtggcttactctcggagctccttcagactttcttcaaatgccagcttctcagtgaggccttcctggctgttgtccttgagctctccactgctctactctgctttatttttctccaaagtataatacttagcattatatgttatttattaattttatgttgtgtctgttttcccagaatatatgtattgcaagaagtcagggatttttgtctgttttactaaagattgtacccctagtacccagaacaatgtctggcacctaatagggactcaacaaaacttgctaaacatctattaacccaaaagttatttaatttattatatttaatggcaggtattgtattgagcagtagagtactatgtactgttaatcttgctaaaatatacttaaatatatcattttaatttagggagggggatatgacatcatttctgctctctcactagaattttaggtacatgatgatgtttaaacaaatttgcccaaaaaaaccaaattctatttcagagataaagccattgtttatacaattattatacttatagtagctatttttttaacttcaacttttctcttctgtctttcttgtttttgttttccagaaaagaggcacagttagatgaagaaggacagtttcttgtcagaataatatatgatgactccaaaacttatgatttggttgctgctgcaagcaaagtcctcagtaagttgaatgcaactttccttctttggccaagttacacgtagaagctcacagaatgcatggttcaagatcacaacgcagggttacagaagtggtgcagagcatttgtacaacctgcatagttgtgtggtgggcatccacatatcatgttaggctcaggctatgccaagtcttatttttccttttgcaaattctttagagaatagaaaagagtaaatgtgctcttcttgttgttttttgagacagggtctggctctgtcacccaggctgcactgcagtagtggcccaactccggctcactgcatcctctgcctgccaggctcaagtgatcctcccatctcagcctcccaagtaactgggactacaggcacgcaccaccacgcccagctaattttttgtatctttggtagagacgaggtttcatcatgttgtccaggttggtcttgaactcctgagctcaagtgatctacctggctcagcctccgaaagtgctgtgattgcaggtgtgagcctccacgccaggcccagtcctttgtctcccccaacagaaagccatgtattcaggaaggaaagagaattattgatacttaatgtaacaacatcagttgtggtgtcaagaaaacggtagttattcaagtataatatgtgtttctccaaatctcttttgtagtcacaagttatattaactattggtaaaagaaacatgaaactgagatctaccacagataaatatctttctgaagaaggcaaagttttaaaaatttcatggagaagaagttgttctcaaagtagtatctattattcccacagtgcttaatttttaactgggctatagtttggatacaatagaatgaagcttttagctttgccacatataactaggaaagcaaacactatctatagtagaataaaaattgttttaaaagattggtaaatgtttaatattaacaagaaaaatatctagcctccagcaatcaaaattgaaacaaacatgaaataactttttttattatcaatttggcagtcttaaaaatggaaatatctagtgtaatgatggagtacagttaatgggaaatcacatacattttaaatgtgatggtagttaagacaacttttttgagaacaattttgcctcatgaaagccttttaaaaaaatattaaaaccttcagtaatttttcctaaataaattattagatctctttccattaagatttatgtatgtgttttcatgtcagagttccatatattatcaaaaactgaaaaaaagcctacattttcaataagaagggattggttaaataaattattgcatccatatgttgaataagatagcaattaaaactgatacacagcactttgggaggccgaggtgggtggatcacttgaggccaagagttcgagaccatcctggccaacatggtgaaaccccctctctactaaaaatacaaaaattatccaggtgtggtggtgggttcctgtggtcccagctactcaggaggctgaggcaggagaatggcctgaacccgggaggtggaggttgcagcgagccgagatcctaccagtgcactacagcctgggcgacaaagtgagactctgtctcaaaaaactaaaaaaaatgtgatacagaaaatttaagttttaggaaatattaatgattgtttattaagaaaaaagcaggacaccagggtacatgttatatgtaatcaagttattaaatatacatatttatataaagacttttgtatcaaaatattgtcatgtgcattcttgatgattttaaaaatctgtgttttttggaaaaaagaagtagtatatcaaatatatgctttaaaatggccaaaattaagtacagggtgagtatctcttgtctaaaactcttgagaccagaagtgtttaggctttcagattttttttggattttggaatacttgcatatccataagaagatatcttgaggatgggattcaagtcgaaacataaaattcacttatgtttcatgtacaccttatagacataggctgaaggcaattttgcacaatattttaaatgattttctgcatgaaacaacattttgactgcaatccattacacgagttcaggtgtagaattttccacttgtagtgtcacgttggtgaccaaaaagtttcaggttcttgagtatttagaatttcagattttcagattaggtatgctccacttataatttgtaatagaagctgaaaaactggttgctttgcttgtaaatgcaaatgtacaccattaacatgtttatacgttgtcttctctgatttcattgtattgtcctggcgggatttttttcatatgatctatgcttgccatgcacaaaaattgaagacattttacattacttaataaacacttatcttcattttttctattaacaatatttcacctattatatgctttttttcccctcttgaatttgtaaaatagatctcaatgctggagaaatcctccaaatgtttgggaagatgtttttcgtcttttgccaagaatctggttatgatacaatcttgcgtgtcctgggctctaatgtcagagaatttctacaggtaagcaatttgaggtcctatagttaaaagttctgtgtttataactctcaaatatagactctagaatacttttgttcactcagctgtacaagagtgtcttgcttctgaaatggaatcgtagtcacctttttctaattcacataaaatcatcgttattggagcgtctcgaatacattttagcattatattttttctttaacttctggttgctgatactgaatatgcaagttgtaaattaatgttccctgaaaaactccaggtggtcttttgtgatctgttcaactgccctttttttggggtaatggctctatatcctagtgattgtggttttatgtgttagacatttaatatggccttattttctatttacaaaacattcctagtttgtagatataatcgagcaatgtatcagtatttatgaagttctacctggagctcaatgtttaggaaaaagtagtagggttttcaggtgttctgtcaccaaaacatacttaagatccattatcattagttaaatattaattaatctactgtacgagggaaaataggaaacagtccaaagtcagtttcaggtgaaaaagttaaataatgcaatcacaggcctttgtcttacattcttgttaaaattaccttaaaagattgtactagtaaattacacattagatgagagactatttctggattgactatactattttaagcattgacatttgtgagaccctcttcttgaaatgtgttaacattgaaaattatatagttgtttgcaaaggatatttctaaactggctgctttcagcagccagatcttgctggaaaatgatgtcagtgcaatactagctgaaccgaagcccagttttgagggaatgtaaactactttcagtccagctgcattattgatttaacagccaaaataagaactttagtgtttaatcaaaatgtctgttgtttacatagtgacatttttcttataaacttaaaacagcattaaatcaagttggaaactggtttgcaatctcctgccatggatttactaaactactggtgtcaaaaaaagctgccacttccaaatgaagtagctgccaagagatatttaaataaaattgaacaggcagcatttaatgggattattttaaatggattaaaatttgatacttaaatgttttgggggattttgggtttttgaatacatatttcactttttagtacttttgttggccactatcaacttatagcaaagtttcaactttcagttgttctgacttataactctctctctcaatgcccatgtttacataacaaaacaaagattcaagtggttttattaattccttttttttttttttaacctctactcattgtgaccatctgctaagcttgttatggcacagtaagagagcaagcggccttttaggtgtgtttctctgtattccagagctgctttatccaataggacagccactagtgcatgaggctactcagcatttaaaatgagatgtgcaaactggggagtggctcacacctgtagtcccagctacttggaggctgagatgggaggatcacttgagcctgggagatggaggctgcagtgagtgagctgtgatcacatcactgcactccagcctgggtgacagagtgagaccctgtctctacatacatacatacatgtgtacatacatacatacacacaacaaagtgcaatgtgctgcaagtgtaaaatatacaccagatgtcaaagacagtacaaaaagaataaaagatggctcattcacaattttatattgattgatttcatgttaaaatgttaatattttggatatatttggttatataaaatgtagttaacatagctttaaattatacacaattttattttatttctctttcaacgtgagagtgaaaaatgaagaaactagaaagttagaatactgtagttttcatcaatattttacattatgattcagttcttttattttctcctggttttgaaattatacattttaagggcaaattgaatatgttaaaatactgcttttctaaaaagtagatatttatgttatcattaggctgattacacagaaattaaatggactttttctgtgtgactataaaacaaaatcattaactttcatacattgttttaacatgccagcacacatatattgacatttttattacgtaaattagtaaaatattctttatggtgacttcaactcttcactaaaaatttaaagactttctttctgtttcagtcctggttttaatcagtcacagcatctttagattctatttcccaaatactgagctttgggaattctgccacttttctctatttccccccacacttctttgggagagtctaccattatctagaggttgaatggattccctgcttctcttcatgactcctccaatctcttctccatcctataactctagtgctttttctgaaatgcaaatgtctctcgtcgtatcgttttcttgcttaaactctggagtaattttttattgctcactggaaactgtcaaaatatttaaaacaattgaaacctacatcctttctgcatctttcctctccctctcccccagtccagccaaacttaacctctttaagaaccttgtatttatcttgttcccgctatcctctcagcttttccactgctcttctctttgcctggagcatgtttccagcactttccccatagataaattctattaattctgcaggtaaaattacttctctgggaagacgccactcctctctccaagctctgccctatcctagtcacggtaactaacctctctcttattttcataggacactctatttccccagccacagtagttttcatactgcattatcattcccatttgatggactggaatgtaaacttcaggaagccagagatcatgtataatctcttaatgtttgtaccttcacagatgcaatctgtatatctgagaataaatgaatatcttttttaaaaaagtgaatatttgttgtttgtgcaaaagcagaaaacacacaataggaagcaaacacaccaatagatcaagctgaattatttgcctcaggataacccatttcgagtgagatcctgtaattttttttacggatgaatcatagattgaaatataaaagaagagacatacactagaccaatttccttttcaggtgaacatcctaaattactgtttattatttaatttacagggtacattgcttgtatctgttgacacttttaaaatggtcgttctgacatttccattttaagcttttagggaacactaaaatagctactgaaatcataacatgggagactatttgattatgccttagctgagcaactctgactcactcatcatagcaagcagaatttccttggaagttgcctgtccacagcctctcagttagatacattattaagaataggtctgtcttatatatgtatatacataccataccattgtttttacttttcttgaaataatgaaagaaaatttctaagtactagacacagcatataataggcaattaatgaaacagtctttaaataatagaattaattaattctgaagtatatgtgtctttataattatttggtccagcctgttttatcaggataatacctcttttgcttaaattttttattcgaggatactgtatagataatatctgtagcttagctccagaaaaatatttgttttctcacatggaggttatcatttccattcacagttgacttaacgaatactaacatatctttccccttgaaaggctttggtgccaatatccaattcatgaccctgcttatgcagtctctcctgtgcttacaaattcaagtttaaaaaatttgcattatgcgtattttaagccacactgagactttaacaaaaaaatagctagaagtcctaaatggataaataaaatataatgggatatatttaggataaataaaatttaggataaataatatttaggatatatttacgataaataaaatttatcctaaatggataaataaaatataaaatttaatggataataaaatataagaaatatttttagagaaaactttgtagaaatactcctcttctctaggcatttcacagtttagaattgattttttcttaaatcaccagtgaaagcatcaacttgtgggctgatgaaaaaagtaataatctttggcatttattctttggttgatttaataattgaaaatataatgtatcaaaaagagaaaaagaagacatttttaaaatttgatttttggatcttatatattttacctgggtatattgttttaaagacaagaccatatttcagtaagaattttgtctagtttttccacttttttattcataaattgacaataaaatgtgtggttccatgctattgctatagtcaatgtctttttttgcgttttttaatgttttattattattattattattgagacggagtcttgctctgtcgcccaggctggagtgcagtggcgcagtctcggctcactgcaaactccgcctcccgggttcacgccattctactgcctcagccgcccgagtagctgggactacaggcgcccgccaccacacccagctgatttctttttcttttattttgtattttttagtagagagggggtttcaccgtgttagccagaatggtctcgatctcctgacctcgtgatccgcccgcctcggcctcccaaagtgctgggattacaggcatgggccagagcgcctggctgctatagtcaatttctatctgaagcttctagtgtactgatgaaaagactgcaaagaatacatgggatttgaaagcttcataagaaaatagctgataaggaatgttcagtttaatgttatttctaccttaatccacgctcacctctactctctaatgtcctattgcattatggcacattctattttccctaaattactgcaacagtctctcccatctcacatgcatttctgtagtatgattttgcctcttccttgcgggaggtaaaattctcttttccttgaatctgggttggctttagtgactatttaaccaatcgaatggggcagaagtgagatatttaaacttcctaggctagagtacaggaagtcttggtttccttcagggtatcttggaacagttgctgttgcgatggtacctctagaaacccagacacatgaaatgagaagcacaagccacatggagaggccacgtgtagactggcagatagcagttctagctgggctctcagcaaagagctggaaataactaccagccatttgattgatccatcttggaaaaccagcctgctccggcattctgataatttcagcccagtttccatctgattccgtcccaagggtagaactttctaatttagccagacaacccacagaaccatgaaaaataacaaataaattattaaagttgtttgacatacagctatggataactagaccactactctgtgcattatttttccctttatattttatgtctgtgttaatatgtgtgtatatgcttgtacaatgagtcaagagctttgagaaagctgtatttgataagataatctattacccctgggaataggagccatgtcagtcccaaacagggctaccaattcaatttcgatggtattacattattattacattatattgtttttacctcccctacaaatttacagagttaaaatgcaattaaaatgagcagcgaaggctgccaggttgactatgaaaatatacgtgggcaaatgcaattttagagaacagttaggatttaaattatgacctaatttaaattagaactcaggtgaatagttagatcagcgttctttcattatttgctggagacactggcttcttcaactaaccttgatatgttgacagtttcagtcattcactcaactcagatatatttgagtttatcaactagcgcctctgttcagcctgccatgggattttcttcaattcctgttggctccaggttttgacttattaaatacaacattgtgatttggccaccaggaacaatctgagattgatgactgatctaattcttaaatgtttgtgcaaagggttattttaggaaatatgaggattttcctgaacagctgtaaaattctaatacttccctaaattatttatatttcttaagaaaaaagagcaccattcactttatttttaactttggaattttaaaaaagagctgttttctcagcatccacaacgccaatttctataatccaataataaaaatagttttattttttaaaaacttatgaaggaagataagaagtattccagaattgtaaggcttttcagtttgaataactggtatatattttcataatttttcaaaatattgattaattgttacatgtagtattatatagactggatcttttttaacatgagtttaaaagcaatagaataagagaaatattttaactgtttttctttaattaaaatatttccttggagaggatggtaatgataaattgatatagctttaaagctatttccatttaaataattttagtgactctggtacagtttctttttaaatagagattttcaatgtttcttttagaaaagaatctctatatcttttcagttgaaaagctatttaattctcaagaagcagctccaggaagaaaaggcaggaaaagtattatgaaagcattcacttcctactccaatctcatgctatttactttggtgtttctcatcatctagggtttgatgttccattttacttaggtcgactttgtttaaatgttttatcttcaaattccaaaatgacttttttcttataaaacttaacaaaatattttttaaattacatgactctcattaaagaatgttggtgttggtcctatttttcagaggtgtgagggatagaaagaaaggaaatactatacctcatcctccttcattgaaaaacaaaaagaggtttgcaatgactggttttaaagatttcttgcagatctaaactgcagtaatattctcaacacagacaactcccttctccccatccactaaaacaaggattcttggatactgaaaatgtttttctttaaaacgttcaaggcaaggtcttacccatttctgtggatcctttaaaaaatttaattagatgtccttgaaacaggaaaatcaggtagttgacttctggggactttgcccctgtaattatgtaagaacttatttttggcatgcatattacaaaaagaaaatgtgcatttattttgaaacatcccaagatctttaaaaatgtgacactttattactcaaaggaatgataaattgtcttttgttttctaaatctgtgaagtgtactatgtctgaaattccagtagagtaccccagaataccagaactaatttttcttttataaatgataaatgcaaggtgataaaataaactagactgacagggagcagaattcctgagtagaaaaaccacattcatttgcttgtagaaaaacaataaaatgatattagaacattaagaaatgaaattattaaattaaaacctttaggtatctcaagatatcaaaatagatgaatggacctactctctatatttttcctgttttttgattttatgaagcctagaagaatgaatcaaagcatatttcagatttacatcattgtttcctgggaatctacttgtgctgcaatgtaagagtttacattttttcagtgtcttttttactttcatacatatggacatacttctttgcaattggccacacagctctttactttctgtaagtgcttctgtgggtatatttagaaataacacagaatatcagttttgatatgaaactcttattccccagaatacattgttagagcaatgtggatgaactatcatctttgtttagatagcattatcaaatgtagaaagggttttctcttggccattgtaagaatctttttgtagcaaaaaaaaaaaattgtagcctgtatatgaggatgacacatttattagcaatataagtgtacttaaatgaaaataacttttaatcattaatctcatttcttgtaatagtctggctgtggtaattactttaaattttgaaagagtaaagccaagtaaggaaggttgtaactcaagaaatcccaagagtattttttatattagatactatctaaagaaaatcaatattacattaagtggtgttcaatcttttatgattcaggagagcactttacttgttcaattaactaatagtaaattcaataacacagtaaatctctggagagttggttactgcaaaaagacagaaaaggtgaacattctcatttggtgtttttggtatcctttggtgagggtgcagtgcctatctttagtgactcaggaagtactgacttggatgattgtgtccactctctgacttgccccagcataagtggtgccagtgacataagtggtgcaagtcgttattgccttatgccatctgcttgagtgaaagtagaaatgttttaataatccagtaaaaaagatgagtatgaaaatgatataagcacattggtacattgatttatgaaatatgtaagcattctgtatagaaaaaatattaaaatgcctttttgaagttattgtttggttcaatttcctttttttttttttttttttttgaggcagaatctcactgtgtcgcccaggctggagtgcagtggtgagatctgggctcactgcaacctccacctcctgggttcaagcgattctcatgcctcagcctcccaagtagctgggactacaggcatgccccaccacgcctggctaatttttggattttctttctttcttttttttttttttttttttttttgagatggagtctcactctgtcgcccaggctggagtgcagtggcgagatttcggctcactgcaagctccacctcccgggttcatgccattctcctgcctcagcctcctgagtggctgggattacaggcacccaccgccacaccctgctaatttctttttttttctcttagtagagacggggtttcaccgtgttagccaggatggtcttgatctcctgaccttgtgatccgcccgccttggcctcccaaagtgctgggattacaggtgtgaggcaccgcgcctggccaatttttgtattttcagtagatgtggggtttcaccatgttggccaggctggttctcgaactcctgacctcaagtaatctgcctgcctccgcctcccaaagtgctgggattacaggtgtgagagcacgcctggcctcaatttcttttttaagtgagccaacaacacagtacctgggcctgactctattagaaacattttctaaatgcagccacaagctcaattttgactttgtgagaaatgcagataaaaataaaactctctcagtgattttttttttctcacccgattttctttcacaaaatgtttcacaacataagtagaagtataaggggtctgagagggctatgaagcagttctcaggtcgtcccttctaagggaagagtcctaatgagaatgattcatcattggaagaacctctcatactattcaaccaagtaaaacagttttaggactccggggtttgtaggttatatatacctcttcaatacttagtggctgccatattggattacttttacatggcaatagcagcctctagaggcaatccggatgaactgatgtttttgctaagaattagcttgactccatcaggtataattgtggggaaggaaacagtagatgcagacggttcaaaaagtcaccagatttatcgagttgaggaggtcattgaatcatttatctggattagattgtcaaacttcatgacctagctcaaatcacatcttcagtttgaagtatttttaactccattctttcagtctgaattgttggcttcctcatttgctcatcaaaagccactctacacatccatttgtgatataaaccatgagctgcttaatcctcatcatgcagatctgcatccaaacatctaccctgcacccaagcccacatgacacagtgtatgatatataatgcacatacaataacattatagagtgaatgcatgattgagtggatgtgtggaagggacagaaaattaatgctgtaagtgtcctgttagagtattgctcaaatgtggacacccgcggaatcatctcattctcaccgtagtttcctcccagtaatctcactggatttttctgtttttctaaattgacctctttgagacatttggaatgaaagccatagtttaattttggcatatctccagtactttcattttaggtatgttcttttatgcccatgacattttgaaactgttttgttgtttttcttttcttctctttaaaaataatcaccagttgtgaatagattactacttgcttggtgtatttgttttttattgctaccataacaaatgaccacaaacttaagtgcttaacacaaatttattaccctatggtttcataagttggaagtccattgcaggtcttactggactatattcagcgtgctgtgctggtgggacgggactgtgtttctttatgttggcttttggggataattgttttcttcctcattcaagtattgacagaattcagttccatgcagttatagggctgaggacccagtttccttgactgtcagcaggcagctgccctaaagtcctggagacctctctccagtccttcaacagtctcctacatctcagaaccagtcgcatggtgttgaatccttctcatactcccatctctttgaccttttgtcattgcacgtctctctgtcaccatgtagcagggaaagcttcttgacttttaagtgcacagtcacccatgtgactaggttgggctcacctggataatccaggataatcttcccaactcaaggtccataaccctcatcacatctgcaaaatccctttcaccatgcgatacaacatattcacagggattaaggcaagggaatctttcagagacagttgttttttcagcctcgtctgaaatgtgctaagtgctttatatacatgtttaaagttatctccattttgccagaagaaataaagtcttagaaaaattgggcgaattggctaccttcctatgaaatgacagtcattatttaaacccatgtctacttgatcctaagtcatattgctcttaattcctataccatgctgtgctgtgtgtatatcctactatatatgtgcagcacacacacacacaccccaacatgttatgaactgagtgttatttgaaaaatcatcttgggccacataaaatgtatagcttacaccgtttcttctagtactctttacaccaattagttttgtatattagtaatctgagactcagggaaacgtggcatcttccaaactaatggcaaggctacaaaaacagaaaatatttattggccaatttattagttttcctagactttcaaaatgtagttatttcacagattagctatgaaactccaccttgatgatagcatactaaagaacatgaagaaattacattgttttagtttctaaaatagatttttaatttctaagatattagaatagttaaatagaaatcacaaaataatatgcttatgttttatatgcttataatttgggcatagttttttgagttgacaattaagttttagaattgcagtataaacagaagggaaatgtgtgagtcctttggccattccctgttgttgatcacaacacgtagaaacagctgccccaagctcttgtaaatgtatctttgccttagcccttaactatgtttttttctgttttagccatcctttttaatcccacttgtttatcttttcttaaaatgtactaactattcatagctgcagatatttttcttaattctgctatcttagtttcattttctctgtggcacttgctttacagatatctcagtggagtgaaggatgtgctacatgtgctgcttcgctgatctgcccactagactccgatttgactcgttttcatatcttgctttcccagagtctgctgtcattgcgaaagcattgtttattggtctccctttcttctttgctgcagaaccttgatgctctgcacgaccaccttgctaccatctacccaggaatgcgtgcaccttcctttaggtgcactgatgcagaaaagggcaaaggactcattttgcactactactcagagagagaaggacttcaggatattgtcattggaatcatcaaaacagtggcacaacaaatccatggcactgaaatagacatgaaggtaacaaacagcaatggagacttctgaacacagatgacatctaaaaatattttaaatgacactctctaaatttacctgcagttatcactgttagtgctcttccctggaagtatatataagccaaaacagtggaaagaccagcaatcttctatatttggcctgggagtgcattatacaggatatttttttccttctggcagcagatttttctttctaattatatagtgttcaaggctacaagaaatttactttgcattccctgtgaacacacaccagctgggaagcagaaggatatgtgacgactgagctgtgggtttcagcatgcaaaatatccataatatggatagtcaaattctaaggcaatataaaattaagtattattttatagatcattttctctttgtcgatttttgtctgccctgaaatatagttggaatgtctaattttgtgaatgaaagtgtttgtttttgtttttgtttttaatcaagttacttggtgaaagaagccaggtctggtactttaaaaattgtgctgttattgataatacacactcttagttttgagtgatgatttcaaggtactgatagggcaaccgtacaacaaagagaaccactgtttctctttacctctggcccttacggtttctcccagtcaggctgctttttatgtgttcagcatgttcatacccaagagtcaattctcagtagctttaaacttgaggccaaagtggggagatagatacctttttccaacctttctttgtttatagaaaacctaatagacagttctttcttatagatcatagatatattgtaacacacttgggaggtctaaaacccttaagtggagtattatccaaaattaaaatagtaacatttaaataaattagaaagatattccacatatttaatctagtaaagttatgttagagttcatggttttctttctttcagaagttggtgttagttcttacgtggcactttttggtgatttccaggtgcatcgttagttttctacaaccattagtaatggcggaaaccacgattactgttgcaccaacctaatagaaagtaggactgtgtataacatggcattatcaaatgcagacatttaaaaattaaagccttgggtaaagtatcacaattcatccatgattgggaatctcactggtattcaatcaaaatagtatatacctcacatttccaatctttttttttttttgagacagagtctcactctgtctcccaggctggagtgcagtggcgcgatctccgctcactgcaagctccacctcccgggttcacgccattctcctgcctcagcctcccaagtagctgggactacaggcccccaccaccacgcccggctaatttttttgtatttttagtagagacggggtttcaccgtgttagccaggatggtctctctctcctgacctcatgatccgcccggctcggccttccaaagtgctgggattacaggnnnnnnnnnnnnnnnnnnnncgcgcccggccagtcttttgttcttgacattaaactaacagtatcgcctgggcgcagtggctcacgcctgtaatcctagcactttgggaggccaaggcggggggatcacgaggtcaggagattgagaccatcctggctaacacggtgaaaccccgtctctactaaaaatactaaaaaaatagccaggcgtggtggcgggcgcctataatcccagctactcgggaggctgaggcagaagaatcgcttgaacccgggaggcacaggttgcagtgagccgaaatttcgccactgcactccagtctggttgacagggtgagactccattatcaaaaaaatagaaaaaaaaaaaaaaataaagcaaaacaaaacgaaaaacaaaaaaaaacacagcatctatactgagtgaacgtatatgcatattgtatgcactgttggttttatttttatttaaccagactgagaaagaggtaggttcatagaaacttcagaaagaaacacaaattaggacacacttggaaactactattactgtggtattagaatctttggcatgggagattgatggctttagcaaactgtatgaaattcaagtatttacttaattatatggttcactttataaaatatttaaattctcttctgaccatttattcaagtgcttcaatatgaacttctgaaatatttgcattttataggtatattttatgtgtttaattttttcaaaagcactgttttgacttctcgagggattctcacattaagtttatcaggtccagagataccagacaatttgaaccacatggttaatactagatcatgtcataaagtgatataccaatgagaagttaaaaatatgattagaaaagctatttgttttgccagtttgatcaaagcaaaaaaattagaattgaataattaattcataagtttaggatacatataattcaatttctctagttaaatagaaacagagtagaacatcaaaagtaggcctgtcatttaaggttgactctcttgccttgtctatgagttagggaaatcaaccttaatgtggtaaaattttcaaattataaataaggatactaatatttaaccagtatagtaagttattctgacagtgaggtagtaacatcccagttttgctacaaaatatatctaaaagaatatatacaatagcatctatagttattgtgatttgtttttaaaaattgcagagaatgcgacagggtactcctgaaaaaaaaaaaagaaaagaaaaatgaacaacattttgtttttatttagctgtaactgaagaaatgttgtcccaaactttttctgttttgggtctggttgccgttgagatcgagttttccctttgtaagagggctcattgcttgcaatttcttaacccaaaaagaagaggaaaatctatactttaataatgtatttgcctgtgaataatactttagaaaagtaggatttttttacattatagatattagctcacaattacgattacttctttagaatgaattcctagatttgcaattaaatcaaagaatccacaaaattttaaggaatttttatgcctattgtcaatttatccttcagaaagattaatcaaaataccccctcatcagtggtatttgagatgcctctttttcagtaccttacccaatttaatattgtaacttttttttctttttttgagacagagtctcgttctgtcgcccaggctggaatgcaatggcatgatctcggctcactacaacctctgcctccccaggttcaagcaattctactgcctcagcttcccgagtagctgggattataggcacccaccactgcgcctggctaatttttgtatttttagtagagatggggttttgccatgttggccaggctggtttcaaactcctgacctcaggtgacctgtccgccccaccctcccaaagtgctaggattacaggcgtgagccactgcacctggcctggtattgtaactttatgtatttgatagttgatggttaaaaatgacattgcatttatttttgaatatgaatctctatcattttatttcccattgttttaaaatagtattgtaatcttatttgatagtgctagcttgcttttagctggctttcaggttgttcactatacaagtgtgcttggctaagaaggcagagcccacaagtgctttttttttctaattctaccaaagagaccatataggatactggggaactgataccagatttgtaattttacaatgattattcaatcttcaaattttatagatcaaagtccagaaatattttcctattttagacatatggagtatttgcatatatgttttgaatttttgtaattaatcttctaaatgcagtattcataactcattttttatatttaggtatttttattaaactgaaatgaagacaattcatgccatttccccctttgatatccaggttattcagcaaagaaatgaagaatgtgatcatactcaatttttaattgaagaaaaagagtcaaaagaagaggatttttatgaagatcttgacagatttgaagaaaatggtacccaggaatcacgcatcagcccatatacattctgcaaagcttttccttttcatataatatttgaccgggacctagtggtcactcagtgtggcaatgctatatacagagttctcccccaggtaaaatgacagcatacttccttggggcctgagacaaaagcccatagaaatactattgttacaggcagccatccattcatttaaccctctgactatgtattaggtaatatgcagtttattgtaagttacacaaattgtttaattgtgaactaagtgtatttgagcataccacaactttccctaggacaactatttttttataataatcacatacagaaacagtaggaatgttatgtaagaatagtatacttgttacagtgaaaaaaaatgggtaactttttagtaacagtcacctttcacatgtttatttattcactgaataaatattcattggatatctaccatctgtaaatagctttaaaaatcaactattgatggtgttaagggaaaaggggagattttaaaaagaactaaaacacaaaatgatagagatgatgatggattcagtagaaaaagcatcaaaggaagcagttgggatgatgatgagaaactgctgttgacttctatgacagatccattggtaaaatcctttatgcttactctttttttcttaaatactaacttttggagttgtatatggcatacgtttagagatactttttgcttgtaattaaagagacttgaaaattcaggattagcccagttggatcaggtgaaatggaagcagagtagtgtgctgtcctggctctggtattgactctacctgtcccttactgtatgaccttgaacttattacttcacttctctcagcctgtttctctttgttctggcatgagaatagaaagcatatgaaaaatacttagttcattgtaagcaatcaatcagtgttacctattgttttcacttttagccctctagataaatattaagagagggtttgctcatgtttttggtattttaatttcatttcaagccatacacatttaacataacactgtacattttaaaagataaattttcattttttctccttctgaaaatgcattgtaaatttatgctagcttacatttgaatattagtcatctgaatccatatcagatttcatgttcttgtaactatttaatgtccatttaatcactgagttgtatagattgagatttgagttgatagttcagctaagtttcccttgaattataataattataattttctagttttaaatataactgagctgatttaatcaagcgattaatatcaaagtataaaaactattttaactgatgtgatactctttgctctctatctatattttagctccagcctgggaattgcagccttctgtctgtcttctcgctggttcgtcctcatattgatattagtttccatgggatcctttctcacatcaatactgtttttgtattgagaagcaaggtaatcaagatattatttcattaaatgtgagaaaggtatgtcacaaattagaagtattcaggggggaaaattatcacattctctgagaaagtatagagagataaaacccagacctcaaaggaagatctatttaaaaggcaataacattgatttttggtttgcctgaggagcagtggaactctatcaactgattaaaattaacagaggtaaattttagagactgtctttctgagacggccttgtttcacatcaaaaaaccaacatcttttactccctgtacagctacagtgccttattctagaaatcagaactaaaaaggatttttttttttggaacttcactcaaaaccacttatttattctttcttaaattgtctattgttcttagtagcgtttttgtgggtgaataaaagtgatgaaatattcacacagttgataatttagatagtgctgggatctcacggtttctgttcttgggatagatacagcaaaagtcattttcctagagtacccattgaatcctttctgtatttggaactgactgtttgcagctgctctatgaatacagggtgggagaatggggaggcttggcttattctttgagagtctggtaatgtatgttggaaccataccggaaaatcagggggataaaaaagattcacaaaagcttgaaataattatgtgaagagtagcacagttactgtcctgaattcagacgggacagtcacttttctgcagtgttgcaaggcagccactaggcttattacaggcagaactctgacagaaggccctctcctgttctaatgatgcacttattctgctttgtggtttggtgggaaatgagatatgcgtgtccttgttgctgaattcttaggtagggagaaaggcattcattaatggttgtatcttgccttttcaaggaaggattgttggatgtggagaaattagaatgtgaggatgaactgactgggactgagatcagctgcttacgtctcaagggtcaaatgatctacttacctgaagcagatagcatactttttctatgttcaccaaggtaatcatttttagattaattatagtggctatcagtacctatctttagctaacaaaggaatgccacaatattttattccattaaatttacatattctctgaggtgtaattagattttacagcccttgttgtgtattactttataacaaggataatcttatttaatatttgctaataaactcagaagaaatcacatactctatgttatttgccatgtcttaatacatttgtggagtgtttatgccattacgccatgggacaaataatctgcattaagctaattctatagttttggaccttcaaaataggcattatgtagaaaagtgattttttaaagcagctaataggatggcataataaatacattggtatatttgacatcaaaaattatcttttctatagtatgttagcaaaaaatctaaaaggtctctttctgggtttgaactattttaaattaaaaatatttacctactctaatccaaatacactgttccaaatatattattcaattaaaatgtatgtaaaatgtgatttttaataaacgtcagagaaaaataaaactatagattgttgttttccaatttaggaaagcattttactaggagatacatgggaattcagaaatataaaaattatgtctaaatttgcttcagaacaatagaaaagataactgtggggattattgtgagatgatattctgtgtattcataattttgtataaacaaagtgtaggtgcattatgtagtaacacagtcaagaaggcatgttttggtgagctattggttaaaaatttaatctgaattccaccatgatcacttttcacttaaaaatgtggtcttaaaatttctgaaaaatgtaatacactttgtaacaacctcctgttatattattactattgtattatacattacataacaataatatataaggccaaataagaataatatattgttggcacagtagttcacacctgtaatcccagcactttcggaggccgaggtgggtggatcacaaggtcaggagttcaagatcagcctggcaaacatggtgaaatcccatctctactaaaaatacaaaaattagccaggagtggtggtgggcacctgtaattgcagctactagggaggctgaggcaggagagtcgcttgaacctgggaggcagaggttgcagtgagccgagatcatgccactgcactcctgggcaacagagcaagacactgtctcaaaataataataataataataataataatatatcgttaatttttaagtacatttaagattaattaaatattatttaactatgacatataagaataatatatcagataatataaggatatggatgtcttttccctgagaaataaatatcaggaaaataaaagaaacaaaactaagaaacataaacgctttttaaaaaaattattaagctacattgatctaaagatgtcccatctgctatcagtaagtgttttcttcttctgcctcttcacaggttgagcttaggagaatgtcagcttctcattaggggcaatttctatttatggaaagaaaggttttcttcagaaataaaagcagaaaatttggagtttatttgttaattcccatatgcagacattggtcacccagtgagaaaattgcagattgtcctatgagacatgctcaggtgtgtaggaagatttgtactcacactacataaacaaagatcaagtaaaagtagttttacttgtaaaataattctaagatgattagtttgaatttagaaaaaacttaatggttcattaaaataatgatatagggcatttttagaaccacgagaccgttatgatttaagttttgtaactcagtatgagcatttttgaccattcatttttgaacgtacaatcatgttttttctctgctcatgggcaggtctcgtatacctttggccgatgatctggcttctttctagatgtgtctttttctgcaagtggatttacatatccattttaacgaaattaaaagacaccgtgtatttcattagtaaaatctttgattgttttattttctttataggtatgctaatttttgttttgctttatgaacattgctgctgagaatatattgcattaatccaaaattctgcaaagtcaccccttttaaagaattttggataggattaattcaaaattcttcaaattattaatcccagattctccaaagacataactaaattttttccttttagagtaattattattcagagtggccagaagtaatgactttgcattaaaaaaattcaagccaaagatataaccttatgccattttaaccaattaggttttgttgtcgttgttgttgttgtttgagatggagtctcgctctgtcacccagactggaatgcagtggcatgatctcagctcactgcagcctcctgatcccgggttcaagcaattctcctgcctcagcctcccgagtagctgggactacaggcgctagccaccacacccagctcatttttgtatttttggtagagacgcgtttcaccatgttagccaggctgatcttgaactcctggcctcaagtggtctgcccacctcgcctcccaaagtcctaggattacagatgtgagccactgtgcccagcctcaaagagtacatttttaaaaagcagttaactttttacttgtcagattatcactaaaataataaacattattatgttgttggaaaaatgacacaagttacaatgatgacgcataaaattcagcaggattgaataatgtttcaaataaatgagaaaaatttgtcaaagtaaaaagaagacatgagagccagaagtaagaatgacacatagttttagatacataaattacatgctgaggctgggtcataaacgtggttgggaatttttactcattgtttccaaaagggaaaaataagcagttacaagattcatagaatacagaaagcaaaatgaaagtttctcaaaagaagcattattattcttgagagagagaataaagatagatttttttcctctccttatgatgagaaaaaatttgagaataataaattacagcctgtgttaaatacctcaacgtttatcatagagatgttttctacatgatcgtttcaatttagactgatggcaccaaaaagtgcaacctggcaaaaatgcatctcaagttcactgctttttggtagatgcttaaatatctaagagaataaactcacaatcttcgttcaattctccataattctattgtcttcagcctgatgttttgaatggtaggaggtggcaggatcagattccttgacagaaatcgggattgcattgtcatgtatataagttgagactgatcttgcctcatttctccatatgacagtgtcatgaacctggacgatttgacaaggagagggctgtatctaagtgacatccctctgcatgatgccacgcgcgatcttgttcttttgggagaacaatttagagaggaatacaaactcacccaagaactggaaatcctcactgacaggctacagctcacgttaagagccctggaagatgaaaagaaaaagacagacacgtaagaatgtaacgcttggagcactactgttattcataacataatgtgactctactatatttaagtttgagaaccagactaaaaagccatgtgacctgtaatagctctggtgtagtaaataaaatctttcacattgcttttaaaaagaaattatgcttaaggaaataaaccagtcttaatggtggtggaaatatgtctgctatttttagaagccaagttggaataatataggccaaaatatcttttggaaaatcatgagaataactcaaattcaaatttagttcaaaaattgaagtttaactatcatttattcctgcattctttcatacaagagttatatattgaccatcttcagtatgctgggggctgccgcgtgcagagagctgctctgcacaatgaacttaaccactggccattacatgtttaaaaatttattttctgggaccttgaatttaggattagaaagaaatgaatctgacaaattgtaatattatatgtaatgacaacaattacatctatagtgacatacattagcaaaaatatcaaaatataaaacatttctatgagtggtggattcaattatgaaatattgagcaaggacatgaaagataatacttgattttcaagaaatgtatttaagtaagtacatagcatgcatactacttggccttgctttcatatgctaattaaacgcacatcactgacatttataagctattttacccaggttcttatgtgttcgttttttaatgtttatataaacatttggcggagcttctaagaccttaggactaacgttcaaagtcacatgggtttgtaggtttgagttactcaatattctgttctggctgtttgtattagaaaatcatctaggtttcattttttttgtattgtgactcaatttgctaatatctacattcatgataaatagataaataaccagcactataaataacatagcctttaaattatgacatatgcagatattctgtactgaaaaagctcttaattcacttcttttcctaaattgtcagcttaagcagagtattagcttctcttcctagaccaggagtccaaaactgggagttgctgggagttaaacagcggccttgtctttaatacgagtagctgataagtacttattacagaactacttctttgtttggattccccaaggtgggtttcacattcaggaactatttgcaccatttcgagttactgtgcttcaaaaatccttatattattttttagattattagatttagaatttggtttttgtagatatttgggtttcaaggtgatgtcattagaaaccatttactattaattttctttaaagctaagtagttttactgttcatacttactattcaaatatagctttaatatttcataaaacattcaatgtttaaaagttgaaaatgaaagaccggagaaattctactatgactaggaaaaacattgagagctcagctccattttgcatatttaaacttcccacatatgcccttttgctttagagcaaaaggcaggaagaaaaaggcaggagggcttcatttgttcctcttcagtcttccaatccagagcccataggtctagtttctgcttctttccctctaaattcaccagctgtcatcctcctcctgtgtgctcacatttgtcccttagcatgatcccatagtagtctcagttgtacctaaagaaatacaataatttattttctagaccaacttcctctggttttatcagtttcttctatggaggagtgaggcatgaatgagactggagagaaattctgcttcttttaatattacttaccaaaaatagagacatatttcttattctaagaggcaaacctgtttccattattgtgctattcataccatgttttaggtgctggtaatgacagtcttcatactgtgactatcgtaatagcagggtcagaatacaggactacaaatgaaaactttgattttctattaccagtctttttgttttgtctgtttgcttggcttattttgatttggtttgaactagtttgggcttgcggatgtcttatgtgattaggatgaacaaataatttatgttttctgtaaatccttgcttataaatacagctaatatttgatgctaattttagaggatgtcctgctagaatccaggcctttaaagtacaaacgacactgatgctgtgtgaaaaggacagcagaagcactaaaggctttcccagtatttcttacagtggctttctgctgatcccactgaacagattgctgtattctgtccttcctccgtctgttgccaatgagctgcggcacaagcgtccagtgcctgccaaaagatatgacaatgtgaccatcctctttagtggcattgtgggcttcaatgctttctgtagcaagcatgcatctggagaaggagccatgaagatcgtcaacctcctcaacgacctctacaccagatttgacacactgactgattcccggaaaaacccatttgtttataaggcaagtgttctttatcgctgactgcagagctatccagaggctggcgttctgagactcccctccagaggccatgtcatcacagctctctgactccagcactgcagccttgagtacagtgagcctccatgtattcactctttaccatgttcttaaataattgcctcttgttataaaactgtctcttccttgtaaccacaatgaatgtttcatgaagtgggtgattccctggttaaaatgaaatgttcaccatcttatttgcacttaggctaacaaatctggacaggctgtttatcacatgtagtataaacatagcattcattttagtcctctgcaagagacatttttactgagatatataaatgctttgtacagtaaagaagtcatgaagcatgagaaggactcagatttgcgtttagataacatcaacttgaagaagataaacatttataaggcgtttttgccctttgtttcatttagaaataaatataatattggaaaaaagaagtcagtggaatattgctacataaaggcaagaatgttaagtaaaccatctctagatatctggggtaatataactacacaaggactatttattttatagtcattttctgaggtacactctagcatgtggtgagcacatcatacaaacaaatgattaatgaccgtgataaatcactgaacttgaaatggtggctctccatgccgtcaagccatcactgttttaggtagaaatgtaaaaaattattcttctgaattataaagttatctgaggtgagaaattaattgcttactaaaggaaaaataattctatgtctgtacctgcccgtcatcaaagaccccaagtgtccgtcatgtgtgtaaattataagtaattgcaaggtttcattttgttggagttgaatatattagaattttaagagaattaaagggggagggaagcttaaagttgctggtagacttgaaaaaatatgttttttgttagggtaataaatgaaacagtcttttttatgctaaccgtgaacatctaaatatatgtactgttaggtggagactgttggtgacaagtatatgacagtgagtggtttaccagagccatgcattcaccatgcacgatccatctgccacctggccttggacatgatggaaattgctggccaggttcaagtagatggtgaatctgttcaggttagtaaatgaagtagatattgtaataatggtatgtaaacctttttggacaattgattcatatcgttgtccggaaaatcattaacgtgtataaagaagggcatcttgacaacaaagactatagcatttcatccagcccactgtactacattctttcatagacatggagatttatctacctgtttgaaattatctagtccgtttcatgtactgaaagtcatggggatgagaaaaaaacctcttgtaccttctagtttattttttaaaacctctttcatgtctcatgtaagttactagattcacatctttgaaatcttcagacttcaaatgtttctcttgagataggatatttccctggggagatagagatttcatggagggcttttgaagttgtccataatatgcttgaaattcttatagacatctcttacgatgttatatgatgactctacattattctgtaatataaagtaagcaaaaattcatgtgttacaggaacagaaaaccaaacaccacatgttctcactcataagttggagctgaacaatgagaacacatggacacaaggaggggaacatcacacaccgggacctgttgggagtttgggggcaaggggagggagagcattaggacaaatacctaatacgtgcggggcttaaaacctagataatgggttgataggtgcagcaaaccaccatggcacatatatacctatgtaacaaacctgcaccttctgcacctgtatgccagaacttaaagtaaaataaaaaaaaaaaaattcatgtgttagtgatcaaaatgattgaagcaaagctttcttttttgcagataacaatagggatacacactggagaggtagttacaggtgtcataggacagcggatgcctcgatactgtctttttgggaatactgtcaacctcacaagccgaacagaaaccacaggagaaaagggaaaaataaatgtgtctgaatatacatacaggtgagagaaaatgtcttggtatttactgatttgcaaagaaaatgtgtctttgcatgtggtttaattctctgagagattttgttgctttaacagagttatcaccttcactcttccccactgcttgtagagttgtttactttttatttgagaagattgtgtcattatttccattttatatgatttcacatcatcttaggaaatcctgatatgatcattgtttctaaagctttgagttacctttcagtacaacttcagcatttgttcttgccatcttggtttataacatgatacatgtcaccttctctataaaacttgtgtatacttctctctctactccccttcccttgtcttttagatgtcttatgtctccagaaaattcagatccacaattccacttggagcacagaggcccagtgtccatgaagggcaaaaaagaaccaatgcaagtttggtttctatccagaaaaaatacaggaacagaggtatgactaatcaaagtgtaatttgcgtacttaagacagagtataagtatggaaaactaaagcaaaatcactgaaaatgtatttcatttgaaaagaattcttgctaacagaaattaacttctaagtaaagcagtggaaataattgaacattaatgagccaattacaatcataagtactttttaggggatactttagtgatttttgtcctctaatgaaatgaaaaccaacagactggattgagaaggctgctttttttcttgctgttgtggttgttttgctcttcctctgtagtctggctcaaaggtaagtgggctgtgaggggctcccctgacccctttcctcagctctctaagttggctctgagatcaccacagataagggctgtggttcatgggaggtttcttaaccatgaagcttaagatccttttaaggggcaggctatctttctatggagtgattggggaattttggaaatcctagtccctcatgtgtttctcctagatagatgagtgatttttaacttgctagaatctgattaattccttagggaagatttaagttctttctactactatggttatactccaggcagagcccatgtgctagaatggacttcagaacagtggcacatccaaagtggaatcacacctctcatagaggccttgcacacactaagatcatggctagcctcttcctagccttttgtaaggagtggcatcagaagcaagtttgatactttgttaccctgttgatgtgttgtttcctcatgggggataagactgcatgctcatatttctcttttagtgtgtataaactctctaaagatgcttttagggcataacaacttctaaagggaatagaatgccagggtttgaaatatttatcttctttcacctggtttaacattaaatcattttcctatgaggtggacatgcttattgatgttcttctgataaactaagccgtaattacctcaaacattggtcatcttagtcgtgcggtcctgtttttcccagaattatggtgggaatgatttacagaaactgtagatgtgaacgtggatcacactctcataaagagaaaaatatatttaattgatattataaacctcactatcactgtaaatcaatccctcttttcttctgcctatttaaggaaacaaagcaggatgatgactgaatcttggattatggggtgaagaggagtacagactaggttccagttttctcctaacacgtgccaagcccaggagcagttcttccctatggatacagattttcttttgtccttgtccattaccccaagactttcttctagatatatctctcactatccgttattcaaccttagctctgctttctattactttttaggctttagtatattatctaaagtttggcttttgatgtggatgatgtgagcttcatgtgtcttaaaatctactacaagcattacctaacatggtgatctgcaagtagtaggcacccaataaatatttgttgaatttagttaaatgaaactgaacagtgtttggccatgtgtatatttatatcatgtttaccaaatctgtttagtgttccacatatatgtatatgtatattttaatgactataatgtaataaagtttatatcatgttggtgtatatcattatagaaatcattttctaaaggagtgaattctaagttttaggggaaaaaatgcaatttattttcagactcccaaagtaagaattaacatatcatgctaagaaaatagtgactattttgaagtatgctacttccctttcagaaatatagaatacacgtttctgttattaaagtatttgattactaattcaaatcatatggcaattataattcttctaaaatgctatcatttgtaactgtatcccctgtattaaatctcattaaccacaggcagctgttacagaaagctgcattgtttcacattgagctgttacattagttcaggctaaatgttgggagctccaaccacatccaagaataaatctggaaacacactgctgggatactgctgttagagcccttcttggccttgtattcccagaaatgagctccctttccttagcttagaagaatgtgattatatccaggacatcatgttcagaaaacttagtttactttcagcatagaatgcattactgttggaataattggcctctagctcttaaatgtctctgataacttattaatatctatctttataaaatagagtgcaactacttttgtgtaaaaatgtttgcctttaaatttagtatttcatatcagcacatcgatatatgtataaatgttccatgttaatgtgtaaaagagtctgtaataaattatttttttcacgtgtctctatacagtttttatttcaataaaaatattaacattatttttcattttattaatgccattattttgtaaatacattttacaattttgcctatttgctaccattataaattttcactgactcctcatagacagcatattcttaaatgctatatttctttttaataccaacagagtgacaggaaataaagactgggcatggaaaggggaaacagttaaatattgaatgtcatcagcttatttaaagagctctgaatcatttagggatgatagacatgtatacaagtaatgaaaatatgcgatattcataatgaagaaatatattcaaatgcagaaataatacttagagaaagagtaacttgaaagaaaagaggtgaagtggggatagttgttatgcttattttggggggagagttaggaatactcagaaactacattgacactgtcatcttcccagaatcctgcatatatttatttagcatctactttgggtaggtactgctcaagatatttgagaaatgtcattgaacaaaacatctctgcctttgaatacctcatattccaatttttacatcttgcatgtttttaaatctctactttattccgccaacactcttcgaagtccaggcactcatcatgtgtaacttgaacaattgcaagatcttccctataaatctgtctatttcctacctttgccacctccattccacactctcaaattgctgccagagtggtcttttacaaatccaaattgctctcctgcgtacaatcacttaaatgctactcattgtctgtacaccttagcaaagcatgtaaacattgtcaccttaaccagccttatctgctagttgctacctttgtaattctatgctctgctctgtctgaataccctctacccatactctgctgcaaattcatttcttgctaagactcagctcaatatcctcttgttggaaatttccctgttaggaaagtttagcttcccctattgtcccaggatctttacaatggttcacatattatctgtttatatataggattccttattaggctttaagtttcttatggctaaattagttcctcttacaccagatattccttgaaccttccacaaaataggcacttgacaaatatttgttgaacaaaggaatggagggagcagcctcttcgagcagtggggctagaagccagatttaaagggaaggaggaataagaaatgagatagattggagaaaagaggaggcacaaaaatggcactgttaaacttgtgcttagagaaaatcatgctgacattggtgcaggggctaatttag

SEQ ID NO: 15434 - DNA, 14349 bp, Human
  misc_feature (1)...(14349): n = A,T,C or G
actttaaggttcctttcaaatttcagtttcaagtcccttgtttagaactcatttccacccacaaagatgttataaatgatggtggattaccaagctaatggggatcctttaattaacaggtaccagaattgtatttctactgaatattagctgcaggaagatgggagcaataataaagaaagtgaaaaaggaagagaaggaggcagtagagaaagagtggtgggaggaagaaaaagaggaagaaaagggggaaaaggggaatggggcaatggggaagaaaaggacaggaggacaaagagtgagaggagaggagggaaagcttccagtgacggcaggagcttgaggtgcacttctccatctcccaccctgctttctcttgccatggctctgaggatccttccttgggtcctctacctctgagcccctgctccaagaagggctaggagacagagcacatgggacccacagatgggacccttcctgcctgcatgaatccacttcccatttgtgtcagtggcaactttggccctcagtaaagagtagattgatccacatgttgtttaaccctcactcagaagttcctgtgttatcttgacctctgttctttgaaacaaaactaaaagagaaacttgttttgaaatcagtggggggttgtattctagaatttacttctgctatgcttctatatacttttctattgtcaaagaaagaaaaaatttcttattttgcagaaattccttgcccacaattcagaactgttatatactctttgcaaattttagtttcaaagtttccctttaaaaccaaattagagacaaaattaatgggaattcattgccattgtctattttgtattttctagaggtcagcattgctaactcagtgtttcatttcttaaccttcaggtcagagatgaaaggaacatgcttaaggttgtttctcggatgcaccgagtgtcagtgatcctgaaactgctggtgcagcagttttccattctggagacgatgacagccttggacttcaatgacttcaggtgtgcacatttggcattttaaaaaatgtgatggaatttactttctcattttggtggggtaaaagcagcatgtgtgtgttttgtgccatgaggagcctgtcttactaacattttgtcactatatggacttaggggtcttcgatcacaaagcatttgagaagttattaaaaatattttattattcatttttacatgtaagcgtaatatgatcaattgatttaaattcatcactgtgtgttctgtttttctccaaaaagaattttagacaacttagcacattgactaaaatagctaataaaatacatgtaattaaatttaaaagatataaaaactcaaaacaggagcgatatatacagaagcatgtcaatcaaagtagaagttatggattaaaccataaattttacctgtacatttcaaggcaataccatatagatagcttttttcttaccaaaatgtgagaagaaaaaagtttaagaaacttccattgggtgtaggatgtaacatgcatgtcctgaacatgtctgacaaaggaaaagtagaatttgtggtgaatttaaaacgttaaagtcttagcagcagtgaaatgaaagacattcacaaagatataatatggggagtgggagtaataacatttttgatatccgatgatatttaagtagctcatttttctgatttcagtgagtcaaatcacaggtctaactctagacagttgtgtgtatctgctcttgatatccaagagtaaaactgacagtctctacaatctcttacaatagaagaaaccattatggtggttgataatgtcagctcttctcttctctcctctcctctcctctcttctcctcccctctcctctggactcctctcccctcccctcccctcccctcnnnnnnnnnnnnnnnnnnnnnnnnnnnnnnnnnnnnnnnnnnnnnnnnnnnnnnnnnnnnnnnnnnnnnnnnnnnnnnnnnnntgttcttcagaacatgagagtcccttataacagaagacattatcgtgataacttcaaaggagaagaaaatgaactgctacttaaatctgagcaggaaaagacacttctggaattagtggaggtatggattcatacaatttataaagtttaactcaatacatcttcttaatttagcttttgctaaatcagaattttaaaaacttatatcgaaactgagttacattcagtggaaataaggatagaaagaattcataaaaatacatgaatttgtaaattcatgttactaaaatattgaaaatgtcaagaaccctgctgagaacttcggaaatacttatgtaatcaattgtatgctaatatttaataaccttatcatctcaataaaacaattccttaaatatcccttctaagtaacactaaattagctgatttttagactgagtgtgattatttagtgagctttattgttttaaaatattctgtaattgaaaatttccagttatttagtatttttcttagctgaactaaattactaagaatatacacctcagaaaatgttcccttcatatccaaattccctaaaggtctgtaagtagcctttaggaattattaattttttcttcaaaatagattattaaacaaagattgtattgtcttgctttccattacaaagccttttcttctgcaaattaacttttcttgtgttgaattatactctgctcattaatcctctgggtattgtaaatgtggatttaggttaatgtattatatataatgccaaataatggcagataagaatagggagaaaaagaattacaaagctaatttcagaattataataagtataggttaaatgagaactcacagaggtacatgaatttagttttatttctagatttaaaaacattttaaaatctcaaagtaattgcatggatggttaatttcaaagttgctaagtatacagtgcccatgaatttagaagagatcgtatcttatacatatcgtaatttcttaagctcctatgacataaagtaacttgagaataaaccagtatatattagtaaaataattattaagaatatactctttaaatatgtttagatagaacatatgtttaaatatgtttgtagatttctagaagacaattggaatttctgtaatcacatatttcttaagaaataaagagtaaacattattaaccattgccataaaaattaagaaaattgaatatattaattatttcataaatgaagaaattgaagagaaataaaaaacatttacaaataaaacttgtagcatatgtttctggaaaccatgaagatttcttgttttaagtttatacatgtcggttacaatgcattttacataattttaccatgtactcacttaaaaaataatgtttatttaaggcatggctggaaagaactccaggtttagagccacatggatttaacttctggggaaagcttgaaaaaaatatcaccagaggcctggaagaggaattcataaggattcaggtatttagatgacatgagttaatataaattcaatacagaaatattcaaaattttattttaattattttttgcttttctcttaaccttttctctttctcatatttttttcttagacaaatgtattttcttggactatgtgacatgattgatttcattttctttatgtgtgataaatattatactaaaataagaccttcattgcacgggagaattttgtctatgataactagctgagattaatattatttttcatttctattgaaaattctatattagaaccaattttagacagaactaggcccacagtggactaacgaaccaaatctatttagccctgtagctttgcttttgctcttgtatatttactgggtgctttctggcagctctcagacaatgtcagttttctcctacttaaaagatactgttgattgctcattgcccttatctttcaggtctctcatcctcttggcatgactaaatttcctggaagacttgtttaaattctacatcttgagaggttgcatcaggtagtgctgaaagcatagactttgaagtcatgctacttgggttccatttccacttccacttcttaaacaactatgtgacagagaacaagtgactgcacctctcttagcctatctttcagcattggcaaaatagaaaaataagaatatctaactcataagattattatgaacaggaaattaaataaatacttgtaaagcattgaaagcagaagtcagaatagttatctctcagctaatcctgagcttacttcaagctgtcttcctgtaccatcattctcatgtggccttcatgtacataaatccaatggccatttttaatcttaacttagttgacctcgcagaaacattcaatactaatgactactacttattctttcttgaacattcttttctcttggatttagtatataccattatgtttgcttctaattctctggcccttatttctctatctcttttacttgctcttatttctctctcagaccaataaatggtagagttttgtagtccattggcttagatcctttctgttctatctctatactctttcattagatggtgtcatttatacccactgcttcaatatctacttagccaccataattctcaaacatttatctctggtttatatatccccttagatttcagaacatgtatataataccttacttgatatttcctcctggtcctctcaaaaacacaccaataaaaccaaacttgaacatttccccttccatccactcttgtaccaacattgtcttctctgcattaaagaattttttctcctataatccatctaggctgtcgtcagactcttatcaatcagtgatccttggctccgccctcttgtttcaccacttcttcaagctatcatcaagtcctaccaatgttacctattagctctcaaatatcatcctttaatctaccactaccactcaagtgcaaccctccatcgtttttcacctggactataataatatctgaactgtgctcccccaccttcccagtatgcctctattccaatttagtctccacattgcagtctgaataatcttttcagaaggcaaatctgatcacgtctcccttttgtgtaaagccttttgatgttacctcattgtttttaaaattaagataaaattaacctggtctataaggcctttatgatctcacattcatgtggtcaagccatattaagtttctttattagctaagtttagttctttggatttatcaccaaggagtccttttatgtgttcttctctgggcttggaatgttcttccccaactaactccttcccactctgaagatcttggctcgaggaaaacttctttagaaaggtctttcctaaactccttattactttaagttatgacatatagcatagtctatggttgtaatttaatgactgtactgggttattatttgttcaatgtcttattcctaccagataattcctgtataatatcacgactctcaatttttgcacacaattttatctctatcatcttagcatgacatgtattgaataaataaataattaatttgaaataatatgcatataggttagtactacacagtgtggtggttctgatgaattggaaataattgggttaaataattttccccagctcaattaattggcttataagcagaatatgtgttgtaggcagaaaaataagaattttcttaaaccaatcaatagatagatagaaaatgaataaaacatgagtgagaaatatctaagaaattgtatttacagaattcaacactgaatatagaacatagaatttcaataggtttaatagttcttctgactaggaattcttaactttttctaagtgaagttaccttacttcctgtgtttaattcttgtttaaaattatatcattattaactgctggtagttatctccaattttgtccatctgagtccattgctcattatatttatgaagataatatttaatattgagaaatcatttaaacttaaataaaaggatagaaccactgagtatgtggaagattccttctcataagacataatttccaaatagtaatattagaagatacagtaaatattaaaagtacatcatttctgcaaccataagtcttttcctcataagcaaagttttctaaaatatcaatctacttattctctctcaggactattaatgccatatttttcctaaaggctaaagaagagtctgaagaaaaagaggaacaggtggctgaatttcagaagcaaaaagaggtgctactgtccttatttgatgagaaacgtcatgaacatctccttagtaaaggcaggtatttttactttatgaatcttttccctggaatgtgtgaatatgagatcaagacatcattttataagactatcaagccttacttgggagaaatagaatgaaaattgatattctactgatagaaacaaaaatggagtaaatgtttttggtgataaacctattttaatgggtttccatgcccagattatttgaaaaacattagaaaaaaatttatagtctctgccagatatacgggatatcaagatgaattgcatatagtttctcaagtagttcacagcctaatagggacagaaatgaagacaaatcattgtaacagtaaacactatggtagaggtaagaaaaggaaggaatagctaccgtgaaagcaagtattgatgtcgccccattgttttagaattaagataaaatctttaacgtggtctataaggccttttatgatctcatattcatgtggtccagccatactaagtttcttttattagctaagtttagttatttggatttatcatcaaagagtctttttatgtgttctctgggcttggaatgttcctgccctctttctctcttcctccctcctttgtgtgtgggtgagttctttcatacaaatctgcttgactgaccaagataccaggaaaagcatacatttagactttcggcacaattagtactgagctgttagttcctgaaatttattgagccataaaatcagtactttcatttctaaacttttgtgttcattttgacttagaacttttattgtaacgcatcccaaacctttttggaaatatgcagaataaaagtaaaaattaacttttataacacaagtacgaaacatagcaatacgtgaaattggtattaagttttataagcttaaaggttgttagcttctgttttctaaaaaaaacaaatctcagtaaagaatagcaaaatcttgtttcgctgcagcagggagaaagtctttcattagagcacacatgtatgattttacataattgtgctcattaaaaacaagttaactaatgtcaagtgaattaatgaaaactactttgaaatgatgcttataacacatcactacttttttgaaatgaaagacacatattcttttactcggaaaatgaattttattatgaaagtcaagtgttttctagaaaaatcaggttttcctaacatgctatttgaaggttttgaaaatttaaaatatgtacatttttagtttgttttttaaaatccaatgttaaaattgtattttaagtgatatgtttacaaattcaacctaagggataaaaaatgtaaactgaaacttatattgatttctaaacacatgtaatccattaaattttttaagatgacgatgccaaattaatacaaaattaccttaaatgacctaaaaaatttaaatttagtatgtattttgcaggtgaaagacggctgtcatacagagcacttcagggagcattgatgatatatttttacaggtaaagcaaatccgaagagagactgaagttaaaattgaggggtggatatggataacatgtccagtataaagcctaaaaattacaatcatagtttaatgcagtaatttagtttttgtagaaaacttggaagataattagtaatgaagttttatgcccccgtccctttttttttcttttaaatagtaaaggcataactttttccctgaacagggttaaaaggggttaaacactacacaaattaatcaaatatcctttttttttttttttttttttgagacggagtctcgctctgtggcccaggcgggagtgcagtggtgcaatctcggctcactgcaagctccgcctcccgggttcacgccactctcctgcctcagcctcccgagtagctgggactacaggcgcccgccatcacgcccggctaatttttttgtatttttagtagagacggggtttcaccgtgttagccaggatggtctcgatctcctgacctcgtgatcggcccgcctcggcctcccaaagtgctgggattacaagcgtgagccaccgcgcccggcctcaaatatcctttttaactgaattctaaaaagcactatgtaacactaagtgtcctaaatggccagtttactctctcagagactcactcatgaaatgtgttctatcattaaacaatgctctaagattattcctgtttaagaaaataaaaaatgcatgaagtgaaaataacttgcaaactgtaccacttattcagcaatttcaagtaaaattagcttcattgtctaaaaagtttgaagtattcctgaaatattgactcactcctactctattgtatgaaggtcccatcctcagggttcatgaattaaatgtgtcagaacaataaacatcacactagtaaaaaaatacctatatttacaggctgtcatgcttctgtgtatttaatttttaaaatcttctcaagtctttcttcaaaatggcaacataaacaaaatcttttgacttttttcctaaactcaagtaaatgtatgccaattaggcatatgtgtcctaactagaaaatatgccgagaaaggtgaagaaatagatgtaaaaaaacaaaacaaaacaaaacaacaacaaaaaaaacaaaacaaaaaaacaaatagatgaaaagaaataaaaagtggtttttccttttgtgttttaatatctttgcctagaagtgtttgattattttcggctgggaaatctgtaatagtgcacctgtctcgcttttaataagaaccaatgttaggtgtgactctaggtgattacttcatgtatattacatggacttttctaggcttcaaacaaacactgcaagttgagtagtattatttcatctttgagatggagaaactgagactgagagaataagccaaagctgccacagctcctcacaggcaaagctgacatttgtttccagggccaactgattgtcaaactcatgctcctcctaacacactcgatttacttgaatatattcttctttttcttctttttttcctttagggaagagcctaggttccaggtgccttttcagttgctgacttctcttatggacatagattcactgatgaccaaatggagatgtaagtccttcccactcaccccatgttgcttccccacatgctgttcctgtgctctttatcttggtcttctgtgtgccctcctgcccactttctctctttccccctcctttgtgtgtgggtgcattcttttatacaaatcagcttggccatcactctctcccagggccaacttattcatatacacactaggcacagtacctaaggcccacaatacttttgggggctcacgaaaatgttttattttaaaatctaaaggaaaaattaaactttaggtcataaaagttttattacataagagtaatttatttgccattatgccaatgcagttttaaatttttaattttaatagtttttttatttttttaaatgaaggaccccataaaggcaaaggtggcatggactcatgagtcatattatgatcctggtctcttctattgtatccatgggctaaatgcagtgaaggatggagtgaaatgcatgtagcctgaagcaagtggagcgctaggcaacctcacagtctcatctggctctcatgtatgagccttccatatggccaagtgttagttgtcaacattttctcagaagcaattatcattaccaacccctcattgttagaacattgtggaactaatggtggaaaaatatccatggagtaaatttgtatgtttgcctagataaccatgtgtgcatggtgcacagaatgctgggcagcaaagctggcaccggtggttcctcaggctatcactacctgcgatcaactgtgaggtaggtggggaaattctcctttcttcctggtggcagtcaccaacaatttgtttctccacctatacatttgttatctaaaaaaagccattttatttgctcctgtctgaactactaacaacacgtttgtagttagaatattccagttcagacttttggtggtaattttataaaatctttaattatgaactttcactgttttgatcctgtatgaaaagggatatggtatcaatggctgcatgatatgtgaggacacaaagggattaacagtgcttacatccaggcagaaaagtcttcaactcattgtggctcaagttttgaccagactaaaacatttatcattaattctactaatgtcttcctggctagataaatgacacagttaaagtagcgtcttgttttctgatatgactattttatattataaaactatttccatctactccagagagtgccccttttaaagtgtttacaaggaaagagatcaacatttattgaggacttaaaatatgctagagaggtttctaagggatgtacattcttattttgatattcacaatatcatagataaatggacaaatggatacatcgggaaactgaaaaacttctgtggtcccttgaaaaagaagaatcaattcaagaataaattagacatttgcatttagccccacctcaaatctttacagcacattgctttcgtccctactgttattaccagattggttggtttctgaaatacacaggtttaaattttcatcatttttagacattttcactgtccctggaaatgaattctgtaagcacaaaacagttgataactgcctataccaaatgagcacacacatcagtgggtggtgggaataatgaacacaaatggcatctctagtgtgttgttatctcagttttaaaaagacctgaccaaaaggaaggactaaagttttcattttatagagttagaaactggggcattgaagtttaaacaacttgtcaaaggtccttgaattgtaggtgatagaaccagaatttgaacccagatttatttaacttcaaaggcaaatgttcttcctccataaaactgcaacagttaaaattgttgactaaccacacaaaagcaattttagtgttaaaactacttcatggacatttattatgagtctaagatggcatttcaatttattaaacccttcagggcagttatttggcatcttttcagttggaaatatttccaaatgagcatctaagactgtttgctttaaatgtattaccttgcatagcatccttcagaagtaggaaatgagaacacatctttatctttatgaaggtgtcagcaataagactctcggttttaataggaaacaccctgttctaaaacacataatactgttttatgggcataaactttgaaaatggaataaaaagcagacaatcaatactaatactacataatacctaatttaatatatgatatatacaacatgcaatatatattataatattgaatactaactatggaaaatatctgagaaataaattttctaattgaaaaatttaaatatttcatgtcaaccaatgtaacacatcttcatgtatgtttttccagtgataggtacaaggtatttgtagatttatttaatctttcaacatacctgattccccgacactggataccgaagatgaacccaaccattcacaaatttctatatacagcagaatactgtgatagctcctacttcagcagtgatgaatcagattaaaatcgtctgcaaaatctatgaagaatactggtttcacagcctattttttattttctatggattttcataaatacagtttgaatatatgtatgcatatattgttcagcaccacgatgctctgatttaattctagaaacaatttgattacctcttgtttgtgacaagactaagcattaagatgagaaagaatacatttaaatagtaacattgtacatagggtgttttcctattaaaaattcagtttcccctgagacttaatgtaaccacttaatgtaatcactatctcattgtttcatctttataaacttgtaaacttcatctatttcaaatattttatgcagtacattatattattctgtacaaaggctttcaaacaaaatttttaaaataataaagtattaatctttctccctgtattgtttttgaaatattgattgtatttgttaggaatcttaatgaccaaagacagaaatctatctgaagtttgtctagaggggatatactgaagaattactagcttgcagaattcaaatgaacactgtccaaaaagccttgaaagaggagcctgaaaactctgatgccacaaggactgggtccagttcctggagtgctatattcctggaacactcttctgagatcttttttgtctcatctcttctctgtaggtgttggctttattctttcctgcagtagaacagcttctgtctcaggctgggtcccagtttccagcaccatcagactcacacagggcaaagcttctctttcccccagctcccatgcctgtggtctgggaggtggagtgaactctaatgcatgcagaactgaggtaaaagcaaggaacagtcccctcaaagaagatgtgctttccagaagaaagtacacagactggacagtgacccagttcatttctaataagacattaactaagctaagagtttagatcagacatgagttttagtcttctttttctagcttggccaggttattgggaaaacttaaatttttgttatgggaggaagtacataatattatttaagaaatctaaaatgtatgtcaaccttgacctagagtgattatcactagcaagcagtgagttcttgatggaattgaactattctttggtttcatttgcaagttttttcttataaggtcttataaggattatatcatctagtttgtctcagaattacatataattgtttttgtctccatgactgttgtgtgctcatgtatgtgtgtatacacagtatctgatggtggctaggctgatataatacagaggcaaatggcatggtggctaaaaggcactagctttgaaatcaacaagctcgagggcaaattctggctctgccatttattaactatctggtactatcaccagttgaagcctagtttcctatccatctggggataaaagtacttattttataagctttgctatttcccaggaaaaacatgtgttaatagatattctgtcaccaaagtgccttagaatattggtgtaaatgttatttgtcaacgtttatcattattttaatagactgtattagtcaggattctccaaagggacaaaactaacaggatcgatgtatatatgaaggggagtttattaaagagtattgacttacaaaattacaaggtgaagtcccacaataggtctgcaagccaggaagccagtccaagtcccaacacctcaaaaggagggaagccaatattgtagccttcagtctgtggccgaaggccccagagcccatggcaaatcactgatataagtccaagagtccaaaagttgaagaacttggagtctgttattccagggcaggaagcctccagcatgggagaaagatggaggccagaagactcagcaggtctgttctctccatgcctcctttcacactggcagctgattagacagggcccacccaggctgagggtgggtctgcctctcccagtccactgactcaaatgttaatctcctttggaaacaccctcacaaacacatccaggaacaatactttgcatccttcaatccaatcaagttggcactcaatattaaccatcacaactttgtcaacttgaacccatccacatctcctgaaatcacacataatcttcaactgaagccaataataaggtcataattacacctaacacaatacagctatcctttgtacaactggaagtgcaccaatccccaatccaaatgctattacctaaagttaacacttaaatgctgatatgaagtcaacaaatcttacatcacatgataaaggaaaaataaaggaaataaaatgaatatattttcttagtacaagtatatatatgtgcaaacatgttctcaacaaaataaagaggaaatactcatgacaattacagtcctcatttctgcaactggtcacatggctga

SEQ ID NO: 15435 - DNA, 14785 bp, Human
caggtttggtgctggggcctgagaatctgtatttctaataagttcccaggtagtctggagaccacattttgagaaccactagaaaatagctgctaaaaaggaatcttggtatgtttaggtccaatacctgcaacattcttgattgaaacagtctcagagaaaattataaatgggtgatagagaagatgaattatcagaaggtgacataatattatggaatacactattcaataatgagcttgcctcattacccttagactttttttaaagtatgcttcttcaggaattatcttgtttcactcactataactccaattctagagaaagaaaaaaattcaagttaaaattcaagttatttttgttctcaataataatcacctccattgcctccctgcccttcagtgccctgggcaagcctttttagtcattgtttctttatctgtagaaagggacatgataatagtacctatctcagtgaattgctgtgaggataaaatgagaccctaaatggaaaatagttggcactgaaaatggcctgtaaatggtagctgctattttttttttttttttactaattcatctgctaatttaaggaaataaattgcagtggtcgtgggaccagtgacccaaactacttaaatctctaatacattaattgatcacagtaataaacccgaatttgttaaaaaacaaaacaaaaggttgttatgctccaggtactttgctaactgtggcggagaactgtttgatttggcagtggtggctcaagctatcagtatagcattcccccaaatacagattataaataaggaccacctgaagcgcaatatgggcccccccccacccccgctcccaccccggaacaaccaaaaccatatccaggggagatgcgtaggaatctttaatcaccccaggtgattttttttctgattaccaactttgagaaacactgaagggacctcttctccattctatatgtggctaatataaaccctaaacatcatttctatgtattcgttagaccgttgtttactagaaaatttcagaagtcctttccgacttagtaattttgttattttgagttgaactgaaattcacttggagcggtcagttgaaaatgttttttgtttgtgctctgaaaaggttcccagtgttccgggtaaagtcatcctttcacccatgggggacctgtgcctcgtgcctgaactgcccgcctagtacctccccccttgaacttcctctcgcaagcctcctcctcccgcttcatctgggcctcgggtctagcttgttttgtcccttcgcggcttttgagtagaacatttggtgctttcccagttcacgacgctttgctggaatcgtcaatttccagggatttcacaggctggccaaaacagtttgttcagaacagcgccgccggggcattggcagccctgggcggccgcgcgtttcctcactccgcacaaccacccgtgaccttgggcgagcgaacgcacgccgccagctgcgtcagggccacgctcgggctggacttcggagctcaaaatgggtgtggggagtgaggaggtttcataaacagaaaagacctcgaagccataaggcaattcttttccttttctgggggtgaatccttacgattcttgggggagggaatgtctgcccagggctggagacaaagcgtgagaactaggatggcgaaaaacgggtttgaatgagaaaatccgaaggagggaggctgagggcggacaattgggttaaaaatagaaacgcatcctccacaggactcgctcttcccagctccaccctaggggccgactgccaggccagtggctgggctccgcgagaaggcacagcaacccgtctcggccccgcctcctggacctactgacagggcaccgggggcgtggccttgggcccgcgacgtcaccgcgctccccgccgccgccgccgccgccggggttttcgctgacgcacgggtcccgccccctccccctcttttccctcacagcccgggcgccgggcggcgagtgcgttagtcggccgggacgcggagctgtgtgcatctcctacgcgggctcgctcgctcccgggagccgcgcagcttccccggcggtggcaggagcggcgaagagcgccatcagcgggcccttacggccccaggcctcgcggcgcgcggtccgctcgccctcctcgtccgcccaacctgcggcctgtggaggcgtgaggcgacgacaggcgagcgcctcgagcagcgttagccgctgcggccgccggtcctccctccacctcctcctcggccccccctcgcttccctcctcccacttcccgagctccggcgtgtcccggccacgctcgacgctgctgcaggaacaaaggaagaccccgcggcggcggcggcgccacctccgcctgctgctccgacccgctcccggcccgcggcggcggcaccagggcgcccggctcagccttcccggaggcctcggcccggcctcatcgtgccggcttcgcgcgcgaacccggctttcgcatttgggaccctgcagggtgagtgatacggggctgcgggtgggagccgggctccttgttgccgggccgggggcgggagtgaagggaccggggcgccgcgggccaatggcgaagccggagcaggccgcggatggcggcgtccgggggaggggagcccgcccgccagcccaggaagcacaaagacggaggcgtcatcctgtcgtcgtggcccgagacctggctcccggcgtccctggctcgctccacagcacggtcgggaaacaatgcacggcgtgccgcctctgcggggccggcctctaggccgctcgcctccgcggcggcgcccggcgtgggcaccacgacccagagaaacaaagaggccgaggcggcggccgcgccccctgcccgttgcagccccccctagctctcccctaagaggagccgttcggggtcgggggtcgggggtcggggatccgcgtggggcctgcaggcgaagggctggccgggcctgctgagctgctgttctgcatgactcagtggttttcggagagggccctgttgggctttattgagtgaggcctttgcttagagggggatggggtatcagtgggacccgaacttgttccaaaatccattggaacatggggccgggggttctcggcgtcgtcttttgggcttctcgacgtcgctgcgtttttatcctgagatccgttttcatggaggaaatggaacacctcctttgtttggtgcatttaggctgatgaatgtgaaattttttgctcgctttccacgcactccgtggaggtgtgttttcggggaagggtcggattatctttattgattgaatgtctcctaagggatagcatctaaggagataccaagataaaggaacatataggtcacacatccccgttcttaaacctgggatttagatacagacttctaaaaacataaacgaatgtattttattccttatttttaggattttttttaaagagtaggctttcagaactcagttggtgaaaatactgcaattttatctttgaagttttttgttaaaatgtttccccacacccccctaaaaaattaaggattctttgtagttgtctcctgttttctatctcccaggccctgaaaaggagcctttaaaagtcaattctactccatttggcaaagagggaactgaaatctggaaagtaaggacttgcccaaggtcactgacttagtggcagactagagacttgaactcaggtctccattcccaggtgagtgggaattcatgccatctcatcacatcatgtgcacctgaaagaactgtattccataggtgtaaaagctctttgttcagaattggaattggagaattgttcagttacactcgggtgtttttttaagctgtaagttagaggaagccataaactttataaaatctgcattctagctatacctgatagagctgacacgtgcatgctcaagttgctaattactttaaaggcaataaatagtaatggtatttttttctaaaatacaaggggaatgcaatacctaatgggaacacacatcccccacttcatcccctaaatcctcactaaatgaggattcttttttacactgtctccactgtgcttagttttttatcaacaaccttgaccattttagctttgactatgctttcatcttctagattgagattgttctgtagtttttcctacattaggaaaaaactagcagccctttttttgttttcttatgttagatatatgaacgctgcatccttagttcttggggttgtgtaggagttggcaggctttgagatataaatagaagctgatttcagaggcccctgttgactaggctttatgtgagagcctccatccagctcagcttgtcacattgcagccttgtgacaggctgaagcgccctcccatgtgatctgagcttctgagaaatattaaagcaagctgtgcacatgtgatggcatttaaaagctggctttctaggggaaaaaaatctaaaagatgggaacccatgtagaagactcatgtcctggtacctcttgtgtgtctcgcagttgaaagttatttataatgaaatgaaggtagacatgttctctgaagcaaagttggaatactttgttatctctgagtgtgtgaaatctttagatggagtatcctccattttatctaaaacaaatattttaagaatcagattaactaaaattacttaggtaggttgatcgcttggccttaaactttaaagccaatgtcacatgagactgggcctcagtgtagaaaatgtaagctagcatacttaaactggttttaaggagtgacccaactttcatgcatagggcaaacattcacacatattttgtgcgtggtgggcatgcaaatacatacatatttatcatttgaaagcattttttgctcctattatgctcatttaaaaacccagctgaaagtgtttattaataaacttcctaagtgatgttgaaatgtttacactaccctgctccaaaatgagtcagctaaattccagttaatatttaaagagacagtgtcaactaaattaatactgttgttaaaagtaagttgtggatcttggtcactccacacaagctagattgtcttaatatttgtatggtgcacttttacttacaaaagggaagataaaatgttttggggaataattaccaggggtctggccaggtcaaaattggttagtccccttctcccatcttctaattttggtagttaatacttgttaaaacatcgttttttaataactcactaaaaagtgtattctagtatgtagttggaaaaaatgactgaccacaagttacagcacacgaattttcctttaagcaaatgctctcaaatatgctttttgtacatatgcttatacatgtttaagatgacatgaaaaccctccacaactttattttaaaataatttttctttaatatgtattttctcatccagaggaaaacttattaataatttagcacagcgttttaacaagacttttagaaaagcaaatcttccttggaaacaaatgcttgctatgtaaagctttttctggtaacccagcattgaatattaaccattactaaaggttatgtgtatatattgactttaatacattgaatttgagcttggaacggttttattattttctggtatgaggaagacaagcacttgttaaaattaatagtgcctttggctgagaaatctggttcataatttgtgtattgcaggttcctaggcactggctttgacatactctgaaacttcaaatggagaatgtaaaaggagtttcgtaaaccagctgaccctaaattcttagagatttacttgttggtgccagggtagcaggaaggggctaccagttctcttttcagccttatatgaagatgtttcagcattaaaaagtacagatgctctgcctcagcagatttgtcaaattactgatgaagcccagatatgtacaggtgttttaagaaaactttattcatccagtttaaagaactacctataaatatcaagactcagtgataattgtgattagccaattaagtaaaaacatttgaaatggtctgcctgtagtgcagcagagtgaaaagttaaagataccagtttcccaaattgattaaaacataaccctgagagctaacagaccttttcataaattgaaaccaagaatagtgataggtaaaaataccctaataattgataaaatttctttttgggtttttttttggtcctaaaacagtttgcttttataaaggcaacaaaatattgataattatctctgcccaccctttttaatgattaacggaatttgggcttttgttaaaacttgcgtagcaattacaacggtataccgatgattatattagactatattttggtgataacactaatttctgaaatttcgtttcgtctatagcagaaaaatatggctcaggagactaaccagaccccggggcccatgctgtgtagcacaggatgtggcttttatggaaatcctaggacaaatggaatgtgttcagtttgctacaaagaacatcttcagaggcagcaaaatagtggcagaatgagcccaatgggtaagttatttccaaggaaaaacacatttgaaagaactggtggacagaaatacagaaccaagaattggggctgagaatgctgaaagcacatggagagaacacctgataagagcttgaaattcaagcaacagcccaagtgcttgacatgactgatcaggaatgaatgactatctacaagcatcttatagcttttcagttttcttttttggggttattttgtttcacacttgtgttcattggattgactttttaatattttttgtttggatactcaagtataggattacagcacagtgaatgcttatatcactaacctaattaaatgcaagtatttattactacgtcttgatactaagtgagtttttgtagtgttcattggttccttacaaatcctttttttaaatagggacagctagtggttccaacagtcctacctcagattctgcatctgtacagagagcagacactagcttaaacaactgtgaaggtgctgctggcagcacatctgaaaaatcaaggtaagattgaacgtttcagagtttttatgatattacaaagaagaaatcaagatgtctgtactggtccaataataagttaatagatacccttggctttgcaatcgaggatttcagtgtcttttaatacatgactcttaagtcattgagtaaagatgtgtgttacttacacctgactccctaaccccctcaaggatactgtgttggaaatgctgtgcttttttatttctttgtaattgaggtttagggattgtcgagtgagactgtagaatattattgggccagacaaggtgttttggcagagctgcccttttgcccttaaacaagttacaggcacagctaaaaatccctagctggttgtaaaatatggtaacctatacaaaatgcagcctcgagttcatgagccatttatcaaacttttttctcaaccatttgtgctgggcatccaatttttttttaaactttagattatctagctccatttgctcattttggaaatattctataatttaaagttgaactgacaacttattcattgtctcaagaagtacccttaacacctttaaaaattgtttgcttgaactcaaatagaaatgtgcctgtggctgccttgcctgtaactcagcaaatgacagaaatgagcatttcaagagaggacaaaataactaccccgaaaacagaggtgtcagagccaggtatgtttttcatttaatacttgttcagttctgaatttgatagtgcaagaaatggctggtggggggattctttccttcccattgaaggaccaaagaggagggagagccataaaatataggccaagcaaagaactactatctttaaaagtatcttgaagagtatgagtatcttgaagtgtaaaatagtcatatttattctcagtttcttctctgctcatcccctgcactacccttgtgcataatgggcaaagtctgtaatctggagattggatgtgttaaaaacttgatgaagttaaatttcaagggtataaggaataattttataaccaaaagcagtaactttagttttgatattgtcaatgttgtggaaaacttttaagtagaacaacatatttgaacactagaacttatttgaagtacaatattcctatcatatattttgtgggagtttgaaactcagtgtggaaaggcattttggttttcatgagatatggtgactttggaaactttgcttatatagcacaaccagaagtgccctgatggtggaagaagactgacttgaattacctgtactaggccctagaacaaaaagatttctgtgctttatatagtgcacgtagcttattttatcaatttgttcttttttggcagagtgctgattaaatgcaatataaaacttctgttgtgaaaaaatactgtcagtggttatacagtctgctttggaggctggcttttgctaacagcagtcaagtttgtttattgtattaatcttacaaagttaaggccaaattctcaagtttggcaggtgaatctatatttggcattttgaaatgagctccatccttaaactgaccacattagtttgcccgtgatgcctttgtttgggtttttgtttttggttttggtttttaaatacaaaattactctgaccttggaagaatagtcttgggttagagctagtctgcatttattattacttagtaggcattctgtgattcactgctatttgccttttctgtgtcattttcttattcccccttcttcccttgtctcaggagccgtagttcatttttcagatgtggccaaagaaatggctgacaccctccctctaccccatacaactattcccctagattattctttatcctcatgacatcaggataaacattaatgttgtcacagtagcagtaggtagaatattgttcgtttagtctaatattaggctatttctcccagtagattcattgctaatgcaattgaattataaatttgggcagagttttagagaaaattgccattaaatcaatcagcttgttgtaggagcttgtctatatgctaatagcattggtgctggcatatttgggcagtaatttcagcattgcatacataaatttgctattgttacatttggattaatattaaaacctgagtttatagtgtttcaggtgtagttgaattatatgtaagtagatataaattttgttatttttgtgttaaagaactagtggcagtgtgggctttagtacagtaatgtattttttgttcattgtgagaaattttattgatgccatgtgtacactgaaacttaaagcctttttaggtggagaaacggtgggactgtttgtagatgctatctctgtcgatagtggatgcccattttagataagattcttgttctgcctgtggaatccttaatagtttaaaatcaatacttctcgagtagtttctaaagactgtttgccgatctgtttttaaaaccaaggtttaaaaaaatctttcaagtcttcctatgatgtttagtgcacctgtgaaaatggtaaaatgattgttttggaatttttggatctgacgttgatttagggatgaatggtttgagttttatttgtcaaaatttgctgtttttatatctacaggattttttttcctataagcataaaatcaaagttggctactgttatttactgtgatgtaatgaatttgaactgccctgattgaaaagtttgcatttaggaaattataacgtggaaaaactgagcatatgattaacatctcccagctctttaaaacagaattaggattttgtttttagtactggctgttaccagtgttttaaaggaatttcttgagtgaagcgatcattttacaaaattagagaagcaagtagtatggtgattggcaggaatttctcagatttgaatcaagttctgatgttaaaatggaagattctgtttaaagcttgtattttcaaggaatacttataaacatttttatcaggcatcttcctgtttctcttaaatacttccttttttgacttaaaaatgttagccagtgaatgcttgacaaatttgtgtttttgtccttttcagttgtcactcagcccagtccatcagtttctcagcccagtacttctcagagtgaagaaaaagctcctgaattgcccaaaccaaagaaaaacagatgtttcatgtgcagaaagaaagttggtcttacaggtattacaaaacacaagacaatgtatgttttacttctgcagttaacaaggagcttttggtcactccctaagagactagttggtcttacacataaaaaaaaaaaaaagcctgactagctgtagtctaggaaaggtggaggaggtggtattggggtggaaagaagttgggttttacttccatttgtctcctaatcatataaaactattaactcaggccctcttattttattagattgataaaaagtttttgtatacctagggaaaatgttactgaactaacagtaagcgccacctactttgagctatgcagggaatgttcttggtgctttttttcttgtctccttcaaatctcagaccttgatggttgttttcacttgaggaagcattacttaagatatggtaggactgtgttttgaatccagcttagcctaactccagagcctgtgtaaattttatcctgcgttgcatctacaggagtcgatagagggagagcatctggtagaaattagctggcagatagcccattttgttttctccacgtggtttggcttaccaaacacttcgctattgcccttgcaaggaaagactgaacatagttatttgaatttctcaccatgtcaaaggaagttaaaagttccttttccaggttaacgtgatagactctgtaagagttgactgtgtcttatcaccaggaagtggaagaaaagagttcactgtcttttatgttacaaagcaatgaaaatctggttccttttctatagtgactaaggcttttttttcttttaattgcctcaagttctcaaatgactctacttcttcgtttgtacagggtttgactgccgatgtggaaatttgttttgtggacttcaccgttactctgacaagcacaactgtccgtatgattacaaagcagaagctgcagcaaaaatcagaaaagagaatccagttgttgtggctgaaaaaattcagagaatataaattacttcttgtgaagagactgaaactttgtttttattttaatatatcgtaggaaaacattaaagagcagatgcatggccatttttctttgatgttctccagagttttacattacacttgtctgtcttataattgatattttaggatgtttgggtgtttgttacaggcagaattggatagatacagccctacaaatgtatatgccctcccctgaaaaaaattggatgaaaatctgcacagcaaagtgaaacacacagataataggaacaaaatgtagttcccatgtgccaaacaaaataaatgaaatctctgcatgtttgcagcatatctgccttttgggaatgtaatcaaggtataatctttggctagtgttatgtgcctgtatttttttaaaatggtacaccagaaaaggactggcagtctacttctaccatagttaaacttcaccctctttaatttcacaacatattctttggaagcaggaagaaatgctcataaagaggatcagaccttctttcccgtgaaaccagtatttggcgccatatataagcctggttaaattggtcatctaaagctgtcaaataagacattctgtgaaaggtaaacatcgaaactggttataagtaaaaccatcaagccaacaacagggtcttgagataacctttgaagcttattgtactggcctgcaccagaagatgtctgcattactcattgctaaaaatgtgtagcacagaactgcactaggattaatttgtttacaagaagaaatttaaactctacgtttggttttcacatacagcagctctattgaataacatgcatctgaattttaagttgcaaaggtatctgaataatttttcatgtgcatcttttgtcgaatgttttggttcaagaaagaatgtttaaagctttttaaaagacttcagttcttaatgtaactgtacccttctgcatggaaaatcataaccaacatggctgcagtagacttcttagtggtatccagcaccacttgcagagggctgctttatcatattgtacttgggtgtaggactctagtgttcttgggtgtattgcatgggctgcattatctacagcattgtacaataacaactagaaaaggcagtatacttcactgatgcttgtctggtaataatcacttctgtgttataatggaaggttttttgtgatgtatgaaacttgtgttttttatatataaatgagtatagttagtgttgtggtaatgcctgttttcatctgtaaatagttaagtatgtacacgaggcactacttctgatttattgcaatgttcagtcctagtttttacttttattcttaaagcattcagttttgctttcaattttatgtaccttagttctgagttagacctgcagatgtgtacagatagttcatatttatgtattgcacataatcatgctattcagcattgatgctatattgtattatgtaaataataaaagccatgtacagagggaaacttcacttgttcattgggtttttaagccatagttggagtcctaaagggggaaaattagaaaatgttactttacatggctatataattttttttcctttgccatcgctgaacttgttcaagtgataatcaagagatattagaagcatttgcaggtatgatacctgataggcagtttatttttgaagaattcaataggcacctttgggattaaaacaattttaaaatttgagaaagatgaaatttgaacaattatggcctacctcgcttctccatgttgtaaaagatgatgttttatgacaattctgaagaagaaagtaggtatgacttagtttacaaaaagagttctgttttatttctgttttgggtttggctctaatacagagattcacccatggacttggtctctgtagcgtttatgccagatcataaagaacaaggggtgacaggtacatgttgactttacctggggtaaatgattaccagagtgcaactgttgcttctctgtgatggagtttggggtggaaataccctagttttatctgtcagttctttgcatgctgctacttttgcttcaagttagggaggtacatatgtatgtcaaagttcctatactgacatagggtagtatttctctgaatatgaaaagtcacaattgagttgaaaatttagaagttgaagatttagaagggcaacttaatttttcaagttaaaaatgaagtaagagtggtatagagaaggtaagatgagccctcggactccatcactctgaaggtctgagtagtagcaagagatagatagttttttgtttggccaggctgcagtgcaatggcgtaatcttggctcactgcaacctctgcctcctgggttcaagtgattctcctgcctctgcctcctaagtagctgggatcacaggcaccagccaccacgcccagctaatttttgtatttttaatagagacagtttctccatgttggtcaggctggtcttgaactcctgacctcaggtgagctgcccgcctcggcctcccaaagtgctgggattacaggcgtgaggcaccgcacccggccaatcagttttttttgttttttttttgtttgtttgttttacaagaaacattaaaccagatcagaacaaagatttgtcagggttgtccattgactggggagaaagggaatcagtgtgtaaggcacctgagaggactcagttctacccaaattcttgcattcaaacctgaatgcaaggccatgaagtcctttgaaatgtacagatattaagcaatttaataatataccatgtttcccttacataagcagacaaatatttacacccccatgacctgaagttttgttaggctgtgaccacatgaattcgcagtataaatgggtgagtcctttttgaaaacctcatcttcagtgtgcctgatctgtaaaactagagcctcaggtttgatcctaggtaggcttcccacaacgtggggaaaattagtttgtgagggaaagctgtttctgagcattatggcatagtgattaagatgagggaccctggaaccagcccgtgattttgggcaagttattttaggtccactttggactgcttcatctcttaaatgaagacagcaaccaccttcaggagtgtgaaggtgacaacacttaaaactgtgcctggcacattgtatttgctattgtcttaatgttctggaataatggtttccataacttgggaagaaaactttgagaacaggattggttacatcaagttgtatagtgaaaagataaagatctgttatttaaacttgcagtttaaagtcattagaatcattcttttccgtaaggctttctttgcaagagatctgcattaaataaagttgctaggaaataactaaaattggggaaataatctaataatagcaagatgttaagcatactattattgtattttgggggttggtaataacattcacatggatttatcaatacacactgagaagcaaagcctctcaag

SEQ ID NO: 15436 - DNA, 199945 bp, Human
gatgcttggcctaatcctctgcccttcatgggtgcgggcaggaacggagtagcggctgatttcccctccctaatcccaaagccccacaaaagccaaaatacacacgcaaactctcaccagcgcatctcacaaacacaaaaactaaagccaacacatgaaaatataacccgatcccccaccaaaacgtacagctcaaaaaaataaaattcaaatcgaaggaaacaaaacacacacaacacgaaattccctaaggcaacacacacacagacgacacccactcacaccaaatcaaaacacatctaaacaccgcggagaaggaaaagccttacaaacgacacacaaaaagacagcctacaaggacaaagtacaaaattacacaaaatcaaaactcaccccaaagaccaggacttacagagcaaaacccgctaaaatcaatcccacgaaaaaacaacacgcaaaacacccgaaacaaaagaatatcccatggaaaaatgaaaactcacagaaaacaaacaaaaacaaaacaagccctctaaatggaaacaacaacaacaacaaaacaccaacaccccccgcccccagcccggggtgaaatgtcaattccgggagggcttttgatctccaggcgcggacaggccgctcctcccaggcgctgcctcccggcgcgggcgaggcgggagggcgggaagcctgggctggggctgggctgcggagggaaagagtcgagcactcggagatggccaaaaatcaaatctcggggtagggacacgggcccgcaggctgcagggaggaggcggcgctggggaactgcgcagaccacttggtgggggggccgcccgggaatccacagccacatttccgattgtggcgaaatctgctcagtggatatgtgatgtccagttgccgccgggggcccccctttcctcgagctctaggctcttccccctaggttgcgacccagcctcgtgaccaccccctccaaaaaacaaacaacactcttgctgaggacgattcactctccaaaactgccattgtccggcgggccaggagtcctcctacggagcgctcccccgccctggagaacctttcccctgcgaccaccccgctgcagggccccacaggctttcagtggctaggcccagcagctgaactaactcaaggctggggaggggaacagggaggggaggcttgagtctggcccgaagagagagggctggacatgccacacctctgctcggtctctgtggatctgatttcctctctggaatcaagtcctggggctctgggactccacaacgtctcagggctcgagggcaatgcgattccacttatgggccggggtaaggtgtctggaactcccgccaatctccagaaactactgagatgttctgctctgcccgggtgctccaaagcggaagcccggatttcatctccagtatttcacagcttaacctccatgctctgggccagaatggaacttgatgtggggaggggttctgggactagaagactggatgggacctgggggctttagggatctggcgctgccctagggtcaggggcccagcaatagtcaggaccccaacaaattggggtgggggttggatggctgggaaccctggggtcgggcgccgccctaggggtgaatcggagtaaaccggaacgtcgcctcggtgcctggcaacactgccagcctttgcaacccctttcaaaagcacctgcttggccgagcagttaatttcttcaaaaacaaaaacccggcctgcgctcgtctaagcagcggggtttgcacatggagatgtcacaggccccgcgcacagcgcagagggccgcgacccccaagcgcatgtcttaatagagggtgcggctggaagacccgggctcccgggctccgcttcggtctgccccttcccgtaggtgcgctggctagcgcccggcgcaggctgaagccttccttccctccccccaacccctataaaagtctggggcggcgcggcagcagcactgctgctctcccggcttcccgctctactccggccgggccgggtccgccacgtctggcgcgctgagcaggcccggccgcgcagcgcctaccctttcctcgctccgggccggcagtgtggggcggcgcgctgggggcgcggcgtgtctggggacatcttgtgatgttggcgagaacaggacatgatctcacatggcgagaagctctttagttccttaatcatttcacggtgccttcggacgctttttttccacctaaaacgtttagtttcagctcagtgatcagctaccccagctcggcgggggagcggaaggcttgaattattccgacctgtgagcggcccctggcaccaaaaaaaaaaaaaaaaaaaaaaaaaaaagaaaaaaaaaggcacaaaaaagtggaaacttttccctgtccattccatcaagtcctgaaaaatcaaaatggatttagagaaaaattatccgactcctcggaccagcaggacaggtaggaccgcgatacgggctccagatgtgcaaactccgggacacggccaggccttggtccccacgcagggtgaccctggaggaggagggggcgcgccgcattttcgtagagactgtctaactgcggcgtgtttgttatgttttttcacctatctgttcacacacttctgcatcagtccaaatatctgtgagtttgtctgtgtttttctctgtttctgaatgttcacgctggcgtccttccgggggtctgcaagttagggcctgtgtgtttatataagggactcagtgtgttcattacagtatatgtatttttaaaagatgtaaaaatatatgagtttgtgtccaaaagttgtttgcctgtgtgtgtgtgtgtgtgtgtgtgtgtgtatctttatactcgtggggtattcgtgtgtgtttataagttagtacttgtgtatattcttttgggtatccaaaatgtgtgtctactatgagtgttatttatgtaattcggaaatatctgagtgtacatccactatttaaagggtctgcattcacctgttatatcccaggtgatttttggatgtgagaaagaagtggctacactgacctttccatttttggatgtcaacggctgtccaatgcatacacgccaatgttcacattgtgtctctaggcaaactcctagacgtgggtctggggcctatggagatccgtggtgtttagcatgtgcattgtaaggcccagtgtccattctattgggagataggaccaggaatgaaggtgtgaattcagggcatgcagcctcttggtgtgcagtgagcactgttcaggctaccatttgtacaaacaggtctcctgtggcaggcacaaccttgcagatgacagcggacacctgtagggttagttgtgacatttctagggacccccagcctacattcactttcacctagacaagcctctgacactggggtgtgtatttgtgtgtacacacagacacacacacactgtgtcctcaggttttatcctgtgggtgccgcaccagtggaggagagcacagtgggtggatgcatgtgcatagtctgggcattcagctctagggcctgtatgcgcacaggcctccctggcttaggtccccatgtgcctcccacaggcctgagaagtaggtagcaggatgtgtttatgtctgagaggagatagcagggacagtaggcctccatctgccctgaggcatgaatcaggtatggggggcctctttcactcactaggccactgtgtaactcccacacaaacactctcttggccctggcaagaagcccccttcccccatctctgtgccctctgagaacccccatctctcctccagcctcaaatacaagcctaagagcaaaaaggataaacttagaccccaagcccaggacaacttctggggcataactgtgtttccaaaattgtggctggagagaagtgagggcagagatctgaggcagaagagtgctcccaggatgagggctcaggaaaagttacctggaaactcctcttctccatcctcaattctcagaaggcccttctccctggcagtgggcttctcagcagatggactttcagagagacctgagcctggaagtgggtgttgtgtatgtgtggggaatgaggcggggatgtgtgagtgtcatggagagggtctgcgcagtcctcgggctggctctcccgacaagctgtgtagaagaatgtaattcatggcggtcgatgggctctttgattagttcaattgcctgaataatcatttaatcaataaagcattttattcctctgcatagctggactgggtggggcttggggtggggtgagatacgggagccctaggctggccaagccttaaaatctagagagccacgccccctcctcactgatgggttggggaagagctgcctgcctggaaaagggcgacagttcaagtgagactgcacttccatctgtccactccagcctgggtcagggctggagaagagagggaagctgagaagctgtccaagctggtgctcaaagggttgtccaggtctggttcctatgagagcttcttccttctcccaacttctgggtatttcatgggccaatagacttcttttttcttccttcagaaccatattccatttcttaccccaacctcagtttccctatctgcccaatggggagggagtgtgtccttctggctctaagcccaaaataaggtcaggtcaacactaagcagggagccacttaaggaccttctcctctaatgtcttccttgctgtagggaaaggaaactcagaggttcggagaggggaagggacttgttcgagatcataaagcatgagtaagggagggaataggaatggaaggtgacctctctgcccttagacctcctgttcctgctgggagaagagacagattcccccctctctccatggacccccttggagaaaaactactacttggacaagtagtagtctctccttgccatgggaacccttgagtccttagatccgggcagacctggatggattgagtactttcccactgggcattgacatccagtctcacagttctggaatgagcctggaatggagtgatagatattaataacccccatccatgaagcttcatctcacagagcctaagaagtcacatctcaggatttgttctctgtattaaacaaacggggaagcagaggctttagaaggggctgcctgtctcaagtctttgggagagagagtagtcccagcgcccctggcctgcaggacatgctggtaatgataacacaccccgactaaggtgattttacatgattcttgaaaaacctggttaaattctcattttttctccatcctcttcaagaactcctgaaaacagggacaggtcaagtagagcagactcctgatccaggggcaggaatcatgcaggaatctgctgtgcctccacttgctgtataatttcaggtcaatttctttccctctgatacttaattttttttattttttaaaaatgaagtttagacagaactcagtgggttgagacagccatgctggcagcatccctgatctttccagaactgagcaaccagtctgagccctattgggcctcactttgtcagaagcaagaacagggaaatgggctggacttgggttgagagagtcgatgtcaggctactagaacactgtagcagcccccacatcctgaagccacggtaatgcagtgcgctgggaggcgtggaaagggaagccgggagggggtgtgtccccagtgaaacgaggtctctggcttctcacacattattctcaatgggctgtctttcagtactaaaactttcaaaggcaattcggttcacataaattgagtttcttcctggatagtttcctttcgcggtctcctgcccccagcgcctagcacagggcccggcccaaagccctgttactgggagaaagaaagcgcatcactgtagatcagagtgaggcccgactgcgttgagagccgcggtgagagctgctagtctcgctctcctggacccaggctgcggctcgtgggcgttcagagacaggactgaggcgcagtagcccggctccaccatggacttgctgtgcagcctcgagctagtcacgtaacctctctgggctgtcgtttggtgacctgtaaggctgggctaggtggtcacggtatgaggtccggtcgcgccttttggggttggaacttcccagaggccgcccgctcgggcggtgatgaatcacccctatccagagggaaactccttcccccaagaacgccgagagttgcgggaaggggctgctctgggtgcacaggtaagacgggtcctgtgtgtgccacgcagcagaacactgtcccgaagccgaacacctactgtgtgaaagggagaatcggcgctactcctgctcgggccgtgccccggggattctatgcaagcctcacgggtatccgaaggaaaacctgcgtgtgcgggcatattccagccgagttcttcgatttggcagcatcgcccctcccccaccatcccgagagcggctctggagaggcgcttttgagaaaggtttccagcccgcagcctttcttctaccccagacttgctgtgtgactttggacaagtcgtatcctgcctctgggcctcgggttctgcacccgtgaaatggagaaagcatagcttcgaggcccttttagctctaagaatctagagaacctgggtttgtaggcctgagctcagcaagagaggctgggggtgggggtgtcactggctgcatccctcagggcgtcccgcactcccgcctctccagtaggtgtgcaagccgccatgttgagtctgggccgaggatctgaattctggttatttccgacccactgggcgccatcgggtgaagccagtgcaggaagtctattccatcccagtccctctctgctgttgcgatcttcctgctccaaggccgggggtgaaaggggaagatccggacaggcggggttccagacaaagaagagataacgccgccactccaccccggcgcgcactgcagcctcctgggtccccagaggcccgcctggggccgttttccgcagctgtgccctggtggggggtggggacgggtgtcagcgccggaaacttgtctactggtcagggacagctgggtgtggaacagggacagaaggtgggcccaagagtcgaccccagtgtaggagtttgagaagtagagcatgcgtagagagaaggcagaggaagggaaaccgaggcagagaataaaacaagaggataacccaggaatcctctcatgatcagcctgtactcttccttacaagcccagtcctggagcaggcatctcaaagcccttgttttgtggatttatgtttaatattagcggatcatcactcatgaaatagaaattgagtcttcggaccactcccatgagttgctggggcaagggaatcctcagcgtcgttcttgagccagggcccagatggctcacagaactatagcttcttgggtgaagaatgactgtcacacgcttccttttcaaggtccagtttctttgattgttgtctcagagccttaaaacccacaaagaagcggactcgctagtcaaagatcccttgtgtagcaagagagttctgctacaaatccatccattttgtctacatagggacaggaacttcccctgtagagggaaggtcagtttcccatcaactggaagctgccgcattgcagcgcgcctggccgctttgcttgacccttgcagatagaatgcgcctgtccacccgcccgcttcagggacccttattagccctggacgcgacttggctcattcggttctcaagaagccttgagccgggtgcggaatttctccggtggacagaagcgcaacaccagctcccaaagcctctggcagttcctgatctgaggcaggaaagagggccagccactctgcttgggcaacctggcccaaagccttagcccctccacccaggtgcgccctggtgcgccccagttactaactttaaaggagtgtgagatattctcccccttcccccaacgtctctgcctttcgttaatgcagcaatgagggccctgcaggtggagtgagggaggagggtggacgacgaggagccagtggtggtttagtaggtacttgataaaattaggaaataaaattaggaaatatttccgtggaaggagccttcagtaaaatctagttaaccccactctgcccattttacagaagaggaaagtgaggtcagaactggcagatatgcacacactccgatgcacacaatccgatcccatcacgagcctgatggtacaggatccctactgcgctccttgtcttcctccaacatacattttttgttttttggtttttttggagacttcccccattctcacccttcaatcgactgctctcaagccttgagagcgtcccaggatcccagcatcgctgtggggaggtccagcccgcgtgggacccgcagcgggactctccaggcactgcgtgggcccctttcccctccccacagccgcgatccactaggccttagtccagcgcgtttgtcaatgaacgtggcgccgccgcctgggccccgccccccattctctcccattgcccaggtgtccgctaatcaggcggagcctgtgggctgcttagccaatggggcggtgtttcgggccagggccggctgacgccactctgattggcttggtggagcgtgattggcaggttagcccccgccccgcccccgcccggagggagctgagccccgggcggcgctgtccacacgcagcgggtcctgaaagcggctccggggcggcgcggtggcgcactgtgcgcgccgagcaggcggagggctagcgacggcggcggcggcggcaacgcaggcagtcagagccgactgcggctccatctcagccccggcagccccggcggccttggtggctgggaccctctgctctctcctctgttcctcactccacgcctggggcaggcacggcggccgtcccggaagaggcagcggaaagacagtggaatcagacccacgagggagggcggcggggctcgaagagttggttggcacgaggtagacaccccggcgaggaagagtccgtcgctggtgtccccgttcctggtcccagcgatgggcgagcagcgggggccgcgggaactttgaaggcagcgggtctcagtgttggagggctgcacgctcccggggactccggagtcgcggccccagcgtcaggggcggaagcatctccaaacccgccaggaccccgcgctgccggagaggaagttctttgcaacttcgtccgagacgtcggagagccagttggagagaggcggagggggcaagtccgagccccagagactcggagaagcagagaaagaaaggatctggcggagaccgaggggtcgaggagggacctcagaagcatcgaggccgcggaaccagcctggcagcccccgggtctctccgccccctgagtgaagtcaagggccgattgttccggcggcctcctcaaagctgctccttcctggggccgggggctgctggctgtcccggaggcgggcccctacgctatgcccccgaagccgcgggcgccttggccgcagctaccccgggctgggcccggagctgctgcttgagccagccagggagggaagccagccggagttgggcacccgctcctagcccgggtgcgctagcaccatttcccgcctctccgcgcagctccgggcggtctccagcagggaggctctgagagagaccccgaagctccagcagtgttttctgagcccagctcgcacagtgcctggcctggtggcgaggctccctatccgccctgggcagccccttggcgccgggaggcggcggcgtgggccggcctgcagtctggagcgccccgatggaaatacactgtaagcacgacccgtttgcatccatgcatagtaagtaggcggcgagctcgcttctctcactctcccgccgggaccgggttgggggtgccggaccgtgggtcaggtattaaggccggaaggatctcggacctctgcagccgcgcagctaactttgcaaagtgcagggatcccaggcaggggacctgaaacaacgcacttggccgcccgggctgaggcacctgggaatcccgcctccggcaacgcgtagcttgggcagcgagctgcagcctttcaaggctccggcggcgacatttcagctctttcggagaaccctggcttggacccgtagagggctccgggccaggccagttggagggcagtaagttgtagggagaggccagtcagagtctcagacagcgccccacacccctactccgatggcgcctttttcagccatggggctgatccagactggcgcttggagggatagtggggccctgacccgtgtctgtatgtgtggaggaagaggttgagagctaagcgaggacaccggggctagggctccaaaggcgtcctggagttgaggagggggctttgaaaaatcaaggaagtagcggtttctgagttcagcttctgcttaggagccggccagttcatacagagacccttaaagaccccattgggtccttctctgcaggacgccttttctcatggcttctcccctttaaaaaaagaggataagaaacgaaaaagaaagaaagaaagaggaagccaattagttaccacgcaggcacccccgcctctgaaagacgcagcgtgtgtaggagacgggaagggtcatttagggcgagggcaaggccggcctggctgcctggcccgcagggatcctgccaattcacccattaccacagcctcctgtgagatgagcgctcctctcacggtgagttaacgccggattagattcggagatttcaaggaaattccaagtggaacgaatcgcgtttcctttctgtttgctgcagagccaggctggaggaaggtgacaggcttcggcagcctcggctcgggtgccgctcggggtctctgcgggcttcaggtcagggagttgctcccgggctaggagccgtccccatgcctggtcctcccaccccgctcccccccatcccaacagcctgggatccagctttcctagccgcaggtcccctatttaacaaaggcagcagagacccggctggagtgaaggtgagcttcccggggcgagcatgtccgtgtctgccacgcagtgctgagtggcctggcaagcaggggaaagcttgtgtaggcagccagggctggctgcgggcaggtcagtttctctttgtgtcaattttctgagtctgaagtaatccaccaaagcggtggggagctctgtgcagaggagccccctgttctggtcccagcccaaacgattcctcaaggtttggggcctgcgcccaaccggtttccagtctgtggtgaccccagtgccctccacagccttttctgcctcggactccagcctggctctggggaggacctgatcttgcaatgtaagcccaaaacaaaccagttagggcaatgctctgagaggtgagcaagcccttggctcagccaaggagcaactgtggggacagatggggagcaccagcccctgcacttctctcctcactggtggaaatccacaggccctcactgtgtccttccgcccagcgctcggtggcccagaggttgtgccctagcccttggggagatagcatcagacctggtggtctctcggctgagcatcagtgtggagaaggcggcttctttcaggtgcaggttagccaaccgctaatgtctgtgcctccttgtccggccttcaatcgccccctccgtgggaagtgctccctcccattttcaatctccctggcagcacagtgggggctgggccccagccagtctagcttccagagcaggtgcaagaccttggcttctctggaagcactctcggttctgaggcccaaagctgttttcttgcacaatgtaggcctgctctggggccccaacttgctagcaatggggagtggggggtacagtagatcctggaaggtggctgaggtagtagaggctcagatcaagtcccacttcgtcaccttcctcctggcccagtcagtttcttcttcctgttaccgctccctgcctccgtccccctaccactgcttccccccaccactgcttcagagccggatagcttctttggagaggagcagggacttccaggaaatgggcttctgagtttggaggagtccccacccactattccaggctcatcattttcatcagcacgataacctcctgctctcttcctgagcggttcccctaggtatctttaccagttataaaacactcatagccagggtcctacctgacggtggcctaaaccttcagcttcacccattttgcagaatatgatattgaggtcagagagacaaaaggactgactcaagaagttcacattggcacagctggagctggttcttgggtctccctgaccatctgacaaaggcattaaaatgaagcttcagagggttcacagaaggggagagggagggactcagattccagagagagggcagtgggtatacacatatgcaaagctctctctctgtctagtctaaccatgtatatgtctactgcctgactctccacatgtatcaataccattagggagacttcttccctgccctttccctgtgcccctgtttgcctgtctgtgtaccccttcattctttctggtgcatctaggaaaaattttaatgatcttgtgggggtcctggagctcaatctgtggctgagtcagcaaagaccctttccccaaaatcctatgctcagccatggtctttgggggtattgggagggcctgtggtgggtagcatgaccttatcagggcctgaggagcatctgtggaggccagccctttccataccagagtcacaaaggcctcaggggcctctgcaattcagtctttctctcctcactcccctccaaacactgcccagtctgccctgtcctgtggtctgtctttttcttgtatctgtgggtctgtttcctggtcttcacctgatttgtttgcctctgtctctgtgtcagtccccctttcacgggatgagtcctcacctaactggagtccataggaagtacaggctgggacttgggttctccaagaagatgcagggccagagctggcaccccagaaaacaaaggtcctctgtctagagaagtcccctgtcctccagaagccccttcctgggcttcctccattttctcttcttattgcctcccgttgtgtgccaccttcgtctttcttttcttggcctattctagcttctccattccttttccctctcctctgcctgcctaacctgctgcttcctttccaggctctctctctcctggttgtctgtctcattcagttcccactctttacacttctcttaacacacctcttttttcctcttttctttccctgtcctgcctcgcctcattcagactttggacttcacttcttaccaattccagagtaagtgaccttcctcacaccatagttgtaaaccttctcaccaccaccctctaagagctctattgggtaggattgtgatggtggagaaggccaaggggtcttggggacctttcaaggaagttgaggaaggtaacaggctcccaggtcaccccaagtctgttgtcagctgtggacctatagatgagattgtgaaagagcattactatctcagcctatgtggtcaagggtagagggtttggggacctgctctcaccttgagagacctggctctaggagacctttagggttttcccatgatacaaaacagcccccagtgctcataaatgtcctgcaggactgcttttggaatttaagtcctctgaaggttgccactgtgttttgggcagaaagtctcaattgtcagtgacatagagaacaggctattgcagatggaccataatacctggactcccaggtcatatcaaaagtgtgctgggtgtttaagcttcctttgcctgccctttgttttcccagatgagcttataccaattttgaatttattttcttttacttaaatccagcctgctcttgaaagatctgtacaacctttttaaataggtgttcccagccccagaacaaagccttctgaaggctcttggccagggtggctgcagtctttctgttttagaaaaactatgcaattatgtttctaactgcaaaatcctatttggaatggttttcctttttcttatgtcttttagaacaatcaaaactgaataaagatcattttgaaaatcagaaatccagcttagaactgcaactaagtacttcagttatctataaaattgtgtttttccttgaaataagcctgagcctggacgtttttgggaaatattcatgggaaacttgagtggattgcttggacagtttttaggaaatacattatattatgggggtttttgctccctttatttcagatgaggttcatgaacctgggttgtagtttagtactggggagaaatagctgagatgaggtggctatttcatattttagagttgagtatatatgtgtgtgagacctttgaggtctttcccttgtacggtccagtcctagtccagtcttggttcaggaggagtttccccttcctttgcctctgagctgccagcaacatcaataaatgctttgacttggctttgggctccagtcttcagcaacgtcagtgagtgactaattaacagctataaggtcaatgatgttgctgcatcggatcactctgtgtttactggtttggctcttcatttacttgagtccttgtgtccttccagatggaccttgatgtaagagaagggtggaggaggcactttctcgggctccttttacttaaaatctatcccaggacccttgtaaaacctgggatccagaggcttttgtaggtttctttattttccctggaccaaaataaagctatatgtcaattgcaaaacattgtaaaaattccagggaaactcctttataacaaatccccgtgcagtggagtggaatgtgctgtgtgtagaagatgctatgacccatttcttttgtgtgctttgagaaggtacagtggtcaagtctgcatgtcaacctcaccttcttaaagggagggttttaaacaaggcaatggttgtttttttttctcagtactctgcaggtgctgttaaatttttaaaaaattccttagcccttgaattagattgctgattaaaaacaaaattccctgagatataagtttattggagttgttcttttcacttttaaagacatttgttaaaaggaaacgagttttatttttttcctctttaaatatgatgtattttaatgcatattttctccccaggatcttccttagacctcagcatcacataataagttgtgcccatttcgtttacattgagatcttcacacatttcattgtttagaaaaattacggggaaaatgctaataatagtatggggatgtttgctgtcaatagctcaacagactggctgcagatggaccaaggctaagattaattttaaaaagcaatctggggacttcgtgtagtttgcacgattggactccaggcgcgagacatccagcctgccggccatttgtgatcagaggggctctgggtcctcacagcggtgcttctcctatgtgactggttctaactaccctttccctttccttttgtttctgatctgtttcaggacatggaggagtgaatcagcttgggggggtttttgtgaatggacggccactcccggatgtagtccgccagaggatagtggaacttgctcatcaaggtgtcaggccctgcgacatctccaggcagcttcgggtcagccatggttgtgtcagcaaaattcttggcaggtaaaggcagtagctcgaggcttcccttgatctttcaaataaagacctaaaacatgacccagcagctgtccaatatgacagtatcatagtgagaatcatggtggcattttgtttcacacgcagagcactttaaagtctgcaaagccccaattccaagtagcccttggaaacccctgtctctagtgacatgtggaatagggtgacttagtcaggagggaagacatgttttctgaaagcctggtgaattgttctaaagaactcaagagtaagacgttcttgggaatttcccttatatatcctaggtgagcctgggtccccgcgtaggacttaatatcacataaccagagttcaatgtttcattttaatgtttttggaagcatattccacttttaaaagtcagctgttattttcagttttgggttattatcaaccttgttatgttgggctgcagtattttccttctctatgtttttatttccatcgcagtgacaagcatccaaagtatatattaaattagagaagaggaaaaaaaaaaaacccaaacaccaactttcaaatatgacatttgaaagttgccacttgacctggcgatttgctgcaaacaaaatactaacaatgaggcttctcccataggaccgtgcagccttttagcactcccgtttattttctcagtagcctccgcatgatccaatgaagcacgttttaagatgagaaaacaaacctagacaggcaaagtgactgacacaggtttatctagccaggcagtacccgggttgcaatgacgcctaaaggacccctagaccatctgggtctcaccatagccccaaaacaaagccacaggtttgtttctgggcatgtgatcttgttttaggtctgccctggcaggcaggagctttcttgggtttagctgttcagtgctttctcactatttcttttcccgggtcagaaaacaacctttgtcctgtagtttgcattatggtttgagcacagacacctgaataggaggtaaatattttgaagtatgtcagtgacattctgactttctcctggctccttccctttcatctgctggaattcaagaaattctctcagatggaaggagcaacagcttctaataaccttggggaggctgcttgtttgaggccaagggaagaaattttaggaccaggggtctggcagctcctttggggaccttgatcccagggttcattccgcatcctccagcccagtgcaggttacctgagctgtgggggctgtgggcttcactcctgtttagcactcagcaaatgaaccccagagatagggggtgattgcaggacattaacatgattttcttgttaggtggttgttttaggcaggcggatgggagcgagagaagaaaagtcgaagacagagagatagagaaaagaaaaagagaaaaagaagacaaagagaaaagagagtgattttaaaaaggcagagaaatagaaagagatagataaatgacaagacaggagaaagagagagagagcacaatactttagactatctcagcatcagacttctagaaccaaaaggctcctagatatctttttgtggagcctcttcattgtaccgagagagagggagagagaaagaaggccctttctttgtttttgctgagacatctttgctgagccgacattttgctcgctgtttgaaatctcagggcaagatactgagcctttttcagaggggacatccaaacatgtggtcctcatgttctggtgctctggagcctccaaatctcccatggagattgagggggacagggatgcttccgagaccagccggcagccggaatagatttgtcactaggtagagtggcactcggaagttacgcgccgctccggtgcctgaccgtttaagttgtcaacaataaattggaatttcatagctcattattttcataactaagaaccacagtggacaaaatgtcactctaattagaactgccttttaagaaacaagttcagccctaaaacagtgtaactgggaatttctgaactggggccgttcaatccacagattttttttttttttttttttttttttttggtcactgaagaatttgatgggcacacaagaggtgacagattgtagggagagtacgatgtgtggtggctatggtttccagagtgtgtggcaaggcaggcaaagtccctggggcacacagggacccctgtcatctcaggaaggtgggcggtctgccaggagtgtgggcattcagtctacagagctcaaggcttcggaggggctagagacgcacagcttggtggcatctgaggctgagttaaatccacccagggcctggctgctgtcttttttcactggagcctggttgggaggttcaggtcattggtattgggtagtatgttacacagtaagaagaaacactagggattttaatcctccgcacgtgctctttattttatgttttgcaaagcttattctcaaccgtctgtatttctgtcttcaaaacagccccacaaaacaagcagggaagacattctccccctattgtatgaatgggaaaattgaggcctagagaggctaagtgagttggccaagatcacacagagagttagcatcagagccacctacacctcttgattactaaactaatgctctttgcaccgaaggacattgtgtgttggtggctgccgttggtcttttgtctgtaagccaaggggctgcacggctgttttgctgagatgaaaggatagttattaaatctgaatcctcatttgacacagtttcgagttggggttttcggagtgtcagggttgccttctaagtgcctggcccatgtgtcagtcaaaaggacgacggagacctctcatgtcaaggccgcagtcttccacagttggcactgctcaggtgggatgggcaggtagccctgcgtgctgccgcccgccagctatgtaagtgggggccaggctgggggggaccttcagcctgccaccctctcagagttgctatgtgaatgttgcagtcccattcaactaacatattttgagtatccaggacagggttgtctaaatgtctgtaaccccttccctgagattctgcctgtcctaacagacactcggtgactatcaattgagtgagtgaatgaatgaaaaatgcatgtgaaaatgcctggcctggtaaatagtaaagttctctgcaattgcaaggggtcattattcttattattatttaaaattttataagcaaagcagcagcttgctgtagcgggaagagcactgaatttagagtcaggtttgaaagctggggctgtccctaactacagaagggagttgggcaagtcacttagtcttccaatcatttatttttccttctataaatccctgtggccttgcagggttagtgtgaggatcaagataattcgaggaagagctctgtaaactttagggtgctgtggctgaattatagtgagttgtattatagtaaaaattggctttacattataaaattgacaggacaattggaggctgcagagattgctgtgtgccttgacttagggtgcttttctagccatctggtttttttgggatattgttaaaaagttgtttgtgagtaataattttttggcaattacagaaaaattgctgaaagcaattttttagaaagagggaagataggttgagtttttaccttatggtcaaaatttgtaaatgactcactcttttcaatgaaaaacagacatttcactttcacatcactgcttccaaagtatttcatctctttcaggatattcactaacttggccttacccaaacatacccaggctgagaatttcagcatctctgtaaatgtgaccagtcatcttgggtaacattttctacccatctcagaatcacctcgttcccttacctatcatcaactcttgttaggtttaaaaattattagtcatttaaaaaatgtctttttggttttttaaaacagattcagctgcaagataatttccttggaaaaggaaatcaagaattcttctgtaaatattgagagagacgtctggtgatgtctcagattcagaaaagaaattatgtcaattttccccccctgaaatgatgtttcatgacactcttcttcttggtcttggttttactgtaaaaccctgacatcctattttccttaatgagcaaatgctgatagcatggaaatgtccttagaaacagccatttacctcaggggaggtccctggaagagttgccgtgacttgtggttggtttttccgattgcttgagttttgacttacaacagatattttcagataattctgcaattcaacattccttttaattttacaccaggattattatttttctcttacagaaaaataagttgcatttcaggggacagtttcatacaatgctggagattgtgctagggcttgggagagctggcaaatcaaaagtgtaagctaccttattggggaaattgtagttcaagaggctgggtgggcaacagccctagcttgcccatttggtcttgtgtgaccctaggaaaactgtttaaccttgatgaatctctgctttatacctgtagatcaggacctattcatttatttgttcattcactcattcattaattcaaagcaatttatgtgctttagaactgttggagataaaatgggaaaactgactcgaaagttttctgtaaactataaaatggtagatgaatgtgaaagaattttgttaatgcttagccagtgctgtccaatagaaatacaatgagagactggccgggcgtggtggctcatgcctgtaatcccagcactttgggaggccgaggcaggcggataacctgaggtcgggagttcgagaccagcctgactaacatggtgaaacccccgtctctactaaaaatacaaaattagctgggcatggtggcacatgcctgtaatcccagctactcgggaggctgaggcaggagaatcacttgaacccaggaggcggaggttgcagtgagccaagatcacgccattgcattccagcctgggcaacaagagcgaaactccgtctgaaaaaaaaaaaaagaaatactatgagagctgtgtatgcaatttaaaattttccagcagcacattaagaaaagttaaaaaaaagaggtactatattttaattatatattttaactcaatatataaaaattgttatttcaacatataactaatatcaaaattattgagatattttacttcttttggtactaagttttaaaaatttggtgtgtattttatatttacagcacattttgattcagactagccatatttcaaatgttcaaaagccgcatctggctggtggctactgtattggaacgtgcagatccggacgtttcctggccagagtagcccgttattttgttgccaatatccactttactggttcctcatggctaagcttctttctctttgggtcctaggtattatgagacaggaagcatcaagcctggggtaattggaggatccaaaccaaaggtcgccacacccaaagtggtggaaaaaatcgctgaatataaacgccaaaatcccaccatgtttgcctgggagatcagggaccggctgctggcagagcgggtgtgtgacaatgacaccgtgcctagcgtcagttccatcaacaggtgaggggctcgtgcctgtgggggttggggatttggagggatggcagggcatcctggaggctctgcatgtgcctttcctgaagatctggtctcttttttcaccaaggccccttaggggttactgaacaggagggatgctaatggggcctgctcggtctctgttacccttctcttctttccaaagcaggtaggagtcctaggcccagggagaggggagcatgccaacaccctggccgctcgagtttcttctgagcccagagttatttccatccctcccttcaccacccacctatatgtgtggaacacttcacagtgaattgtcctgactagatcttcacaaatgtcgctgtctctgcaaacctaggctcaaggtcttagcactggcccatctcaaagattcccaggaagaaaatccttcctccagtttgggcagagcttgagccagtgagtgagaggaacataaacctgacttggagttgggagacttggctccttgttccagctctgccacaagctcaaagtgggaccttgacaaagctcttcctctctctgagagcccagaaccccagtggttctgatgtgcatcttcaactccagaggtgttgtccaggaggctaagatgctctggagcaaaggagttgccctctccccaactcatacatggaatctcacacagggagagaaagaaccagagaaacaccctgggagtcatgcacaggatcttcctggcagccacacagctccctttcctttccagtctgatccaagacacatggaagggcgctctcagagctttaaaaataaatgtatggaagaaagttttctgttgtagatgatgaaatttcaactccatttaaacccaaagagtcagggatgaagttcagagatgaacagaaatgatggttctctaaactctgcagagaaaagagaagggagcagcctgaaaacttggacagtttccatttctccaaatcacaccctaccatcatcagtgcagagcttgtgtgggcgtaggagaccctcactcctggcagaatgaggtggtcggtcagactagaatgagagcctcttgtcctgatagtggatccttctgtgatgattcaaatgcacagatcgctgtgggagtgcatgtgttcacattttgagtcctgctattttgtaaattgttagcctgtttttcttctcttggcaaaccttgacagaggccctgacatcatgcatggtacaggggagatagaggagaatcaggcacacagtttcttggtctgttccagaggggctctttgtccagggtggggttctgacatgcacttagaagcctgatgcacctggacaaaattgctgaggggatagcaatgatgatggtaggttttggggaggaggggataactcctgttctttttatggattataagaggctccattgtgttttatgagccccttacttctggctctttgcgggatttccacgacacaaaacaacatgacaggcagctggcctgctctgcagaggaacatcagccaaacccctggtcaggctttggggacccacaggtttcccaacgtagagtacacatataattgggggttcgcaagataaccttaggtagtccatgggggtcacaaaatctaatgccttacatggggccaggcagataaggtaatgagggaagcaggccaggcaaaagacgatggggagaggttgggtccctggcaagctaggcagcacaagtccgattaaaggggcagtgcttcttagctccagccgaatgctgccaggaccatgggtctggtgtttgccagattttttgcattcttcaagagaaggcagaagctggggcttgtgtagatgtatgcatggatatttctgtatgtgaaatctctatatttaaattaattttttttttatgtagagatgggggtctccctatgttgcccaggctggtatcgaactcctgggctcaagcaatcctcctacctcagcctcccaaagtgctggaattacaggtgtgagccatcacacctagcttaatctatatatttttttaacagaggcaactaatttcaattaaaaatgccttgcaggatgagcataacttatttacagagcatcggtttacatcctctataatgcaaagatgcaagggtgcacattgttttctaatacatttattttaatgtatgttagaaaaacgtaagtaacacaccaaaccagtgagtttgtgaactccccctcaacactcccacctacccacttacagtagggaactacaattgccttataaaataaatttatttaagtcaaaattgaagtgatgtgaaagaaatgtatgaggcaaatagagcagtggttacagatgtggcaaagactgtgaaggggcatgggatgtgtggtcaagagagatcacgggcccgctgatgttttctgcctggacctgtgctgtggggaatttctaactgctgtctgtagggccatggctagcctcaggggcgtcctgagtgtccagtccaaagccatggccaggcaggccatgcctctaaggtgctttcatgtctgtggtctcctatagtccttaaggcttgactctatcctgtggcagttgtagcaacagaggccaagatggagagtgcagaggaacagtgacttggagatagacatgggggtagaacccaggtttcccaatggtaaaaggagggctagtttctttccaccactgccctgtaggactccgcgagtgacagaactgaggatctgtgagatgagagacaagagggaggacaagtattttcttctgcatttcagatcctcgcgggctgcccgttctgctgcctggctgcctgccctctctcatccttagccttctccagtgctcttcactgggggctcctttttgggagtattctctggctccttcctgctctcttcagtgacagctcactaagtgtaggacaatctcatgcggctgccttcctcacccctaaacccccaaagccagagccatcccagcatacagttttatttttcagatgaaggcaaagctcccactgcattcagatgaatgcagcttctaaatgcctgccttgcaaatgacactgtgtaagagggtccacatctctcccagcccttgcctcccttggaggcaacttttcaccctttctgatttcaaacagctggggagggagtgatggctggatttgtggctattcttatagccacaggggcatctccacggttcacccctaggagtatgtgacttcctgttaccttccaggggaccagcctaggaaaccatgactgacaaggggttaagcatcactgaactagttctgttaggcttgtgggggatttcctgggacacagatcaccttgttcatttgacttcttatggacaaacgtgctgggaggctgcacaacctgcagggatcgctggatccagtctgagtgtccattggaggtggccatcccaaagctgacccaaacggtgggttgaatggggtcttccttcttctattctagcaccgtggccaaggggtcgggagtacaagtggcactcccagcttagaggggcagctctatttagtaccaactggttgggtcatgtgagaatgtgaggccagtattgttgggtgttctgatttttcaagagaagctagaattcagatatttatgaaaaatctcccaacttaaaaatattagcaactaattcaaataaaaacaaatatactgtgcaggctaacaaaacttgtcccgggctggaggtggccctggggaagatgttttgttagttctgctcttaattctaattttggtagcaggccttctgagattgtttatccatttcctctttctttctttttttttttttttgtttttttgagacagggtctcactctgtcacccaggctggagtgcagaggcacaatcatggttcactgcaaccttgatctcccaggctcgggtgatcttcccacctcagcttcccaagtagctaggactacaggtgccaccaccatgcctggctaattttttgcattttttgtagagatagggtttcatcgtgttgcccagggtggtctcgaactcctggactcaagtgatccactcacatcgacctctatctgtgtcctctttcttctccacaacagtcacaggcctgggtgccacctgtggggccccttgcagcttggcacagttggacccctgggttttgaattctcggcatagctgatggcccaagcttcttactgcactgatggcagtttgatcagtgccatagatgtgggtgtttcttcagccttatcttcctgtttcctttttcaaggcaccatgattttctctttcactgtaattttgtgaggactggtggtggggcggggggcgtgggatgatggtgagaagcctagcctttcaaagaaggaggagtgatgtttccatgggatccttaaatgccacaaagtccctcagagttttaaacctcaaattctaagtgggtttgaaatccaaatagcttttatgcctcacataggaagtatttagcagagggaccgcgcttcctttgaatgtggcttaaagtaaagtgctggggcatgggggctgggagtctgggctgactcgctgtgcaattctgggcaagtcatttgagcatcttgggttttagtttccttattcataggaagagtttgatgctgagctcctttctctgttggaacgtctagtgtgctctgcagtacggcagccagggtcctgctcacgctcagcaggtaagggacgggcaatttggtgtgactgccaactcagcccaactgtccctggcttagaaaaggtcctgagtgtgttcttattggatgagtcttgacagcctgtcatatttaaaatttaaaatttgtttagagttgttatgattcaattacagtcttgttcttcccactacagtttcttctcagtgtaagctgatgctctttgtttttacttggtgactgctaaaggcagatgagcaaaatctctcacccctgggggcagcttcagaggcttgcctataactctgagatccccctttataaaggacaaccctgatgcattcttaaaacagtgtgagagtggctaccttcccctccccagcttccaagggggccacttgtgctttattattattattatttttaatttttatgggtgcatagtaggcatatatatatatttatgagtacatgagatattttggtacaggtatgcaatgagtaataacccaccatgaaaaatggggtatgcatcccctcaaacatttattctttgtgttacaaacaacccaattacactcttttagttatttttaaatgtacagttaaattattactaactatagtatcctcattgtgctatcaaatactaggtcttattcattctttctatttttttgcacccattgagcatctttactcccccaccgccctcgccttgtgctttttaaagcaaatgtgaaaaatatgaatattttaagacggaagctagtcattaatctttacaaagacaccactgaaaataacatcttacatttaaggagcacctagtatgtagctaccactgttttaagtaattcattaatttgatcctaatagtaatcctatgagatagaaatgattcttagtcccatttgcagatgaagagactgaggcatagagaggttaagtaatttacccaaggtcatgtagctggtaaattgtaagagggatgggattcaaactctagtggtctagttccagagcctgtacactgtgctactgcagcctcttaatgatttataacaattgataatgctttcccagtgatatttataactattttaaaagaaaatgaggaaaacataattttctttgcttttttacatacaaatttaatagtcagacaatgatttgaaaagtaaggattttaagctgaactacagtgacttttttgccatatatttatttgtaactatatttatgtctggtatatccatatattgacatatccagcaatatctctgtagacacatacacacagagaaagtgacatacacaaaaatataaacattaggtcagatgccagcttacttccaggtgaccaaaaagagaacctcactcccagaactggacattttattatgacccactcttctcccaaatgccatgagttttctggttgtccaatatgcttcgagtttgcttagttaaaataagtggtttgaatattagggaaaacaaacaaacaatctgaatgtatttgagggaacacttaagctgactgattagaaaagggcaagaggctccttgctgagctcaagtagccaggctccagatggcctgtgtgtgtgtggtgagactatagggtgaacagaaaagaccatttcaggctatcagctgaggacacggactgcccttggtgccgagcaccaagctgtaagatcagaaagggcagagaggctactgcccattgagtttaaggggaggcacccacctgctacttctgtcattcttcatttgtataagctggagacccagtgcagcctcagaataaactttcagatattaatggtctggaatgtgaagaagcttctcacagaatgttgcatgaaaagagcaggctgcaaaactgtatacatggaggctgagtgcggtggctcacgcctgtaatcccagcactttgggaggccgaggagggccgaccacttgaggtcaggagttggagaccagcctggctaacgtggtgaaacctcttctttactaaaaatacaaaaattaggcagtggcatgcgcctgtagtcccagctactcgggaggctgaggcaggagaatcagttgaaccctaggggcagaggtggcagtgagctgaggttatgccactacactccagcctgggtgacagagagagacttcgtctcaaaaagaaaaacaaaaaagcaaaaaaacaaaaacactgggcatggtggcgcatgcctgtaatcctagatacttgggaggatgaggcaggagaatcactcaaacctgggaggcggaggttgcagtgaactgagatcgcaccactgtactccagcctgggcaacagagcaagactctgtctcaaaacaaacaaccaccacaacaaaaaaaactgtatacatggcataatcctgattttgttaagagaaaaatggatatttctaaatatgcccaggaatgttggtataaaggaaatacaccaaaatacggtttttagatgtcttctttatactttcccatactgtccaaagagtctacaatgaacgtatattactgttataatgagaaaaaactctaataaatgtcctttcaaaaggtaatagtttgagactggaatataacttttccaaagaaaccggacattttattatgacccactcttctcccaaatgccaaggaaggagctttctggtagatccgaaggagcttttcgcgtggccctgttctgctgctctcagatgcgccggacttgctgtcttgcgcatgcgtggtccttgctggacgtctacaaactcttcagagcctaaggttctgcagaaggatgttagagcggtcagatggccaagggaaggcagtactgctattatctcttttatgtacggggtttttccataagatcttttttcttttccgaaaatgatttggttacttaaaataagcagagtggtctgttccaactccgtcattgtatcggaggtccacaatggaatgtacttggtcaaggtcacagtggaatttctattagagtgtgagcaaggtctctgaaaagacaggccaggatatcactggctccagccctgtggatcctttctgtgaggtttggtgcaaggtaggcttcctcttaagaaagccaaaccggatgtctcctggctgcactttgactctccctagtatcagaacaacatatacatcccctcccttggcaacttcctaggggaaggggtgttatccctccttatgcgttctctagggcagagaaaccagcacgtgagcgctgccagaggacagagagattaccaagttcagttccttcattccacatataggaggctgaggtctaggaaagggaaggactccctaaagtcactcaatgagtctcttatggagctagagctatactcgagaaagggatgcttactcgtaatgttaacacatcatcctctttcttcagaagaggcacttgaagcccagagagggggtgcaaattacacaaggaaacaaattacacagggaaacagaagcaaagttgggactagtccataaaccttccaccctcctgattccagcctgggtttataatctccctccacctctgcccctctgcctcagctcgaaccatggcccagcttgggtatgagttttctggttgtctgtgcatagctggttgaggtctcttctccttcctgatggtaaatagcaattttgtttttcaactgcccacaggatcatccggacaaaagtacagcagccacccaaccaaccagtcccagcttccagtcacagcataggtaagaggaacttttaaaaaaaatttaaaaatctaatgggctccaaatattctaaagaacttttaatcattcttatggacagataattctgcataaaacacttcagcacacgtactaatgcgccttctttgtcattctccaagggctgaacctggtaaatgaattttataaatactgctaaaaggttttgaattttactgattattatgataaatagctttcaccatgagacagaaaattgaaatctaagccaaaaaaaaaatccactaatgggggtctatagaatgtcagataattaaagtaataaatcaagaaagggatacttattcataacattttctgcatcattagtcagtaagtagttttgaatgtgtttttttcttctatcaaccagcccttctacaattctttgtgcacttgcagtcttgagtgaagatgtggcaaaagttcccaaacttactttctctctctctcttgcttcgatctcatgaactctatgaactgtcaagggctgccagtggggtttccagtgctcgcaggtgacgtctgagagtggctgtgacccgacagagtgggagtcatacttcctagtgctcaagagttcagaaatgtcctttgtcttcccttcaaagattgtgaaatgacatgtgtctatttaaggtgtattatttctccacttgggatacaggaaacaccgctggttagctgggggaaaagttattgtactatataagaaagtgggcaatgatttagcaagtctctgacacttctggttgccacagtcaatcctgcagaatcacacctcagattgtgtaacatttccacacttttgttattccttctttaactgagaacttgaactcacacggtgatggggaatgggcagagtcctggcctccagttccaactctgtcattacctcacccagtaaaatgtaaaagttctctcacctccctgagcctcagtttcctcatttgtgggtggaggggcactaaccaggtgctcactgaggcctctgatcctccatggttggctctttggataaaggtaagacagatttcctccctgccatgaaataattcctcatttagtaatcccttcagaaagtgtctgctaagtccctgcggtgcagaccttggcatcagaggccaagcctataagaaagggaagacaaaatccccattctcaaggtaaagggggaatataatgaagagaagtttgcaagacagagatgaagctcaagaagaagggatgggtgctgtgggggcagaaggaaaggaaccaccagctctgctgggctagggtgaagagggtgaaggaaggcttcctgggggaatgtttgtggctgagatttcacttgtagctgaccaactatttcaggtcacatagcactgaaaatcaaatgggtataactgctaatattctttcatttggtttagaagaataattctactgtaggtcagcagcatgttttgttctgtcccagaaatttttaaattaaactacatctcgcatacatatagccccttagagttcacaaacttaccgaggagtgaggaaactgaaacttacagagatgaaataactagccctaggtcatgttgccagtaagtggtggggccaaaagtggaatctgggtcttttgagcctagcgcaatcacaaaacaccaaaacgaatgtcatgggctctgccagcaacatggtgagctttggttatatatggtggttgttgtttaaagtaccaagtgacctgggatcttctttcttcctctgttttttacatgttaatacagaaaaggttgtgggatttgcataaatctattttaaggagcttcttctggtgaagaaaaagagaagttaacgatttctgcctctgtgtctcttaaggaagatgtgagatcaaactgaaatgtgagaagaaaggcatggctccctctaggtttgtaggagccaggagctggatctgctccaaagggaagccgtgaagggcttctcaggcagtcaccaccatttctagtgatttcctactcttaagagtcaaaggtggctccacctgcctccagctggttatagcccaaggaagtgtgtctgagattggtctgtaggttttaatgaatcaaaaaagaattcccacagcccagaaatggcaattcagctgtacagctggagaggcccctgctgatggactggtctctccctaggaatctggggccagaagttaatgtgaaacttgcacaaaagttgccccccacctcccatccaattcttattcttaggaactttgagacctagcctcagtcacaataagtcaccaaccactgcccctatttctgggcgggggaaatctagactttaagtaagtaaacccaaggctaagttctggtgccgctgtttattagctagatgactttgaatcactttccctgtggagcctcagtttcctcatttgataaatggggataaataatagcactctgggctgttgcaatcatcaaatgaaaagtactgcattcatgtgaagtatattattgctcttcattgtttattagtgcgaagcagattagttatagggtttgaggctttagtctctgggttcaaatcaccactctgtctcttttattttttatttttatttttgagacagggtcttgctctgctgcccaggctggagtacagtggcacaatcatagctcactacaacctcgacttcctgggctcaagtgatcctcttgcctcagcctcccaagtagctgggattataggcttgtgccaccacacctggctaatttttttttaaagttttttggtaggtcttgctatgttggccaggctggtcttgaactcctgagctcaagtgatcctcccacgtctgccttccaaagtgctgggattacaggcgtgagccccggcaccaggcactctgcctcttattagctgtatgatcctgggtgagccacttatcttctctgagttttacctttccaataggattatcacatttcctagcttctaagattgttctcagaattaaatgagataatgcctcaatgcctggcacagagtaagttctcagaaaatgttagttattgttattgtcataattaatattaaaatcaaatcgggggaaactggaaggagaaaaggcagcaagaaaactataaaaagaaggggcactctgcggtttggagtttgttagccgtgcgcgtgagtttgtgctcaggtagttgtgtttgcacccaaggttgggttgggtgtgcaggcaggtggtgaaatgcctaacgagtagttcaggtttttttttttttttttttttttttaagcactgactgttggtgggccccggctcccctctttctcctctccatcccctgcttcctgcatccatggataggctggaatttaagcgaaagcccttcctgtccccgtgtccccgtgttcctttctgcaggggtcagtccttctcagtgcccacccttccctttctccccccatcgcagagaactggggcacacggcccgcccgaggcctgcgctcgtggctcaggtgtggccgcctccgcagagcgagggtcctcagcgccccctgcccaccctgcgctcgctccctcccagccgcccccagcctcacgtgcggtgacagccggtccgccgccctcagccctctgcggccctgaccgcccgtctttctccgcgcagtgtccactggctccgtgacgcaggtgtcctcggtgagcacggattcggccggctcgtcgtactccatcagcggcatcctgggcatcacgtcccccagcgccgacaccaacaagcgcaagagagacgaaggtaagagaggcccgcgcagccccgtcggggatgcgctccacggggtctgtttccggcgctcggtcgcgggtggcagcagaggtgcccgcgaacaccccccttacctgcagaggagcgagtcccccggcccgcacgctgtccttttcgtgaacacgggaaagggctgagccctccgcaagacagacaggcagcagggtgagactgtggcattcttgctggcctcccccatggtcaccccttggatagaagcagcgggcctggcagagcccttgtggcctgagctttggcctttaagaagaccctgtgtgcgtgcagatatgcggcccgagggcagggtgtgctgggctccacacccaagtccactttgtggaggagctttggaccagagagagggggctggccaaaccgtgagaggggcacacgtgcggagggcggaggggtgggttctctgaaaggccctgcacacgtctcagcagacagagaaggccttcagccctgatgatggtgttggggggcggtgctgaggaaattaataatcatctcatctttgtccttgggtctggaaggaagaagtgcgggggtgttgggggggattacaaagatgacaatcttcccggttggtttttctcagcccctccacgggcctggccctgtggtgcctgggtctccagagccagccacctccatcctggacaccggacaccttaactggggctcctttcccctgtatgggctgccagtactggctgacattaatgggtttgagaggagaaaagaccccctgggagcctgtaaaaccttagtcaggaaaagaaaaaaaaaaaaaaaaaaaaaaaagccagagctgtggtctagggcctgagagcagcgtgacagaaatcttgattcaattattctgttcctcagcacaattccctttctcagctctgtgtaagggatgtgtgttctcatgagcacatgcctaagtacttaagatctgtaactagaaaattgagtcggcccagccgtggattggcctgtggtctgcgtgttgccagcagtgcagaagcagagccggtggcctcggtttggaaccgtgggggtgtgtggggaagatttgcggcttttggaacctgccttgcctctctcttctgctcctgctgctcctgagcagatgtcagacgtctttaactcagtaggctgcggtgctgtgttgctgcaggaggcagtgggcctgccatctctgttgttttatgaggttgatggtatcatcttttctcccattgtcacctggactcgcagcagatgtgcctaagctggggcctggatgtatttgttcacggtggagggacagattgtgtgagactcccccagaggctgagggatccaggtggagatttttggggaaagagaaaagctagtttgatgtttaccaccaaacagacaggttctggcctgggggcattatttactttgttttcggagtgctatattggcttgcagtctgaccagcagtcatggttttgcccctcaagctcctttacaaggtatagcgtggtcagaatgtgggtggtgttggtcttgactactccgtactactcagatcatgcccggaggaggactgcagcccatttgggggtattgacctttaagaggggcggtgacaaatgggattgtgtcctgggcgaagagggatctgatacagcatctgggaacacctcaagcctctagggatattttggcacaaagaagagcagaataagcgagactggattgctgccttcaagtatttggagggctgacatggaaggaggaaggaatgagatctcattgcatggccttaaagtgtgtggctgatgcagaggtgatttcacctcagtttaaaaagaaccaagttgcacatatgagagtggcctaggataaaaggagatgcctcgggaggtaatgagtgccctatctctggggatatgtaagcagagactaagtggccacttgttgggctgccaacagagtatcaagaatcagatgtggtattggatgatcttttttactttttaattaaaatttttttcttaataaatagacacggtgttttgatatgttgcccaggctcatcctggactcctgacttcaagtgatgtgcctgcctaggcctcccaaagtgttgggattacaggcatgagccactgttcctggcctgggtgatctttgaaatctttccagttctgatatatatggtagagtcctgatcctcaggaagacttagggggcagtccagtcagtggtctgtggtagaagggagaatgacttgatggtcctggaagcttataggagtggaaagagtgggggacaaacccaatcaaccagagcctccccctaactcctaccccacaccactgagagtatgcacgtttgatcccaggggtgggcagcaatggccgggctcacaccagggaagtgtctgtcgggggtattgcataagtgcccccttctgatgtttcccatcctctctctgtatctctctggattcctgcagtggccctagggggaggtaaagaggcagagactgtcacttccgttttactaggggaggggatggaggctacacagccatacagctggtatggactggggagtcaggaggagctggagtgcccctgaggcctcagttccctggtattttccagctacctgttgtccctcagccctttcagagatgcgctttggaggcggagcagtctggggctgggcagagcctggggccggtatggggaagagtttcaatcagaagggcatgattagcaggttggatgcggagagagaagtgagacctgaaggccagaggttggaggagagcagagaaagtaagaagcagccactggggaaacagggatatttcaggcacactggccggctggcccatggcagctgcaaaccatggatttgtgagggttctggcctccagtgcggtaccatcagcagcctgagagaagaatcatggggtaagagaggcaatggagagctaagaggaagacagctgagggtccttgcccatttttcggatgaggtgactgaggctttgcaaggtggagttgcttactctgctgcctagttcacagtcatccccagcttagacttgagttttgctctgagggcatttcctggggccaccctcctgcccagatcttgcagaggtgaacgggtgataggatccaaccacagagggtaaggtggcgagcaagactggcaagctgaaattcctctgatgagcagggcagtgggtgaggtgacactgggggaaagagtaaggcagggagggccagttttgaccaaaaggatcttgggggctcctcataggaggtggcatttgagagctgggtaaagggaggagagggcattccaatcaaaggcaagagagattgtgccaagtctgggactctggtgagcatgtgcagggagaggaccagcacggcaggatttggaaagggagagaggtagagagatgtgggtggcttagactttgacggaggctttcgaacatttagtctagaagcatttagggagatagttttgagctatgtgtctcagatgctcaagaaacattcactctgctgagtgtttcaggtaaaaagataacatgaaagtgactagccctgcactatccaacagaagtagaatgcaagccacgtgtaattttaaatgatctagtaactacattaaaaagagtaaaaagaaacaagtggaattaattttaataatatattttatttaatccagtataccccaaatatcatcatttcaacatgtcagcatataaaaaatttgatgctatattttctcttatttttgctgccaagtttttgaaatctggtgtgtattttacacatgtagtacatctcaatttggatgcgaaacgtttgacagttaaagttagatgtagtcctaccaaaacaataaagctgtgtttagtgggacaaatattttacactgcttctattttaaaattaaaattaaaatcaaatcaaataaaaaaattagctcctcgattgtactggccacatttcaagtgcacagtagctacataggactagcggctgctgtattggacaacacagctctaatacaagtgcttggcacatagtaggtgctcagtaagtgctccttggtagagtggatcagtcacattcctttagagggttcacaattagtaacgagggtgagtggagggacctctactatcctcagtcaagggtgcttttgtttggtattttgggcttccatagaaagctccgagtagagttctggagcaaagacaaacaaactaactagaatattgttaggccagtggattggcgaagggccctttcagtatagagattctagagttcttcctaggatgcctgcctccaagaccagactcgggtatatggccactatgtccaagtctcagatgaactgttcttcagcagcaggtaagatctctgtggcctctggaggaagagctggggctggttaaaggaagctgcaggaggcagattatggctgaatgcaacatacggctttcagaagcagccaggctgggccaagaatggaagctttatcttagaaaggtagtgagctctccatcatcagaggtgtgagcaggcgctggacaaatgaggagcagaagagtcaaggatgacattctggttcggactctgtgacttttgaggcaggcctgttctagcctgggtggccaatgcttctgtgccagtactgtgtctgcaagtgcatctacccacttgtctttcccttctgctgcctgaccctgaggctgccactcatgtggacttgacagggcaggggccacaaatcatttctatccccagcgcagcctctcggcacagccccggttcacacggatgcctgggaggcctgcgggatggctctgagggtcaggctggggtgccacccagttatgagatgtcgctttgtctcttggttggtttgaactgagagctttcgtcgaggaagctgtggcatggctcaggaatcctgctgggtgaggggaatggaggctgagtcagcacctccctctccggaaggcccagaggaggtggtggcagggagagacttggcaaagcaggcagggctgtgaatagcggccatgggtgaaagggcagcctcagaccctgggttccttcctgggcttttgatctctagtgagacctccttccgccgctctccccacttaggtcccctccctgtccccctcacaataactcacagggccctgagtttgaaaggccctgaacacactgaggtcagcggagtgcgaatccctttcaccagtttagaaagctgacctgtccagccagtgtggactgtgggggccagaggtttctttttgggcagtaggggtacgttgcaagtgagtttccagccttctgggctctggactaccttctaaggagggcacaggaagggcagccagggttcagaggtggcctgtcctttccagaagatgccaagtctgatgagactctcatggggaggtttgttggggggcatttagccaggtgctcccattatgacttcctttttggggatgcctgtctcctgtctgtttttgtgtctctccccatgtctttgggggtgcatctcattctgtgttatttggctttatttcctgtttattgaaccttcctctgtgtctgtttctgtctcccggtctagctctcactagctttctttttcgtacatactctctctcacacacacactctctctctccctctccttcttctctttctctcacactcattcactcattcaatttcctttctctcttgctatctctctctctccccaaatcccctcttcccctgtctctttcaggctggacgccccctcagccctgcccagcagacctccacgggagctatggccagagggaaggggcttcagaagctcacagaccgtgctggggccctgggcccctctgacatgggcaggtcctggtcttttctctcctaggacccttttccttccctggatgcatagatgctgtctgctgctcccgggatgagggcagaaaacagaagcaggaagtggggagagccctctcagagctcccagaagggatgggtatgtggaaaagctcaggattcctgagtcaggagtaataggcagcccctgtgggattgagagttcacagatctctgatccctggagagccccaaataaggtgttgagtcaaaggcacaggctcatgggcagggatgaaatggtttgaggacttcttgtagcgagttacttaatctctctgcacctccattttgttatctggcgaatagagttgacgcaagccttgtgggttacagtgagaataaaatgaagtgaagtgacagctgccaagggcgtggccccagggcctggctgtagtcaatgctgagtagatggccacggagaggcctatgtttgaggacgtgaggcccgtcatggcagagggcagcaggctttagccacggtcctgttggcagctggaactggctggttcgcccaccaccaccttcctgtttggagctgtggagccacggagcgattccatagtactgaagaagccgattgcctgcagccgggagcccggggcatccaggctgaacaacagtgcccccaggtgtcggctgcagaatgaagggccactcactttcctcctcctttgcctttaggaagctgagtctcccagcctgcttcatggcagaagaaaagggtcaggccccagttttccctgaagagaggcacagggagcacaggggggtggaggcctccagggtgggggcagagggtagcaccctgggcctgggagggctgggcgtctgaggggttgttggggccaccagcctggacctcgagactcccccatgggagctggaagggccttggagagcacctgagacgccccgctccgtcattcgcatgggaaaacaggctcagagaagagaggcggtctgcccagatcacacagcaaaacccccaaaacctagagagagaggatggctctgtggaaaatccttggcatcccttgcctttcgatgtgataaattcagttttcctctccctcctttcctccattctcacagggccgtccgccatccccactgttgacagccagccccatcagtcttatctccccatggggtgctgcccacacgtccccccgcactgacctcagttcttgagagaagccctgcccttctctcgcgggcctccctttcctcctgctcattcctcctgtgcctccagtccctgtgtgttggctcagcttcccgtctccaggccattgcccactcagggcctgccacctggaatgctgtccttgagcctggacctggcctggctttctggaaccagcccactcccctgtggggatttccagtgttgggtcattggtccttcacaactggctgagacccagggattctttagggtccagtgtggagtatgggtgaacaggcaggctctccatctccttttcccagtgtggctttgggggcaggaaggaggttaccaccattttgtcttggcctctgctggggctttccaagggcaggtcccctccctggccctctgtgtgctgtcccctggatgtagagaggtgtctacatgtcccctcatgtagagaggtgggttgttccctgagttctctttttgtctaagaaggagtcaggaccaaggttctgctggggtgtggtcgtggtgggggcatcacgtagaacccaggggggaattggcagcctggtagccatgctttccttggcttgccctgtattgatgatgattttgaattagttaccaacattgcaaaatcaggaaatttcatgtatggatggatgcctggcttctttggggaagaaaaatcagatctggcaaccctggggcagctggcagcctggcaacccacaaggcaacagtcatctggggctgctgggcccgagttctcatgcgctccccgctcaagttgctctcggcacttgtgctctgttttccttggcctgaaggtctttgagcttctggagtcttagcatgaactctaaagaaaccagtttggctcagtctctgcctgtggcagctgaagctaatgggaggcagatcctggaactggccggtggggccgagtgtgcgtgcgtgtatgtgtgtggtcagggaagtgggtagtcaggcttacaggccagaggtgggtagggtagcggaggcaagaacttagggcagtggccaagcagccacactccttggcaggtcatgtgctctataccctgcaggtagggtagtccaggcacagagggcgcaggcttggcccaagggtatgcagggggcagttagtggcagagatggtgaggacctggtttccatctccctgcctggcgggccactctcccctgtgatctctgtcctgatcttgtagctgtgggcacctcagctgagacccagatagacaactgctggaggcctctgtggtaacgcagggcatctgaggccaggtggccaattggaggggctcctggggcctttccctagtgcccagggcctgtcccacgggtgggggctcaggtttcggttcctcctcgctcctgggtccccaagtttcactttgattcagtgagcgagagcccccgtgagagccaacgccgctgaacccccaccctctctgtttgtgcacctggtttgccccagcccctccccctcctcttacccccagttccttttcccatggggtggtgtactggtgttcgggagagccctgggggtatgggagagggcagggtgctgccatgtggggatctcagttcagggaatcagtttgggggccaaccagtaaaagagtggtggggccgatggagggggatatagtctcatctgctgtgggcagtcccctgccaaggcggtctggaacttgaggtgaaatggccttggctttctccaccctgcatgccctgctgccccatggggaagagaatcccacagtcctttctctctggcttgggaatatggtttaatccctggctgcatagcctgtgggtcagagaatttacaaggcttcaaacccctgcccctgctgtgtcccttcttcctgtccctttctctgtctgggcctcagtttttccatctaaaacaggagatcaatgaattgctgaggtttttttctggcaccaaaattttgagtttctcctggttccatctcaagtcctcttggcattattgtagggcagcagttctcaaatgtttggtcctgggtccctttaaactcttaaaaattatcaaggacttcaaggagctttagtttatgagggttaattaaaatggatgaaagtttaaaatatttatttattaaaaataacagtaacaaacaagtaacataaataatatttttgaaataagaaagaaccgaatcttccaaacccaaaatttagtatgaatggcattggcttacagttctgcagatccctttagtgtctggcttaatagaaaacagctggactctcatagctgctgctgtattcactccgttgtgatggaacacatcttacagcttctgaaaacctccactgtagactcgtgagagaatgagagtgaagaagacaaatcacacattagcattaatatgaaaataacaggtgcagcaaaccactatggcacatgtatacctgtgtaacaaacctgcacattctgcacgtgtatcccagaacttaaagtaaaataaaaaaacaatgaaaataattttgtcctcacagatcacctgaaagtatcttggggaccccttcttccaaccctggcagggctccctggactacactttgaaaatttctgcttcaggctgctgcaaagtctgaacttgcctacttatcactcatatagataaggtgagcaattaagtggtttcagttaaaagaaaggtgtcatcagtcatttctcctgttcttagctccttaagacagtgggagccatggcaggtctttgagctgaggagggagtgacaagacacactgggttttggaaatcctccactagccgattgggatatgtatgtagtgcttcttgcttctatcccaggttgagctcccacggaaagacatagctaccgagccttctccccttcccagcagattgttggtagggcttgaggtctgatttccctccagcaggctttcttctgtgccagcagcagccagctcgtgccacccgagagcctggggagtgagtgtttcagaaccctgcctattctccccatccagcttagctctgtactagcctgcagccacctggagaccccatctggggcatatttttgatgggaagaaaacctagcaatgctattgattgggaatgaaacaaaataaaataaagaagtgggtttggtatttatcttgactcctggcatttgaggaaaagcaggtctaaaagacagttgacaaaggggagatttttgttctgattccacaggggcttctgggtgtttctggaatgtttctggttgactcatgtgtgtgtgtgggagggttggggggtgggggcgaggtgtgtgtgtgcccgcatgtgtttaattttactttgaaatttctagttttcatttttattagtacaaattaacatttgtgttagtccttccttggggcattttatccctgtgttagaataaactgtgggagagggagaacaagagaatgtcttaaggtaatttgagaaaaattgagagaggaagaaggataaaaggtgtgagagaaggtatgtgtgagaaacacattgcttgtagcaaaattaactgatctatgagaggaaataggcagaaagaaaggcatagcctcttgagggactgaacagtggaggacgaaagtgatgagggagtcagacacttcccagcaccagccaccaggtggcaccatcgacccaggacagcttagttgctgtccagggttaggaacaagaggggtagggtagcagggcagtgtgtaccggccattcatgagcttggtatgcttgtaactgggtcggaggtggcagtgcccaggtgggctgaccattagctgaagtctcacttcttcagcagcattcagtcagggagggggaggctggaccattgctagtggggattaatctggtcctttctcacctccatggtccaaatgccttgatataaacctttctgggagtagagtccttggttctactctaagcctttacttgctgtgtgaccttggccaagtcacttctctctgggccttgttttccgcatattaaaatgtggaaattggagcagacgatttttgaggttcttttgggctctgacactctgtggtgtaccagagagcactagagctggagttagattctagatctttctgtcagccatgtgaccttgggtaggtcacttctcacatctgtggagattatagtcacatctttctcttagacttacataaaatagaagatggaaaaatgcttttgaaatctttttggtgctttaggaaaaggagagtgttgtgattttataatttttgctggaattttttttttttttttttgagacaaggtctggctctaccgcccaggctggagtgcagaggtgtgatctcagctcactgcaacctctgcctcctgggctcaagccatcctcccagctcagcctcggagtagctggggctacaggcatgaaccgccatgcctggttaatttttgtattttttgtagagatgggatttcaccatgttgtccaggctggtctcaaactcatgagctcaagcaatccacctgtcttggcctcccaaagtgctgggattacaggcgtgagccactgcgcccggccttctctggaatttaaattagcgggaagcaggggctccaccatcttcactgcttagaaagtttgtgcctctacatgtcaccacggaaaaaggcctgccttatggcaagcgtttgctcaaggtcactgcatctctgtcctaaatatccattgaatctgctcatttctctccatccccattgctactgccttagtccaagcactctcttctctcatttggactattgctgtagcctgctggctggtccccatctccaatgtcgttgacttgtccaaataatagtctgccctccacatagcagctgaaagaaaattctgatcaatgacttgcctgaagggttttaaccttcaaatctgcccattgttctcagaagctatgcaaacttcttaacaaggctgccaggccctctccactctcctcttttcatgcgcactccagtcataccaaacctctttccattccttaaacaccacatgctctgtcctgtttgcaacctaggagtcagacaacccgagttctagtgctgactcaacaatgactactcctggaatcttggaccaatctctgagcctcagtttcccaattgtgcttgtgattggactgttatatgaattgaatgagattatgcatgtaaagtgctcaggatgaccccatatataataagtgctcaataaagagtgccttttattatgctcttcccactgcttgaaaaactgtcttcctccctcaccctactgtttacctggctgacatcccaaacttcaggatctagcttgtgtcacttcctaagtgagggcttctcagatgctcccctccaacccaactccccaccagcacacagaacctgcctgttcatcaaaatatcacatttgtcactcgcctgttttcccagcaagactgtgagctccatgaaggcaggaactgtgtctggagcagtcaccaatgtcaccttagtgcccagcacagggcctggttcacaacagcaaatatgtaccgaatgggggccatggatgtcacagaagccatgggctcatctggggaatgagtggaggctgctgagcagaacacagagccttgcacgtcaaacgttccccaagtcctgcctgaccccagagtctccatcctccaggatcttgtgacagccattctagacggggagggagctctttcgtgatctacatgcacacatgcatacatatggatactggtgcctgtggtcctctttctgcctgccatacctaagcatgtgctccagatgtgtatagatcacagcaccaaagaggaactgcaatatgggataactataacggctaacatttactgagtattgactctggattttaaattattaactcatgtaatactcacaaccactgtaccaggtggatactcttattatccccattttatagagatacagagagagtgagacaatttcccaaggtcacacagctcaatagtggcagtgttgggactagtacctaggtgcttactggccatcccagtctgcctctcacagagggtgtcacaacaggatgacatccgtatgaggctgtgttctccaggggaatatcctcagctctctccaacatggggctttgattctactttttcgcagttctgcctgttcccccattatcctgtctggctgagctcagggggaccttggctcagagtctgttgcatcactcaggggtacgccatttctgaagctttcctaacactgctgcgcacacttccctgtcacacctgcaagttggtcaccttcaagcgcagccggctggtcacatgtgggttttaagccacagcaggtggcaccatgagtagactggggtttgagccttgcctttccttttactagcagtgtgagctttgacagcaaagggctttagcttctttgagcttcaatttcctcacctgtcaaagggggataataattcctgccttttctggtaattagaaaatgttgcctataatattttgattagcactggcacatggcaagtttcaaaaatatcacctattattttcttatttctattatcagagcaaagtgtttttactctgaatctagattcctcaaaaagatctcgttgagaacgttctaaattcccagattttttgttttctctctctctctctctttttttttttttttttttttttgagacagggtctcactctgttgcccaggctggagtgcagtggtgcaaacacagctcactgcagccttgacctcgtgggctcaagtgatccttccacttcagcctcctgagtagctgggactgcaggcatgcaccaccacacccggctattttttaaaatttttttgtcaagacaagatctcgctttgttgcctaggctggtcttgaactcttgggctcaagcaatcctcctgcctcaggctcccaaaatgccaggattacaggctttctttcttttttaatgatcattttatttatattactaagtttcatgataggattgttcagcttagggtcagaagaaaaggaaagaaataccaactggaattcatgctggcagaatttcagctccatgtttctgaaacacaaataattcaagtcgtagctgagggcagctgtcagaagtaaggtgagcctgacacgacactggagaagcctgggtttctcatcctgactcagccgtggccttgcggtgtggtctgagtcaggtcctgcccttccggagcctcggttaggacccactgagtctggacaacccttccagctcctgatcctttctcctcccccgctccccgccgctccccctccctccttcttcatcttctcgctcttcgtttcctttctgtctcagacacaaacgccatccagcacttctgaatagtacttttgttccgtgaacatctcttttctgaaaaggacgattggtcaggtttgtatcttttaactgctggcacattttatcagttaagaacctgcgtacctccctctcgggagacaaccttaaggaggcaggcaggcaggcagagaggcagagacaatgggcgaaaaacaactgtttgggggcctaatttatggttcctccagcaaatgccttccttcgtgggagcccctttcccctttcctgctcttccccatggccccgagcatcttccagcagaccccagtgtatgactccttcctagctccccaaagaatggggagagggaacgagcagagcctgtgcctgagccatctcgttcaaggccttcaaggcggggcttggagtcctggcttggcactcccttgctggtgatcttgggcaacccatgctgggcctcgattttcctactggcaccagagagagcaggacgccttcttcaaattcttgtgcaaattcggcgagaagaagtgcatgagaaagtgctttataagctgtaaagctctcttgcctatgagagtatcattgtagttcatctcacatacccgctctgtggcaagggacacatttctgaacatctccaagggtcggtttccccatctgtaaaatggggactatatacttaggtcatacaattactgtgagaattccataacagaggcaaaacacctggtacagttcttggcagtgggaggtgcccaggtctaggctgggccgttttccgtttccctttcttattcctccacagcgcctttccctgaatgcagcgtataggcacgcagccgcaggcgtttgaaacccaactggccactctctggcctgcaccccacttcgctcctctgtagaagtcggacagtaacagtatctgcttcggagggctgtgggggaagattagactgtgcccatccgtggctcggcacagcgtcagcaccaggtgaacgctggtgatgctgccaggccttcctccctctggacacccaggcactgggcatgggctggacgggaccccggccaccatctccttcgagcctactcgtggccggtgaagaaagccaggcatgagaggagcaggaagcgagtcgctcaagggcgcaccgagtcatatcccaagatctttgaaggaggtccagggatccgcggtgccaccgtgagaatacagctcggcagagaggccgaggtccctgcggggaggccggtcccttcctcctcggccccgcggtccgggcgccccgtgggcctagctcccgcccaccggccgggagtcctcggggctcgggctccgacggaggagtccccagggccgggggcggagggcagacgacttccaggaggtcacctggatttcctgcgcgacgtggaaggagaaatgaattcagctgcggccgaacgtggcgcaaagagaaggctgagcgcggcgcccccgggaaggaggccgcccgctcgcgccggcctccgccaagcatttgcaatttaattgacattggcggcaggaagccaatcagtctaagtcaattgacgttccgagataaaactaatcggcggccggcgctgcccccgccggcgcggccgcggcggggcccggggcgcagcgtggaggcggcggcgcgccctgcaggtcccagcgctggcgcgtggctcggcccgctgattgccgcgcggcccgcggcggccaggagaggcccgtaatgaatgactttatttgccggggccccgctgagaacaattgagtttgttatgctaacaacggatgccagctttccggggccccggggggcgcgggcgcggcggcagccgggagctgggcagcggagcagatgatgcgcgccggggcgagggcgccggacgggggtgccgggcgggggtcggacggagctggcgtcgggacccggcctggaggggcgaggccggttcggatggcggacgcgcagcgtggaaccgggatgggagttcttgatcattccttgatgttggacaggcaggtcctcctgggtgcgactgccactctttcttccctctgtccccgagcctgagtgggggttctgatcttgctggatgatgccctgacataaacttttttgtctcttgcaccggtggaaaattagaaaaaggcacaaacacaaaggcatcactttttccagtgacctgctgtggcttgggaagttcgggactggattttgaccctgccacgtgtgctttgcgccctggagggaaggccttccttccatctctgtcccctgtgtgtatccccatgctctgtggccaggcgccggcctcagaaagctcttcttgccctacacagaaggctgcctcatggagatggctggctctgaggccccacagccttctcctgcctcccccttcggaccttgagttccaagggcagaagtcgtctcccattcgtcccagacgccctcagtgcccagcatagggcctggcacacacgtggaagtagtagtgagggaatggacttctctcttctttgcgatctcttgctttccctctggttgcagacaccagagtccccttttccagttctgttttcaggcatgctggcattccctcactcactaaacaactgagaaccaacctttcatccaaaaaagccctggccagggagagataatgtaacccgtgtgatgagtgtgtggcaggcacctgctatgtgctcagagttggcaaaggtgtaataagtgcttgctgagggcttttccctttgtcatggcactcagagatccctggtgccacccggtgacaatcaccaccccaccccccatttgaagacggacaaactgatgcccagcgtgtttgagaggcagcatgatgcagtggaatgggtctaagctgggaatctaacactagtttgctgtgtgagctttgtccattttcttcccctctctgagcctcagtatccttatctataaagtgggggagttggagatgatggcctctgaaggccagttgagtgtgagttgtctacagggaagagggacccaggtccctgctcccagcccagctctctttggctttatagtgtgaccactgggaaaaaattgccctctaccctcagctgtacaaggctgatggtgagagtgaagcactcactttgtgataggcgagtgtggtgagtgtgtatgtaccaatactgttttcctttggctgttggaaaaaatgaggctgggtgcggtggctcatgcctataatcccagcactttgggaggctgaggtgggcagatcacctgaggtcaggagttcgagaacagcctggccaacatgatgaaacccctaaaaatacaaaaaacctctactaaaaatacaaaaaattagcctggcgtggttgtgtgcacctgtaatcccagctactcaggaggctgagacaggagaatcgcttgaacctgggaggtggaggttgcagtgagccgagattgtgccactgcactccagcctgggtgacaagagcgaaactccatctcaaaaaaaaaaaaaaaaaaaaaagagaggttcaataaccaatccagggccacaaagccagtaagtcacaaggctgggattcaaacccaagcactctgttttcagagcctgtgcatataactgctctactagttggcagaggcagcatataacccccataacaccccttccttgccctacacctcaccccagtcttagtcccacctgccttgctcttggagctccaacgtgcattctgcatgttttcagggcaggaggagcactgatttttcaaggtgatttttctctccctggcctatccctcttgacctaggtatagacagctgagagaaggctccagcagggaggagaagctgctgtaggaagctgggactccttggctcagtcctagctggaatcttatatttgggaaacggttttctaaaaagggcagagggaatccaggtcttgtctgttaggaacaagcttttactattcatgatcaaggaagtacatttatttcacagttgtttttggtacttgtctttctgtccctcaaaggtggtctggagaactctttctctctagagctataccctttttagcaagacaaattaggaagatagtccctaatatgggatagtcttgaagggtagaactggaggcgccttggaatcatatatagtgattttaaattgtgtaaccccagctgggcaaggtggctcatgcctgtaatcctagcactttgggaggccgagaggggtggatcccttgagctgaggagttcaagaccagcctgggcaacatggtgaaaccccatctctacaaaaaatacaaaaattagctgaatgtggtgaaaaaaaatcatatcaatccaatgtttcctctttaaaacaagtattttgtagcgcttcctttgctatcctaaaatgaaatttagaggaaatagaatccactcatacacataatttaaaaaatagatttaatgccccaattgtaacaaaaaggggaaagaaaagtaaaatcataataaaatgatatattttcattatgtaaatgctcagacatgactacaccagaagacataataaagtagttagttgcttgcacttaggcgtagaatctccatgaatgcagcagctataaatgtggacagctgtgttttttggcaatataaatatctctggcggtgttgccatcagtgaactgattttctgaaattatgaacatgtcctgataaaattccaaccaaagcaaagcgtaatcttccctcaatgtatatgttggttgtattcttggaaaagttagtgtaaatgaaaacaccaaatctctgtgtatgtcggaaacacagagttatgttcatggctcacctatctataaagagttttcaccaacttcagtgtgtgatgggtcattccaaagatgtgtgagatgcaggccaattatttaccgtgctgaactgtgctgggtagcatccctggccccatccattaaatgccatacttcctcccccataacaatattagtaataattcatagatttcccaaatctcctctgatctgatcatgcttaccgacaaccactggaatgaatgggtttctctctagggtatctttcttttgggaagttctgtggagtctgtgaaaaagcaaaatctgcaggtattgtgcacccattgtgtgcaaaacctgacccggagacacagaagcatagcctgatttagatgtggaggtgtgaaagctacgtgaccccgctccatgggtgctaagctcccaggggcctcagtcagtgagcatagccccacccacatcttatccttgtctgggatgccccttgcctcttccttcatgcccccaaatccaaatcctggctcagatgccaccttctccttccaggagaaggaccccccatcctcctgcactggacaggttctttctgtctctagactttcattgcctgcagttgagggctctcttaggatactttcacaagcttggactgtaagtccatctccaggccttctctccttgacagagtatgggctccctgagggctgagactgggttccctggcagggctatgcttgggaccagagcaccagcaacagatcaatgaatgctggaaccaagggattcaccttagccaggtacccctctttgtacacatcttgttctttttattttttatttatttatttttatttttttattttttttgagatgaaatcttgctctgtggcccaggccggagtgcagtggcatgatcttggctcactgcaacctctgcttcctgggttcaagcgattctcctgcctcagccacccagtagctgggcctacaggtgtgtgccaccacacctagctgatttttgtatttttactagaggtggggttttgccatgttggccaggctgttcttgaactcctgacctcaggtgatccatctgcctcggcctcccaaagtgctgggattacagtggggagccacagggtccatcccttgttctttttaatttagcaaatggcttctgttttcttgtcctcactctcagtccttattgactcttaggaggtgctcactgtgcagacagcactctctcacttggaatccagcagcttgtttgctctgaccagtgctgtaggcctggcatgatttattgaccccattgcacagatgtgttgagagaagtgtaagatcacacagctggcaagtggcagagccagagcttgctctctgtgctccaccacttttgtcacttaaacacttccaaggcagagcctcttccctggggtgtcattcatccatttactggctcctgatgtggtgtcgggcactgtggtctcagaggtaggtaaggcctgggagaccccactgttttccctcagggattttccctagggacccctttgttttcccttaggcaaggcatggaaggggagcatcagatgtcccctgggagggtgtggccactatttcccagtaggaggtcacaccggagcagctgtctcccttctcctttgtacctgttttttgtttttttttttttgccagtttcagtgaaattcactctacaagtatttattgtgtgcctgctatgtgtgctaggtattgtcctagttgctggggacacagcaatgaacaagacagacaaaaatgtttgcccacatgagtgacgttctaaggaagaaagacaataactaaataaggaaaataagcagcatgctgttctatgctctggaggaaaacaaagctaggtgaggagacagggaatgaagcagggctgagggggggggggctttgctgtttttggagggtggtcctactgatgagctgacgtttgagcagaggccttaatggagggaggagtgagccaggcagatatctgggggaggaagtttccggagagagggaacagcaagtgcaaagaccccaaggccggtgagcttggcatgactgtggaaccctatggaggcgagtgtggcaggagcagaataagcggggaaagagtgggaggaaacgaggtcagaaaggtgggattgctgggggggtacccagttaagtaccagtaaagcctagtaagctgtgaggggctgtgggttttgctcagagtgggagtagacagcagcctagaacctccaacagggaacttcagaggtgcattttctcccctacctccagtgagtcactcactccagcataccttctctcctaatcacctcccgaacctgcccccttctctggatagccattcccactgttagctctgtcctggctgagggctcccactcgaccctgggcctcagtctcatctccctccaacagggtctctacactgtggccagattagactgtatgaccctcctcccccaacccttctgtgtctggaattgtgaatgtattgatatcatcagacaagggactgactggaacagagactggggaatctgggatgtggggattggggctgctggtaagtgggttgtcattttgtctgggaggcagtgcaatgcggtgcagtgggtggcccaaagcccctcccccaacccttaaccagctcctaatccccagccctgtctctggcttcggcaatggctccccccagaggcacctgctttatttatggcttctccccaactccccacaggcagagggaagtccattagtgtgtttgcagactctgccagctctgagcagatgcaaagcttatttgcagactgtcattgccctggcctcctccagagactctcatgctgggctcagccttgtgcctccaagagccacctccctcaggcagccaccggtgcaagccgctttcctgatttccctaagcatagtcttggcttggagttgggaaaattaaattaaatgccacgaaggaaccatagcagtgcattgggccatgttgacagtagggaatgaagtcttctctgtcgataggagttcattgttttgacataaattagggaggcattgagagaaagtggaaaaagtcttgacctgagaacctgggacccaagttcaagtctctgttaggctgctgagtatcctggtgatttggggcaacagtttattgccttctgggcctcagtttccaagctgcacaaggagctgtagacaggcttggaatccactccaagctccagaattctctgatttgaattttggggatgtttctttcatccaatgagctggggacaaagtgatttgtccaaaatggcttggtaattctgaaattgcctggagattggcctcactggggtacaaggcactgaggaggtgagacaccagggctctcagtctcacctggcctgataactctgctgtgtgaccctgggcaggccactttccgtctctgagcccattttctcatctgcaaaatgggaatcgtaatctcctgcccatctcctgagattatcaggagaatcagataagctgatgaatgtttcatatgccacaggaatatgtatttgaggggtgcgattgttatcattttgtcgctgttatccttttcagatgtctaggcatgcacacttgccagtgtaatacaagaatatgcccctataaggtacagagcccaaacacgtcaatttaactacataaaagggaaataatggtgcttccatgaataatgaagagcccttcttataatttgtgcttgttcagttccacaccctcataaatccaccattcctgtgtgtgtgtttggtggaaaaacacaccacagacatacacaaaagcctcttgagttcttttcaactgggacaggagatgacacacgttggcagacagaggctgatctctgtgtatccaagaggagtcgagccagtccgagtacatctaacaggtcaagctctgaaatgaagaagcaataagccagtgaaatggtactatcaccgaaacatgattgatcaattgaattctatcagagacagtggacagtgagattaactcaggcctgataggttcaatgagttaaagcatgatgttcatttcagcttcatttcaccagtctttgcttgtgaaattggtcaatcaatagaggttgaagatcatatatatatatagatatcggggaccatcttatggggaatataatcttggtagttggctcctggctggggctgcctgctgcgggtaatggagacagaacagggactccatcagccccatcgaaatggcctgatatcttctccaaatgaaaagtatttttggatctctgatgatttatcttttttttcctccctctcactttgatctatgacaaaacccatacccatcttggagaaatttagtgatttctcctgaaaacatttgtgcaatgatcagatagatacacttcaaatacgaaccttctttttagttatatcgtccttgggaaaaaatacagacagtaatttaaaaactcaaataggggtaatgcaaagatatcagagtaaatatgatttttaaacccttttatttatttatttatttatttctgtgcagtgggggatgggagagagactgctgtgtgcatgaaggccataaaagggatgtatgcatcccttccaggtccttccaggtataattaaaatgaagcctttcacattctttgatctcatttaaaagcacaattcacagaaacaaatcacccttttgctcctagtaatatttcatttgcttcagaatattttcactatggcggttaacatcctttctaattagtgtgcatatccctctgtaaggtggagtaattagggactactgtatgaggtaatggacttggacagtatggattagagagaacagacttgccctgtggcaatgcaccaggtattacttcctttctgcctcttgtttcaggtcatcttgattcattttagcacagagaaatcccatctcttcataccaacaccatgagagcttcaataatgtatttgcactgtttgtatatcagagtgtatattaggttctggataatggatagtgatgctgaacagctcgacagagagggaagagcctctcacacttcactccctttcccctcctccaactcctgaattctaatcatgctgaattatagccgttcccctgcaccatgctttctgtgcctccaggctgttgcagatgctgttccctctggttggaatgcaattcctcttccctgggcatttctttggctaactccatccttaagacttagggtaaggctggacatggtggttcatgcctgtaatcccagcactttgggaggccagcctggccaacatggtgaaaccccttctcaacttaaaatacaaaaaattagccgggtgtggtggtgcatacctgtagtcccagctacttgagaggctgaggcaggagaatcgcttgaacctgggaggtggaggttgcagtgaaccaagatggtgccattgcacaccccagcctggatgacagggtgagactccatctcacaaaaacaaaacaaaacaaaaaaaccccaaaaaaaacaaacaaaaaaagactcgggctacagggggcctttcttgggctacacttgcccctagtctggattaagtggagtgagttagtgtagggctaggagcagactctggaaccagactgcttgagttcggaccctagcttctccacttcttagctgtgtgatcttgggcaagttactcttttttttcttccctccccccacccccccaatctttagatcttgtgactaggcaagttatttaaccccctgcctcagtttcctcatctgtaaaatgggaggaagcaataacagacttgacatcttagggtttttgtgaggatccaatagggaaggtgcttagaacagtgtctcgcagagtgagctctgaatagggtctggccacttgcattaggctcccagggctgtgtctgcttctcaggctcctagcacttatcgcactacattgcaattattcacttgtcttcatcctccagtaggggacggggctaagacttgaagctctctctagctctggtgggaagggcagggccagatacccagtatgtagctcagggatcaacggatccaggaggcttgaggcaggagtcagaggcctcatgtccaagctcaccttgaatctgctgtctggcccctgacagatccctttgccatctggcctcccgtttgccatcctcgaatgtggaatcaccagcccttggggcctttcccacactgacagcctgtgactcattgggtaacacccggcacaatcggattcactctggtcaaacctgaacgtatttggcaattttacaatttcgcattttccttctccaagaagaaagattgagtgaaacaaatggctgaataatggtagtttcagtggaaattttcctccatgccaccttgatttttcttagtctgcagccccagtttaggacaggatttagaaaatgactcagaacatttgtttttgttccaggctaccaagggacatttagagcctggccaccctcatccctagcatggggcctggctcatagtagatgtcctagaagcgtttgccaacttaacctggttgcctgtacccggaatcccatctcttaccttggcatcttgtttcccaggcctggctctgatcgtcccttctccaggacccccctccctgttgttagtcatctctggatcactctaagcaccccaaacagcaccatgcagagaatagaagctctgtaatgagtttgagcttgagtctgtgaacagcattttgttgttgttgttggactctgagcaatatatgacttgctgcattttctttttggtatatgctgccagggagcttagagctcaactgagtttagtagtttatcatccactctagttcaaaattctatgaacagcctcaaatctgtcttagaagtaggcgagacataaactcttagttgtttcactttttcctcctctgagatcactgatataatagaagccactcctgagttctctgatgataccagcgactgtcctagtgctgaattcttctgagccatacagccctgcaagccctcaagccttcctagcttaataattcagtcaacaaacattcattagcatctcctatgcttgaggtaaatgggacatgggctctgccctcagctcatactttagcaggggaaaaaaatactaattctggaaacagctaacgtttattgagcacttactatgtgtcaggggttatgctaagtattttacatgtattctcattaaattattttgtcaactccagatactattattatcccactctacagataagaaaattgaggattagagcagttaaagaagttgctcaaggctgggcgtggtggctcacacccgtaatcccagcactttgggggcccaaggtggatgaatcacgaggtcaggagatcaagaccatcctggctaacacggtggaaccccgtctctactaaaaatgcaaaaaattagctgggaatagtggcgggcgcctgtagtcccagctactgaggatgctgaggcaggagaatggcgtgaacccgggaggcggagcttgcagtgagccaagatcacaccactgcactccagcctgggcaacagagcaagactccgtctcaaaaaaaaaaaaaaaaagaaattgctcaaatatcatgggcttgtgagagacagagttctggaattcgaacccgggcccccatgagttcagagtgcctaggcttccccactgttctgtaccaggtctgccacagtgcccaacttcactttagcacatgtaggagctgtgcaagtgctctgctgtgttatcttgggcaaattacttcatctctctgtgccagcttccttaactgtaaagtggaggttccaagaggactgagttcacagaatggtttgtgaagagtagaatccaggccatagtggtggcccatgcaacgtgctgaggacacccagaagaaagggtggtgaattcagcctttggatttggaggcaggcttcagagaggaggcagcttttagactgagtcttgctgggcaggagagaagggcatgccagcagagggagcagaatgtccaggggcactggggagcagtggggaagagacacatgagggctgacaaacggcctgctgggatggcattgcggggtgaagtggggggtgaccctgactagaggggcaggtcgtcgaggcctcgggggctcaggctttgtccccggggagccttggaagggttttcttgatgaaaatgaggatgacagcagctagcattatttggacactaaactctctgccaggtgccgtgttaaagtgtcatggagattatctcatttaatccttataaaagccccacgaattgtcctgcatactgttgttttcagtttacagatgaggaaactgagggctttcatcttagcagctgacaggaagagtaaagggaggtgtcctgagtgctgaatctgcagataagagacctaggtacaaatcccagcgttgccactttgagctgagggacctcagtgactcaagctctctgagcctctgttttctcatctgtaaagtggaataagaatacatacttcatagagatgttctgaaggtcaaagaaactgaaggatgcacaaataacttggctcagtgcctgacactgaacagcgctctatccggggtgagaacagggggtgtggggagctttgcagccctgttatctaatgtcagccccacttcattctttgctagggacagacaatgctctctcagtctcgcacaaggagttttgctaacatagccccagaacaaatcccttggcttcctatcccttttaaaaaattatttggtttttttttagagacagagtcttgttctgtcacacaggctaatgtgcagtggcaccattgtagctcactgaagccttgaactcctgggctcaagcaatcctcttgcctcaacctctcaagtagctgggactacaggcctgcaccaccacaccccagctaacttttaaattttattattattattatttttgagacagagtcttactctgttgcccaggctggagtgcaatggcatgatcttggctcaccacaacctccgcctcctacgttcaagtgattctcttgcttcagcctcccgagtagctgcaggcatgtgccaccacacctggctaatttttgtatttttagtagagacggggttttaccatattggccaggctggtcttgaactcctgacctcaggtgatccgcctgccttggcctcccaaactgctgggattacaggcatgagccaccatgcccagccatttttaaattttttttttgtagagatgggggtctcgccatgttgccaaggctggtcttgaactcctggcctcaagtgatcctcccacctcagcctcccaaagtgctgggattataggcaggaaccactgctctcagcctgaaataatcctttaaagttacaaattagcatggtctgaatttggtgggtgtctactttataggttgttttgagaattagccattgcagccacctgaagatgccaattccaagctcattggactcacttgacccaaactggaaaaatgccccaagtcacatcatttcatcttgccagtcaccccagctctgtactcctgtggcagatgaccatcaggacctgctctgtcccccatcttcacaagggaggcaagtctaggcatgcaggcagtgccagaggcctgtggttacaagcagcaaactgggccgatctagagacagccctggaccctggggtaaggtgggggtgttgtagtgcataaaacaggaatgggatctgggagttattttcacagtttttcctttcctttcctttcctttcctttcctttcctttcctttcctttccttttctttcctttcctttcctttcctttcctttcctttcctttcctttcctttccgttccgttccgttcctttcctttccttttctttctttctttcttctttttttttttgagactgaatctcgctctgtcagccaggctggagtacaatggcacaatctcggctcactgcaacctccgtctcctgggttcaagagattctcgtgcctcagcctcctgagtagctgggattacaggctcccgccaccacgcctggctaatttttctatttttagtagagacggggtttcaccatgttggccaggctggtctcgaactcctgacctcaagtgatttgcctgcctcggcctcccaaagtgctgggattataggcataagccaccgtgcccagcctattttcatagtttcaaacagcttaagagtaaatatatccctgtgaagaaaaaggatttattcctgtctctgactttcccccagcactcccaccacccccaaccaacaggcctctcatcacaggagtgctcattcaagaggatgggatccccttggttggctcaggcagtctcttagcggtgggatggatcatagccagggagtcccctataaagactgcacaacaaccaaaatgggaaaataagtcaatgctcatttaatactacttagcacacaaaaatctaggtggattttggtggagaaaggggttagaaatgaccaactcagctaccttagcttactactggggtctctgaggctcagagagggagaggaacttgcctgggcccacacagcaagtaacagcagagctggggctagaacccgggactgctggctcccaacccttttcccactgggccctgccacggccctgccatgctaaggagcagctgtgaggatgaaggaagctgtataagggctctggctttggcctgggttctgcagagaaactggactctgagaaaggctggaggctgacctggcggctctagcctcttttcctggggctcttcagcctccagatggggttacatcccaaaagccatgatgctaggagggatttcagagattcctgtttgtttttatattttcctcctagtgagcatctgcagacataaagcgcatgatgatttttaaagaaacaaaccagaaccctccaagaaaaatgcaaaacccctgaatctgctgtgctctgaagaaaatgcaatgggtttatgatcttttaagacacacaagagacagctttctcttgacagatgggaatctgaggctattttgcttcttccctttttgcgtgaccagacccgattgtgtaaagcttttagcttcaaagctgggttgtgaataacattggtttaacctgaaatttaaagccagcatttctttgctccccgagacggggcttcctgccccttgctcccctgaagctagcttccagaatgttaattctacgagccatggttgactaagcccagcactgggtctattacatattatttgatttggagtagaaaaaaaagatttaaagataccatgccccctgtacacctttgtacttttgcccgtgtctgtccatatatttaagcataccattcactttgtgagttcagacttttctccctggaataaaatgggtctgagcatttctgtagcctgcctccaagaccacattctccaattaagtcagacagcatcttcatggtgcagatgagaaatgctacggaagcttacactggaggcctggaggttcagacctgcccttgtgcaagggctgagttttgggattaatttttatagctgtctctgagcatataatctgtttgttggttcattctcactgagtacccactgtgtgcgacaccagaggcaggacagagggtcccctcttaagaccatgcgccttttcagtcagagtacttatcttggttgatacttgtacctttactagtccgattatttttcagttactgtttgccacctcctctggacataactccatgaggacaatggctggctcagcttttgcccatcactgtgtccctggcattagcactcactaagcttggtggagggaagaatgatgaatgtgtgaggtcaaatggagggatcctgacattttcagacagacatgcagagtgatggtgcttgtcacacttgtcacaggtagtaccaattcattcatttattccacagatattcgctttggaggagagagagatgaattacctcccacctttaccccgaaggtagctcatagcacagtgtgggagtgaagggcccaggggatgtggttcctaaaataagggagaaagtggtcagagccctaagaatgggagctggaggaccagctggggcatgaaggaaggcatcctggaggaggagacatgtgtgcttctggctgtgtctggagaacaatgcccgtgtccatgggagatggtttccattccatatgggcacagtgaatcacctgcggctgaacaggtgactcagcagatccaccttcaaacacccacaaatgcaagctcctacctcccctggcccctagtttctaccaaaagaggaggcttgggagcagagtttagaaagcatggcctgacctgaaggaacgagcgattcgggccctgggactgagaaatgtggagggcacatgtttccccagcccttcccgtagctcctcaagactcctgcagcaaggctcagatcctctctctggcccctggggctgtctggctcaatccctcccagcctctccagattctcctggggcctcttccctctctccctctgttcctttcacccccttctctcagggcctttgtacgagcatctcctcagtctggcaccctctctgccccatcccctctccctggtcactcctcacggttccatgcagttcctcttggagacttccctgattcctcccacaggaggccactcccctctccattacacatggtcacatggatatatttttatgctctcttttcaccctagcatcagtcaccgttgtttgtaatcctatgtttattcctgtgatcacttgactaaagtgggctgccctctctagactggagagagagaggcttgtcttggtcatcactgtatcccctgtttttgtttatttttaaaatatatttacttaaaaaatattacctgatacagagtaaatattttatcaatatttgttaaaccaatgaataactaattatgtgttttggagtgtccaaatccttcttaaggaaatgacagacactattgccattatttccctagtaaagaaagcaagcgaggtgctggtggggtgagagtggtgaggggaatcgcgggacagggtgaatgcccggagaggcaggctctgcccagctcgcagcccttcgagggcagtccacccacctcggcctcccaggtgccagaattacaggcatgagccacggcgcctggcagcctagatatccttacaggctcagctggcagaggctatggctgactctcaaagaaccagagcaggacgcagccagtctgcttctggggagactgcagagaggggcgcgtgtccagcgaggctgcctgtgctgagtctgtgtggtgtcctcagggggagggtctcctaacaccccctgtgtgtacacttgagggcctgtgtgccctgagcctttactctgtgctgggctctactgggtgaccagacagtgaccttgcccccaggggccctcagtggagccaccctctctgaactttgggctctgagctgtggaaagagcctggcccatgagtcccgggggagagggatcaagcctgaggactcctctgggaggatggcctggctggctgaagagacgccccctagaggggcagagttgaggggatctgatggagcagcctgggtgggccggaggagctgggcactgccctgctggggacagagccaggcctcagcgggagttgttaggagatggctgacaggaaggaggtttcactgagttttgggcccggctggcagggtcagggctgggaagtataactgaagctggtggagggagaagctcttgaaagtggatgggccccttctgacaaggaggaacttggtggtgtcctggggaccaaggcccacgtcatgctttagcaagagtgactgggaccaggatgactgggcagagccacagctgagtaggaaaaactgagccatctttcctggtgtgcgtgtgcgtgtgcatgtgtgtgtgcatgtgtgtgtgtgcatagaacctttgagaaaaggatcatttggtgggtgctgaccaatggaagaacactgctgggcagatagactgggccgtgagctcccatacctgctagtctaggtgaccttgtgggaatggtccccatggggatgggccatgatgggagaagggtctctgaggatgatgtcctgtgggcaggagcaggcacctgtcttgtggaaggccaaggtcatgggctgccagaggaggggcctaggcttcaggctggggaacgttggtcagagagaccaacttctgccttggcccacatgtgggggtatctggtcactcaggctgtggcccagcctacagtatcctcttgggtcaaaattggtggggaatccattttctcagagggctcatgagctgcctccgaaggcccttcctatagaggatgctgggtcctctgagcctgttgacttctacgagggatccgaaaggccaaaactcaaagctgctatctttgttcaaatgtcagccctgcattgcagttgtccccagataagtacagttgaggaagcattgacttctgactgagtcttggtgacaccacatctcactgcttcatggtctttagtctggcctcattcctcacatgggtgggagcttgacgtgacggatgaagtctagtctagggcagcagtgcactggtgggggcaggggtcagacaaggccttgagtaagggcacctttcagcatgagagcagacccacgctggttttccccagggcttcctgactgcaaaggcagatgcctcacctctgggcctgggtttcaagaagcctctggtcagccttgcgtgagcaatatggtcccagagagccccggggaatgatgtacccccgaggccatttcctcacgggaaacatttgccctctgtgcttgattttattttgaacagttcaagcttgagactcaacagaagatatttcatcccatttgtttctttattgataattcgtaatatttcttttgacatgtaagcatcatcaccagagactgttacagtgtgaatagctaacaatacagaacacagagggaatttaatcttatacttagttaatttacattttgtaataagcagtacattcaaacttctgaaaccaaaccaaaccaaagaaaaacatgccatgaaaagtctctccccctcacctccactcactcacttcctacctccctgaatgagcaaccactgtaaatgtttctcatatatcctttggagagatttatattgcacatcgtcttattttcttccttttttacacaaaaggttgtacattatacatgctgtgctgtaccttgttttttattttttaacataacaatgtatcttgaagatcttttcatatcaattcacagaaggaagcctcattccttttcagctgctgcacagttttccattatgcaagtatgcctggctgagttaaccaaccccccacaaataaactcttgggttgtttccagtcttttgctacaagaaccttgtacatacatcacttctcacatgtgtaagttgagctgtaaaataaattcccagaagtgcaatcgctatatcaaagggaatgtgcatttgtggctttgatagatttgtcgacttgtctagcacaggtgttgttaccacttccaccagaattgtatgagagtcccgttttcctacagtcttcctagcacagtgtttcactgaccggtcacatgatgtggtagcaaatgtccagggtaaggacctcaactctgggaaaaactgtacctcccgggaaggtctttaggacaggaggggcaggagcaccggatgactaagcctgtgggtcagcccaagctcgaatcctcaggcaaaccaataaatctctctaggtctcagtcttctcatctgcaaagtggggaaaataacctaccttgagggtcatcatgaggattagatgacatgatgcctgtcaaaagggctttgcacagtccctggcacatggctgcgggaggctgactctgaacttaccagcaggtgaccttgggaaaggcagtgccttacctgagcccctgctggtgtattctctggtcagggagggagttggggtcaggtcctcttcatagtctcagggtctgacctgtctttctttagcaacgtgtataacctccactcacccttcctctctcctgctcatcaaaggtattcaggagtctccggtgccgaacggccactcgcttccgggcagagacttcctccggaagcagatgcggggagacttgttcacacagcagcagctggaggtgctggaccgcgtgtttgagaggcagcactactcagacatcttcaccaccacagagcccatcaagcccgagcaggtacgcctcgtgatgcacgcccaccacacctgccaccgccacaccggcccagccaggttcctgaaggcagaggcatctggcggggtgtgggtgagggcacaccaggttctgctcagagaggtctcttcagtgttcttggccaaacttgggcagtcgctacatcctataaggtcgggagggcttgtctgggcctccagtggcttcttgccctggtgcctctgtcgctggccagccagggggtgggtgacttctctggctgctctggtgtcctttccaagggctctttggacagaagggtgtaatgatctttcgggccacgtaaggtggtcttgggtcagtatcttgtcagtcagggtgatggtggaaatatgtaaccagcacgcggcctgggggctcaccggccgtgaacaatggaatgacggagcgggtgggtatcccactgtctgccctctcaccaggtcgccttgtcattctcttagtgactgaatccaaaattctggagataaagaaatgtctcattgcacaaactcccacctgggttatttgcaagagagggagaaagcaggaggaccagccctggctgaccggctgtctgctataccctgggcagagtagtcactacctgtggctatagagatgagatcacgaggctcggcccagtgagaggctcttgaggcctgactaagatctctggactatcagattcagttcataagactatttcctgacacccagtgtgtgccagggccttgacaggtaaccttgcaggctagacatggctctggactgccaagagctcccacctggtgggccaaccagagagaccctacagacaacaactttcctcggcactttcctcgctggtactagtggtgagaactggctgcactgagtttcctctaaatgctaattagaggatgcttctgaatcttctccaaaaagtcagtccaagcagtgtagcctccctgcacagctcccatggagaggcgaggtgctggagagaaccgtgtggtgagggaagagcagggcctctggggccacccatctatgacagtctgtctgtgtctgagcagtttctatgagagctcttacagaccttctagccactttgttttcagatggtaaaaccaaggtccagagaggcagagcaacttgcctaaggccacgctgcaagacgcattcacataacaaatatgatgagtgtttactttgtgcaaggcctggagccatgcactgggtcacatcagtgaacaagatggtcttggacctcccctcagggagcctacagacttgtggaagaatcccaatagaagaattacctaaagggtcatgggttacaggtgcgcttggtgctaaggaggaggtgtctgaggttctctgagagcctaaaggaaaggctgagccagcctggaggcctcagtggcctcctgggggaaaggtatttatgctgagcctgaaggggttgagtggagcaaggagaaggggtgtgggggtggagggaaagtgcctggcagaggggacagcaagtgcaaaggccctgagttgagaggaaggcggcaggaacgaggaatggagagagccggtgtggttgtggctcagggatgggcgggcgatgatgctggggaggtgggcctggtcttgtagactgggttgaggattttagtctttctcttacaagtcgagtgacacctctgttgggtaggacatggttatggtgctgggcatagccgcccccacacactctagatcttggacttcagggaggagagtctgtttctatcacaagcaccctctctgctctgctcagagcccttctgagagacggcagaaggcacattttctctgacacgggaggagagtgagaggggcctcgatcaggaaaccttcctggatgaggcctgtccttccctccagaatgtggaagaaagtttatcttctttttttttttttttttgtgagctggagttttgctcttgttgcccaggttggagtgcagtagtgtgatcctagctcactgcaacctccacctcctaggttcaagtgattctcctgcctcagcctcctgagtagctgggattacaggtgcctgccaccacgcccggctaatttttttgtatttttagtagagatggggtttcaccatgttggccaggcttagtcttggactccggacctcaggtgatccaccctccttggcctcccaaagtgctgggattataggtgtgagccactgcgcccagccagaaggtttatcttttttctttttttgagacagaatcttgttgtgtcgcccaggctggagtgcagtggcgcgatctcggctcactgcaagctccacctcccgggttcgcgcctttctcctgcctcagcctcccgagtaggacggactacaggcacccgccaccatgcccggctaattttttctattttttagtaggggcagggtttcgccgtgttagccgggatggtcttgatctcctgacctcatgatccgcctgcctcggcctcccaaagtgctgggattacaggcatgagccactgcacctggccagaaagtttatcttctaatggctgacaagatcatgtaattttaggggtaacaggagccacagaggcaagatttcaacctgttgtttttttagaggcccagagagaggacagggcatgtctgaggtcacccagcaagtgaacagggaagagcggggatccaggcctctgcactccacctggcctctgcagcacaagtgtttctgtgaaccccttattcacacagacactccgtgtgagactccctctgtgtttcacatgaccgtcatggagactcagaatctgcaccataactcctttagctcagagtgcccaggaagaccacgcagcctgcaagacctcatccctgagtggtctggaagccgcccatggattcactcactcacctgctcacatgccactcctctaacttcttccctgaacgtgggctgggagccaggcacagtgccaagtgctcatcagctctgtccagtctcgcaggggcagcgtgctgtggactcagagcccgcaggacaagagagactgttcagagggtcctgatgaggtgtcagccagagagggggatgttacctgggttgggagcatcaaggacaatggcactgagggggcagtgttggatggggggcttgaaggacaggtcccatgggctcatggagagatggggtctgatggggaggagacctgattacaaactctgtgaggactcagcatctccagtgtccttcagaatgagcaggcacgtctgcaggcctgtctctgactgtgcgctctgagacggcgactgcaggcgaactgtgtggcaggataatgactgacccagtgttttctggttaatctgcttcacctccctgtaatgtgttttaatgaggagagatggaaggtgaggagacggggctgccctgcacccacacacaggcactggactatgaatgacataccctcgtgcccgattcccaatcactttggacaaatgatgcctgagcaaggggccgcaggctgggaagggatgtcagtcaagggtacaggttccttgagcccctcatgctagctctccaagaggtgaatgttccacaggcctcgcctgtgagccccagcgtggcatggcggtggtgacaggaagggggcctgaggtgctggccgcggaggctggctgcctcttccattttcgagcagattgagctgtctcagtgtgtgtctctgtggcctagtgccctggatgggggccttgctgtcactttcgctgagcagcttggtggggaacaaagagcacttactggccttggggtcgggaagcttgatttgagtcctagctctgccctgccgagcaagtcactatttttctgggcctcagtttccatatctgtggtagaagtgatcatgattttgatgacgacaacaacaagaacagctgcagcagccgaaaccgaacgtgacgacagcgatcctcctcacctacacaccacagcgttcagttcacaaagaccgttcacatccatcctctcattggacccccgaggcaaatgcctgccaaacaggctgggcatgattcgggagccccattgtatagactagaacattttttttcacagattgtttattcaaggagtttccaagattgttgaaccgcagagctggaatctcatctcagggtcttctgtcttcatctcatgcaagatggttccatgggcctccaggtccaggacgattccaggggccagttttctggctagctggtttccagacctggcctatttcagtcagagtctgcctgtcatccagaactctcagaacttgccataggtttggagaggccacatcctcccggatcctcccaccctgtctcccatgggaagaacattcctcattggggccaggcaggggtcctgacagttactgctgttagctcggagcctgccccacttgcagcttttcccgccaagatctacctgggtgggtgggcccaggctgctggcttttgtagggaaatgtagtaaacgctttgccctgggtggaaggcgttaatgttgaccacgcctgggcaatgaaacacttccttttcaaaacggttattgaaaaagcaattctgttttccctacatatggagtgagtaaaaatcacgttggaggaagaaaagaaaagaaagctgctggtggcgagtgtgtgtgcgtgcacgtgtgtatgtgcgtgcgtgtgtgtgtgtatgtttccaacagtggtatctgtttcagtaaaactcccgttgacgttgtcgtcggcgcagcgctcctgttgggagcgggtccctcctccggcggccacaggaaggctacggagcatagcctgccgtatttactctcggcagactattaaccaacaccaggctattaatctggcttttgagccttcactaaagcccataaaagctcacagttgtcaaatggagttcattttaatttcctttcaatcacagtaaattattcaggtgataaatcagctggagcagcctcctggctgtaatagaaaccctaattcctggctaattatccatcccattgctgccaatagatcaatacgggtgcaaaatggaacgggccagggccctccctcccattgggccagagacagagagacagctggggaaggggatgtgctgctgacctcccagggagttcaaaggtcacaggaggttaaactgggagaagatctgccccttgtctaacagagaaaaccactagaaatgcctcctgctctcatcagctgctttgccccctcagtggtggcacctctccaggctggtgggccgaacagcattgccttctcctgtgggcatcctgttcctgggaaggggctggtttgtgcttctgagcatgttgagcttggtcatcagggatggcctgaacctcgaccatgaggcagaaaaagggctgggtaccctggggagaaagaggatgtggtttttttcttcagagagctcattttccttcattatggatctgtgtcccaccatgaggaggagaggaggagaggaggaggtggggagacaggtgggccaggctgagaaagaggaaggcttcctggaggaggtgccttgagggaagggcagaatgcagccccgtggcaatagcagatggcgggctggagaaggcattctaggccgaaggagcagcacaggcaaaggactgtgggaagagaggaatgcaggtgtgggcagggagctgcaagggggcctggatggttgaaatgggggtcagtgacaggaagtcaggtacaatggggtggaggagcaggaggggacctcaaccacagaggggtggaacgcagagatgaggtgtgactgctttgagggcagtgtgtcccagagcccgggatctgtggcctggattattctgctcaccttggaagcaaccttcactgggacttcttgcctctcgtcctgttcctgcgactaccgttggatctctttcttcttgaagcctacctcctataagagttcctcatggtttcccaccattgaaacccaaccccggaccttcatccccatcacgccccttcaccgtccccatgtccctctgcttgctcacaagaccctcgggctgtggccaggcctgacctttcactgcccacacaggctgggctgctcctgtgtccaagggggctgctgcccatgacccagcctctcccagggctggcgtgcgcatgtgtgtatgtgcatgaacgtgtgaatcccaggtgaggctctgagcgtgtttcgtgacaggtactacagttattactttcttaattttgtggctcactctctaagctgctgctcactgcttccctgcctggaacattctttcagcctgtttctaaatcctaccctgtccgggcccaggaggagtcctgcctgccctgtgaggccttcaatggccctgcaccaattcggcctgcaccaacttgtctcttatctgagctcataaatatattgggttttagtgattgctgtagtaattgctgtagctactatgtattcattgcttatggcatgcctggctctgttctgaaaagactcttacttaccccacctcattaccaagtcacaacaactcccatcatccccgttgtgcaggcagagtagctgaggcttggtgagatgagtacagtggcttagccaagggcacacagtaaatatggggccaagatcataagccaggtccttgcctccagagcccaggctggtggccattggggtaccccccagttgcagcacaggctgcccactgactcttagagatggatagtttcctggagatgcaacctgggggttcaatttgatcatgcaagcagctgagcatgagttaggaggtgctagcacggccacatgaaccagtgtgatctcaggaggcataaacagaagtctagggtggtgactgtcccattctcctctgagctggttctgttcctctcaccctgcctctctcctcgtggggctgtgctcagggccaagctcctcctttgcaaaagtagagtttgtgcggaagaggcaactgaaaattcttacctaggaagaatgactggagaaatttgggccatttggtctgatgaagagaaggcttgaggttgtgggcaaggaagaagacaggctaaaagaactcactaatagcccaagctttctgacagtggaatgggcctccttgttaagtagtgagcttcccattgctggaggcatgcaagtagaatctatccattttcatacatgtggttttagaagtttaagaatccagagagcttaattatctaaatgccaatgcctttccaacctgaaagaatgattctaagataagaagaatgagaagggtctggtgggaagaggggaaggagtagagaagatcttttacactgaagcaccggaaggggcactgaagggcagttcccccgaggaatcctcactagggtggacaaagagggtcagtctgcatcacaggagccatggccctgagcagcaaaggggtggggactgcagggtcttgggaggccattggatgactccagctcctctagtgcagggagcagggctggggttctggtgaagatgccagggccaggatactggtggctgctgtcagccttgctgcctccagacagtatctggcttcctctgcccaggagttcagggccaggtcccatgggggaggagtaggctggtcagcacattagcagaaagtggtatgtggtaagttggtgaggtgcgaggggacttgtgtgctggggtcagggccttggattgtattaccttgagagcaaagagaggcctctgtgagattttaaatcagggaatatcaggatccaatccaacacagagtggaagattactcttgcagctgtgaggagactcggagagctaggggaccaggaggcgattgctagggtataagcgacgttgctgtacccctgaagatggctgcctgggtctagcttctctccagtccgtagtattgcccaaaaagtgtggccccatcatgcacggcttctctcctttcccttctgctcccccacctcctcacacttccccccaccaaccctccaagtctccagccaggcccccgtagttcctagagttagcttgaatttgattctgagcttcctgatggtcaaagcaaaatgggaaatgcaatcagttgtgttcttctcattgtccaccagtggaggagagtccagttccttaatggaagccatttttttttttcctgacatttagagtggaaggaaattttcacatgggttttcagtgggtagaccagtgaggcaatggtcacggtcctcaacagcacatttagaggccctgcagtaggttgtatagagcttgtcttatggatgagtatgacgcccacatgctaatcagtgcatttctgcaggggcagggctactgtgaccatgaggctcaagaaagcagcttttctgatagcccaacttaactaagaaaaaatcccagaccctctagggtagctcttcttagattttccaacttgatgctctgggaagatacgctttggggctttgagacctcctgccacccagagggtacccctgggaaaatgtcctccttaggtggaaaagtttcagtctattggaaggtgcctccagtggtcaccatcgactgcatcagctcaactcttgatgagaataagaatttcgtagtttgcgttgacttctctggtgggagcttggtaggcagggacttggggacttgaaggagggagaagtcatatgttttagagattaaagaaggagatggtaggctggatgcgcttttgttcaggacttcccaattaccatagcacgcatagaaagtgttaatatttgcgtaacacactgggataaacaggatgctcgtggctggaggcaactggcctacaggctttagcttccccacatgtcccctggtcatccaaaggctgacagagtttgatatcttggcacactatttgtaaggctctgcttttgtggaaaggaagagttggggtttggttggagctttgaatcttctttcttattcttcctctgtagggttgccaacctagcaaaaatggacaaggtattgatttgggtactgaacaagtacccaaatactcactccataccttcccaaccgtttctaggggctctgaaaacctgagttgcgcagtaccacttaggcttaacttaagcaccccttagaggagacctaaagtgaagcttctggcacgttatttcccaaactgactgccctgtagagcagaccctccctggcttacccacccagttgcaggaggggaagatggaactgagagacggacttaactgggccttcctatgggaaacctgaagcgtgtagaagcttgaagttccagagaagggcttctgagccgcaaggcacagcgatgccgcccaccagcgagcacagctaactgcttgtcctgggctctgaccagtcggataagtgactcctcccatggcagggagctataagagggtggaagtgggggggacaaggcttctcatcccagttgtccccagcaggaggagaggaggtagaaataccttcctgttcactgaactgcttaagatttaacttggacgctattttgccttaggaatgagataatcacaaggattattctggaattgttgctccctagatctctagaagtgccgggtgcctctagaccagccatactctcccttattctatttattctattgtcatcatctcaaagtgacccaaggatgaaaattacatggactctatgggacctcacttgatttgctgccaagaatattgcctggggatgtccatttgtctctaagtagcttttgaaatattttctaaacagttgagtagtctttgtcttcctgtgaaccaagcacaaggacagctccccagtaaaaatcgttcctgctttgtaagggagggggatgtttgagggaatactgggcaaattgccatagtgaaaagcgtggggttctgggctttagtgatggctcttaggctagtcactctgggtcatggtttttgcatttagggtgggagattgccctgggtcatccttgagatccattctagctctaacattctgtgagtgataaaacaaatgggaaatccatcacttatttttattttgacttgtttacagtttttcctcctgtctgttccactctttttgatgacaggcaaattctgtgtttgtgggatttaaagattacaagtgaattgtcaaagagctgcctgcaccttgctcggttgttctttcattcatttattcattcattcatccaagaaatttttacagatatgccatgtcagtgacattgaccacctgtgctgtgttgtgtggcataaagtaacagcaattgatgcagccaaaatactgtgtgagaattgactttcgagtagagatatttcccctcaaacaaggctatccaatatttgcaattcaaaaaaaagacaaaagaacagctaattttggtcttacaccttgtttgttttgagggtgtgtcggaagtttgacttaaggaagtcggctatttacaaaactcttaaaaaacaataaaaataaacatttattgttttgtaaattattttttaaaaaagaacgtagatttctgattcttataacaagatctgagctattgtaggctctcctattgcaaacaattggatcaaatataacaataaagcattatatatatatgtgtgtgtgggtatatatatatatatatatatttttttttttttgaaacaaaaagagggaaatcctcagtggctgtaatttaaaaggcagctcaaagccagaactttaagtgcatgagctaatgtcctggtggcccagggtatgggttctcaatatagtctctagtgaacaggggctggggttttgatgctgatgttgagacaaaagatgtagtcttagaattgtgtgatatataggagtgggaaccaaagctcctgcaaaaaactagaaacctggaagggctgcacattccatgaaatgggcactaggtaagttttacccacaagctgaaggagtcagtagggaaacttgattctacatgggactcagacaaaaacaaaatatttctaaaaaattcaaggatggaaataatataaaaactggaggcatattagtgaaatcactgagatgcctcgcagatgcatataaaaaaactttcatctggctccttccacaatttagtatgtacaacatgcctacagaataaataataactactaaataagctcacaatttaaaaatgtcaaaccacccaagaaaatgagggaaagttaggagacataacgggcaaaatgagtattccaagaatccaagatagcagacaatttgaaagagactagaaaatgattaaagagatgaaaaagactagaaaccattataaaagaataaaatgccatgacaaaagaaggaacagactagaaagagaatcaaataaattttctagaaataaaaattatgatgtgagaattaattaaaaattcaactgatggattaaataccagataagacatagctgaatagaaaattactgatttgggaggagacaaagctgaggaaattctcaggaacatagcatagaaagctaaagagttgggaaatatgaaagaaaaaggtaagagataaaacaaaatatcatgagaaagtccaacatacaccaaatagttggcatggaaaaataaaaacagagaaaagaggcaatatttgaagaaataatagctaagactttgtgaaacaaaactgttgcaagaaacatgtatcattagattgaagaagcatactaaatcccaagcaagttaaataaaaataaacagacatctaagcaaaactttagtgaaattgaagaacatcaaagacaagagaaaattatgaaagcaaccagagagaaagtacaacatttagactgacagggctcttttttcagcattgttagaagtcagaagacaacagaaaatatcttcgagtgttaagagatagtaataattacctcgtactcagataaatgatcatttaacagtgaaggcaaataaagacattttcagataatggcagggagagtttaccactcacagactcttgctgaactgctaaatcatgtacttcaataagaaagatatgagagacttgcagtttcagctctgacaagtggagttttgacaccattactctgatctttacaataagaagtaaagctgaacaaaaggaaaatcaacacgttttcttggcctaagtcataagaatacagagttacagctgagatctgccagattaacatgaaaccttactttagtccaattacttcatgtatcatgtacaactttcaacaaaatattaggcaagaaaaaaaaaagtaagaagagacaaagtaagcatcaaaatcagactcagactttggaattattagataggtatatatttttttcttttgagacagggtcttgctctgtcacccaagctggagtacagtggcatgatctcagctcactgtaacctcaacctcccaggctcaagtgattctcccctctcagccccccaagtagctgggactacaggcagcaccaccacgcctggctaatttttgtattttttgtagagaccaggtttcaccatgttgcccaggctggtcttgaactcctgagcccaggtaatcaacctgccttggccccccaaagtactggaattacaggtgtgagctactgcacctggccaagatagggaatttaaaatgactataattaatatgttaaggactgtaatggaaaaagtaaacaacatacatgaatggatgagtaatgtaagcagagagatgaaaattctaagaaagaatcaaaagaaaaataaaaaacacagtaacagaaataaagactttctttgctgggctcatcactagactggacacagccaaaccaagaatttgggagcttgaagatatgacaatagaaactttcccacactgaaaagcaaagagaaaaaagaatgaaaaaacaaaaccagaacagaacacctaagaactgtgggataattttaagaggcatagcatatttataattaggttgccggaaggagaagagagaatgaagaagaagaaatatttgaaataacaatggctgggaatttttcaaaattagtgacagatgctaaccacaaatgcagaaaacttagagaacaccaaaatatctacattaggcatataatattcaaaagccagaatatcaaagacaaagagaaaatcttgaaagaagccagaggtaaaaattaccttacttatagagaaacaagaataaaaattacagtggatttcttgtcagaaaccatgcatacaagaagagagtggagtgacatattaaaagtgttgaaagaaaaagttcacccacctagaattttatatcatggggaattatacttcaaaagtgaaggaaaaaataaagactttcccagttaaacaaaaatggaggaaattcatcaccagcagacttggtctagaagaaatgttaaaagaagttctccagaggaaggaaaatgatgtagttcagaaactcagatctacataagggaaagaagggagttggagaaagaataaatgaaggtaaaataagacctttgatttttctattcttaattgatctaaaaggtaactgtttgtgtaaagtaataataataacaatgtatggagtgatttattacatatggataagtgaaatgatggcagcaatgtcctaagggacaggaatgaggaactgggaatattctattagaaggtacatgattgaagaggaatagtatcatttgaaggtgaatttagattagatataaacgtatattgcagactctagggaaagtactaatacttaaaaaaagaaatataattgaaatgctaacagaagagataaaatggaattgtatgacacgttcagttgaaaccagagaaggaagaagaggagacgtaaagaaacaaagaacaagttcaacaagtagaaaagttacaaacgtagtagatatgaatccaattatatcaataatcactttgaatgtgaatggtctaaacataccattgaacatattgaaaccccgtctctactaaaatgcaaaaaattagctaggcatggtggcatgtgcctgtaatcccagctacttgggaggccgagacaggagaattacttgaacttgggaggcggaggttgcagtgagccgagatctcgccattgtgctccagcctggctgaaagagcaagactctgtctcaaaaaaaaaaaaaaaaaaaaaaaagggagattgtcagagcatattaaaaaaacagaaggactcatccatatgttgcctacaagaaggatatgaaatacaaaaggagagaatgggatttaagaagtgatggtaaccaaatacatagataaatgaacaataatctaaataggtttgtccaataaataatatcacctgtaaaagtaattcatagttttggaagtttaaaacaaagtaggaaaaaaggcaataataatatgtaagattgggaggaggctgatctaagttaaaacattctaagatttttgcatttcataggaggaagatagatatattgataaacgttaggctgtgttaggtcaaggatgccagtgagcaaattaaggataacaattaaagggtaaccattatggtaatagaatgcataatgtgcaaaccagaataagcaaaaagaaatatttagaatacttagtggatccaatagaaggtaagggagaagaaaggtaaattaaaaatataaaattacacaatagaggatagaaataaataaaaatatttgagtagtctcgataaatagattggatttgcaagataaatagaagacgtgtaaaataaccaagacccagaaatgtggtgtttttagtaattaacctaaaacaaaatggtactgaaagtttgcaaggactgagagaggaaaatatggcaatactaaccaaataaaatgtgatagagtaatctcattatcagatgatataaactttaaggcccaaagtatgctcaaagacaaagaggattattgcttaatgataacaagaacaatttgtaggaaaatataacaatcctgaacctgtacgcacttggcaacagagtctctaaatatttaaagcaaaaaatgtcaatgaacaaatgaacaaatcccatgatattttggggagactaaaatgcccctcttgttaatgaataaatcaagctgacaaaaaattggcagggatatttgtaagttttgcacaacataattaacaagcttaatagaatagacacatgaaaggacaacaattagagaatactttgctttttgaactcctggaaggaatacttccatgaatgcccatttatcctgccccctacttacaccaccctaccaccctacttccctacccccaaatatgtcttataaggaacttgtagaggaagtggaactggctggcctatagaaaagaaaattcatgcagtggctcacgcctgcaatcccagcactttgggaggccgaggtgggcggatcacgaggtcaggagtttgagaccagcttggtctcgagatggtgaaaccccgtctctactaaagatacaaaaaattagctgggcgtggtggtgtgtgcctgtaatcccagctacttgggaggctgaggcaggagagtcgcttgaacctggaaggcggaggttgcagtgagccaagattgcagcattgcgctccagcctggatgagagggcaagactccatctcaaaaaaaaaaaaaaaaaaaaaagaaaactcagtggatatgcaagaatgtgatctgatctcaaaagggctcctgtggagaaggaacagaagcagacttcttcgtagttccaaggggcagacccaggatttaggtggaaattacagagaggcagctctcatcttagttgaaggaaaccttccaagcaggcgagctgcctaaatgtggattgggctgggaatcttctgtcgctgagagtgtctggtgtgggcagtgaggccacttgggaggaagactgaggaggggtttcaagtgtcagattggggcttggaagaggtaaccaccagggtcccttccagctctgagctttggcattctgtgacgcatgtggttgcatttcctctcttctattttggagaaaagatgaatttgttgattctttcccaatgtcttggctatgaaaccaaatgggatgattttattgaagatcatcacatagtccagctcagtgtcaatgcttttaagaaggtgcagacccttcttgggtcagggcaacagaattggtgatgttttcatttcaggctcaccaagaggacagataactttatctacctgttggttacagtagttcaagggttcctggcaagagccggctcatcaggatgagagcatgcaaggaagattatgacaaacaagctttcagaaggagcttagggacttagatgagttctaaatgacaggttaataacggtcctatctgtgtccatccatgaggctggagctggggaatggagattaaggtcagtggagtcaaagaggtgtcgcttagggaggtcgagggtaggtgaagatcgtggtgggaggtcccgaggaacgggaaatctgccaggaggaatggccgcatttcactaacagtatgaggggattggcttgggcagataatgtggaattctgaggagatgctgtggtaggatggtgtggtgagcaatggcatggaattttgcagaccccatgcctggcccagaaaggcctgaggagaggacggtggtgtgctttctactggggagtgcgtcagggacccatgtctggaggactgctggaagtagcatagtgtcatggttaagagcacaagcttcggaagcagctgcttgtgactttgcaacctgttacgttagttttgagctcacgtaatctcttgggagattgtggtaataaaagtgaatgtaggcttacctctggagtctatgtgattcttcctttattcctagctttgagaacactggttattatcacatctcaaacaaatacgaacttttcttcctttgtgtacaaagttattatttccaatctacttggctttaccactgctttatcctcagttttctcataagtaaaatggggataataacaatacttgtgttggccgggcacggtggctcacgcctgtaatcccagcactttaggaggctgaggcaggtggatcatgaggtcaggagatcgaggccatcctggctagcatggtgaaaccccgtctctactaaaaatacaaaaaattagccaggcgtggtggcgggcccctgtggtcccagctgcttgggaggctgaggcaggagaatggcgtgaacccggaggcagaggttgcagtgagccgagattgtgccactgcactccagcctgggcgacagagcgagactctgtctcaaaaacaaaacaaaacaaaacaaacaaaaaaacagcaatacttgtgttgtaggtggttgtactgattaaacaaagtttgacagagggttcagcccatagtaggtactccaaatgttcctttattatcattgttattattattaaggagtgttctgccacatcagaggttctacagggcagagagtcagggtcatggtgggaaagggatcaagaaagctcaggtgggtagggctgggttgggcaggaaaggagttggagaggaggcaggagggagtttgcgcagggagacaaagtggctaagaattgtcttggtgggagggaatgagagacagaccagaaggccctatctgacctgcagtgatggggcatttgcactggggagtttctgggaactttttcttccccagactttctctgtttttactgtttgcttggctacagattacacaggcaaatgagcccaggcttccagggaaatattccattaaagcaatcaaaataacaatttgtatcacttttagaacttctgcctgaggagctaagaaatctttgtactaaattattaattctgggttgtactgtaaggatcttcccctacaaacaaacaatttaatatttcctttttggtgcaacagaggacgagttctccggtctcccagatctgcctcaaaaggagggaggaggtatttaaacccagactgtgatacttctaaggaaactgcctaacagaatgtgtcccgtccctctcggaggaagggatggactgtcagcctcggtaaccttgttctcagggacactcgccgctcccacttatggtcgggctgcacctgtgctggccacatggcaaggcggtaagagccagagctctggagtccctggtcctggaacctggcgtgcgtacctgctggctgtgtgattgggatagtttgctccccctcactcagcatcagtttctccatccacaagaggagggtagccatgccgatatgctagcacagagctggtgtgaggctcccgtgtgtctccaaagtcttggacagtgcctggcacgtgggagacgttcagaggatgttatttattattatttgcattctcagggaatgtctcagtgatatagacacggctctgcctttcaccaggggcaacgggggtggggtgcacagagagtgtgtggggaggaggatgaggaagagggtgccaggtagggaagtggaaagaggaagaagagaaagaacaaaagcatggagacatatgcatatgcgttcagtctgggaaagggagagtagtttcaggtggccaaagtgtgaggtgtgctgggggtgggggtgatggttttggaaattctgttaaaaatatatatatatatgttcacacacacatatgcgtacaaatataatataatgaaacatcatataatatgtaatacagtaatgtaatatctggacagtgcatatccttaaatactttcacttgagaccatttgagaccagcctgggaaacagagcaagaccccatctctacaaaaaaactaaaagttagccaagcgtgatagctactcgggaggctgaggtgggaggatcacttgagcccaggagttcaaggctgtagtgagccatgatcatgccactggactccagcctgggtgacagagtgagaccctgactttaaaaaaataaaaaataaataaacaaatgaatacgtaaaatttcaggaaactgaggaaatggtacttgatccaaagcaaggtttaaaatttttacattgcattagcctgacaggacatttatggtaggtttggagccacagtgtaatttttcatcttttaaacatcagggcttgtcactttggatgttggagtatgaggatcagtgatgggcctgatggtgctgcctctggagctgccaggaaggggaacgttgcttccataagggacatcattttaggaacaggcatatttatttatatgggctcctctgaataaattcatttatgattagaatctggatgtcaaattatagcacatggaataaatctggagaaatcctgtgatatatgtgccctgggggcagcactattcactgttatcctttttctgggcttctgatcctgtttagaatgggtttttgggatttggaaaaagtaaccacttccctcctgttttggccctgcacgtggctgagtcatcattttacactgtggcttgggggttaggagcaaaggagcgggaagcagccatggggctttccaagttggttgggccctgcctgctggtggttggtaaagaagttgcctcaactgtctcctggggatgcttccaggccagctcaccagtggatttcaagtaactcaaaatggacttaaaccgcaaagtgtcctggtgaccgtaacctatctctagcacgtagttttcccttccattactggtagtcagaaagcgcatctatgctgtggggcaaaacaactcagacatgttcacacatggccttgagagacaaacctctcattgctttggagaagcttagctacaggaaaatcttacaggacaactgacattggtcattagattcccctcatgggcagatttgaggtcaaaatttccagaggtttcaacctgatgaatgtggcccaggttttggctggttgtggggaatcttattttccagcactacacactgaggtcagctgctcgggtttctcttgatctctcagtggttcccatgaaaagttccctgatttacaaattcgagctgtccatctgtgcaccgggagaaacacacggaaatgctcgaggcagcgctgcttggcattgcggagttcctgaagctcaggggcagctgggccatggcccctctgcgagcctcagggagtcacttcctgatggagcactgcatcctgacggagcactcctcagggagtcgcttcctgatggagcactgcatcctgacagagcactcctcagggagtcgcttcctgatggagcactgcatcctgacggagcactcctcagggagtcgcttcctgatggagcactgcagagtttcctgcgtgctgttcctttagggggaggtatatgtgtgcatcttggtgtagagaactcaaagctgaacactttctagcccctgaccatgctgttttgtaacaatagagtacaaatgatgtgccaggcactgatctgggcagtttgcctgtattaactcattaaattctctcaacagccctgtgaggcggagactttattttaattttacagaaaaggaaactgaagaacaaaatagttaagtaacttttccaaggcctgcagctggtaagttgtgctgctgggatttgaagagcagcttctctatctcattcaaagagtggcccaaacaattggaccggctgatccaatttgccagaaacaatggctgtggatcaagcattctaaaataatagttactatttttaggatctgtttcttgtgttaaacagatctataaatagcaatgccctttgataggttacttgatttggttatcttggcatagatgtcatcttggaaggtatgggtacagtggcttacacctgtcatcccagcactgtgggaggccaatgtgggaagatcacttgaacccaggagtttgagacagcctgggtaacatagtaagacctcatccctacaaaaaattgaaaaattagctgggcatggtggctcatgcctgtagtcccagctactagggaggctgaggcaggaggactgattgagtccagtaagtggaggctgcactgagtcatgattgtgccactgtacttcagccctccctgggtgagagtgtgagaccctgtttcaaacaaacaaacaaaaaattaaaaaaaaaaaagacagttgtccaaagggagttttgttttttaccataaagacaggaatgtggctgtacctgtcccaaatatcttccagttcatagcctttgtgactgtgttatacagagaggaactttggcgtctccgtcatctatagatctgtgcgttggaggtctgtgattgttgctacagcagtcttctgaggggattcctgtccctgtctgtgggtagttgcaaggctcactctgcgtggcttcaggcctgggttcctgtcaggtcactgagctttcacatgagggtgtcagtaccacttccagctcggtctgtgtttaaccataggcacagagcagcatccctccggtccccggttagaaataaaaatgcttggagaacatttaatttatgtccctttcatttattttaaaatcattaccggataaagccattcaattgggtaactgccccaccagtgtggtccccttagagttatactgaacccatatggagacaccctaagaaatcatgtttgaaaaccacccctggatctgaagcgcattcggcactttctcagcttgctctttaggggggttttggggagaaattccacctggtttgagagttagtcagaaaacctctgagtaatgggcggtctgcatctcatggactctgtgaggtcgtgaaccagcttcccttctccagctggcagtggggagggcctcatgcagtccttcctggagtgagattaaaagcctccagcctcatctcctggctttgaggatgtggagagcatggtggttgagagtgggcactagggccaggctgtctgggtgccgtcctggctccatcacctaccagctgcacgattcgggcaggttatttgcccttgctaagtcacagtttcttcatctaaaaaatggggataatgagtgcttgccttatagggctgttagaggtttcaatgaggtccctgtgacatgtggcacatgttgacatgagcgtgccccatgtgtttgttgttgggtccaattattattattttttaatcagcttttatttttttgagacagagtctctttttgtcacccaggctggagtgcagtggtgcaatcatagttcactgtaaccttgaactccggggcacaagcaatcttcctgcgtcagccttctgagcaggtgggactacaggtgtgcaccaaagtacctggctgattttttatttttgtagggatggagtcttgctatgttgtccaggctggtctcaaactcctggcctccagtgatcctcctgcctcagcctcccaagtccctgagattacaggtgtgagccactgagcccagctctagtcacttattgggtccattttatgttttccctttttctgtcctttcttccctccatacctccatatattttttacatccttgtgagctgcttatatcttttctggaaagtagtgaggtatgaaaaaatgagtgattaatacagttaattaatataacaatggcttataggtgtaggttctttggaacctacgcctattcttctcaaagtctttcatgtgtcttttctgattttattacaaaaattctcttgcaacattaatttacccagaattcttacacagtgatccttaggccttcttttctggtattaagtagcttgcaaatatgtagctgtgtgtgtgtgtgtgtgtgtgtgtgtgtgtgtgtgtgtgaatgttgaactaatccacaaatactcagcaatatctttaggagagctgaagttagcaagtaagatcagctttattgtactgtgaagatctgattttcgaaagtaacgtggggtgtgtaaaactccagtctcgtgtcctagaggccaagcatagccatttgaaatgaggaataggaaagaatggggaaacagattggagccaccacctatgggatgctaggagccagacaggtaggcactgaggagacttggggatgccagactccccatctttgcctgggctcccccttggcctgcacccacctcaaggcaatgtgcctggggaggcaaacctgatggacccgtaagtcaaggtgattctggccacatcccagggaatgggaagaaaagaacgtgaagcgatggagatgggggacggtgggactgagatggagaatagctggatttggcagggctagggtgggcctgcactggaggagggtaagcacaaggacatagcaggccctgggtagggaaactgagggctgggtgcagagaaggagagcgggaagacaagggtcagcgggtgttacgctccatggttaaaggctgaggcacttgcagccttgtagggtagcgtcagcagtgctgaaggccgttgcccggccaccaggccctgccctttcatggcactgctcctcctgggctcactctcttgcaggcaaaagccaggccccacaacctctagcaactcctctgctaaaagctctgcttccaacatcagcacttgtagctacataacctaggttaaaattttattaatggcgtgatcatgggaaagtcacttcatctctctgtgcctcagtttctgcatctgcaaaaaggaagaagaatgagaaccacacccctctggtagaggcagaacgaagcccagtatgaaagctgtgtcagcagctgagcacgactcttacaacagagcagggacttgcacacgtcccacccctgggtcctcctcaagcccacctagcacatggagggggactctgtgtgtaaaaggtgctgtgaaattacctgactgctttcacatctgtggccttgtttgatcactgtgaacgcttctgtgatatgaaggcaagcagacgctatgattcccattttgcctgtgaagcaagtgtaagccagggaaatgcattttctttgctcttcctaactccaagtgttgcttttcctgagacctgggctctgatttgaggcctcctgtcttacaacagtgtccccttgatcaagtctttccccttcagcttccatctgaaaattgaggggatgggaatggggataccccaaatcccttcagctcagacgctgcctagagttataggcctgacctaggaggcctgggtcctttccctgagccgaggagagggtcaggctcctggacacgcaggtgggcacacgagttcatgtttcagccatcagctgcctgggcacactgccagggtattaaatgagataatgagataacacgtgcaaagtgactagcacttgatcgagtgctgctattattatttttactaccactattattcttcaggaagcagaagtgagttcaagtacaagctctttttcttactagctatgtgattggaaagggtctgtcttgggagatgccctatgcacccctgcatcatccagtgagcctggtgtgagtctcatgtcctggaggccaggtgtaaccatttctccatctcagtcccacccccgcccccacctccaccgcttcatattctttgcttcccattccctgtgacgtgaccagaatcaccttgacttgtgggtccaccaagtttgcctccccaggggcattgccttgaggtgggtacaggccaaggggggagcccaggcaaagagggggagtctgaggtctccagatcctccccagtgcctacctggctggctcctagcatctcacaggtggtggctccaatctgttttccgttctttcctatccctcatttcaaatggttgtgcttgacctccagggcatgagctggagccaggacaggagattcacgcccggcatactgggtgatgcatgggtgcataggatacccctcaagacggacgctctcaaatcacacagctggtaagaggcagagcttgtatttggactcacttctgctgcttcctgaggaataatagcggtagtaaaaagaatagatagcaaagctctgtcaagtgctggtcacttggcacacatcatctcatttaatactcagaacaactctgtaagggaaaaactattatgagttgtgttccacagataggtagctgaggcacacaggggcaaagccagggtctgtgatgggtggtgctggggttctaacccagctctgtctgcttcctgagcctgctggcttagcggctgtgcaggccacgcccttgcacgctaatccgtgctttctcttaccctacagctgccttccaatatggtttagcgtttactgggcattttcactctgttgctcaccagcagcagctctagtgcttctgggcctgttcctgccttcattaccccttgtgcctgggcctctgtctctcccacttaacctgttttcagggctctaattatccactctctacctggacccgtaatcttctcctctcattgcgtttctttaggatattttccgagtacctgccgggtgcctggcactgctctaggtacctggagattcagcagagaacaaagcagatgaaaatcactgcccttgtggagcttctagactcctggacggagatgatttctgaccctgatgcctgggtgcctctccagactcaaattcgattctccctggtgctgtgcactgagagccctgccttctcctgcttgctgttcctgggacagcagcacatcctggtgtccacttctagagggcctgttttcccctggagacctgacctcctcctccaggcaccctggggatgttgccgtgggctcagggcgggtcccagggctgctcctgggggtcgtgtgcgcaagcatgtgatttaccgcgcctcactgcgccacacgtctttaaaattacagtgcccatttcctgctgaaataatttccacaaagagtggctcctattaccacaagaggcgtgcagacgtcatgatttattattatttatggtcccaaggccttgtttatgcaagatgggttaggtgcgtgcgatagaaatgccattatgtaaatgacattgaatgtccttactgcgcctaaataatttttgtgttggacgattaaacctcatctgttattgatatgggctgcagtcgggccattacagagtcccaacagtacttactcccagtaatgggaaaattgagagagagagaccaacgcaattgcctcaagtgggctgtgatggtctggaaggagtagaacatctccggggctgagcaggggagcctcagactcctcaggataaataaggaaggcagcgccgggcaataaattaagccccggctggagtgggtgccttgcaggatttgcagccttccagccctgtgatttagctatttgatttagccaggggactaggcagccccagcccgagttccagtgaggccccgcgtcgaggggagggtgacaggaggagagtggccacgaggacactgggcatccaatctgctgcgcccacacgacgccagcgtgcacccgcacgcgagcgctctctcactctctctctctttctcttgctctttctctctctccctctctctctccctctttttttttgacacagctgtgaagtcccattttgatcagtgttgatagcttatgaattccaaaattgacaaaatttacagaaaaatgaggataatccatcttccttagcaggctgtcaggagctggccatacttcataatctccaattacagatgctattttccgacatttacatgcagatattagaaccaaatgaaaatgagaaacaaagagggaatggaaatgcagctatttatatgtataaaagacaaacaggtaaattcaagacatttagattggatttggggtccctttaggaggctggaaagagacagccttgagcacgtggggtttcagaacaaaatggcaagacacgtggtctcagcagggcctacccagggtctggtggtttgggttaaaaatgggtcagccctgcccaaacggctaaggatgcttgactgggggtgggggacacgtagggcatcccccagggctttaagggtctctgaggatcacccacagcccatactgagcagtaaaacccacacatatttcatgaaagggccagtttagaaccttccacatttattttaagaaagaaagggtggtggggcaactaccattggagctttgccctagggcaaatttaaaaagttggccctttctggtgacagaatgtacatactcccgctgagaaggggacacaggaaggggccgctgcttgtcagaaaggccctggccaggtgcatagggagttgcaccaataaacttttaaaatgggatataaataataaaattaatggggagagaaggagttctgatatatggatcatccgcttccttctcgaggctaatctggctgagagaggagggtctgggaggaggctttgtaatgaaaatgttcttcccataaaattgaagggagaacagccttgttgccctcgcagctgtatgtggcactgacttctggaaagccggggatattaattagcactgctttggattaaactctcccaaccatgtcggatggtacgatttttctctttgtgagcttgacagagggtggcaggaaggatcctgcctgggttttcccagcctactgttattactgaacttttatttggggataaaacctcttcctttcctggaaataaaaatgaaatattccagggttttccagggcaattgggcagagagaggctgttttgttggaccaggcagaggaggtggagacggttggatggggagatgtgaacatctcagttgcttttggcttgaaagcttttgtttgtttgtgggaagcctatttctagcaagcagttttatgttatttgagctttgatttgtgggaaagaggtgaaggaaataaaatcaggagtctaaattaatatatgtgtgtgtgtaagggagaagaaattattaaaaatccaactcagaccaagcctttagacgtgtgtttgtttacatgtctagcctcaaggcaaatggcttgcttgtctaagtaaattataggtattagcacgaaaaataattattatgctttgtttctaggtatgaaatgcaagattcatggaattaacacataaccacaaaatgcaaatatatttccgtaattaaaagcagaagctcttaagtaaagttaaccctgataaaaaggcatacaagcagaaacaccaccgttgctgtgctagttttgtctagattattgacattagctaaaatttgggcttacacatcatagctaaatcctaagcctagtgtctccttcctttagtttctgatctttctagaagccagaatatcaccttcagtaaagaacagagaggacttgaactaagcaaacagtcacatgcctggtttttccttaatggtgctaacagtgccacatgttactgtttatttctctattgttttgcactaatgttaagatgaattgctaatgttggcattaaatgggagccctgctgtcctctgagttgacggtgtaggagctttctgtctaaatgaggagaataaaggataaagttaacaacatctgcggctaaacctatctggaaaccttttctataggaggtcattcttcagccaggatttgaaggggtggatagacaggaactggaggagagaaagtgagagggcgcccggcggggaaagcatggccatgtcaaaggtgcagagtcaggtgggttatctaaagaggtcaccaaacacaggaagaggagcctggcctagcaggtggtgtccccgtcagggctccggcacatcgtggagcagtttacaatcagagtaaagaacacaggctttggagtcaaacagaagctgggtttaacccccggctctgcaacttactcaacttctgtcaacctcagtgttctcatctgcaacttgttggggttagtaacagtggcagagggggtgtagagtggtgtttcagagcttggactttggagtcgcactgctggggggtgaactggacacgttattttggcaccttgtgtctcattttcatcatctgtaaagggagggtagtaatacttaccctgtagggttgttgcaaggattaaatgaattattagtaatacattttaacatctagaacagtacctggtacacagtaagcacccagtcaatgcaagttattccgcctcttagtaaaggtatgtgagggtgtagggggagctggtagagtcttctgaatggcaaaccagggagtctgaattcaccatgagaggccttgcctttgcagccttctctttctggtagttgccttgcacagtttttgtttggccctaggaatccttggtgacccagagggcactccctcctgaggctggctgggtatgcctttgcagagcatcacgtgttaggaagttccttctgacagggagcggaagggcagagaggtggtctttggcctgaggagtgtgtgtgtgtgtgtgtgtgtgcatgtgtgtgtgtgtgtgtgcatgtgtgtgtgtgcctgcaggttcccacatggccagaggtggtggtggtggggaggggcatccaggcccacctccctgtccccaccctgccaccctattgatctggccatgtggagtgaagttttctcttttcatttctccatgcctccaacataacctttctgtcttccttgtagctgggaagtcatgccaaaagaatgtgaactatgagagtcttagggtgctccctctcctcccatgctaggtatttgaggatggggatcctccctttggacccctcattcaggcccctttgtggccaagagtcctgcactcccttggaggtaatggcctccctgcccattactagccatgtagtgggaagagcagctgggccccatcatggactgcctggaagaagcctgtggaacttggccacctggagatggagctttgtccctggaactttccctccctttgtccacattaggctctggagctgctcgtgacccagccaggcagagctgtagcaggtgcagaggtttcccagacagggagtccccatcccccttccccacaggagtcaaccctactgggatcttactgtttaggaggctttgactaccgggtcctgggccactgggtcccagttctcattctccagaagtggagctttgtgctctaagccttgtcaggataacctttctgtccacgtatttgggaagacctgtgagcttgcaaatagcacactggttaagggaaggagaaaatacctaatcactttccatttctaatgaacttagagtgagccctgccttgaccgtgagaacagtatgaatcagtcaggttctaggctaccaggaaagcagaagcaagcatcatacgccccagtccgacagcatgtctggtggaggagtggaggccctggggccccgtgctggatccaggcagggagggcactggcacctgtaggacctctgttggaactggagctccagagagcacacccaggaccaatgtagggagaccagcatttagcactttctcacaccggagctgtgtggctgcctcggaaagtagtgagttcccatcactggagatacccatttggtggatttcaagtgccaggtaaagatcagcctacagcactcctgagctccattagaccctgagatttggggcttactaaaattccgtaagaggacaggggaagaaaagggccttctgattagtcattgctgaaaagttgctctcggacagaagttaaaatgtctgactttggtggcctccctgggcttcccctgctggtacccaccaccacttgggaacctgtctgggggtgtgcctgaggggggcctggcaggctgtaaacagaacagggggagatgagtcactgaaactgtatagatctcttcttggaagcccttcaattctgctgcaaatcatttttttttttgtttgtttgcttcggagatggagtttcgctcttgttgcccaggctggagtgcaatggcacaatctccgctcactgcaacctccgccccccgggttcaagcaattctcctgcctcagcctcccaagtagctgggattacaggcatgcaccaccatgcccggctaattttgtatttttagtagacacaggtttctccatgttggtcaagctggtttcaaactcacaatctcagatgatctgcccgcctcggcctcccaaagggctgggattacaggcatgagccaccatgcctggcctgctgcaaaccattttgacccaggccatgagtacatttctggagaaacaaatgaataaagagcgtgtttggcccatgtccgtggcaacctctgatgaataaaagcaccttgacatcacttatcctctcagtgaccctgggaagcacctctggcaccgttggaagagccaggccatggtacctgtccaagttcatttgattccacaggcatttatgtcacatctgttcagagctgggcactgggccaggagctgctgccacaaagatgagggagacactgtctcatccttatgaagctcacactctagctgggggatgatgtccctaaacagttaaatgtataatgcagaataataagtgctgtggcagagagaggcacactcagccattttaggaacacagagaagggggaatccatgagggcttcctggaagaggaaggcccttcaacatcctttgtagtacttccccctagttaatattaatggtagcactttgtagattatggagtatttctgcaagcatcattcaattaaactttttattttgagataactgtagattcatatgcagttgtaagaaataataccgaggactcctatacaccctttaccgagtttccctccacaaaaacatcttgtaaaactatagtacaataaattgacactgatagacattgagtccaagatacaggctatttctaccactgcaaggattcctcctgctgttttttcagtagacattttcaaagtatttatttatgagtctagcactggggactcaaaaactgaaacgcaaaaggcctgccctccagggctttattctgatctctcttctgggctttctcacaaccttgtgaggtaggtcacatatcccccttacaaatgagaaaaggtaccaagagtgagaggtgcctggcctagtttcacacagcacagacttggccgtgtcaggcttgaagtctgtcctcctggccccagacccggtggaattcctcagccacgctgcctcccctggttgctgtcaggcctctggattcggggacctgaggtcaaacgggcaacatcttcaccagcccacagagggaacctaagcccttcctggggccatatcaaggagaaccccattccacacagtgaggaccccatcttggtgggcacagacattagtgagtcagaagggccccaatggatttggtccatctccctcatgacagatggagtcactgaggcctggcaaggggagggtctggccctggttgcatgggagtccagggcagagccaggtctccaggtcccttgccaccccatctgatccattgtaatcaaggcagaactactccttaacatacactttgccaggtggaattttgtgtgtccaggtttaaagaacgcagggcattcctccttgcagattcagtgctctttccccagctggaggaggatagtgggtgtgtggccagggcccttcatggaggagtgtctgagctgtaccttcaggggtggcagtaaagtcccctccaactctaactctgcttccaggtaggggaccagtgctgcacacggggtgggcagcagggctcccctctctgagctctagttctgcatctgtccacatcccaggactcccggggcaccacggacctgcaaggactttgcaaactggaaagtgctaggcaggcaagaggacttagacttcttgtgtttggaactttggcatccctgaagatgcagggatgatggctttcaaggagcagggcagggcaccaggaagaggaggcgagagagtaagctcctggctgtccttggcttcttgcgttctctcgttatttcacaggtatttgttggatggctgatgagcggtgacaggcggtgccatgagtcaaatatgtgtggtttaactttatttattttaactatggagactttctttcttttttttcctttttttttttttttgagacagggtctccctctgtcacccaggctggaatgcagtggtgcgatcttggctcactgcaaagttcgcctctggggttcaagcaattctcccacttcagcctcctgagtaggtgcccaccaccacagcctgactatttttgtatttttagtagagatggggtttcatcatattggccaggctggtcttgaactcctgacctcaggtactccacctgcctcagcctcccaaagtgctggaattacaggtgtgagctaccgtgcccagccataattacggagactttcaaagtagacttggagtaatttaatcagcctccaagcacccctcccccagattcaactcatgacaattgttgcactgatatccctcccccgacacactccacttatcttttaatggctttattgaaatataatttttatatcataaaattcactcattgtaagtgcatgaatcaatagtttttagtagatttaaggagttatgcaactatcaccacagtttggttttggactcgtttcatcactccagaaagatccctcatgctggtttatagttaatctctgatcccacccccatctccagccaatcatggatctgtgctctgtgcttgtagatttgccacttctagcatctctatgggctatcctatatgtctggactttttcacctagcataatgcttttgagattcatccatgttgtaacatgtatcagcactccaccccttttcactgttgaatagtattccattgtgtagatataccacattttattaactgcactttatttttcgacaaacttcagacattatgtcacttcacctgtaaatattctagaatgaatctttaaaagacacaatcttttattatttttttgagacaaggtcgcccagactggagtgcagtggtgtgatcaaggctcactgtggcctcaacctcctgggctcaagtgatcctcctgcctcattctccaaaatagctgggactacaggcatgccactatgcttagctaatttttaatttttttgtggagatggggtcttgttatgttgcccaggcttgtctcaaactcctggcctcaagtaatcctcctgcctcagcctcccaaaatgctggaattactggtgtgaatcacagtgcctagccagacaagaccttttaaaaagcataaccacaccactatcacatccacaaagttagcacatccattcatgtcatcaaatactcagttggtgctcacattgccaattgtctcattatatgttatgatttttttttttttttttttgagacagagtctcactctgttgcccaggctggaatgcagtggctcgatctcggctcagtgtgcagcctccgcctcctgggttcaagcaattctcctgcctcagcctcctgagtagctgggactgcagtcacatgccaccacggctggctgatttttttatttatagtagagatggggtttcaccgtgttggccaggctggtcttgaactcctgatctcaggtgatccgcccacctcagcctcccaaagtgctgtaattacaggcgtgagccaccgcgcctggccatgttttttgttttttgttatttaatgattatttattttacagtttgtttgaatcagggtccacattgtgactatcgatttgtctctaagcctcctttaacctacaggttcaccatctcttgttcttgacttgccattcatttgttgaagagggaatctagactttgtcatgtggccagtgatagaggcaaagagcatcagcagtggaaggagacttagagatcctccagtgaaggtcctcagacaggtggggaagcagaggccagtgaaaggaggggcttgcagacccctttgcctgctcagcctcagtcgctggagccaggctctggagacacctctcacccactccagcttctgtcctccttctgggtagatgtagaggtgggcaggtgtctggtccttcagaatgggaatggttggcctggctctggcccagctcccaagggatacctgtggcctggcggtgagcctacaggagcccagcaggtgacagggaggcctcctggccccaggtggccatctgaggtgaccagccctgcagccttgccccatgcgctgccctcttttgtgctgccctccttctcacgtgtctgtgtttcttttctcctccatgctatggcagtggtgccccgtgctgatgagacaatacttggtgcagccccaggcagtccttttccaggtaatttcctagggacccaaatgatgcccagtgcacactctcctggggcacgtgcctccttgagtcccttgctagaattcctgaacctctcatattgcttagtttccaaagtggtgtccctctccttacccctcagattctcatgatcgtcgaggtaggcaggcagctagggactagaattaaaatttcattttactcatggtgaaaatgagattcatagaactggcccagctcacctacagccacacaagtgagaaaggggcagagctgggacaaaaaccctgtgttatcactcctagttcagtcttttttcccccactgggtcaaaggctatcaatgatgcagataaaaatgaactaagggccaggcgcagtggctcacgcctgtaatcccagcactttgggaggttggggtgggtggatcaattgagctcagcagttcaagaccagcttgagcaacatggtgaaaccccatctctacaaaaaattaaataattaggtgctgggtgtggtggcgtgtgcctgtagtcccagctacttgggaggctgaggtgggaggatcccttgggcctgggaggttgaggcagcagtgagccatgattgtgacactgcactccagcctgggtgagagagcaagaccttgtctcaaaaaaaaaaaaaaaaaaaaaaaaaggacatccatccctatccctgtacctcagtttttctatgttgggaaagatgaccctgactgtccttctattatagttctgatatttcagaggacaagctgttccatcatctagaacatggtgtctgtgaggatggtgcacacaccttgagctggtggtcttgaccttgaggtcttataagagtctgtggcagctgggtgtggtgtctcatgcctgtaaatcccagcactctgggaggctgaggtgggtggatcatctgaggtcagaagttcaagaccaacctgactaacatggtgaaaccccatctctactcaaaatacaaaaatgagctgggcatggtggtgggtgcctgtgatcccagctactcaggaggttgagacgggagaatcactgaaacagggaggtggaggttgcagtgagccgagattgcaccatttcactccagcctgggcaacagagcgagactctgtctcaaaaagaaagattctgtggcagcaggcagaggaagttttatcccaatggttgcattgcagtgggaaatctgtgaattgctgacttcagttcatttctgttcctgggtcatggtcaaggacagcaccagggtgccctgatgaagagggagaagaagcctaaaatgacatcctaagaaagaaccccaagggctcagaaaaagtaggaaatgtagaacacagctgttgcctgtgattcttaggggctggggttggcgggggcaatgtacccaagtatgtaggtgcaccaacacacttacacatctgtgactgcgtgtgtacctctgcaccccgccactcagcctttggcttcgaaaaaactgagaaatggaagtagaatgccgttgttaccaggaaaagaggcaccaggaattcctttcctcttctctttctttctctctctctctctctcatccatccttccttccttccttccttccttccttccttccttccttccttccttccttcctccttccttccttcttccttccttccttccatctttctttttctgtcagttcacctttcccagccttcactttcacaaagaacttgaggtggcctgcaaaataagcaagtatgtgtatctaagttaagtttggaaaaaaagttcagaaattacatagagaaaaggggaagatcattgtggcaggagccagcaatgatgtgcttatggtggttgaacactgaatttgaccgagtttcctggcagtcaaagccaaaagagacatgcagtggtttccagtgttcttgttgtttagtcagaggcagattaatgactcaccaggggaaacactttactggtgttgaattgtaggagggattgataaggaatttgaatattctagtgggcagtgtccccagaggttttaaacaatcttctttttatggctgttttctttttttgcctcgtaaaagtgttgaatgcctgatattccatcagagactggtgaaagcaccacccaggggctttaatatgttggatagggatgtggctttctggtgacctgactcgatgtggggtagaggtggaaggagggaaggggatgttagcgtatcacttagtgctcttgttcaaacacttcccagttaatttttgagtgttgtagctcataacatgctactgaaccattattcattcattcattcaacaagcacttagggggcactaaggatgttccatgttccacactgtcaaggcaacctggagggagatagacaaacagccactctacatggtgataatggaggtctgtgcaaaaagccaccaagtatggaagcatagacaagggagagattgtttctttgtaggagtgtggagttcaggaatggctccaccaaggaggtgacatgtgaactgggtcttgtggataatgtaagagttctctaagtcacggagtgagagggaccctccaggcggaggtaggacagtgtctggaatggctgaggagctgtggtgtagcaatgttccagggaacccaagagattggggagaatgcagttgcctttaaaaatcacggacacctcaaaaggacaaacggtgatgaggacttagggaacaattaaacaccaaaactaaatgacagcttcccctggctcatgcaggagcagagtaagaactgagggaatcccaccaaagaagagaggctgggctctgggcaagccctgcaaggtggttatggtgaaaggcccagatatctgggtgcagtggctcatgcctgtaatcccagcactttgggaggccgaggcaggtggatcacttgaagccagaagttcaagaccagcctggccaacatggcgaaaccctgtctctactaaaaatacaaaaaattaactgggtgtggtggcatgtgtctgtaatcccagccacttgggaggctgaggcaggagaatcgcttgaacccggggggcggaggttgcagtgagccaagatcgtgccactgcacaccagcctgggtgacagagcaagactttgtctcaaaaaaaaaaaaaagaaaaagaaaaaggaaaggcacagatggtgaagtgcagctaaggactcgtttccaagtgtcccgccgtcccccagggcctggcttatagggaggtttgctttgctttctgggagccagtggtggttggatgcctggattttcggacctcccgctgcatgtataacataagttgaagatttcttgtcttaaaaagatgatccaaacctaacttttgaagtggctgaacgagctttgtttgatactgaatttgttgactaaaacaaaaatcaaatagcaacataagcctcttccatctggaaattaaatatgtaaggggcaggatatatccctgttgaccaccctttttgtggttcttttaaacccaggttggctctgctttcttgggggaagtaaaggcattcccttgcagacccagcagcccagcccatgtcagagagaagaggctgaggtctaggaatgtgccaggccccagggtgggctggggaggggtgcagggatgctgactcttggctgggatgctgcctggccctaggaagagcactccttccttcattcacccagtgttcattgtgcaagcccttcacaatcgagttccagctagtctaccattccatctttcccctttacgcttgcaccccctctaactattgcatgtgccctgtttctgggtcactcttgtcctattacctctgagcctgacttcggctgttctcagtcttgggagttagggattgttcactcccaggttaaatacagcctgcaccaagaaacccttcctgaccacttcacgccccatatacattaatgactctgtgctcttgtccctcttggatggaatttctgggccaatgtgtcttctcttggtgtttgtgggtgagggtcaaagagtgtgtctggtcttcacacatcatgttgcacacaacagggctcagtaaaggttgaacgaatgcacgcccaccattcactagggcattcgggaacacagagaggagggcggaactgggacctacccctgggggcccagaaactctagaagatgccatctaggaaaagacccttgtcagaggcattttgacctgccgtctttgcacacagcaatgaactgaaggagttgcttccagtgagtggaattctaaattcatgcccgattcattctcagaaaattaggaggctaatgccacgaccaagtcttgttctacagaagaggaagtctagacagcaacctttttccaatagctcttgctgcatggaatgaagcagtattttccaaactttgctggctgtaacctagatcaagaagtacatcttaatctctacctcgtacacacatacccactgacatgggaaacaaagattcacaaaacaggacttatcctttctatgtgggagacccttggatatttttttttcagtttcatttataaaaatgttgggaccagcaagttgatttcactgtgttttaatggatcaggtactgagagtataaagatcattagggtcattgtcaaggttttggagtcagaaggacccaggtttgaatcctggcttgggcacctagaagctgtatgaacttagttaggcaagtcattcctgcgctatcataaaagcctcagtttcttcatctgtaaaatggggatgtcatagagcctgcttcaaggggtgactgtgaggattaaatgggatagtacagctaaagctcctggtacagagtgaatgctcagtgagtgtgagattttgatgcaattgtgaagactgtggttgttattgttctggcaccacttggcggggccagcagaatgagggtgggactcacacttcctggggaatggtggttatgaaagacttcttggaggaggaggcactgagacagggcagcaggatgactgggtcccaccactaaccccacagtgagcaggaactctgcgtgagcatcccaggccagaaaaggcactcttccttccatgaagggcagacttgttcccaaggatttttggctggacctagagctcgccacgttggatgcctttgccttccacatttaggtctctaatccacctggaattgatttttgtgtctggtgtgaagatccaatttcttttttcccctgtttctgaatggataaccagttacccctgctctgtttattaaagagtccatcctttcctgctgatttgtacaccatctccttcatatatcacggttccatatgtgcacggaccagggtctggactggattctgtttcattggcctatttatctacccctgtgccaataccaccctgtcttaattactgtagctctgtagcgattcctgatgcctggtaagcctgtccccctggccttgttcttctcccttagaaggacctgggcttgctttgggcctgtgctcttctccacatgtttcagaaccagcctttgatgaatgaggatcaaagagccctggggaactctggacatgctgtcctcagcacgaatcatctagagcctgggcctgcagcacctcctggactcgctgctgccatcacccccagtcaaaactttagctgcccaggaagtaatctctgatttgaagggaaagacaccaggaatgtgcctgagtcccagccccttctgcctgccacccagtggctcctttggtttccctcccagtggctcagtcctcatcattttactcagggtgcctgcagctccttccagaagactgcttgcttctgtgtccctccctgacaaggacataaccctggaccaacatgggtgtgtcctccatcagcaatgccagcgtcctggaggaaactccccacataaaatcttcacatgcacaaacaaatttgttggcttaagtgtttgcaaattccctcctccctccctcccttcctccctcccttccttccttcccttccttctctctccctccttcccttcctctccctccctatcccttccctcccctccctccctccttccctccttccttctctttctctcccttccttctttctttccttccttcctccctccctccctccctttctcttttccttccttccttccttccttccttccttccttccttccttccatcctctttctttcttttttttgacagagtcttgctctgtcacccaagctggagtacagtggcatgatcatggctcactgcagcctcgatctcctgggctcagtcgatcttcccgcctcagcttcccgagtagctgggactacaggtgaaagctaccacacctggctaatttttgtattttctgtagagacagggtttcaccatgtttcccaaggtggtcttgaactcttagattcaaatgatccacccgctttggcctcccaaagtgttggaatgacatgcgtgagccactgcacccagccgcatatattttctttacctgaaaataggccctggggtggggtgggaggaagagacttgtcactcatgcttataatttagtctatccttcagttgaaagatccaggttggtgcctttgctgccttctctggagaccattctgacagtggcttggatgacaaggaaatgactcattgcaaactctgatttcgtgaaatggcttaaagaaaggagcgtgactcatgggctaaatacacatggttggtgtggacttggtaaattagatatgtgcaccctgtggttttcagcatacaggtgtttacctgcttctagaattcaaaaacacttgccaaatggtggctcagttagtttgccatattggattagggtgggaattcatggtgacccaccccaattggtattcttccctgttggtggtgggtaaagccctcctccccttgagcctcagtttattcatctgtgaaatgaggatttggaatggatgatctcccagattcctcttaacccttgtttctgtgattctacctttgtggtttaagagcacagaaatcagaaaccgttctttccattctcttggcaagaagacacttatttctgccttgcttttggttacggaccctccatccctgcactgaggagtgtggggtctctggccaactggagctgggtgagggcaacatgcaggccagagggagcaaagtttggattcttgtgaagttgcactgagtcctgcccacctcctctcctgggaagaattgttgattctggacaactgtctcgttccaccaagctgactctgccctttcaacactggaagtgttcatgagccccttgtgggccttggcacaggcatggactaactcagcttggtggctgagctcagaacgtggagttggcatttgactaaggtactgtggagtcttggtgctgagacgtctctgtttcttctttcagaccacagagtattcagccatggcctcgctggctggtgggctggacgacatgaaggccaatctggccagccccacccctgctgacatcgggagcagtgtgccaggcccgcagtcctaccccattgtgacaggtgagggcacctggggcatgggggatgagtgagggagagagagagagataggagtgtgtggtgggaagagtggcttcttggtgtgtttggatgtgattggccaattttgttttaacaaggttatgaggcctgggaacaggtcaggtgctggggccagggttgcagctgtgatgagacatggctggatatgattccaacaaagctggggagaacaaatgccaaatggactgtgggctggaggggacttggggtagggggcaggaaacctcatgccagaggggcccccgtgggtggggctgagtgttcagaggcctagggtttatttctttcatgagaaaggccaccctggtgggcaccaacctcaaggaggaatgggattccttgcagattgatgttggcaggcagaatctgagtcaagaagggtaggtggcgtaagctggatggtgcatggtggatgccaagcagcttccctctggaagtcccagggccagactctttagctgtctgtgtagagattgggagtgtgggtcctggaggtgcactgttgagtctgatcatgccatttactagctgtgcagacttgggtgagtcatgtatgcgttctgggctgtggctttaagctgcacagcgggactagtgctagcacctaccccagggggctgtggtgaggattaatttgttcgtctgtggaaggtgcttggactctcgtctggcacatggtaagcacccaatacatgtagctgttaggattcttctgagaaccctctccctgtggcaggtcaccaaggggcttgctgacttgctgctgcagaagggctggatgcgtgggccaggacggggagacccctggcccagctgtgctggggtaacgtggagccgactccatgtggacagactcagctgccagctcttggttgtccaaccgggcaggcaggaggcccgctcgggtactgcacaaatagacaaggggctggcgggccacacttgggccagagccatgggtctggtttgaggtagcaggatgcccatgtgggctggtaggcagggcacagtgaatagtgacagtgacacgggactcgtagacatgcaggtggactgtgggtgcatcagggaagctgggttagactcggattagaacagtggagggggtcacttaggccaaagcagcaagacagggagggcccagctccgagacctgggctgaagggtcagcactgaggctcaggcagaagagaggggccctatttgcagctctgagcaccacgtaagggccagtcaggtggcaagagcaactttgtcccccatccacctgaggtgggccaagagcctggagtgcacccaggcctgaggtgggagacgttagcgaggggcagggagccggggagcccatctggagtaagcctttgctgaccccacaggtgtccgagggggtcccctcccctggtgtcacaagaatccatgacaagacctctgaaggcactcccatttcacagacacagaaaccaagtctcagggaggggcggtggcttgcccagcataaggggtaagggggagttagagctggccctctggctcctagatcctgggccctttttcctctttttcaaggaactacaaataattatagaggtgggcatggcagagtgcaaagaaacctggattagcgaacaataatagaaactggcacttcactgagcacttactgagaaccaggcactgtgctaagtgaactcactttatcttcagaggaatcctgggaggtgggaccgttatgatcatgtccatttcacaaatagagaaactgaggcttggggcagttgagtggcttgtcaagatcacagctggtgagcagtggagttgcagttgaatgccagggcccgtgctgctggccatgctgccacacagatcagctggagctcatccagcaaggtcactgccttgccgtctgactctggacacatctctgagcctccgtttctccatctgtaaaagggttctggtctctcaggctccaggtaaggatcaaatgagatcccagaggagagtgttctgcagaaaggagggtttgttactgggatcagagtttatgagaagattgggtaggcagatcacaagaagatgttataggcttatcttggagacattgtgggtttggttccaggatactgcaataaagcaaatatctcagtaaagtgagtcacacacattttttggtttcccagtgcgtataaaagctatgtctggctgggcgcagtggctcacgcctgtaatcccagcactttgggaggccgaggcgggcagatcacctgaggtcaggggttctagaccagcccggccaacatggtgaaaccccatctctactaaaaatacaaaattagctgggtgtggtggtgcatgcctgtaatcctagctacttgggaggctgaggcaggagaattgcttgaacctggaaggcggaggttgcagtgagccaagatcatgccattgcactccagcctgggccacaagagcaaaactctgtctcaaaaaaaaaaaaaaaaaaaaaaaaaaagctatgtctatactatacaggttgagcatctgaaatgctccaatatctgaaactttttgagtatgacatgatgctcacaggaaatgctcattgaggcatttcaaattttggattttcagattaggagttgaactggtaaatataaagccaatattccaaaatccaaagcgatccaaaatctgaaacacttctggtcccacgcattttggataagggatactcaaccagtactgtagtctagtaagtgtgcattatgttttttaaaagacacataccttaatttaaaaatacttgttgctaaaaaatgctcataatcatctgagccttcagtgagtcatctttttgctggtggagggtcttgcctcgatgttgatggctgatgactgatcaggacggtggttgctgaagattggggtggctgtggcaatttcttaaaatagacaatgatgaagtttgctgcatcaattgactcttcttttcatgaaagatttctctgtagcatatgatgctgtttgatagcattttatccaccatagaatttctttcaaaattggagtcagctctctcaaaccttgccactaccctaccaactaagtttatggaatattctaaatcctttgttggcatttcaacaatgttcacagtatcttcaccaggagtagatttcatcttaagaaaccactttctttgcttatccataagaagcaactccttattcactaaagtttcatcatgagatggcagcaattcagtacatcttcaggctccacttctaattcttgttctctcgctatttccaccatatctgcaattacttcctccactgaagtgagtcattttcagccctcaaagtcatccatgagggctgaaatcaacttcttcccaactcctgtaaatgtggatatttttaccttttcccatgaatcacgtatattcttttttttttttttttttttttttttttgagacagagtctcactctgttgcccaggctggagtgcagtggcatgatctgggctcactgcaacctctgcctcccgggttcaagcaattctctgcctcagcctcccgagtagctgggattacaggcacccaccaccacacttggctaatttttgtatttttagtagagacggagtttcaccatcttgaccaggatggtcttaactcctgacctcatgatccacctgcctcagcctcccaaagtgctgggattacaggcgtgagccaccgtgcccagccaaattgtgaatgttcttaatggtatctttaatagtgaattctttccagaacgtttttaatgtactttgcccagatccatcagaagaatcacactttctggcagatatagccttacaaaatgtatttcttaaataagacaacgtgaaagttgaaattcttccttgatccacaggccacggaatgggtgttgtgttagcaggcatgaaaacaacattcatctccttgtacatctccatcagagctcttgggtgaccaggtgcattgtcaataagcagtaatattttgaaaagaatctttttttttttctgagcagtaggtctcaatggtatgcttaaaatattcagtaaaccatgctgtaaacagatgtgctgttatccaggctttgtttttccacttgtagatcacaggaagagtagatttagtataattctcaaggactcaagaatttttggaatgatataggagcattggctttaacttaaagtcaccagctatattagcccctaacaagagagtcagactgttctttgaagcttttgaagccaggcattggcttctcctctctatctatgaaagtcctagatggcatcttttttcagtataagagtggtctatattgaaaatctgttgtttagtgtagtcacctccatcaatgatcttagcttgatcttagcttctacatcagcacttgctgcttcaccttgcacctttgtgttatggagatggcttctttccataaacctcatgaaccaatctctgctagcttctaacttttcttctgcagcttccttacttctcttagccttcctaaaattaaagagagttagtgcctttctctggattaggcttttgttaaagggaatgttgtggctggtttgatcatcttcttcttcttttttttgaggcagggtctcactgtgtcacccaggctggagtgcagtggtgcaatcatggctcactggtcttgacctcctggacccaagcaattctcccacctcagcctactgagtagcagggactacaggcgtgcaccaccatgcctggctaatttttaaattttttgtagagacagggtttttctatgtttcccagtctgttctcaaactcctaggctcaagcaatcctcccacctctgcctcccaaagtgctgggattacaggtgtaagccaccatgcccatcctggtttgagcttctatccagacccctcaaactttctccatatcagcaataaggcttatcattcatgtgttcactggaatggcacttttaatttccttcaacaacttttcctttgcattcacaatttggctgtttggtgcaagaggctttgcttttggcctgtctcagtttttgacatgccttcctcactaagcttaatcatttctagcttttgatttaaagtgagagatacatgactcttcctttcacttgaacacatagaggccattgtagggttattgattggcctaatttcagtattgatgtctctcagggaatagggaggccctaggagaagaagagagatgagggaacagccaatcagtgatgagcagtcagaacacacacagcatttattggaagttttccatcttatatgggcacagtttgtggctccctgaaacaattagaataggaatatcaaagatcactgatcacagatcaccataacagatataataataatgagaaactgtgaaatgtcgcaaaaattaccaaaatgtgacccagagacaggaagggagcgcatgctgttggacaaatggcactgatagatttgcttgacacagggttgccagaaaccttccatttgttaaaaaatgcaatatttgtgaagtacaataaagtgaaacacagtaaaatgaggtgtgctgggcatcctgccatttatgcacatgcctctttaggtagaaaataatcctgtaaaagttgaggctgtggttgcctttctgagaatcttgtctacagaaatggtcaactggtggccagctggccaaagggctaatctagcccacagacatgtttagttggggctacatagagctttttacaaatttgagtcaatatttagaaaacaaaagtctggatttggggattcccttacaaaaactggaaaatttggccacactgggtcatattcccacatagtcgtggtggttggggttcagtagcagtagctgctgccccttaagacaggtccccatggtccccactcagttgcttccttatttatcttacaagcctggcaagaaatttgagttgaactgatctagaagattggtgctaagaaccagctcagtggcttagctgtcctggggtctgcaggagaaggcttctttgttaggcccaagcaggaagtctgggcatgcattgagttttaaagtaaacccttgaccaaagacctgtttatactttgatttatccattttaaagtctcattatagagcagaaaaaaatataaacatcccaggcctaagtcaaaattatgcttaatttaaaaatattagaagtattctaattatcaatataatatatattcttataagtaaacaatagttagctagaaaacataataaaagagctgggtgcagtggctcgcgcctgtaatcccagcattttgggagaccaaggcaggcggatcatttgaggtcaggagtttgagatcagcctggtcaacatggtgaaaccccgtctctaccaaaaatacaaaaattagccaggcatggttgtgcacacctgtagtcccaggtactagggaggctgaggcacaagaaccacttgaacctaggaaatggagatggcaatgagccgagatcacgccactgcattccagcctggatgatgtaatgagactctgtctcaaaaaaagagaaaacataataaaagagaagaccccactaactataactataaatatatatatatatatctcacctgggaataaacttaagtttaaaactcccttaagggtcataatagaataaatgaagagatgtagtttattcttggataaaaaactaaatatcataaaatgccaactcctccgaagtaacctattaattcaaaataatttctatcaaaataccaacagatttcttttgactttatcaaaatgatgctaaataatagacaaattaatactcagtgatagctagaaaaattttaacatagagaaatgagtaaaagtcttagcatattttaaaatatctgataaagctacaataactaaaactgtttgttactgaaactgaagtaaacagacgaacagcatagaaaattcagaaataggtccaaatatacttgggcattcacaaatgcagcatttgaaatcagtagaaaaaaaggtaaatcatttagttaatgacgttgagacaattgggcctgttgaataccttcctcactctttatattaaaataagattcaggttgaacaaaacctttaaatatcaaaaatgaagtcataataaaacaaacaaaaaaaacctcaagggattttttttttttttcaatctcactttgttgtccaggctggagtgcagtggtgtgatcatggctcactgcagcctcaacctcctagtgatcctcccaccttagcctcccaagcagctgggaccacaggcatgcaccactacatcctggtaatttttttatttttgtagagacagggtctccctatgttgcccaggctggttttgaactcttgggctcaagtgattctctcaccttggcctcccaaagtgctgggattacagaagtgagcaactgtgcctggcctggaaatttttttataattttagagtgggaaaagtcttttttaaactatattctgaatacaaaagacaaaagaaataaatttaagtattaaacatttaaatcttttgtatgtatatggaagaacatccaaaagacaaagaacaaaatgaaaaaaaaagtgtagaagacagatgacaaaaagctaatttcctcaatatataaagagcttttaaaaatgaataagtaaaaatcctttgcccatttttttctactgacttttttttcttaacgtttcattcaacctgaacatcttttcattgggaaaaaatgcggatgcccagcagtatatgaaaacgtgttcacctgacttataactttaaaactgtaaattaaaacaatcatgagacacttaaaaacatcttaacaaagattaaagttcagtgttggagatagtatgagaaacttatcttttcacacactgttataagagcatacattgatgcaatctctttggaagggaaacttggcaatattgatcacttttctttttttagagctacacgtactggaatgggatctatcaaaattttaaacgcacatgtttacttgcttgactcagaacttttatacgtacttttaggaatttatgtcataggtatattcacatagatgcacaatgatatctatatatgtatgatccttgcagaattatttataatggtaaataaaaacagacaacgcaacatccatcaataggagctggttaaataaattatgtctcttgcacacaataaaatactatgcagccactaaaaagaattaaatagaactatctgtaccgatgtaaataagtgtctaagatatactttgaagtaaatattaagtatttaagtatttcattgatatgaacaatgaaagtttttcatttctatgaaaaaatataaaggatagacacacagatgcatgtgcgtgtgcacacacacacatcagatgcttgtatgtgaagatccggtgggagagctttgagccctttcctctgctttttggggcattatggtgctgtagcagggatgcattgcagtcgagttctccacccagttccacccagcatccccttgggatagcatatattcacagtgcccctttactctcctgaaattacattcattaagaatgtaggtctgtcttcacaactaatttcaaataaaatcaaaacaatgccctatgaggtaaatgagatgaaagcaaagttatgtataattaaataatatgtactatgatatgtatatgctctgtatgtttaaactgcaagacataatgaaggtgtccagggctttccccgtgcacagaatcacagtgaatgcaacagccccagacatagccttacacacaggtatggactagggactaacactaactcatcctgccagcgtgattttacaaataggtgaggaacccttggcaaagttccaagtaaaacaaagtacaagctttgctccatttacacggtagttgcattcctagaaaattcagtgtatattaaaaccatggaaattgcaagttcacatttatatgtaaatgaagttcagttctagattcaaatacttgtaaacggatttctcacgtacctgaatgtttggcaggacaggagagttgtgaagaatggagaaaaagtcttcactgtgtgggattcttgcactgcagggcagtaacacccctcaggcagggagaagcccccatggattttcaaaacgccctctggaggtgcagttacccaccccattgagaactgttaaacaccttgaaggaatgcccccaggagctgttggggggtggggggctctgtttcaccacacggcattcatctaactccacctgtgttagcggatgtgctgacatagtgcagagctcttcaagggacactcagaaccttccggccccacctctctccttttccctccccacaaagcccagagtgctgtaggtgcccagctggatggtgagcccggcccagggctctacctggggtctggggaacagatggcttctgcgctgctctatctcagccctcacactctgggctgctcagggaagatctcattagagagggatatatatgccgcattaaatattaagttaaacacctgctctaccagctagggccacagttctgaaactgctcaccatttgcaaactggtgacatggccagcctgttactgcactgtcagcagtttgggcctgtcctgattgggactaattatctgcaggtgtctcattgggccacaggcctgctgatgggggagccactgtgcctacctgccagagaggacagcgggtggggcaccaggctccccacttctgctcacctctctactggtgaaggacttagctgggtccacctgaccttttgcctgagagaacaaaggaatggggccagactgtatcttgctggcctttttccctgaggagcatctctttgcatcagtaagttggcatgtgaggaggagacagagagaggcctcctgtgggccagcaagtttgggaaacactagcctggtaggagacctgggccctggggactgaggctccccctgggcactgcccctttttagtagcggaaatacccacaaagacagacagaatggctgccaagtccctgagtccacctgctctgatttgcagtatccctcaggttcaatgtttggagtctcaatacccaaaacttggcagccaaagaaagtccaccctcttctggcttttaatctgagcaacagccaagggctgagggaaagagcactggaacaggagtcagaggaacaggtttctgtctggactttgcacctaactggtcctgtctttggacacattggtcatcctcttctctccaagctcatttccctatctatgaaataggggtggtaattctgcccctgcctcccttggctgtttcaaggataaaatgagccagtgggaggagggggattaagagccaccgaaggggtgtctgagtgtatgtgggcagttgtggagaaggaggcttggaggagtttgggatccagctttggcgagtcccagccttcctcagagcagacgttctgaccatacctgggtagggtgggaggatcctgtggtcccactactcacttcacagctggggaggctgaggacaagagagggaagtgacctgctcaaggccacatttagtgagtgagagctggagccccagttctagctcccccagggccctggcttccacagcctactgccattatatgatgaaatggactaaaaaaatcccagttcaaatttcctgaaggcgtctctttcagtgtgcagttgagaatgtcagcagggaagccagattaccagagctggaagcccacttcaccgtattctagctgggtgatctcaggcaagttactaatttctgggcccaagtttcccatctgtaaaatgggccagcactagagttttctcacagcttctggcaaggattatatgagcggaccttgcagagtgcttagcacagtgcttggcaggtggtaaacaccccataaatggtagttattactatgtgtctgggctcttgtccagagtcccttatctctgccctgggggcataagacaaagagacatttgcccagcgacagctctctacgtggggatgctctccgaagggtcctgatcccgcagaaatcctcagaaggtggtggagtcttggagaccccgtcaggatgtctggctgaagggcaggggtggagagctctgaattttttccacttgtttagagtcccagtgtctatcattggaagcagggacatccactgtgtgtttggggattttggggaaacagtaaacactgcatggggttgctttcagcctgtgaacccacggactccagacctggggcgtctcaagggctggggagcccaggctggtttcggctgcgtggtggagaccctctgctgggctgagtggctttggggttttcctcctcaggaaatatgttctgcctcctctgtcacaatcccctctggcggggtgccaggcagctctgaacagcgatttgttcatttttccatggggcatgcctcctttgacccatttttatgagcctttttgaggctcatgagatgcagtgaaatacctcttctctcagagtgaaatcataatgaataatgaaagcaaaaatacaagaacaccttatgtatccaggctgccaaaaggcgctgtaaaaaattacaacaagagctacagtgcaggatgataccctgcaactgagtgtcggccacggggccgtcctcggaattccatggaagatgctgggctggctatcagagttgttctgtgggccgggcgtgtggctcatgcctgtaattccagcacttccggaggtcaaggcgggaggaccacttgagcccaggagttcgagactagcctgggcaacatagggagacccccccgatctcaaaaaaaaaaaaagttgttttgtgcattggaaaggagataatatcagtagttacagcttattgggctctcgctctgtgccaggccgggagtaccatggtgcccctggtggacagtccctgccctcactgggcttacttgtggggcagaaccaggcaatttacagtaaacacagaataaatttgcaatgtaattttaccagggcatgtgctctgaagaaaataagtgggagagaagagagagactcagggagtggtgcccagctggggggatctctgtaaaatggtggtgtttgatctgagatctaaatgttgagaagctttgtggggagctcggggaaaggcattctggcagaaattacagcttcagccttttaaatgtacaaatgaatgaacgaatgaatgaatgacatgcatatcctaaaggatgaggcaggtttctcagttgtttctctgctgccagccaggctcagcccataaatcaggcttcgagggctcttggagttagaggaaagcatagaggtccggcggcctgactcttcacacagcgcggggtcagttccacatcagggcttggtcacctctggtattggggatttcactacctcaaaggcgaagtctcttccagcggtatttacccaaagctgttctcagttgaagtgatttcctttcccactgtcaggccagaagctgaggtatctacaaagtccaggcgggcatctatgctttgaactcatagaccaggcactgcccaacacaccccttagcctggcgtgtgcccccgaggtccagcccaaaggtgctttgatttgcatagagttttttaaacttaaaaaaaaattagtcctaacattttaacaaccagaggagatacaccccaatgtccatccgtggagaccttgttatatacagaatagctcatccacacaatggagtgggaaagaacgaggaagctctttatatcctcataggggatgtaaataatgtatctttgagatatattatttatgaaaaaagcaaggtaaagaatagtgtatacagcatgctgcctttgcgtaaaaaagggacaatgggaatgcatatttatgtttgtgagaattaaagaaactctggaagggtactcaggacttaaccatgtttaggcagagggtgtggggagaacactttttactgagcggtgtttacattttgattttttgaaccttatcaacatatcggctatcaaaaagttaaatttaaaagtgccttaaaaatcaggagatttaacattaagagggtggattgcttgagctgaagagttcaagaccagcctgagcaacatggtgaaaccccgtctctacaaaaatctacaaaaattagctggatgtggtggtgcgtgcccatagtcccagctgcttgggaggctggggcaggaggatcacctgagcccaggaggtcaaggctgcagtgagccatgatcgtgccactgcactccagcctgggcaaaggatcgaaaccctatatctaaaaaaaaaaaaaaaaaaaaaaaattaaaatgtctagcttctcttggaaaaaaagtaagactcggccaccttgggtctacattcccaagtggccacacttggggagagttgagaagtggttgccccctgtagctaaagcagcaggctcctgtttaccccacaccccacctggcagcttcatccacttaccttacctgctggcccctgtgggcattgggttttcaaccctgttctaacccagtcaccccatccttcctgtgtcctcttaccttcattcctgcccaacagaaacccctctctcaagccaggaagggcagcccacaggctctccagccagccttacctgtccctgacttcaggcctctgctcaagctattctacctgcctgggatggctttccccagtatcagctcagtgtgcaaaccacccgctgggaagggcctggaatagcgagtgcaaagttctcaagaatgtgcagcaacacagcgtttcatcccagtgcaatgacatccgctctctccagactcaatgttgtgggccctttgcagtagcagtggctgcagagtgaaaactccatatccaaattggactctccccagagatgcagggctatttgcattccagaacgatttgggggtgaattctattgaaatttgaagtatttgctttttcactggtaaatagactcacaattatagattcttggattcctagaaacctagaattttggaatcttagtgtttggaaggctactcagaggttcagaggtgccagaggtccgatcattttaaagccgaaatgaaactcaagcatcttcgtaattaaaatgcacgtagaagaaaaatatgatttgctttcaggttagcacaatgttcccaagaaatatttgttgaataaaatgaattaatatttgtgtaaagtgtagcatcaattaaaaaaataatttcagtggaaagtactccagttgtttctgaccttatatttataggataaaaaataaatgaagctggacagcccttctgctaatggtctcatagatttttatacctgtgagtggcttgggagccgacccttccaaagagccttcaagcaggtctctgggcctccagcatccagcccaccctgctgtgatccatcttcctaaaatagcgatttcattagcttgttcttgtggtcagagatccccactgccttgtcattgtctggaggagaaaaagtgcaaaggatagcacctgggcaatttgcagagcttctgccattcatcacccattcactcatctctccattaaaactgaactcctccttcatgtcagacatcagcctagtctaagtcctgagggttttagaattcctgccctcagccaactcacagtctgatgggggaggcaaacatggatacatgtatgcagcaaagcaaaacaaaacaaaaatgaaaaagaaagagaaatattgtgggagaagccaagtgcttttgacagcatgaaggaagggacagttgcttctctctgtggggtctggggaaggttttatggggaagcaacatctaagctgctccagggaagccatccactcttggcttctctttggtttaatctctcaccattctcttaaaaaaaaaaaagtcttctttttttttttttgaaacagggtcttaccctgtggcccaggctggagtgcagcggtgtgatcatggctcactgtacccttgtcctcccagcctcaagggatcctcccacctcagcctttcaagtagctgggactacaggtgcacgccactatgctggctaatttttgtattttttgtagagacagcgttttgccatgttgcccaagctggtctcaaactcctgggctcgagcaatcctcccaccttgacctcccaaagtgaataattcctttttaattgcaaagtaatacatgttcactgtaaaataaattcaaatggcacagaagtatgtacagcaatctgtccccacgtctcctcagtctattcctaatccattctgtagatgtcatcagagttggcgatttggtatgtgttcttccagaacctttgctgtgcataaagaaacatgtcaggatgtacacatacagtttatttcctataaatgggttcaaactctctgcattgttgtttaatttttttaaggttattcatgttttaaggacaccctagctgtcggtaagtaaagagcttccaccctgtctgatgaactggacgaaccagcatggactttttccctagcagtgtggctgaacagccccgatcctcagggctagggggcgaatctctctcagtatttgatacacggggcttcagacagaggtgaacaggcccaagaagggcagaggacagggcaccttggcatccacaggaggcccagggctgttggcatagagacagctgacttggagcctggctatggcctcccccatgctatgcggggagggaggctgccaggaggacaaggggaagccacggggaggaagctttagtttagtgagaagaagcacttctgagcagtttgaactctctgaaagctgaataggctgcctcaggagataataacaatgatagctaatgtttaataataagcatttgttatgtactttggttcatttaatcttctactctttaaaacacaggcactattttggtcccaagtaatagttaaagaaacctgtgagttcacacagcttgtaactggaggtatggttttctcctaactcctctacggtcctgcttcccttggtaccaagcccctcaagcagagcccttttccgctcactgtagcacagagaggctggcgcccactggggtctgggaaactgatcaaacgtgcagtcctgtgtgcagatgctggatcagactgcctggctttgaatcccagctctgccacttatgaattggtgacctcggtttctcaacatgtgtgtatgtatgtgtgcacacctcagtctcctcatctataaaatggggatagaactcactatgtagatgaagtgagtggataacttgcaaagcactaaaagccctgcctgggcttcttacatgcggctttgaaaatctggagctcgggaaaacaacctgagtcagggagtcagacttaggggtccccagcagaggggctggtgggagagcttgcggggggatctgtccagcgtggagcaggcctgacggctgcctgtcttggatgttccattgacctcctgcagtttccagttgcggctgtaacaaattaccccaatcccaggggctaaaacaatgcaaatgtattattgtaaagttctggaggtcagaagtcctaaaatcaaagagtggtgggctgtgttccttctggaagccctggggtaaaattcgtttccttgccttttccagcttctagaggacacacaaattccttggctcatggccccttcctccatcttcaaagccagcagagtagcatcttctctcctccttggcctctgcttctgctgccacatcttctgtctgtgactctgacccccttgcccctgtttctaaaatctcttgtggttacattgggctcacctgggtgatccacacgctctccacatcgcaaatacctcaatttaatcacatctgcaaagtcccttttgccatgtaaggtcacatagtcacaggttctgggaattaggatgtagacatcctggggtggggggtggattattcttctgtctaccacatctccagggccaaatataaaagcctccttgagcaccgtgtgtcctgtagttcccctggatgacccatcatctgtgagggcactgggcacctcttttgctccgtttctgcctgttctttctccactctctctgtgagcactggctggttctcactctgtctcctccatctgccccagtgttgagataatttgtgccctccctagagtcaagagactttggaatataggtgctggataaaccctagggatcaccaggtgcaattccatcattgaacagatggggaggctgagactgagaactcaagttctcccaaagtcagacacctctggagcccatatcccttgactcctattctagtgctctttcctccatgtggaactcagcctttgtccttgcagagtgggtcttttttttccctctcctatcctcctttctcagcctggttgatccactgccctctatctgcctatctatgaagctgcccagtggaacctttatccaggcccgtctttttgccatctttcaactcagccatgcggagtccctgactccaagcctttggtcttgctggttcctgtacttcgggtgcttctgtcatttgcccagaggtggcggcagtctgctgtgaaagggagagaggggcctgatttggagtcaggctcacaggtcttcatcccagctctgccataactcctggtaactttgagaattcccttcccctctctgaacctcagttttgccgtctgcccagtgggaattataaatcctggctcattcttcccttacgggactatggtgaagtgcacatgaaagaaagtgtgtgacaatggcccagaagctgtaaggggctgggccctttcttgtgagctcatggagagccggccaccttgactgtgccaggggtccggcctccccggcaggaaagtgaagatgagctggtccaggactttgcctgtgaaaggatctcacaacactgctgagggatttaagaaccagcaggcctgacagtccctgcccatgtgccttcagtgcatgtctccttggagcactccccaagtgctgcctcctctaggaagccctcctcaattaccctacagtcagaagtcatattgcccttgatcagcccaccattatgcctgttagcccattgtgccttgatttataattctttgtgtccagcctaactttcttcttagtctacaagattctgaattgtctctgccttctccagcacagcctagtatgggacttggaatatagtatgtactcaggaagtgtttattgaatgaatgaatggatgaattaataaaccaacgagctgtctgctatgattggtcgttactaatcacgcagcactccacccttctaggtcattgtcaaggttattgacatgattcacacactcacatacatatctttgattagcataaagtcacatttgaattcaagatattatcataattattatttcttcccaaatgcattagcttctactagtctgctgccttttttttttcttggccaagttcacagctcaggaaaaaaatctctctctaatttatctctattagcttttattttcattatctgtgaggccatagaacttctactcccaccctgagatcatctataaatgtttagtaaggttgtttctggcatgaatgcttaggggcacctgctgcctgtctggatgaacccatccagagaagtgtttgccttttcagacccattagttcctttcgtatgcctctgtgaacccaggttcaagatggggtcacatgcccatgttaaggatagtgtggcccagcagcctatttagggggctggtgtgtaggataggggactagggagctcttcccccagagttggtttcaatcctgaacagctagagaggcaggcccaagctagggtcccatgagccaagagtcaccagcaggagtgatagctgatgctcccatccactccctctgcaccatgcattgttctaagcccttgacttattaatagcttgtctaatctgcataacaaccctttgtgggagtcactcttctcatcctcatttcactggtgcagtaactgaggcacagagaagcatagaaacttgctcaaggtcacacagcttgtaagtggtgtagccaggttttaaatgccggcagtcagactccacagaccacacacttgacctctaagccacactattctcataaagcctggtgagtcatggcagcctggaagtgtgccagaggaagtctgagttggacagacccctatctgaagaacagagctgataggtggatttcaggccacgtgtaggggccgggactgatggggcttcttgggtgatatctgattgaagggtagtgggttgactcacccctgaaaagctggcatccccttaggtcagcctcctgctcagacagacctcatgcagcctggccaggccttagcaggtcctgggtgaaggtttggtgagtggatgggcagacacagcaggtatgattgctccttctttcttgggaaacatgctgtgtattctttcatgttcctgcctgggccaggccacctggacatgccccagcagcctcagggctctcagcccctgctgtgcagcctcccagccctcaggctgtgtgttgtccattgtggggagccctgtgcttcaagaaactccccacctagaccaaagctttcttctgttcttttgctttcaagcaaaaaataaaagcataagaaagataattgtcattacttaaaaacaaatattttagagatggggtctcactctgttgcccaggttggtctcaaattcctgggctcaagtgatgctcccacctcagcctcctgagtagccgggaccacatatgtgagccacccttcccagccaactgcttttcttaaacagactttcttcctccttccttggtctgggagagagaaggccaagtgccagggtaaggatcatgccacttaggtctggttctcttcaggaacaagtcgtgaagtccccagttcttcacacctgcaccccatggagttcctgctttcttatcctccattgcccggcctgcctgagaggaggaaggatgccaagtgctggtggtgaggggtggggaacctcggcccaggtcccggggcaggccagcaggtgtgatccaggtgactggatttgggggaaggggaggggtgaagccagaggctgcacttagggctctgggcagctactcttttctagctggattggcagccttatggggtctttcacaaccactaatatcagccccgaatgttatagttgctcaaaaggtgttgcccaaaagaaaaccatggttggcacaaatagccgtctgtgccagtgtgggtgggggtagatttcaaacagatacctgtggcttcattattttaaaatccgtcttgtgctaatgaggctgatggaataaaaggccctggtgaaacccagcctaaggccatggagccagggtgtggcttcccatgcccccaacactccccactcggatcctgcagcctattttggcccctctccacctgggcttcagggcctctctaagggctgggcccatcagtggcctagtttctctgtggcctgagcacacttccagcagggacaggctctgcccacggcaccctcccggatgaatcccttctttgacctttgtaattattcctgttcaatcttccttcgtgttttcttcctcctccctttttgaggtgctcaactcctgcactctctccagtgtattaaggatgtgagtgaaattgatgactgggatgtctcaggtctttatgatgatgaatgactttcactgccaaagcttttattgtctgtgatttgggaagaagggggaactgatatatcaaggctgcctgtcagaccatttaatacagttataaatcctgacgtcactaactggtggtcaggagctggagaattccaccgccaccgctttgccgagcctttatggattttcttctttctctcacctttctttgcttgactatcacaattgtgttttgggaggggggatagggacagctagatagtgaatttaaaaatcacagggacaccctggtctagggaggggatgggagccctccctcacccttactctaaaagaagcagcagatagaaggcctttcattctaatgtgagcaaggaaattgtttggtgagacaagccctgaaagtatgctaatgccttctttgcatgtgcaccactctctacagtttactaagtgattttacatctgttatttttcagatcctcctaccatcttgggagggcagcagggaaagacttgaccctcgttttacagaagaggaagctgaggctcagcaaggcgatgttccttggccagggttatgccacctgggctggtgacaggagctccctggggtgaagcaacagagcatcaccattaggtgtttagggcgtggggtcggacagcgctgggctccaatcccagacccccctaccttttagcggctgaccctgggaaggacacttacattttctgatacgccatttcctcacctggaagtgaggctaacactctcctcattgggttgttctgagggttgttctagggttaaatgaaatcatgcacgtgggtttctaagctaggctcttggctcatcaaaagtgctcagtaaatgtttttaaaaggtgaaatgataaggagaggcatgtgacagatgtcacaggtgcacaacgggggccacttcccgaggctgggtgggagggcttcctgagggaggtgacacttgagcacacggaaatgagcaggaattaaccaggctggggaaacaggtgagggaagagcattccaggcagaaggaacagcatgataaaggatgagtgaagaaagcagctggagatgagggagggcccaggtccctgaggctgccaaagacctgggggcagaccttgcaggtgctgggagccctgaggagagtcgactctccaggggaatctctgtggggtcttgacagagggtggaggtaaggaggatgagactcgcaggaagacctgacctgacccaggtggctgtaaaagcccaggagagaacggatgaggacctgaacccaggctgtggaaagggggatggaggaaacattttgaggggtggaactggcaatagtcacttgtgaggaacaggtgggcggccatcaacgatggctcccctggttggagtctgggggacccgggagataatggagccagtggctgagatgaagaccatggaagaggagctggtttgaatatttaactttggggtaccccagggacactcaggtggaatgtgcagaggcagtgggggcggggtcaggactgggggcatggacacaggtggtgggaggatgtgagtcactcagttgagagctttagacaaggacgatggggaggagcagagctggagagggactctgggaaaccagggtggctgaggaggaggacgccatggaggaggacgccatggagaagcccggagtgggggagtgagtggtgattgacactcccgccacagatgcgctccatcttggaggctgtagcagtcacaggacttcactgtaaacaacagaattctctctggcttgttaagcagaaaagggattttctaaggatgttaagatgctcagggtctccaagagggccacagaaccaggtttggaggcttcccagtcaggcataaggcctggcccatgctgcaggactactctgtgaagcggccatgctgtcgcctgtggacgcagaccctttggttcacacaaccgtcgctggacaccggatgtcaccactaggacctccgcctcagcagatggactccatgtggtgcctgcttctttgtgtcatcagcttctgaattaaagactcacacgcacgtgtctacttgggggacccaaaaatatgcctgcaccctcacgcaagggaggctgggaaatcacgtctctgactttggcctcaagaagcctgaactcttaaagtggaaaatgccccaaacaaaagaaggatgttcgatgatgtcaggcagccaaaaatatttgaagatttagagagtgagcagagagatccaaggtaacaaggctggaaagaatccattggctttggtagttaggagggccttgttcttccagccagttatctcccatagcccatccatttccacaggatttgaggcagcattaaatgaaagcccaagggaatctgcacatggccagaaaccacctgaagaaaggacgaaatggttgcactggatttgggatgggggttgtggcagtggagccctgaagctccaggaaagccatagtgaggagaggaggctggatcaggaggccatggggtgggggctgtccttcaggacttgagtgacttgcagaggatgcctggactggggaaaaagtaagggagaagaatgaagcaaggacctggtggcccggccccaaccctgtagtcctgggggttggctggcaggcatttccctttggctagcccttgggtagtttctgggctttggctggtggcttttctcagtggagaggttggaaagtaacaccgattgggctcaaaaaaaaagcctcctgtccttatgggcacaaaatccctagcactgagcgcaggctgggctcagaggagtggcctgggagatgttttctgagtgaaagaaagaatgagcctaggcatttgtttagcttcagctctgcgccaaacatcgtgatgggtaccacagggaaacagaagtgagcaggacatagtacctgcaccagaagggttaggtctagtgtcttctactagacagctgtcccagcagtctgacatgtgctgggctgtggagcagcatggctctgagagcactgaagaaggagcatgggactgtgggggacaggaccagggcatctggggggtctttcacaggagatgatattggtggcatttgcctggcgcctgccaggactctgcggcaacatttgctaaggcatggaggcgagttgggggaaagcaagccatttagggctgtggtgctggtgggggtgctggaacctataccaccccagtagagatgcttgggaaaaggcaggaggagagggcatgaggggtctggacttcatccagaggtgatggggagccaaggagtgcagggtcccatggatcagaggtggctggagccaggcaggggttcagctgggctgcggtggcgatgggtgtctgcagtgcggctggagttggctgtggatgacacccccagactctgccccaggggtgttagtgggagaggctgggccagtgggtgccaggatgtccgggccaggccttcttgcccagggccgcccccagagcctgctgggtgccctcattatgccccctcatgtggcgaggagagccgggagctgcaatcaagacgccgggtgcctcctgctggtgttcggagagcgggcaaaccacatgagatcccatctcgcgcataatgtgcatccgaggacaaaattagattgagaagtaaatggagccgaaaatttccaaagcatttcccgtcaagaagctgtttgattgcatgttttaattctcctagtcctcctgcccggtgagcttcaatttggtggggatggctggggcagaaggagcctgtgatgggaggggttgctggggttctggggcccggagaccagagggaagaagagaggccctttacacatgtgaatgcagaccccacgtgcctccttctccaggtgatgtggctcagacctcagacaaccctgtgaagatagtgccactagccccaatttgtagacaagaaaactgaggagcagaaattaacctgcctgaggccgcataaataatatgcagttggctgggctgggctggcaagcactggcctgtggaactttaaaactaaagctcgtgctgagttggattacacgtttgaatgttctattttctttcttttcttttgttttaaccagaagactgccttgttcctctttctcattctctttccttccctctttccatcctccatttccaaacccaggaacaaaccatgggaggcagagcaaggggcatggttcccattttcaggattgtaaagcaaggctcatcgaggcacaggcatttgctggtagcacagaaggaaaaagttagagtcaaattctgtgaagtcggatttctgtgtgtgttgcccctgaccagtaggctcaaggatggctcagccctatctcccgggctccagggacacggctgactttggccaagtctgcagagcccaagaagatgctggcattcttagatctactcacaaaagaaagtgttgtaattctcttcatcagggacatgagcgccctggactactggaagaaaattgagcatcagtttcttgagcttgagaggtgttctgtgaagacagagggaagggcaggaaagcaacagagaaaacctgggaaaggaaacctggatcaggatccatgctgggtccaggacccaaacctggctgtgcacagccctctgggcaagaccctgcccttgcaggagtttcttcttctcacctgcagaataggcatttagtgattttttttttttagcaactgttaaggttttgtttttttcttgcttgtgtgtgtatgtgtgtgtgtgtttgaagaaacctttattcagatgaatcttcctgggaagcctgatgtaaactagttagaagtgaggttcactggttgaaagaatgggagctccagaggtccctgaggtccccctggaggctcatgggaacagatcgacccctcccccaaactggttgaactttagcatccttcgagctccggtgctccctgattccacagcggttttccagccagcgtgaaggccgctcacagtcgcatgtcctctgctaagcccagctcggttcctacctctgggcccacagccctcacaccttacccacagctgctgcctggacccgaggaagctcagactgagtcccaggcacatctgccattccaggctcacaggaggcagcagtcagatgcccactgcattgcccactctgccccaactcagcccgaatctccttctaggtcctcctgaaggaaccctacacactgaggccctgtttcagtgccttctcctccagaaggtctgcagtctgactgcaggaaccgaatctcagatctgctctttgctacatgtgagagcttgcgcaggacccttcacctcttggagcctcaatttccccatctatggacaaattgaacccaggcctgattggctcttgtacctgtccccacatggagttccctgtttagtggcgtccctacccctgcactgtacaaagcactttcacttctgtgatcccatttggggctctgattacccatgagggaggcagggcaggggtgatcaatcatgttttacaaagtggaaaccgagacccagaaccagcagtggcctgcaagcaagagcctgagctaggctggtggctagcaaaagcagccggtgattctgtgagatagttcggccctggcacctgatctgcttctcagggaagggagggctggagagggatgggctggcactttggtagcctgcagcaccagcctagcagcacaatttaatgcatgttctctgcagcacattaatttgctgtgcaccctgggaggtgcctctgtgggatgggcttggttttccttggcgagcagtgcacctgctcagcctgcctgtctcgtatgggcctccttgctgcttggtttgaggaaataattggaggtgtaggagctggcgttacaaaatatcagcgttgtctgtttggactttcttggttccaagcctggcactgtgacatcgactatcccgttgccccctggaccagctgaggcactggtttaggattcgtgatgggcctcagtccctttacaagaaatcagaagcctatcagaggcttggatacttacctattgactttttcttaaaataatatgagctgtcagccggtcctggacaaagggcagagaagccgatgactatggattcctcctgtctctgcagcattagctgatctccctctggtgggtggcctggggttgggcatcaggtgcacaggtgaggacatttacagaggagaggggacctgcccgagggcacagtgaggaagtgcggggttttctgactcctagtccagggctggctgtacctccatgggctttgcacttggtcccccagccctgaacttaccccttagcttcaaagatccagtaggtccctcccaccatgcctgatttcattgcaaacacatcttagatttgagccccaggaggggctttttgcccagtggaacttggtggttaagagcacagactgctagggtttctaatcctagaaacccccaacctgtcacattttctgccagtgcaaccatgggcaagttacttcacttctctcagcctccattgcctcctctgtacattggtggcagtaacaggcatcagaggtaataactgacatttgggagcacttacatgggccaggcggcttcctaagtgctttacatgcattgagtcttgaatccttttaagcagtctaaggaggtatcattatccccattttataaatgagaacactgaggtgtaatcttgcccaaggttatagaacaactagtaattttaatccaaagaatctgctccagaccttttgcccttcaccgctaggctgagcctcttaacaaggacaataataatagtgatcatttctacctcatacgattgttctgatgactaaatgaggtgacgcaagtaaggcatttagaagagtttctggcaaatagaaagatcccagtgctggccaccattcttcatgtacctcgcatgcattcggcggattcggcggcacacacaggcatggggtgaaccgctccagaggcctccacctttgtgcacaggcctgcttccctctgcgcctctcgtcttccgcatttagaccacatgttttattcggaccccggagctggcagaggtttagcacaaatgaaagcgtgtggtagggaggtgcagcgagtgtgagtgggccatgggcaccagcctatgtttgttcccagagctgtctcactcactcggccctcgccaccactccatcagagaaggactgttggggttccccttcctcctcccttagacgaggaaaggaaggcggggtcacctgcccaaggtcacacggctggtaagtggcagagctgggatttgagccctcagagcccatgctcttagctgtgtgtgtaagcagtggggagccatcgaggatttctgacagcagctcgatgtgaacagagctgtgctttccaagcccaatctggctttgcttttgggatggcccgagggtggctgtggagcgcaggaggcacggttaacaatggtggccttactgagtgttcactctgtgctgggccctgtgctaggggccttacctgtatttgttaatttaatacatgtgacagcactgtgaggaagataggatcgtcctcattttataaatgcaaaacctgacacacagagaggcgaaatgacttgctggagatcacatggccagtgagtgtggagccaggatctgagtggagaccaccagccctgtggctcttgtcccatcgcacactgcctaccatcccacatggccccctttacaaagatttcacatccccaaatccagaaggccagtctggggaatgctatcctttctgtgctttcatgtatttattctattttttcatttagccatcatcttgtttacataaaatctatctcccaggaagggagactttcccaaccattagatttgacaggtatgttctgaattagcagctcctacccagggtgggcaagaggtgctgggcaaacatgtgatgggaatactgccagccctgggcaggagaacatggggtggccgccaagtttcggaccagccccgggactctgtgattctgaaacatgaggcgtctttggatttgtcttccatgttcaccggccagtttggagatggcttgatataggcatgtaccaaaaccaggagtgggggcgtggcgggtctcgatcagcaaccaacctcctggaggtctttctgttgccttgcactgcacaagggctctccagggagccactctggacccagatggacagttgggctctctccacatgctaattatgattacataggtttgtcaaacactggtttgtcctatcagtttcttggataagaggtgcataatatcatgttgaagtgacataccgtcaccgtcctctgatgacaaaggttcatctttgggaaccagcattactgaacctcgccgatacagtagcgaaggctctgcacgtctgtaagtgggcggctcatccttccaccaagtaccccagactatcgcggcttgggcttcttatgtctgattatattgttttcctgtctctgtccttgctgctcacctgccacctgtcacttttcctaatgtcagtttcctagccatagaagtctctttccttccaattttgctgtttttaatctgctgggggctgggaagccaagccactgagctcgtcggaactatgtgcaaatgaaagtgggcaaaaagcctgtccctaagtccctcccagccttccagagttggtgccaggaaggatttagggacaggctttgtgcccacttttggctactcatagccggattgcaggggctgggattgttcatggtgcatttcagatcggtagggcaggccaccacagaggtctggatgccagcctgggagaggcctggtggggacatgagctctgagtatgcaacttggccaaggtgctgctggcatcgtgatgctgtccttgaacgcgagaagttcctgccatgacactggcctgagagcggctgcagtgggggcagggggcaactgcacttcatacatcttggttcattattatctcttcttctagagtgtgagtgagccccttgggcacggactgtgtttagttttaagaaaacattaattttaactcaaaaagttaatttggaataaaaagtaatacacacatgtggttaaatattcaagccatacagaaaaatagaaaatgaaaaataaatctcccactcccaacctaagccctcccatctgtaatccctctccccaaagttaacagtgtcttctgtatattttcagtaacattttaattcctctatccgcctccagattttatcctctttttactagcacagatggaattatactgtacacagtgttcttccacacttgcctgttcacttagtagtttcccttggagatcgctccacaatttccacaatcaaatctacctcattgtttctcaaaactgtataataaatattccaccacaggcaagtatcataatttatttatcccagcaataaggattgctgccttccttccttcccatgaaatatcttggtgtatttttctgtgtgtttccataggtgaagtcctagaagctgactggtcacaggggagcgtgcattttgtattctgtgattcacctactgaaacaatcgtgtgtgtgaggcaggagtgactggctctgaagtcagcctcagcctgcatccagctcacctcttaagagctgagtaccttatctgcaaactggggattgtaaagcttgatgatatctcctggagtggctgcggtacttaaatgagataatacatacaaagtgcttagaacaatgcttggcgctaagagctgtgtaaaggatagttgctgttgttttggttgttattgttactgttatcatctttgcatcctttagagcactcaggacagtgtttagaacttagtgtcagataatgcatgaatgagtgaatgaatgaataaagtcacgagctagcccactttgccctgggaatccttgcgccataaatactgccttcctcctgtctctggagcagtccccgtcgtggcagggaggcccagagccatcagtgtggtagagctgctttgctgctttcctaattagaaccctgactttgtcatttcattaagttggctcaacagttgctggttccgggggctggtgtcatacatgtgcatggaaatatagactgagtcccagtgtctgctctaaaatgccaggcaggtgaaattcaaacacgcttccaaaattgaaacacagtattggagtgtgatagttccagagattccagggaggtgggtgcggtcaattcagaggaaggaatgaggagggttagcaaagtaaacagctccctggttagtggattctgagattgtcttcctggctctacaaatccagattagatctttagccagggcaattagaaggaggtcagtcagaattagttaaaagtggggattaggtaattttgggaaaagaaattgagggttactattcctaagtcaataacaccacccaaactaatggctaataaacctgtcattaggagcctgccagatccgctttaatgactggatacagctcatctgcaattagcacatccattgtctgcaggcagaggtaggctgttacatcaccattcccactgcccttcccctccgggtgaaatattccccctctgcatctaccgtcagcagcataccctccactagtggcaggtctggacaaagggagactccagagcaaccctgttcaaactgccacacatttccaacaccagctggaacgaataagcctggcggcgtatgcactacgtgtacacacgcaccgacgtgtgcgtagcaggatgaatccccgccccacgtcctgggtattgagctgtttctccccctctccctaaggtggcacttgttcactgtcatctgcttcggggtttgttgaaaatcttcagctcatgtcattgtctttggcattgttcaccttttcctacaacaggtgtcaaaatatacttcagaaaaagttaaaagcataactcttgtacaaatataaagtgaacaatatgtaaaatgaagtttttttttgtttttttggagatgaagttgcgctctgtcgcccaggccggagtgcagtggcgcaatctcggctcactgcaacctccacctcccaagttcaagcaattctcctgcctcagcctcctgagtagctgggactacaggcgtgcaccaccatgcccagctaatttttgtattcttagtagagatggggtttcgccatgttgtacaggctggtctcaaactcctgacctcaggtgatcctcctgccttggcctcccaaagttctgggattacaagtgtgagccactgcgcccagcctaaaatgaagattttatttcatttgcagactgaccactcccatctccttctgtaagtgccttatgcttatcctcctttcactcgggtttaattcaggggctccaggaagtctgatgctgtgggcaagagtgtggaggccacagcgagcaggcactgccatatctgtctctgtaggaattgatacccaccttcttttccatcaacatgggggtgaaatgatgccaccgacttatggaatgttactgtggaaaaaaccctcagaggccatctgttcccactgcttgagtattcagataaccaaggcccagaaaccaaggcccagagagggggtgaagtttacctgaggtcacacagcaatccgtgttgcctggagtgtgcaggcttcctggaccttaggagtccccagcagacagagttgccagttcgcaaagagctctgcctttcccagccagttcccccatattcccttatagtttgggccttgtatgctaagatctccctcctctgggcaggacctcttgccccagggctgtcaaggctggcagaccctctcgggccatcaagccatcaccaggatcccgcccccacctctcatcttgttcacaataattaatggctgctcgatggcttgcttccttctttctctcactcacacacacagtcaggtagatggagggggagtttggttggtgccctatggtattcaaagtgaagggttttcacactgtcagggtaatgaattctgcaagggtttgaagcgaaggactgggaggatttctgtgtcatgtgtctgggagtgacaacccccagtggttaattactgccacacgatgagaaccgagctggtagcaaaatgagataagttcattatgagctaaatttgaagttaattggattcacattccccccccccccgttagtgtacatagagagagcctacctagaaatgggctctatgaaaaagaaaaagaaaaagttgcgtctaagcaaaaactgatcaatcaggcctggttattttgtggagttcgtgatgaagggctttctgagacgctgatgcgaagagaagcatagttccttcagaagagcagacccaatgtcatatgattaatttcatcttggcaaacgttttctgagtacctactgtgtgccaggccagtgcaagggaaacaggaatgagagcagttcttgatctctggggacttccagtctagaagcaggagaaggatgggtgcccaatgctgggggattgtgaaggcatctggtgccagaacgcctccgtttggataagggtccatttgtgactagctgtgggaacttgggcaggtgcctaatctcgctgtgttttagtttccacatctgtaaaatggggataacaatagggttcaccttacagagtttttgaggatgaaatgaatctatatttacaaagcagagtgaatattgtttagaacactgcttagtgtagagccttgtctggcatacagtaaattctacaaaaatattagctgttattgttattattatcagctgtgcaaccttgggtacatcaactgcttgggagccttcatttcctcatttgtaaaatggggattataaccgcaaccttatggggttcttgtattgaatgaggttaagacatggaagtgcctggccagggcctggcttgtgggaaactccaaggaggctggagctctgtgggttgaccagtcaccaagggggcccaggttcagggtaaaggatcatagacctcacttctccatgagaagagtaacaaagaatttgcagacatgttttaatcctgttacagagagtaccattgttacactcccaataaataccctctttttccaattatcaaagaaagccccatgctcagatcattgtattacctgccagaggtcacacagcgagtaagtggtggagctaagatttgaagccaggcctgtgtgactccaaactccacccctccctgcaaggctcaggggcctagatttggctctggaggcaacgggggagcctgtgtgaaagggagagcagatgtgggtggcttcatgccccctcaagcctgccgcctgcagagctgcctggaggtctcctccctggggtcaggtctgccctctggatgccaggtcttccaccagcgtcagccatagagtgcctctgcccagcctgccctctccccagatgcagcctgagactttatatcttcccttcatgtctttgcctgttgagcatttcccagccccagccctaggcaatcacgaatctaccttttgtcggtagatttgcctatcttggacatttgtatgaatatattcacacaatacatagtcttttgtgactggcttctttcacgtagcatagtcatttcaagttcattatgaatgttactactgtagtatgtattggtatttcactctgttttattgccaaatattccattgtatggacatactacattttcattatgcattcatcaattgatggatatctgagctgtttccactttttggctatcatgaataatgctgccaccaacatttgtgtacaagtttttatgtggacatatgttcttatttctctggggtgtacacctaggagtgggaattgctgggtcacgtggtaactcgatgtctaagaactgccagacttttccaaagcggctgtaccattttacattcctaccagcagtgtttgagggttccgcttttccccatctttgccaatgattgtgacaatatgtctttttgaccgtaaccttcccagtgggtatgaagtggtgttttattgtggtttggatttgcatttccctgagagctaatgatgttgaacatcttttcatgtgcttgttagccatttcatttattcttctttagacaaatgcctattcagttgctttgctcattttaaaattggattatttgtctattattgagctgcaagagttctttatatattctagatacaagtcctttatcagacatatgatttgcaaatattttctcccattctatgggtcattttttcactttcttggtagtatcctttgaagcacaaaagcttttaattttgatgaagtccagtgtatctatttttttgtttgtgtcatatccaataaactattgccgaatccagggtcatggagatttatgcccatatttccttctaagaattttgtacttttaactcctacatttaggtctttgattcatttttgagttaatttttgtagtgtgtgtgcatctggtttcgagtcatagtcagaaagtctttctgcacctggattagagaggaattcacctgtattttcttctagtacttgtagagttttatttttttacatttatttctcagttctatttgtagtttattcttatatatggtgggaagagttgatctattttatcttttttcccagatggctttccagttgtcctaacaccatttataaaaagtccatatttgccccagtgattcgagatcctaccttcatcgtatgctagatttccatataatctatgcattggattattgggtccataatccaatatggattggatcttttgagcctttgtttaaatttttcattctattccattggttttttcttcaggtgctggtatcacaatattaattataaagacttcatagaatgttttagcatctgggagggctagtcccctcgaggggaaacatttttaataatcctacaataatagcatttaagtagaaatcatgagatctgaattgaagtccctgttctaccgcttactctgtgactttgggccagtcaaaactcatccctgagcctcagtttcctcatgtatacaacaggggcagatccctgttcttccccttcctctcaggattgcaaagagtgagttatttcaaaccaaatgtgtctcttctggaggagtggcctttgtgttgagtttcactgttctgcctggactccttgctgatagtaagcaaagccaagtcttggttattctccctggtaagagaaggccacgcatgagttagaaaagatgtacttacgtgccattaataggaggaattatgttaggaatgcaaattgattcattttagttagttatttgcaaacttattataggccatcaataacattcagtgccattgcaaatgatacaaataatttcttccttggttaaaaaaaaatgaaagaaatgtgtgctttgaggtcatagcatgtttagaagcattaaatctggtttcccatcccagtccagaggcttgaattagagctaagaagggggagtagcatctccttagctgccttgtgttgacaggttgtaaaccccaaccctggcgacatgcctaagacatgttagggaagggactgagaaggtgaaactgcctgtgtcctccaaggtcacagactcctcagcttggtgccgggagagttctgatgggcctcagagcagatctgaggcttgaattcataagagtgggttccccaaccaggcgtggggatcagcctctgcctggaatttgatacgtgttcttagaggttccaggcagcaagcttttaagtagagaacagtgatgacatttattaaatctttgtcaatcagcaattgccaccacattgctgcttagcaaatgccccccaaactcaggtcttaacacagtaatcgtttattcttgctagtgcacttggggtcggctggggattggctgcaccaggctgggctgggttccagtcacagtttgggtccatctctgctccacatgtgccccctctccttggacctgcaggctagccaggacatattctcaggataagggagaagggcacccagccacacaagcacacatcaagcttctgcttgccgagtgctcccatcccattggccagagcaaggcacacggctgaacctaaatttaagggtcagaggaggccactgtgctctaacaggaagagctgcaaagggttccttttgttttttcataaaactgaatttatttggttttaaaaaccagtttaatatatgtccttcctactttttggtgttaaattactatttctttttcaagctgatggtggtgagggtggggtgaagaattaccttccacactgtgccatgcgcttctcacacatcttccctctgcctccttaccacagccttatgaagaaggcatgcttctgtgtggttgcagagatggcacagggcaggggtggagagggcaggcttgcaagccagactggctgggtttgaaaccttgctttttaatattctagctgtgtgactgtgagcaagtcacttaaatgctctgtgcctcagtttccccctcagtaaaatagggatcatagtagctctctaatagggctattgtgaggaataagtgagaatgtgtgtgcctcactcacagtttactctccgtaagcgctggctattatcctccccattttatagataaggaaatcgaggctcagaatgactaagggactctctcaaggtcacacagctaataagtggcaaatcaagggtgtgagcctgggcagacttgacatgcttcgtcactgtgctctgctgtcttcctttctctggtgagctgcagcctccccgagacctccccacacagtgtcatcaggtttatgctgggaattttgtaagctatgaggtttcagtggaataatgctgctcaacagcccataccagtgcctggaacactggagcaattcaggaggttgagaggacacagaaagctgtcagcttctctcccttccttgcaaggaacaacccaggccctttgttttcatggctagtccaaggagagtaagcacagctacaggtgaagcctctggttctggggactgtgcctgcgtaaaactggagccgtggacaaggcaaaggagcccctctgtgatgggaactcggaggcagagtgatgtgtagagtgcatgcggccatgtgccagctcctctgagcacatactgccatcctggtgggctgggagagggggacctgagaatggaatgagtccccagcatggtggttgctcaagtcctgcacaaggctggagtcgacacagtccattacctggctatttcaccgaaattttccattggttctaggagatgagccaattttcttatgatttcccaagcctaagatttatccagctgattataatcttgggtttccccctgccccccagtgcttattcctcttatgtctctgtcttatcgtattgtactggctaaaactttcagaacaattttcagtgataacattgataataggtttccttgacatgttcttgacattaacaggaattctctaagtatctcaccaattaagtatttttaaggtattaactttagatttagtatcaatataagaacaaggaagtatacttcaattcttatttactaagaggtatcataaggaattaatattgaattttagccaatgccttttctatatcttttatataatcatatgattttcttcctttaatacattaatatgatgtcctgaacagtgctttaatattgaaccatccttgcatacatagaatgaaacttttttggtcatggtatattattctttctgtaatattgcccaatcagtatgatagtagactttttacatgtatattaacaaattgtgagactagtctttaattttttgtgtgctgcctttgttagatttttagatcaggattatgctagcttggagaaatgaattgggaagatttccttagttttatatatcctgggaacagtttaataactgagatatgtgtctcttgaaggtttaaagaacttgccaaaaagaataacaaacaaaaactttcccaagaagctaaatggatgaggcacttatttttttttaaactttttctatttcttctaagattattgggatgttggtattctctgactcttcttgaattacttttggcaattcatattttcctagaaaattgtaccttttgttgagatttctacattcattcatgtggagtgtgtttctttatgtttttaaatatcatctctggttataatgtctcctcatcctttatcttgattatctgtgctttttttttgaatcttgatagatttgtctattttattgttcttttcaaataacaattattggctgatgtattgttgtctgcttttctgtttcctaattcattcttttcttttctttttgtgaatggagtctcactctgtctctcaggctgaagtgcagtggtgccacctcagctcactgcaacctacaccacttaggttcaagcgattctcctgcctcagcctcccgagtagctgggatcacaggcatgtgccacgacgcctggctaatttatatatatatattttttagtaaagacagagtttcaccatgttagccaggctggtcttgaactcctgacctcagcctttcaaagtgctgagattacaggcgtgaaccacagcctgcccctaattcattcttttctgtttttattttgttgattccttcctccttctttccctgggttcattttatagatttttatctggcttcttgagtgctttggtgaggcactgatcttctgaacatttgctttagggttcaaggttttaaagcatgtgtaacagcagcagaaactgttggggttcagaaatgaccctgagagcaacccaccgttgaagaaaggatccactcccagggggcaggggggcagactgtcagtcccagccttgcctcaggtcagccgagtatctttggacaagttccctcccctctcacgatcctcttatccatcccaggcagccaagtaggatgtgagcacttgtaccaggcagcctcctactgggctaatgccccccatctttcaggaggcaggtttggcagcaccccttatgtggtcctggcctctaccccaacatgcacacccatcaaaactgtgcaattgaattttcctctgcgtgatggagccaatcagtgatggtgacagtgtcccagctgagagacacatggacactctggactcatggtcagaagcacagcagcctgaaagagctggacactcgcccatgggagtgtgcacgccttgagggctgaggccttaacctccatgtcccagggccagaacagtgtttggcactgggaggtgcttcctgcatcttcactgaatgaagaaacagctctaggccaaaggaggaaaaattcagtactaggccagatatgggactataaggtttgaggcagatatgccccctgttcactgtggggggctgttgaggagaggagaagggaggcatttgagctggtctttgaaggcaggtggtggcaggctgtgtgcagttggaggaagggggactttgtacaaaggacatagcagaaacaacagtgtggagatggagaggtcccagccattcttggggagtagagagtagggagagctggctggagtcggggcgtgctgtcacctgcattgcctagcctccccaagcagggggttctgatttcccaggaacaggccacatccctgactctgttcttgctgagtggagcgagggtggctggagatgtgtgtgcatgagtgtgtgtgtgtgtgtgtgtgtgtgtgtatgtgtgtttgtgagagcgtgtgagcgacaggggggagctgggggcacattgccgttcagcgtccaaacgtgacaaatgtgcagaagcgtccagggagctgtggacatgagcggctggccgcgaagatgctcaccctgtgatttgttgctttgattcctcaggccgtgacttggcgagcacgaccctccccgggtaccctccacacgtcccccccgctggacagggcagctactcagcaccgacgctgacagggatggtgcctggtgagtttgcactgtcggcgtctccacagcaggcagcggacggggtttcggtggggggacatccccccccaaacagcctgggtgacctctacgcttctgagaagcggacctgaataaatcaggcagaggtctgcactctctgcagctgggcctgcagtgggccctggaccagccagcagcggcaccagggaggacaccgggggcgaggggagggtctttgactgtcactcaaacaggccttgttggccacgtacagagtctgaacacagagggtgcaggggctggctgcaggtcacccagccggtgtggagcgagccttctccccaaccttccctccctcccggcccccgccctctctcccacacaatcgtgtgacacgaacaagcagaaggcgctgaggtgctcgcggtggcctcactccttggggttgaggataatgtgttcaggacagacgggatgttggatggtgggtttgtcatttgattctaaactgaacaccctgtggccgttggaacctgatccccccaggccggtgattgtcagtttaaaacatctggagaggaggctgccatgtctccttacattgtggggtggtgtggggacaagcggtactggctgtctgggtgttaagagcattagcatagcagaaatacccgagtattctttcttgaaagatgtttttaaaaatcaggaggaaaatcgggcctccactggatgttgttacacatcttttatgagttagcattgtctccttttaaaaattatttctaaaagtttttatttatttaatttaatttttaatagacaaatagttcagtgtatctatagggtacagtgtggtgttttgacagtgtatgcattgtggaatgatcaaatcaggctaattaacatacccttcacctcaaatgttcatcatttctttgtagtgagaaccattaaaaacctctcttttagctgttggaaatatgcaatgcattattactgactatagtcaccatgctgtctcttaggtagagtcatttacagggggcaacacagcttgtttcagtgcctggggctctaagggccttatctcctcctaacacacactcttgactgtctctgggcacctaaaaaagccagaataggccgggcacagtggctcatgcctgtaatcccagcaccatgggaggcagaggcagacagatcacttgaggccaggagttcgagaccagcctggccaacatggcgaagccctgtctctactaaacaaacaaacaaacaaaatacaaaacttagccaggtgtggtggcatgcacctgtaatcccagctattcgggaggctaaggcatgagaattgcttgaacccagaaagcagaggttacagtgagccaagatcgtgccactgcactccagcctgggcgacagagcgataccctgtctcaaaaacaattaataaaaataataatgtaataaataaatagataagggagccaccccttagagggccccactttagccctgctgaagccttgcccactctcccatgcactggggagagcctgcagggccaaacggacataaccacacccctctttctagctcatgctggagtcccacccaaataggcccaagtctcttcccccgggccatcctcctaaagccagcccatgtcactggtgtgtgcatccctgggcctgaggcccggctctctgtcgagagtgtggacggagcttggatgtgcgggctgggtgtccacacatgcgtgtgcaaggccccacgtggtgatgaggatcccagggtggggagctcagcaggacggatcttagctaggctggctcccctatggccacatcctggcacagaacgcccagaaggcccagaattctacattcgatcctggccttccaggttgtttcgaagatgtatttaacaaggtaggaggatggagcatatttcatttaacgatttgctagcttgattgatgacttttaaatatgagacacatgggaaacggcctccgtgtgtactcttgtcctgggccttgccaatgccagggaggcctgccaggttcctgcctgcaaaactttggtctgctgcaaggatggacctgtggcagatcacagaggtggtgggacacacaccacccttccccttgccccgccccaccggctcctcattttccaacctttagcacgtccaggcggccttgggagatggaccccaagccgcgtccatggatggcccgtcgcatttatgtagtgccttatagaacacggacttcccctgagtgctatgacgcaacagtcctgcaaggggggcagggttaggagagtaatccctgttttccaaaagggccagagaagccccggagaagccagggaatttctggggggctgtgcagcttgcaggaggaggacttgaaccccagtctttggccccttctacctccctcccagcactccccacacccagggaggcacttcttcctgtgccctgggctgcctgggtgtgctctctgaatcagtcaactccagcttatctgtgatgacagagggacagggacagccccggaacctgttctgagagcatgtcagtggtgaagctgaggccacccagccggtcctctcagccccccactggaaaccccaaagaggctgagttcagagaagcagctgaactttgccaagtttatccaaacagagcctgccctctggccaccaggattcctccagccctaattaccaggctcaagacacagatggctgcaggcctggcagagcctccagtgggaatggatggcgactctttgcccattaacagggcagcaggaatcacaggcccgagcaggggcacagcttcaccaagcctggcagcagctggacaggggcagccccagggccccatgggactctgtccttgggcacagaggagggtgcacgagtgtggagggaggaaacaagcacttcggcagaggagcctgctgcctgggagcccatgacttcttccttctctctctccctccattctttccttctgcatctctctgtctcctcttcctccgtcttttcctctttctcctcttgccccagcctccttgctgtctcttctcatgcatctcccagcatttattcagtgccatgcctggcgtcagggctgggattccaagctcagccgcacagcccttagttcctgtttctcaatggccaaacagggtcaggtctttgggactcttgtttccaacaaaatttccaaatctgtttcttgggtggcctgtggacattgtttttgcagacactacccccggcactgtcccacagaacagagagggcccaccttttggcagagcaggggccctgggctgtcaggcctcaccgtggttggcctcaacttgcctttctggcctcctctcccagcctccccaaccctgactgctgtctggtgcccagcacaccttggactctcacccatcagttccttcatcattcttgaatagcttcccaccttgacctgtcagaatccagcaacacccttcagggctgaatgcaaacctcacctgctcagaaaagccttcccagatggccccccctctgggggaagatgcttgtgcctggctctgccacatcacatgacccaacgtgttcaaggcacagccccctacgccacgtccatcactctcactgggaccttattagtctctgcacccttcatggcccctaacacgtatcaagttatctttgtgaatgttggctaagggagggaggagagggaaattatatggacctgtgtgttagtttcctgtggctactgtaacaaatctccccaaacctggtggcttaaaaccacagaactgtgttctcttatagttctggagcacaggagtctgaagtcagtatcactgggccaaaatcaaggtgtcgccagggctatgctccctctggaggccctggggaaagatctgtttccttcctcctccaggttttgtggttcgttcccggcattccctggctgcagctgcattgctccaaggcaggagttttcagtgtttccctgctccatcttcaggttgccttctactctgtgtgtcgaatctgcctcttctctgttatagggatacatatgcatttaggtcatacctggaggatccaggatgatctccccatcgcaagatccttagtcaatcacatctgcaaagaccccttttttcctttcacggggagtcacattcacaggttacatataaggagcctccctatatcaggctccagggagtagggcatggatgtgccacaacacgcttgagaacttcaactcagtgtttgttcagatgctgatttgtgacctctcgggcttctgaatcctgaaggcatccactgaattgtgacggtgctgaagatgatgatgccattgcattgaccccgagggcctgttggcatgtttggagaaacaagtgaagcaaggctctgggacacctgtgtctcttgcttttgtctctctgaggttgctatgctgcaatgatctgtttcactgtgagatctgtttcactccctcctggcctctggtgggctggtggtgcaatctagagggaatcccaaaatcttcggggtgttttttccccactgtcggctttagaaaacatttagctgccactactttcacttcttttttcttttcattttttaaatgaaggcatggtctcactctggccgtcgcccaagctggagtgcagtggtgcgatcttggctcactgcagccttgacttcttgggctcaggtgatcctctcacctcagcctcccgagtagctgggactacgggcacctgccaccatgccacctaatttttgtattttttgtagagacgggttttgccatactgtccaggctggtctccaactcctgagctcaaacgatcctcctgcctcagcttcccaaagtgttgggattacaggcatgagccactgtgcccggccaccacttcatttccaagtgaaggcttttattgtaaatgtgcttggaggacacacagaggaaggcacgcttgccttgggctatgcttccacagccacactgcagagcctgaaaaagtggatgtcatgtttttccttactaaatgtctgcttgttagcttggactcatgttcagcttgatttctgattccatcatcagagttgtctgctccttccggctccagggcatccccatgtctgcaaaacatagcttctggtcttctctagggtttgcagattcagtaaactctgcatcaccatttgcagagcagttacgttgaagaaagcgaatatagcatcttatatcagcttagaaaggaaacagttttcaaattttatttccatcaagtcccagaaaatgccgaaaattttgcaccaaagatttcatagtgtcttgattggtgtaaccagttgattcctgcctgaagatattttgcaacctaacatggttgcaaatatcttaacatggttgcagatatcgacatggcatttgaaattctgacaaattctgggctagaggaaaaaggaaggggagttcattgccctttggctttagtaagtctgagaaaaaaaggttgctatctttgaggaaccggtgggtgccccatccctcatggcccaccagaacaatgtgcacaaaggcactaggtggggtccctgtgggcctgggcactgtacttgccatggattgatggacatcatttctagatgcctttcaattgaggcactcactaaactgatggcttttattttcttaaagaagtaggaggtgagggtgcagtgtggagtgggggcctgaggccagaggagaggtgggcgcagccgtgtgggccgggaaggcacagggtccactgaacaccacagggggagtgagaggggcctgctccttcccacctcagcacctgcaacttcctctgcttaaagggctcagcccctctctgctcgttgcccagcttgcctggtcccctctcacctatctgggtttcccttccatagagaggccttccccagtgaccaaatatatttgagtttcctgttgctgctgtgacaaattaccacaaatgagtgacttaaaacaacagacacttttctccctctgattctggaagtaggtctcactgggctgaagtcaaggtgtctgcagggcttgtttcttctggaggtgctaggagggaatgatttgctttcttgtcctagcttgttgctgctgccggcattccttggcttttggccccttccttccttgtcgaaactggcgatgttgggctgagtctttatccggctgcccctccttcctcccccattcacttagagagctctgtgtttcccttggacccacctggatatctaggataatctgcccatgttcaggacagctaatttcattttatctgcaacctaattcccctctgccatgtaatccgacataatcatgggttctagggcttatgatatggacatttttggggggggccacaattctgcctgccacataccctccgaaccaggaccccctatcattcctctcccagagcttcctgctcttttcatgtgcagcactaagcccagctgaagtcatttagtgtgtggtttactcgttcccctccggcttctcttcaggtctgtatggtatgtaagagctgtacaataatcaaggctatgtctgttttgttcacagttgtgtccttagttcccggcacagtgcctagcacctagtcgcactcaggacacagtagctgaaattaaaatggagaactttaggccgagctgccaaggagagcttcgctaggtttgctgtggccctgagtctgggggctggggtgatgcaaccaaggaggctggggctgacccagggctgggagtggtagcgctgttagagtggccgccacatggggaagcagtgggaggctgggtggttaagagcatggacctgagccagactccctggttctgagtcacagtcctgcttctcactagctgtgtgacttggggcaagttacataactcctcagggccctggtttcctcctcgtgtataaaatggggatactgataataaatgtgagcattaagtgatgtaatatacataaaagctcttagaattctgactggcacatatggagtggcacataagtgttcattattattgctattattatttacacaggggcctgggctggatagggcggtgaacagagaagcctagcaggcatgctaacgctcaaatcaagagctctccagcagagctcatacctcctggagcctgtggatcaatgggaaagccaactagagaagaatccagtcagaaatgagagcactgccaagtaggagtcaggcagtctccgaatacagtgggtctgcagaaaacagagaggcagctgtggttggtgcaactgagaaaggcattctggcaaaggtggccctggagctgggctgggaaccatgtgtgcttggctatctggagaggaggatgggggctttgcggtagggcagaaggctaagcctagtggctggtgtgggttcccaggggtgggagtccagcccaggccaggcaagtaggattggcagggaggggagcctgttgagtggaggctgatggccagcaaggttaggatctgagcttggcaacttttggaggccaagcagacatgcagatgaggccttctgcagacaggtgcatgaaccccaggagcatggggcgagggccagtccagacagaaatatgcagatgccccaagagaagcgaagggtgctttggcaagaatgtggcttcaccattattagcagtgtgaccacagaggagctctgtgacttctcggagcctgccttgctactgtttgaaacgatggttgtgtagttacggagacaccgcctgtgtgagataggaagggtattgaggttctggagcggggaggagaaggtttcttttgtggtctggcaagcccacccctgattctgcgtcttgcctgccctacaggcctgctctgtgcaaagcatgcaggcttaggggtgggggccgcagtaccaggcagcatcctggcccagctcagccaggacctctgtgccatctgacatgtcatttccactctctgggtctggttaagcatgtgaaacagggagaaaatatatactgcccagttccataggcatggccgggagtagtgaacaggattcagagggccaccttttccagccttgtatcaagaacctttcctatgattagtactgaagacattggaatgggcagacttgggagggtccagcggacactggtgagaacttggtggtggggatttgagcatcagatggagagaggaccagtgctctccaggcacctccgtgacctaagcatcaggctcagggagcgtttgctcagggaaagaacagcctttgttcttaacactaacttcccttgacccctgactttctttctaagctccttgctggggctcctggtagctctctggcctgggcacgccacccctttgccaacctggccctggcctctggggtgcacacctgttgctcgttcctgactctttgctgccctctggtggcctccagtcactctgccacagcaggaacacagacttgaccctggggaatcctagacacagctacgatgaaatgcaggtggccattcacttgttcattcattcattctccatacatttcctaagagacccttggtgccaattgtgggctaggggtggagctgccgacacagcccctgccctcagggagctcacagtctagttggagagatggatataaaaaaatcctgatgtgctaatgttaagagctaagacctaggaatctataaagtgtggggaaatgcaggtgagggggaccactgagtctgctgaggcaatggggtggagtgggagaaatcagggaagacttctcaaaggaggtcatttgagctggaccttgaagagtgagtttgccagtctgtgaagctggagggatattgttgggtaagggaccagtgcgtgagaagccccaggggaaccagagaacatgggcatcagggagggagctgggagtgaccaaagccttgtggggctggtgggagatgagctggaagggaaggctggatctagggaagaagggtcccagtcacacccacacctcagccctggaaacctctgggcatgaggctgagcatccaatagccttgcagagggcaggctctgcccaggcagatgtggagagccagggttgcctgttgcctgtgccctcatagggtggggggacgaggggtctagaatgaggtggtctggacagtctatgtgactaaagctccaggaaccctgcacggaagtgatgctgggagtgaggagaaactgatacacacatgtaggctttctcagctcttgcctgcatttgggaagaaaagaattacaaaagcctcagagatggaaaggactctggggacatgaaggtcctacttgaatttaggagacctaggttctgattctagctgccagatactcacagcatgaccttgagacatgaccttgggactccctgctctctcttaaagcaggaggcagggcctggggaggctgggctgaatgcaccccagggggttttctgctcctgccattcaaggtttctaagtcagtgatgtttatccctgctcataacagctcctgaccgaactggagggctccctaagccctgccacctctgttctaagtaagcagaaagtgcttccaagttcccttcagatctggggctgtgaataataagacagtggccctgggctgtcatgtataatctggtaatcacttccaagggctggactgaaggagaagagcctgaggacttgttaaccttacacactgctcccatgtcttgatcgggaaggcccagaaactgctggggcaggccagggctggcttttggggcttgtgcacctgggaggagggctcccagactggaatctgcaatcttagggtgagagagaggtagtaaagatcaccatcatttgttccatctttgaaagcaaagtgtcccttttgggagcatggagatggggagagagaatatcctaggctcacaggtgctgggaaacattcttatttctcacaaccccattgcaaggacagctgagaagcagagtctcagctgggagagtgccctgtccaaagccggtgctcactggcccgcctgggaagtgtgcagtgctgggggagctcagagccaggggctgaggacagctttggtgctgctctgggctgaatctacttgttagatttccccagtttccagctccttctgatggtggttggcaggccccagatccaactgcaccaacctggtcatgagtatgtgagaacatgtgtttgggatcctgacttacaatttcttcctgatgtccttctactaatggtgtttcttaaaaacaaacaacaaacaaaacgactgggctgtgatggctttttaggagatgaaggggaatgctatcagaatttgctttagaagaaactgaagcatttgcggaagggctaagcgttgggtggctgatgcagggtcaaggtgggcctggagggcttaaaggttctcccagccctgagaggttaggggtcccccattagtgcagagaggagcctggacgtacacagcccaaagtgagggtgtcctgaggacagtggccttgctgaaccttaggccttcttatcctaattcctgatgaccaagtcagattctgaccagagacagagtgggcatgaatccaggagataaacgccaaggactggacgaggactgcagcccgggtatgcacagggcccacggagtggcagcagaagccatcctcagcccctgccacacagcaggtggcagagcagcctgacgccaggcctggggtttaagccacgctgctacaggcacctcccagtagcactgcttgccaaaaggcctgtcaagagggcaggtggcaattccctctgttttgtggttgagtcttggttgggggcaaacagggagaaagtactctgggcctggcttacctggaggtaggatgggaaggagaggctgaagtcctaggaggagcctgggccaggcagcccctgccctgagggcaccctatgcaggagtgtccagggctcagaccagccccttcatctactgggcagcagcaatctgaggggcttggggcccaatgcactccttcccttttcttttactttttatcacattatttacgagtgcgtctctacctccaccagacttgagctcctggaagatgaggttggtgtcccagccaagacttcccacaggatcctaaatgaaagtgcagggccctggagaggccctgggctaaagtcccaggagctttttaggaatctacaacaatctgaggcccaaacaaagctccttttacctctaaaattaaaataggaaactagaaaactgacattaataaatgtcatagtaaatgtttacaaattgtaacattgttgttaacttcattaactattaaatttagggcttacaaaaatttcattacatttaaaaaccatttttagattagattttgttcctttaaaagaatttctaagtttgtgcctcagttgcagagtattcatagctaatcatcaattagattacttgtggccaaataatttcaaaagtaaaattataaaaataagctttttgtgtttttagagtgaaaagtatcattattatagggcatttaatgcatgatgtgctgtggggtagaatggaaaggggcctccgtgtcctagaagaaggggcttgggagagagcctgttgaaatgtattgaacataataaataattgtggggccttgagctgatcaggttgcagtggccatccatccatccatccatttatccatccatccatccatttatccatccatccatccatccatttatccatccatccatccatttatccatccatccatccatccatttatccatccatccatccatccatccatccatccatccatccatttatccatccatccatccatttatccatccatccatccatccatccatttatccatccatccatctattcatccatccatccatctatttatccacccatccatccactatcgcttccttcctttccttctcccttccaacatttattgagcatctacatgtgccaggtagtagcctaaggatacaagatcaaaactcatgacccttgtcaggcaaatctgtgaggggctatgggggccagttgtggtaacaggcaagcccagggactctgggaacacagagaagggggatggagcctagactggggatgtcagacacagaggggcttggaatctctgtacagtagggctgggtgggaggcatgtctgagggtgcttttgcagagagttttgctaagattgagaaaacacatcaaagaataggggcacagctaaagctttccaagacatccctggtgctgcccttagggcaggggaggaatctaggaagagacaattttcaggtttattgttgagagagaaacatatgttagccagtgggaggtggagtgaggagggagaagatgagtgtttcaggcagagcaggaacaatgaagacaaaggttctgagatgtgctttgctcctgtacttactgcagtctttccgaaacccagctttaatctactggggctgtcagagtttgactcccttcggcttgctgggatctgcagcccctgtctccaagaccctgacagctgtcagtcttcatctggaccaaccgctgcctccaaccctgagggtcactccacctgggatactgctatccagagaacttctggcagtgtccgaagccctcagggcagtgagagccagtggagcttggcttctgccttccaaaaggagagtgttctcaaatggggccaaaccacccatgcccgtaagctcattctaccaacaagccccatgcttccccacccccaacctgcatggtgctttagagttatcaagggacacacagctgttagccccagttgccatttgaaagcatgttgtgaggttggagtgcgcatatccatctcggaggcaggctgactgggttcgggaggtggtgttgcattgccagggggatagccagtcagggaacagctgggcttggcgcctggaacttagggtctctgagcctccggtgtccatggagactgagaggaaattgagactatctatgggctctggggccagggaaggtgctccctcagggacataggtggccttcctaactcgagttcttttatggcccaggaagagctcttcctgctgggatgctacggagctcacacttggaattctggtatattcctttctccctccccatcctcacctgtctgtgtttgacacatgctcctagacccaaatttaaggctctctcttacaggaagccccccaccgcagtccctcatctccccactgtgtgcaccccccgggcactgcccatggtctgccatagagaccccgtgcgcccgtctcctggctgcgtctgaggtcagggctgcccggaattcctctcagatcctggccctgcctgcagtaggtgctgcctgcagtaggtgctcagtagctgtgggtgggatttatctgaatacagcacatgcccctccccatcttgcccggtccagagtccagggcaagttagggtcggactgtgtaattaaacagggcttgagtgctactggcacgcccccagtccttcttccaatatttgctctggcttctagcaggaagacgctgagacaatggcccttgttaccctctgtttgagttatttatttttttcacttttccctccttcccctctcgggggacttgcctctcgccctcatccctcatgttttccctttcacttgactgtcactctcattgtcctcccggggccgggaacgcggggtgacaggcaaggggagcccaaccaggctgggaggctggaaatatagtcattaatgggacccgcgaagcccagatgtcctccctgaatgcgggtaatttgtttttaatgaaaaaccatgcggtgaccctgaacaaatgaattttctttataaggagtctatgtgcaacgggcacaaataaagggcccgaaacagggagacttaaatccagggctgaaagaaagaaagaaaggaagagagaaggagtggaaaagagaaagagagataaaagagggaggaaggaaaaatgtgaaatgacaactgtgttaccatacccttcgcctgaagagcaatcccaggccaaaaatgccttgggcattgtcctgccagggcagggtttctgaccgctgtggccatcgtggggtcttgttcacaatgatgctaagaagacgaacccccacctggacggagctttgctattcatgtgcccctttcatgtataattgcagtggagcctcacggtagccccttttacagaggtgaaaactgaggcttaaatggtttgctagcaagtggttcagtctagatgacaagggaaggattttgccaatttggagtgtgactcttagaaacactgtgttacagcccagaaattgctttcattgtgtgatgcaaaagaagggtgtggcacgagcaggtctaagcggggacaccaggtgtataccgaagagtcttgggttgaagcagtttcccatagcccctacaactttgcactggacctttgtgaatgaatagcttttccatgggcactgcgggtgtggggttcctgggtagagaagaactccccaggaacgagccagacacatttggaaaaacaaatgcaaagaaattggaatctagccttgggaagcaggagaccaaccaaggccccccccccaccaccccatccaggacattttgtaggctgtagagctggccactgggggcagcggcaaagacattgattcaacagaggccctagccgagggccttgcctttggctttggagaaatctgctctgcaggagaagctttgaaggctgttagccctgtgtagattgggctgtgcctgtgtggagcgtgttgtgtgttcaacggagaggccgttgtgtgttctgtagctgcttttccgtccatcactgatggacagggctggactcaaccttagaaatcaacccagggctgtgcagatgaggatgaggaaaggacttgttcaaagtcatatggcaagtcagagggggagccaggtggccctctttctgccctattgtccccacccccctcagttcctcaccgaagcaataaaaaagaagctattttgtctcctgtccttgtgcagaactggtataaaaaggacggttcctggatgccctggcttctacagcaacacaaatcgagacccccaccttcaccccaacttttgttgtgctcttcctgaatgcagatcctctcccaggccctgggacctggccagctacaaaaacatcttctcttaagtctcaggcttctgtgcctcagtggatccaggcaacggtgggctccccaggtctggccgaggttggtctgagacctgcaggtacgccggggcacagctcccctacccagagtcaggtagccagacacaaagaaatgattgttttctgttcctgggttcagtttccctctggaagctgtgacccagttagaaagtcagacagatagaaaaatctgaccacgaccccaactgaggttctgaagtcttggcttctatttaggcctctgcctcgaacgctccctggtgaggcccggcccgcccgcgcttcttcagccaccaggagcagaccttcctagccgctggtttcctccataattgatgatttattccccactgacttccaaaatggatttgaggcaccttcctgacctttcaataacatcagccccaacctgaaatccctgtcataaaacaggaggactgccagtggttcccggtggggcaggagtggatgcagatccaccccacctgcccgaggatgggcagacttgcttttcacagcgtggcaccactgagccgtcctttgtgcccagccctgctctggagcgacccacgcttcactgctaggaggtgggagctcacttttttggaaacagctcctgtctggatgcataccagagcaggcttccaaaaacatacttttaatcaaaagaagactaccagaaaaactggggcaaattgtgattttgacagtggacaattataaatactgggaggggttactagttggcaaataaactccgctagtgaagtcttggattaattataccaccagtgagctggccgtgtggggtctcctgattatcttcatttgcggaatatgttctggtcttcctccatttcttccttctctccctctctccccagcctctcccgctgccttccctcctctcttcccttcctcccttcttccttgactcacttattcattcatcagacaatccctgagtccctcctgggtgctgggcctagttcaaagaatgggcacagaaatgactgaatgaatttctcaagacctaggagaatcgcccatgctacctgctcagatggaaagaaaccagcttgcatgtggaggttctgcaggattgctaggcccaggggctaggcagagactactgggggacaagagggcaaggtgtggggagctcagaagctgagggttgctgactcgatggatgctctggccgggctcaccctgggcctccctgggagaactgagggaagcacctggaaatcttggtctctgaagtgggtgcctggcctgtgtttccaaatagggggctctgtatttaggagtggggaggagcagggagctgccctgaatggctgcctgctttggaaatttctatgcatttgtaataacaaaattaccataatttgctcgttaacgcagctagatcagtcaagcattgttccttcgcgggcgggaaggccgcggtgcctctctctgcacactctccacaccccagcccgcctgccagcccgttagagtgctggaaattagcatgcaaatggtcctaattcggtgggcgagctgtcaggcagcgcctctccggcctcgtctctgtgaaggccctgacagcccggctccggcgccggcccaccctcctcactccagccaggaggggctccgaggggcacctctagactgacagcttggcggcctccctccctccgtcagcgccatcagccctggcggcaggctcccaggggagcaggcagggcctgccaccatgctggccaggccggaggaggcaggcaggccggtgggctgaggggggaggctggcccacgctcaggcccaccagccttagctggcctgggccgatgggggcaggtgagggtggagttggggtcccctgactcagggtccggctggggcacggggaccctcacagctggtgggttctgacagtggccccatgaggactctggacaaccttttcccacctgcacatccacaaggatcaagttcaagtcctgccctgctccccactcgttgtcttccagtcctgacttaacacattgctcctcgccctcccccatacctggaccgtctctgtccaggtccactcctggaactcctcaggctctagtggagaattagggaggctgagaagctgcatggaccaggacttggcacctttggccttagtcctgcctgtaggtttaccagccttagagggaagtcacctttctgtctctgtacctcagcctgcacttttatggtctttttcccagggctcctgtgaggaaaagggcttgctttgtagcagtagctgacacctactaagcacttttattgggggggcggggggagacagagtctcgctctgatgcccaggctggaatgtagcggtgcaatctcggctcactgcaacctctgcctcgtgggttcaagcaattcttctacctcagcctcccgagtagctgggactacaggcacatgccaccatgcccagctaatttttgtatttttagtagagacggggtttcaccatgttggccaggctggtcttgagctcctgacctcctgatccgcccaccttagcctcccaaagtactgggattggaggcgtgagccactgcgcccggcccctactgtgcacttctatatgccagtcctgcactaattgcctttcattccccgacctgcgtgttttttgcaatgctcccattaggctgctgttgatgttatcccatttcacagagtaggaagtggaggcatcggcttgcacagagtaacttgcccaagtgatagtaccaagatagagcctagtaggctcactggttctagagcccttttaacaagagaaaacacaggggcctgagagctggagcctgcctctgcctggcaatgtgccctagagcatgttcctgaactgtgctgggcctcggcttctgcattggtgaaaggcatgatgacatcacctgacagatgatttgtgcccctcatagtacccggcacatcattgacactaaataaatgtaagttgaggccaggcacagtggctcacacctgtaatcccagcactcggggaggccgaggcgggaggctcgtgtgagaccaggagtttgaggctgcagtgagctatgctggtgccactgcactccagcctgggcgacagagtgagaccctgtttctaaaaaataaaagaataaaataaatacagattgaaaaaaagaacccaggcgggtctgtctttgaagatccattggacttatccttacgtttttctcctgatctgtgacagcagtgtgaagcagctaccgcaggagggagagatcatgcaatagggtttgtcttaaagtttcccctgggctgtccccaggctgtttctcagcaccttgttccttccttctcttgagcagatgaagccccacgccaggacttagggtttggtggctgtagagcaggctggacctcagtccccacttgtccagtcagccggtgactctggtgcaatgaacaacctgcccttccctgcgtgcctgccctgcctgcccccttggtctgttttaagggcatcttattgggcctttttaaccttcagataaatggagaggcgaaagagaccctgagagtaggtgggagctcatgagcctgagtttctgccgcattggaggaccacctgctcccagcatacagactggcacagggcagatgcccagtgaacatgtaaggagccaccttaaagaacctgtgggccaagacgggaaacaggcacgcaaacctgggcagggctgaacccaaagccgcccacctacctgcttcagaccaaacgcccccagccaggggtggcttctctttcctatgttgcttttcctttccatcttctttttggtttgtttattgggggtcatagcatgatggatccacgtgccagcctctcaaatcgctgctgttgggctgtgtggaacatcttttggagagaacatgatctgccaaccacaggatctgaagcagcatgaggacctctcaggggcgcatctattcccaccccagaacgcggtgctggggacttctgaaataggaaggccggactgctgcctgcgaagttcattgctgcgggcgggagaattgaccaggctcccccttgtggagaatcgggatgcatcgtcctcctgcattcctggtgtgtggccagacaggactccgcacccacacccctcctcagtttacccagagcttccacacccatcttctcttagaatcctcaccacaaccccgtagggacccatttttatggcttttgtgacaggcttagcgagaggtagagaggcccaagatcatgcagagccaggactagaattcagcatgctttccctctaccagctgcctccacacacctggccccgctccgtgagtgcccttggctttggccagctgaccctctgcttgcatagccacatggcctggcccttcccagtcttgtggcattaggatagaaagggccagaggtgtccactcagtgggaaggtcagtcttacagtaaatccttgcaacagcctctttcctggtctccccattgccagtcatgaccctttagtctattcacaacaacgcggctgcagtgagcctgtgaaaattggagtcaggacacgtccctcctgtgcacactcagagtagaggccaaagtcctgacctatctcccactccccacttccctccctggccttctctcccctctccccaccctggcttctctccagccacataggcctcctggctgtcctagccacacacctcccacactcctgccccagggcctttgcacttgctgttccttctgcttagagggcccttcccacagatattcatatggcaaactcttgctaccttcattctttcttcaaaagtcaccttttcagtggagtcatccccggtcactccatctaaaattccacctcctcccaatatttcttattctgtctcctgcttcatgttttctctttagcacccatcattatctagcatgccggacgctttgtttttacttgtctggtttactgttttgtttgtaccactggaatataagctccatgagggcagggactgttatctgctttgttcagggctatatcctcaggacctggtacctagtaggccctcaatcagtatctgatagatgaatggatggatgaaattgcgactgtctgcagtgggcctggtacctagtaggccctcactcaatatctgatagatgaatggatggatgaaattgcgactgtctgcagtggacctggtgtcaaggcagatgccaccagggctcctcaggacatctctgggcccctcccactgagccctgcatttgccctcttaggtggtttcttcacttatctttccttggcctcccaagatatctttcctcccctcctcttccctcccctcccctcctgctgactccctccctgcagagccatctctcagccaggtgtgtgggctggtcacaggggatacatatgaaagtgtaaatctcctagaaaaaaatgggtcttcatcagcacaggactgcatggggctcctgccttctggtccagccttgggagctgtgagggtcatcctaattcagctccctccatggaatggccctgtcaagctcactgagtcatggtggcggctgccttgtggcctgcctggagtctcccatagaagccagcccttctcagtggttagcttatggtggctgcctgcttagaagccagtctccttaggggccccatttcagaggccgtgggaactggacaccagcatgcctctgaggacgctagcgaaactctttaacaaggatcagtgcttctcaagctttattgcacccaaatcatcagggatcatctcagagagcagattctgcttcatagagttgagggtgggtgcaggaggcttgtcctctaacatgctgcacactgagtaccgagtccctgccccctgtctctcaaacttgctgtacattggcgtcaccttggaagtttcgacaaatattaccatctgcctccccccgcttactccgagctccctgtgaactagtatgagatatggcctggtcatctggatttttaaagcttcccagatgatttttttttcttttttgagacagtcttgctctgtcacccaggctggagtgcagtggtgcaatcttggctcactgcaacttctgcctcctgggttcaagtgattctcctccctcagcctcctgagtagctgggattacaggcatgtgccaccacgcccggctaatttttctatttttagtagagataggatttcaccatgttggtcaggctggtctcgaactcctgacctcgtgatctacccgcctcagcctcccagaatgctggaattacaggtgtgagccactatgcccggcccccagatgatttttttttttttgagacagagcctcactctgtcacccaggcttgagtgcagtggcgtgatctcagctaactgcaagctccacctcccgggttcacaccattctcctgcctcagcctcctgagtagctgggactacaggtgcccaccaccatgcctggctaatttttttgtatttttagtagaggtggggtttcaccgtgttagccaggatggtctcgatctcctgacctcgtgatccacctacctcggcctcccaaagtgctgggattacaggtgtgaaccactacacccagccccagatgattcttaatgtgcagcaaggcttgacagccactggcctgggtcactgcattattcctgcccgcctccacctcccctcagggcagctttgctgtaggagagcagtaaaacttacaggaatttgcggacacagtgaggaagggtgaggagccggggagggaggagggggcacatcccactctcagtcagccttgggagagagaaccccaaaggaatgaatgtcgggtgcagacgctgaaggagaggggccactgagaccctgaggctggcagggggagggagggagaggccctgggagctttttcagccagaggagtgaccaggagagccgaagcagctgggtggtccagcctgggtctttggcttcttccttgaccctgactctgttaggagaaataactctcccttccctacttcagcccggcccggctttcatacctgtacaaacacactggccccagcctcccagggttgcaagtaatttatgtgcgcgcctgcccctcccgcagactgtgggctctccgtgggcagggaccgtgtctgattcatctccgcctcttccagccccaggcctggcttgccgggggcaggaagggtgtgcagaattgagcgcgctcctcggggtgcaggggaaatcggggcctctgtgctgctgagttctcagcacacagtgaaccccgagcgtcctggtagtaattgtggaggtaaatcttgtctggtctcctcgcagacacttggtgaggcattccataaatatgtcagcagaagcattaaaatttgatggcaggcagcgcaggtcgggactagcactgcgacttcccagcaaggtatgacaccttcaccctccgtctcattagtcagcggcgggacattcaggcctcagcgctgagcccagcagagccaggggaggtgatttcttccaaggaggacccctggctgctctgagggacaggccaaggtctgggccgcaggaaagtaagtcagctttgggctgagcgaaggagttcctgaaggccttgggaatgtgccaggaggtttgagggtctccaagctggagggggctgggccatttttggaggctgggagccagtaatagaggctgggggctggttttagctttccagtcagtcttgtggaaattatctatttgcccaaacacagaaaaagcctcatagaacatttttaaaaggtatgggattggattcataattttaacaagcaaagagtcatttgggcagaaactggggggaggaaaactattccttagtggcagaaagactggaaaccaatcttgtctgtttcccaccctgccattgtccatttggggaaactgaggctaagtgaacctggaagggatgggtagagacggaagatcagggacttggactcctagtttgaggctttccttacaatcaagaattttaggcatttgttgaaatatgagaaaaacatcctgaaatataattttgctcaaaaaaaagtcccaatgtatctgtttttgcaatagacacacaaagcatgtgctgtgtgccaaggattgagctaagtatcaaatagctcctcacatttgtataatacttttcaattcacaaaggactttgaaatgcatcaatatttagtcctctgagtgttgtaattaccatactgcaaattaggaactcagactcagagattcaggagacttcttcgaggctgcccagctaagtggctgctgggctttggccaggactgactggctgcacacccaggggctttccaccacctcccagttaccaacatggagtggcagccactcctgccctcaatgcctgtgcagaaaatcagcgctcccctttctacaattatttacaaaaaccatgacgtggttcagagctgtcaggagccttgggtttatcggccagtatcctacattctcagctgccttgttggggagttgaaagcaaggacagtcgtgtctttgtggcccattccatgtcagcaccgtgtgcgtcctgcttactggcctctttcttgaaagaaagtgaggactcccttccctggggacagaggcagtacactttgactcaacaatgcagcctgggctggcaggtgatgggacagatttcggtacccactaaatgacaacatttgaatgtcctcaagcccacattgcagccacttcttacaggaagctttcctggataccctagctagtatgaagttccatttctactctgcttctgaatccatcttgccttttgctggcacccgaatgtctagttttgggtctaagaatcccctttaatgcaggcagttccctgaggattgaagcctaggcgcatttcactgagtatgccttactgggggcctagctctgagctctgaatggagtaggaccacagtggatgctgaattaaatggagttaccaaaatacacagcatcaccagtataggagtctaaaagtgaaacatagtccccaagtcaaagcttaagataagttttccccaaatttagtataggaggacagtgaagaactttagaaacttggggagagatgttactttctaccatgccctaccttttaaatcattcattccaactctgaagttgctccaggtagacccatgggaagtgtgtatgactgcctgaacaaacccagttgaggctagacacacgagaacctagtgagtttatttgacacttatcatgaatacatgagttggattttcctgggaatgtagttcaatgttattcctactcaactctgcagaacctggggccaagtgggttaggccctgggatgggggcttctggcaacattctagacgttcaaagagactcttcgggtttccaggccaagcatctgccagtggccaaatggatgcagagaaaaggtgctaaggacaaaacctagagccttcctatctttgtaatccagcttcagtctggtactgctctttttttgcttctccctttagaaaatttgtgtattttcaaggtcaggagatcaagaccatcctggctaacatggtgaaaccccatctctgctaaaaatacaaaaaattagccaggtgtggaggcgtgaacccgtagtcccagctgctgaggaggctgaggcaggagaatggcgtgaacctgggaggcagagcttgcagtgagccgagatcgcaccactgcactccagcctgggcgacagggcgagactccgcctaaaaaaaaaaagaggaaaaaagaaagacgaaaatttgtgtctctttattttagcttgtacttttgcactcttttgaagtgagccgaactgagtgctgtcattatgtggcaggggaggcctactgaggcctgcaggtgggagctaagccgctcaggagagcaccagtgtcccttttcactcatgggacctgcacggtggtttctgcagtaaacacagcccacttctctttgtgtgttttattccctttctctgccttgctgtctccatgtttctagcaaagatcgggactggtgtttcactaattctttccagcatggatttcacgaccttttctgttctgactctgaaaggggctggctcaaggaacatctgctgggcacacttagtgctcactcagtctgcattggtattgtgggcaagccctgtgctgggggtggggctgcagggacctgtcagtcacagatggtcagccttggttcctgccattgaggagaagccagacccaacagcaggggaaacaagacagggtcacagacagccctgaatctgtgtgccctgggacatgggcagtgatagacccagggctggggactcagggaccagtgggggactgctctcagctgggatgattaatccagaaagccttcctggaggaggtggtatttgagctgggtcttgacaaataggagaattggacatgaggaagggaaggaaggtggtgtttgggatgaaggaaacagcatgagagatggaaacggccccgtggagtaggtgtgcagaacaactggtggtgtggttggcctggaatatggcttgtggcgggtaggggtggagtggaggatgtgggcagtgggaggtgtggctgagaagctccatgggaaccagcccctgaagggccttgaccgccaccaggcggcgtctggggtgttgatcttcacaaagtgctacctgtgggcactcccagcacagggcactgcagtacccccctccccacctcacgcatgcacacaaatcaggtgttatcttgcaccctagtgaggcttcaggggggtcatttgtacatgcccattgtttgcttagatgagggcaggacaggacagaattttggaataggaccacagcagcagaatggattaaacttggaccagtgttgttcaaaatgtgccatggcatagccagggatctcaaatggaaatgcctgcaggggccaggcaggttacagaaagaaaggtcagccttggaggcaagtacaacagatctagatagatggaagtcctgtggctactgatacttgcccctttcaaacaccaggagccgatcaattgtttcctcctggccccatgtgtctcgaggcccccagctcttgcctgtgatggatggccagctggtggagtcggacctgtgccctgtggcagaggcaccgtgatgccgcagtggagtttgtttccactgaattccctagaggatccttggatttgggtttttgtagttgtagacaacaggaaggggacacaacagcctcttctttacagaggatcacactgaggcccagaaaggccacttggccaccgcacagctggcaggtggcagagtcctggcctccacgccaggctccctggggctcacccaggcctgccgtccagctgtggggtccgcggctctcgggagaaacagaagtgagacacattgtgcattctgcccctcatgctcaccctctctctcggtttttctcttccctctgtttttctgaaggccctcgtggctggcctgagctggtgggagagaggtttttcccagcaatggatcgatgcacggctgtcggggccgacaggctgacctttactgagctcaggttttcatctccctgttgggagcccaggaaggtcttgctgtggagagaggaacggtgagaagccttggcctgcgagggggagaggcttggcgtgggtgcagtgaagacagcttctgagagctgaaagcccttggaggtcacttatttcaatttcttccaagcacaccacttttacagatgagaaaactgagacttggtgagaaatgacttgtccaaggtcactctaagaggctttgacacagctccagaatccagtgtgtgtgtatgtgtgtgtgtacacatccaacatacatacatctgtatattataaatattatacatattattacgtatacatacacagatacattatatgcatgtgtacgtgtatatcgggagtgtctatacatgtgtattatgaaagcctggctgtggctacgtgtgatgccgtgcctgcgctcactctggtcgtcaacagtttggtcccgcaacatcccgggtagccgccgatccctgagccaccaggcatttcatgcagttctgcaaagccatggagaggagctgaagaaacctcatggtccttttcaaatcgtttcttcctcctcctcctctgcaaagattttctctaagcccagtttgaatccttcagaaacagaacttggctgcgaagtcactttgaaagactttccatatgttaattgcagccggccaaggtctggagcagaggtgggagcccaccatctgcagacggggtcggcccccagtgcgctctgcaaatccccgtcatctggcaggtgtcgttttgggttaattaagagctatactgagcccgtttacctgtcacttctgagaattttaggaaactttgactttcttgccatctctgagctttgagcgaaggggaagctgaaaacacctctgaatctggtgatgtttctgcctctgggatctccaggacagctgcattaagtgcatcttatcataacccctttttaaactttttattttaatcagtgttctctagttagtgcattggtttttacagtcacgtcttctatattggaagacagtactgtttgggggaaacccaccatttgtctgaaatttcttaaggctctgctttctctctgtgtctttgaggaaacagcatacattcctctagctttgttctgtgtaatggctttggagaaactttgaatttgcaggtcaggggctctttcacccattggggtttggggctgtcagtgctaacctcagagctctatgttcatggagggatgactcagttacatccccagatagctgggttctcggttggtcaataggcccccttcttcagtatgagagaattttctctctgtgctgttgacaatgttctattaatatatcttggtaggggtttgggtcacacagatctatgcatttgtcaaaacacagcaatagcacatttaagatttgtgtgtttcattatgtgtaaattttgtatccaaagaaaaaactagtaaacaagtaatgaacttcagttaattgtatgcatgctgaagtacttaggggaaagtgtactgatgtttgcatttacttggaaatgaaatacacattaaggtgaaagaaaggctagagggatgaagatcgatatgacaagcaagcataagaaaacattgatggtagaattaggtggtggctacataggtgttcactataacattctttcaactttgctgtatgcttgaaaagtttcaaatacatcaggggtgaagaaggatgtgatgagaagatttccctttcctctgctggcccagctcaacgaggtgttccttgggatggtgggatccctggggtctgggaatataggccagggtcccaggccctgctctgttcctgactggctagaagaccctggggatggaaaggttgagggaacgtatctctaaagttcatcccaggcctgatcatctgtgactatgagtgatggcacaggttggtaagtttcaacataagatgaatttgttgcgtgaagggaggaagaagtgcattgctcggggttaggcagaatgccgggagggactgtcagccttgagatgcccagtgggaagccacgttccttctgccccagcccgggctcctctgctccgcgtcctcctcaccagggttattgtgagggtgaggtgccatggcctcggagctgctccttgactgccagcgttctgtttctagtctcgccgtcatttttttcctccgaaggctaccttccagacagttcccacgcagccctcccctcctgtctacctggcctctgagggactgcatgtgctgggcctctgccaagtcccttctcctttctgagactcagtttcccaatctgcgacacaagggcatgttgagtatgtggatctcaccaatcccttccggttctgtcacttccacagctctgtatttctttctgtcactgggtttcctcttcccacctgcccaggatcaaagggtgaaggggcagggggaggagctgggatcagagggcttgggtgggggcagaatttctgagtttgttctctctcaatgagagaaggtacctagtccccaccacacaggggtttgcaaagagcatctgcaaacgtgaagtcatttgatcttctccataagcttaacaagtagggattttccttccctccattttatagatgaagaaactgagactcaacaggtgaatgcatgtacccaaagccacacagcttggaagaggaagagccggcctggagcttgggtctgtgtgacttcaaaggccattttctgtcttctcctccaatgtgggcagctctgggcaacagcagagagcagagcacaccttgggtgtggcctggagcatggcctagaaggggaccagccctctgttcttaattctgtcaacagcagctagagaagggggatcagagaagggggatcagcccggatgccctggaatcccatcgtgggccatctgcctgcccctcctccctgcctttgctcatgcagttgcctcctctggccccaccatgcctttctctgattccaataatcccaacagctggccagcatcacctggcactttgaaatcaaggtaaaattgattcaaaccctcatttgccacctagtgggaaaatcctatgttctccttaagatttctgccccatttccaggtggaggctcactttcccatgctcacctcaggctcaggcttctcgggacattcttcagccactttctttcatctcaatcccgctggctccttcctctgatttccatgtggggagaaaacaccaacccggccatccaaggcatttgagtgtgagtgagcagaaatggcagaggtagattaaacacccaacaggcaactgaaaatgggaacttgggcaccccacttcttcaatgttcttctacccccagccccaccgaaagctatcaaattacgtttagggcctcagttagttttcagaggaggctctttcttcttccatctccacccaacatccccagtccccttggcctggggaaaaggtagttttgttcttccagtaacattctttcacttacttcttgccaatcctatgatgtaggtgcttttattttgcccatattcaagatgaggaggctctgcctggaaggttcaatcgcttgcccaaggccacaaaaccagtgagcagatggcctgatggcagagcgtgctttcagccccgccgcaggaatgcctgtgtccaccacatgcccacctgccttctgcccccacagcaccattttggggcccagtttacagtgccaactgcaggcccagtcccatgaggctttgggtccagtcctgttttctccccgggactgcttgctcctgggggaatgccgatggagaagttggaggcacgtgttttgttgttgaaagagttcttaggggtttccatgtgaccaactccagagagcgccaggaaccacctctgagaatggccatgtgctgtgtgtctcccagaggcgggtctcactgcccactgagggacagccactccgatgtaagctggcacctaccagaactcacagcagcttttctatgaatacgtaaagaaaagtttcccaattccaggggttagtatttttgagagatgccaaaagtgtgggtcagttagaaggaggcgaagggcccgtggtgtcccttgtgctgggcacggtcatctgaaaggggttcattgtgggaactttgtcttgggcctgttggctgcacctccggaggccgcaacaaaagacagaagcaggggctttcatttccttccccaagaatgtccttcctgcacatgaggaacatcattttgtgcctaaggatgccactgctgtgtcatctcccaggtccagtccctcttgcttagactgtggccacagccacctggaggggccccctgactgcaagctgtcctcctccagcctgtcctccagattctggcactcaccagtctgaagccttggctgatcccagccctaatgagagaaaagcattacactcttgccccacgcctgctctgccctgcagctgcctctgcggggcctcacggaagacctggccatgcaggggccacgttctgcccagccccactgccgggcctttgcttgtgcctggaatgcccgcctctctctgccatcaaagtcctacccacccttcaagtcctggttcacgtggtcgcttccactcccagaaagtgttcccaggccttctctggactgttgactaaggacctagcttctccggatctcatggggtgagggctccctacactcagacagcttcttgtgtggcacttcagataatcagacaccatcccagagtccccagcaggtggctgaaccagcctctaggtcagcctcacgacccgtacatggtcaaacgccccttacccagagcgtattgctctcatagggcaggggccccatgttgggggtgcccaccacactaccactcttagcacaccaggcaagccagtccctggtaggctcatttctcccaccaaggggcaggatggtgtggtgggcaatggaataggagaaattggtttggatcctggcacatagcaggtgtccaacacacccctggctgtgggtgctaataacggaggccgtgagagctgtcgcctgagttagagagtctgctctggaagcgtgtgcctggttgacctaggagtctcattcgttcattcattcattcaacaaataattattcctgcctactagaggccaggccctgtgctagaggttgggatcaacacgtgaacagacaaaactccctgcccccatggagcttacatcctagtggaagaggcagattataataagataagcaggataaacaagacaggttggattgtgatcagctctatggagaaaaaaaagcaggaaagagagatggggtggaaggaacttcccttttaaacacagtgatcagggaaggcttccccatgctacagagagctggtgagcaaccaggaattgttcagacactcattgtctgctgtggactgggcaccaagctggggtgagggtggcacacaggtgcagagaggaatccaacggacctgcagggccaagcatgcccacgtacaacggattcccctgcaggtcagggcaaagccagtgctgcagaaccacacgggagactgggatcggaagaggaggggtgggagaggggcttcccagaggaaaaggtagccaaggacctctatattcaccactgtaaggctagaaaggtggggacagggtaggggatggtgggtgacactgacttaggcacatcctataaaggaattgggagctgtttatggccctttgcaggagccaaagccaatctggggatggataatatgtccacaatgaactaactccagccagatggacctgagacttgcactttgtggggctggagatctgggaggcttcctggaagaagtggccttgaagctgggccaggcagcagaggcgacgctaaacaaagatgcagaggtggcctctgccacagtagcccaatgccctgggctcggcattgtcaagaagtgcctctgatagggcaggtccacgggtgctcagagtcccgaggggagggcgctgtccctgttctccaggctgcgctgtgtctctactcccccacctgaggaggaggaggctccgtggtgctgatggatatgccggagccgggcggctgcagcccactgtcatcgggctctccctctgcatgccagaacctgacaccctgaccactgaggcataaaaaacagagaattggaaggctcagcctgtcaggctgggagtggcccccagagaggcccgaggaggagcgcgagcatgtgtgtgtgtgtgtgtgtgtgtgtgtgtgtgtgtgtgtgtgtggacacgctctgcctgtggttgtgaggtgcgggggaagccagctagacctaggaggtgggagtggctggcccctcagtcctgcctcattattcctgccccacctggcagatccccaggggcccacctctaggcttgggttgtaggagagagagcaggctcttggtcccgggttctggctggcccgttctggaatctctcacccttcggccctttgtaagcatccttgtaggggatcgtggaggcaggcttgggccacgagtgggctcatggggctatgtaactcctgtcacctccagtagggaagggctcccatgctctgtacccagcagcagccagctttccatgccctgttccagggcctctactgaatacagtctgccgggtactgggcacctggcgatgagtccaggctgaagcctactctttgggatcccctatagccatgggggaagacaggcaggccctgccagctacaagaccaaggcagcaaggtggtaagggacagaattgtgaactctcctcctagtgacctggccagtagtaaagaggctctcctgggacgggcacccagagcccagggaagtgccagaggcaggtattactgctccatgagcacctggcctgagtgaaccatgttcgggtcccaccatgccccacaatgctcatcacaccctggcacacctcacagctcctgcccaagcacgcccacagctgccaacagctgccccctccccagtggccagaaggccccaaccactccctcttctgtgctcccctagccctttggcttgttgtttcatttcagcacagttctgtctgcctcctccaggcagagggcctgggtttatgtctcatctccctgacgagactgaggccccagggacagccacccctgccttcacagcacagagggccaggctagggttgaggttacctttggcttctctgtccagagccactcatcagcaggtggggggtagaactgagcccattctggggtcctggattggcttcactcagggatgagaaccaagcagtctgcagccttgaacttagcaaggtgtatcaagaccattttgtgagacgacctgggcatcagccttctcatatgtaaaatgagccaatgaccccaaggaacatctggcacatggggccacagaacgacatgggagttccatggtacacatgtgagagtctgccattcactcccactgataaggaggggaaatacagacaatgccagtgacagctgcccactccataatgatgtggacctgacttgcttttgttggttacaaaagcgcctgcaactcacggaagaggcaaatgccattggcaaccaggctggctgggacccagggccttttctgaactggatttgacgtttggttcctgtttctctctccacccaccatacacagggagtgagttttccgggagtccctacagccaccctcagtattcctcgtacaacgactcctggaggttccccaacccggggctgcttggtgagtactggcggaggccctgcggggcccttgggccatcagctaccccatccaggcctcctcactggcctgggtccctcgacatcctgaggtctggtcactgaggtgggtgggtagcttgcccagacacatggagcacaggtgttttcatgggggccttagggcagtaaatagtgctccagccctgctcatgccctcctccctcccccagatgctttggtgggttaggaaaaatggcacagaagggaaacagaggaaaaaaggggcattgaaggagaaagaggaaggtaggaaaagtgcctacctgtgagtaacttgtatttcttaagcataatgacatattcaggcgagaactctctaaataagtgtcagtaaagataccaacttgaatcgattggtagtggctgcctggagaccaccttgataaagaccctgatgcccagtgattgattagtgatgtctgcatggacatcaccagagccggctctgttagaacctggttgcctgtggctggaggtctgacaaagcatgccatttagggctcagctggtgcccaccctctgcccaagccttggattggcagattgtccgtgactggtggcagtctgatctgtgaacatcatcaagatttgggccaccgcaaagaccatgcaagtctaactcagctttcaaaaggccaaggggagccctctgttttgttggactgaccttacatgaaaccagctagtgagtgccagttggagctaaaggttctgggacatgaagtagaggcatgggctcaaagatgtcactcaccatctgggaggtggagccagccaatcagcctgcagatagcaacatggagccctcccccagcagtcagctaagaattttctacttcgagcagtaaaaggtcagacatggaagggccctctgagaccacccaggtttatctgcccagcttaacaaggcctccttaaggaagaaccttttaattccttggatccttaattattttgggactgagaaacaggcttcatcagaaaagccataacctggtgtcttcaaactcaagttgccaaaccataggtctgtgaaaaaggccatgtaatctcagccttgaccccttcccaaacctgatttggtggctaggacagacacacagtatggaaaccacttctctcttgctactaccattccatgctcttgggaccttgggctgtccaaaggattttggtgtgtcatgcatgacttggggattcaataagaaacaattcccattagtgctgcaggtccctgtgcaaggagattgcaagccttgcagaagactcctagcttcttattatctgtggtctccaagaggggcagaatctgcagattgatctcttctcagactccttttttggttttggtcaaaattagttctaagtatcgaaccaagatatccgcttacctaatgtttttttcttaaatggactatttgagttgacccagacgtctgtcttaggaaacaggaggcatgggctggctgtgggctccctgaaccagtgtcttccagcaggggtgggggtagggagatgagtcttgaggcccaaacctgggagtccttcccaggaaatctgcctcaggcagaggcctgatcccagtcctgctgggagaccccaggggatatggcacacaggagacctggacactggcctgtgggagaggttccttctgatggagaggtgaccccaaggaggccatagtggcccagggctgccacacatgactgcactgcccaaggggacaagtgggagctgaaccccagcccatgcatggcacaaaaccctgagccctggcacggggctgcaccttctcaaaagggacacatttttctcatttttacaaggttcctagaggttgatagtggctgtcatttatttgcctgggaattcaagaagcagagaaattagaagaaacttctcaggcacgtgtggcaaaggcttggtgtaggaggtggggctatctgtggagtgtgcagagtggccccttgaaggccaggctggggagtttggacctgactgtgtaggtctgaggagatagggaggggagggcaggactagactacatccaaggcttttgctactcaagctggagtgaaatctagttcacagccccaattgttaggcttgggctgtgtgcctgttgtggaaaagatgcacactctgtcccagggagctcacaggctgtgggtgggagcctcaggcaggggtgtctggctgggaagtgctcagtacctttagggggccagagacagcatggagaggaggaaaaggaagcaaagctccattcatctacatgagcgcttgctaattgtaccaggcacccaaaaccctttttacatgggctatctgatgtcgtcctctcagcaaccctacagagcacatattattatctctattatacggaagaggacaatgaggctcagaaaggtgaactaattcacctgaggtcacacagcattcaggtggcagaaggaggatttaaattcaggtcaccctgacaccagagcctatttctggaaccagtatgtgatgtggtactctactctccctgactgagtcgcagtttgaacaacagcaagccaggaaaagaggcctcacccctctgtagaaacaggccttgggagtcctgagtcctgaatactcagacctgtgtgtgagtgatgagactggctctggtccagctttgaaagcaggttactatctgtatctgtcagactttcagtttcaaacaacagaatccactctgactggcttaagcagaaaatgaatttattaagggatatttgggactcctagaatctccaggaggacaaaaagaggtaggcatgggacacagccaggacaacacccaccacacaactagagttgcactagcatcaacagccctgctgccagccagcacccagcctgcagctccactccactgtaacttttcccggggtgcttggaactgggcaccagaagctctggcctgcccccagccaaagctggatgcctttgccacccactcccaacagatggagtcccccagcccactgcttcaaggggctaccttctcaatcaaggtcatatacaagaaagtctaattggcagagcccatgaaacacacctgtgccctagcagcaagggaagctgggaggatgagttctgacttctggctcaaagaagcaggcctcctactgcagaatctctacaaacacaggaagagcacaaacgatattggccagaaacaaacatgagaaatggtccctgcactgcccaagtctataacctggaggagcctaggcaggtctgggcctcagttgcctcggatgtaaattgaggatagtcatccctgcagcctcattccaacaggagctgcatgcatgctctcttgagatgtgcagggcagaggaagcagtgatcccaccttcctgaagatgggtgagattgctgcctccccaacccacagccttgcaaatagctccaggcccgttcacctctcccggcccgccctgccccacggtgtcttcagcgtggcctgagagaataccccagggcaggtagacctagatgggttattcgtgacatctggggagggcgccagggcatggaaacctgtccggaggtcccttggtgctcctgttagattggtgcgctctgtggaacaggcgagaaccctacacacacacatgcacacacacacagacgcacgctcacactcatacactcacacacacacacgcacacacacacaggcacacacacgctcacacactgatacactcacacacacatgcacacatacacgcacatacacacacagacacatgctcacatccccactcccactcgcacacaccctcgcatgtgctgcccacacctcgtccaacctggctgaagcctccttcccaggaatggccaaggtgaggatcagcgatgccaggagatgaagcagaaggactggggcactttgacttctcgggaggatgtccctcagccagggcaactgtgactcagcatcccaccagggccccagggtggcaagggggctgcggtcccggcaggaagaaaggccggctgcggtcaattaggattagaataggagtgcctgtggccgatgtgaagggattagagagaaagcagaaccgggaatgactgtgtcaagcagtaaattgaccataatgtgaattagagaggaaaaatgacagaagaaaggacaagtttattctagatggaggtttaatgggcgccaggaagacagagtgctttgtgaggtgatgttttcatttttcacagtaaatgcaagctttcacacggaggcccgctggagggtctagcctggctttgggagggagtgggtcagagtccagggtgagaggtggctggggttgagggcttggagggtcaagccagggatcctccaaggagaagactctacttccgtttcctgtcctctggggcccgtgtgtagggcagaccctgtgattaccctgccttcgtgccatgcccctctcatgcacacacacccgccttcctctgggctcacctgcaggcagggtgaagggcaggcactgcagacactccatgggtggctgtccccatccctcagaagagagaatagaggaaggctgacaggggtctctgagtcgggactgcagccagggaggtgacagaagaggcggcagaagaaaacccatctcagggaatacttaggcacggggttggtgtttgtgctgtctggaacagcacagcaaggtactagcccctccactgccatactgcctccttggggggatggggagggagcagcacatcggctcatcagggctgaatgaggaggagaggtggtgcatcccaaagtgtcacccctactctggcagactccaggactcagcccccagttatggtacaggtcgactctccctaatccaaaagccaacttgctagaaccatcttgcactctccagagcttctttctgaccttggatccccttcctgctctgaatattaacctgtgtcaggctggcgtttgccccattattgcccagccctgcccccagcagggtcaggaaatgagtggtgaatgaatgagttaatgaatgaatgggcagggggtgtcttcgctattgtttgctcactcagcaaagttggttcatttacatgtccaatccagctaagcaggtgccacatatggctccaggctggaactggggacagactcccaggaagagcagaacccagcttctgccttttgggggctctccatctggggatgggggaagtgcagaaagaagtctttcccatagcatagggacagactacaggggagtgtgagctcagggcagggggcttcccagaggaggagacagggctctgagatttgaaagaggcatagaagtttaacagatgggaaaaggggtgagggtgcaggccaagagttccaggcaggaagcacattgtggggaaaggcacagaggcaggagagtatgctagcatgagctaaactgtgcctaccccataggtttaaatgagataatacatgcacaggccctagcagggccaggcacagaggatgtgctcatctgttcgcattgtgtatgtatgagacagctgcaaggagtttcatccagcttaagcatgatatatgagtgtgggcaggaggggccttccctgagggaaatgaattcagagatgctggctggggatagctcacagagcacctgcaggccaaacaaagggaatgcttttcatgtttttatcttctaggtcaggggttggcaaatgatttctataaagagccagagagtaaatattttaggctttgcaggccacagtgtctctgttgcaactatccaactctgtcgtaatagcagtaaagcagtaatgggcaatgcctgcattcataggcaagactgtgttccagtaaaatgttattcactaaaacgggcagctgggaggattggacccaagggccccaggctccggaccccagctctagatggcgaagagcctcgaaatcttatgagcaggttgtggccctgatgggacttgccatctggggaacagactgggacagagatcttggtgagagaggatggtggcccggactgagtgaggggaggaaaggacagaagtggaggagactggtggaaaggggaccccggatctgacctcggtgctctctcccgtctcttccaggctccccctattattatagcgctgccgcccgaggagccgccccacctgcagccgccactgcctatgaccgtcactgacccttggagccaggcgggcaccaaacactgatggcacctattgagggtgacagccacccagccctcctgaagatagccagagagcccatgagaccgtcccccagcatcccccacttgcctgaagctcccctcttcctctcttcctccagggactctggggccctttggtggggccgttggacttctggatgcttgtctatttctaaaagccaatctatgagcttctcccgatggccactgggtctctgcaaaccaatagactgtcctgcaaataaccgcagccccagcccagcctgcctgtcctccagctgtctgactatccatccatcataaccaccccagcctgggaaggagagcttgcttttgttgcttcagcagcacccatgtaaataccttcttgcttttctgtgggcctgaaggtccgactgagaagactgctccacccatgatgcatctcgcactcttggtgcatcaccggacatcttagacctatggcagagcatcctctctgccctgggtgaccctggcaggtgcgctcagagctgtcctcaagatggaggatgctgcccttgggccccagcctcctgctcatccctccttctttagtatctttacgaggagtctcactgggctggttgtgctgcaggctccccctgaggcccctctccaagaggagcacactttggggagatgtcctggtttcctgcctccatttctctgggaccgatgcagtatcagcagctcttttccagatcaaagaactcaaagaaaactgtctgggagattcctcagctacttttccgaagcagaatgtcatccgaggtattgattacattgtggactttgaatgtgagggctggatgggacgcaggagatcatctgatcccagccaaggaggggcctgaggctctccctactccctcagcccctggaacggtgttttctgaggcatgcccaggttcaggtcacttcggacacctgccatggacacttcacccaccctccaggaccccagcaagtggattctgggcaagcctgttccggtgatgtagacaataattaacacagaggactttcccccacacccagatcacaaacagcctacagccagaacttctgagcatcctctcggggcagaccctccccgtcctcgtggagcttagcaggcagctgggcatggaggtgctggggctggggcagatgcctaatttcgcacaatgcatgcccacctgttgatctaaggggccgcgatggtcagggccacggccaagggccacgggaacttggagagggagcttggagaactcactgtgggctagggtggtcagaggaagccagcagggaagatctgggggacagaggaaggcctcctgagggaggggcaggagagcagtgaggagctgctgtgtgacctgggagtgattttgacatgggggtgccaggtgccatcatctctttacctggggccttaattccttgcatagtctctcttgtcaagtcagaacagccaggtagagcccttgtccaaacctgggctgaatgacagtgatgagagggggcttggccttcttaggtgacaatgtcccccatatctgtatgtcaccaggatggcagagagccagggcagagagagactggacttgggatcagcaggccaggcaggtcttgtcctggtcctggccacatgtctttgctgtgggacctcagacaaaaccctgcacctctttgagccttggctgccttggtgcagcagggtcatctgtagggccaccccacagctctttccttcccctcctctctccagggagccggggctgtgagaggatcatctggggcaggccctccacttccaagcaagcagatgggggtgggcacctgaggcccaataatatttggaccaagtgggaaacaagaacactcggaggggcgggaatcagaagagcctggaaaaagacctagcccaacttcccttgtgggaaactgaggcccagcttggggaaggccaggaccatgcagggagaaaaagcagacttcctctggccaccgctaagtattttgttccctaagtcccccacagggtggtggaacagaagagaaaactaaggctcagcaaggtggagtcctcaagcagtgactggtgggggtggggctgggactcgggctcctgacccccaacccatggtgttccctgtcaccctggtctatccacatctcctattcctgaggagagttgacagtaagagcagtgagagatggttctgggccccatgccctagacaatcagtctgtaagaactgccaaggaagcctggtcacccaggccagggatggagcccagcgagctcacagcaggcacatgcacccccgcccccacccagaacctgcggggcaaagaagggaggtagttggggccagagtccacctccaggagccagggtgagctggctgcagcttccacctgtcaggtaaggtaggagaaggtatgttacctggcatctctctccctgcctccctccatttagcaggaagtggtggggtcaggggtcttcagcacagacttcttgagcctctgcctcctgtcacccttcttttggaatgatgtgtacccacatctttggatcctgccctccttgtggttccaggctgttgggaggaggtcagcctcccctgaaccagctgcctgaggcatgcagcatccttcctcggcaaagcccacctggctcacagcggccccctctccccatcctgttcctcttcttgccctgtaatgagctccccccatacctttcctccctcacctgaggctttgctggtcctcagattggttttgtatttgtgagacaaccacttgactcctgggctgccaggcggaagcacaagcgcacatggatgcacacggatgttctcacacacacacgcccgctctcaccaattcacagcacctcgtggtccagcggagctgcctgggagcttggtgaggatggctccaaaggacacaagccgttgagtagatgccagagaattctgaatggaaaacacaagtccggggcctcaccagcatcgtggcagaaggcctggggcatttctccatgggccttcttccctgtgttcgagctctgacttttggaaaaggacattgtggattttatgaaaatttctcataccatcagtctagctccaacctagaaaaattggatgatatatcaaacccaacatccctttcccaaggcaccttagttaaggctagcccttccataactgacattgtacggtgctttgcaatcctcaaccactctgtggagcaaagagcatgatgcctactttatagacggggaaattgacatttggggctctcacggcaacatagaggcgaagtgaattctcagatctccaggccccattctctctccaccgagttgtgctcctgtcatgggagtgtatggcttaaagacactcccccacccccattccctagaaatcccccagacccacaatcaggcaagaaagaacagggacccagaggctggcctgacctaggggcctgcaggttggcggctttgtttcctaagaacattgaaacctgcggagtctttgaccaaatccacaacagtgcttctgaggtttcatccagactctttcccagctgtccctgaggttcagagggtatcagagtcaattcaaggccatgccataatccctgaccaggcctggacatgggtccagccctgactccaggggtccaggtgccagggtcatgtgctgtcccccacttccctttctttgccttcccactttggaacaggctccaggcctggctgtgacagtatgcaggagtgcccaagccagggccaccagggtgtccacagcccctggaaacacagatcacaatctcaagtcccctgaatgaactgcttcctgggtgaacggggtggtgtagccttgccactcgggcagcgcaccagacagtacggtgcagcagtgcccgagatgcccagaagtgtgcctgcccccctgagtggcattcaagt

SEQ ID NO: 15437 - DNA, 8983 bp, Human
attaaaaaataaagaaaaagtaggctagggctcaggccccttcctctggatggcagtggtggcaggggggtggtttggaaagactcccccccacacacacaccaggcctcaccccactccttccatctgggggacagaggcttcggctcaccgagagtgacaagctgcaggtgcagatccaggcgtacctggacaatatttttgatgtgggggcgctgctggaggacacagagaccaagaacgctgtgctggagcacatggaggaactgcaggagcaagtggcgctggtgagagtgggtcctgaccccagcccagcacatcataggcccacagggcacacgggccacagggccacgcaagcatgggcactgggcagcagacagtgttataattgtgcattggaggtgctgcctgcctggccccagagcctggcctgaatccaaagcctgaatctgttgggtgtctttctcaatgagtgtgggtgagcaccctcactgacaggcccctcctctacccaggctcagaccccaggtgaactgaaatgggtgcctggggcccctcccagctcagtctcctcctctccctccacctcccgcatcactggtaccttggtttcctctccttatttgcttgggttcgagtgccaggctcggcccacccttggcacctgggctgagcggatctgggagcctcccccagtcttccaggcaggcatgcctgatgccgccccctcaccggcggtgccagtgccgggctgcgggtcggggctcaccatgtgctggtgctacagctgacagagcggcttcgggacgcggagaacgaatccatggccaagattgcagaactggaaaaacagctaagccaggcgcgcaaggagttggagaccctgcgggtgaggctggggcgggtggtaggccaggcgcccaagaacaggccagctgaggcttctaggcttgacatctccctccaccccgggaagaagatggaggcttggtgccaaggagcctgctggtgggcactgacccctcccgtggggttcgtaggagcgcttcagcgaatcgaccgccatgggcgcctccaggcgtcccccagagcctgagaaagcgcctcccgctgccccgacgcggccctcggccctggagctgaaggtggaggagctggaggagaaggggttaatccgtattctgcgggggccgggggatgctgtctccatcgagatcctccccgtcgctgtggcaactccgagcggcggtgatgctccgactccgggggtgccgaccggctcccccagcccaggtgcgcaggagcttcaggctggcggggatgcggggcagggtctggaggggagcccaggggcatctgtggcgggcagagttgggcgagggaggtttggattgtaggctcggctcaggtaggagcgcatgcgtagagcggagaggcggagaggggcccacccaagtcaaggagctgactcgcgcctcccccacgccgcgccctcgctggctcagatctcgcacctgcagcagagccggctcccggagcagcgccaccgccgccgcccccactgcccggcctcccctccccgcaggaagccccgccctctgcgcccccacaggccccgcctctccctggcagcccggagcccccgcctgcgccgccgctgcccggagacctgccgcccccacccccgccaccgccaccacctccgggcactgacgggccggtgcctccgccgccgccgccgccgccgccgcctcccggaggtcctcctgatgccctaggaagacgcgactcagaattgggcccaggtgagtggagtggaccaccttgggcccggggctggggggagatggagggaggggcctgggcctcagtgtcctccagggtcctctgcctgggggcctcctgctgcctcctggctgccccatcagccctccctgggcccaggttccctccagtagtacccccagtgctcaccactgcccccaaacccccgtcccaggagtgaaggccaagaagcccatccagactaagttccgaatgccactcttgaactgggtggcactgaaacccagccagatcaccggcactgtcttcacagagctcaatgatgagaaggtgctgcaggtgagtggccctgcctggctccccatgtgggcaccggaggaagaggggagttgcctggatcaggctgggccctgggggtagtcattttctccaagccatttcacagatgaggagggggaggcccagggatgggcattaagccagactggaccaatacctctaacaggcagaatcctgctttcccaaacgccttcccctccatccctgcagaggggtgcctcccctcaccccacttcttctgcctccaggcctctttccttccactttcccacaggcagccaaggcttcagccctcctgattccacttccagttttccaaaaggatgtattctcttgcctctaggccattgttccattctgtttcctctgcctggaatgtcttttcctttctcctttttaccgctggccagttcagctcttcctttagctcttgtggccccaagtctggatcccccgggttaggcggccctcctcctccaggctccctgtgcttcccctgtgcctcccatcagggcctgtggtcaggctgggttactggttctctgctggtggcctggtcagggccagatggatggctctagcactgtgctcagccaggagagtgccagaccccagccccacccagctccgcctcctcaccctgtaccttcaggagctagacatgagtgattttgaggaacagttcaagaccaagtcccaaggccccagcctggacctcagcgctctcaagagtaaggcagcccagaaggcccccagcaaggcgacactcattgaggccaaccgggccaagaacttggccatcaccctgcggaagggcaacctgggggccgagcgcatctgccaagccattgaggcgtgagtgtccctgtcctgggtttgtgggcagtccggcccctttgctaggctggggttgtcaggcagatcctagtaaaagagcctcaatggtgagctctttcatcaggcttcataccaaccctggtccaggaaacttgtccccattttaaggtggagaaaactcagtccatgcctaaattaggatgtcccacttcctccctgcctctttgcctagctgtgagcacccaggctgtgggatttacagccgggcgtccgccgctgacgtacgatggggaccctggctgcccagttcccagtttctctggattcccagttcccagtttctctggattcctacctcttgctctctgaagctgttggcaaatagaaaatactgaaattcatttattcaatcaaggcaggggtagccctgctcccagggactggtgggtatggatgatgcccaatctcccctctcctccctctcacaggtacgacctgcaggctctgggcctggacttcctggagctgctgatgcgcttcctgcccacagagtatgagcgcagcctcatcacccgctttgagcgggagcagcggccaatggaggagctgtcagaggaggaccgcttcatgctatgcttcagccgcatcccgcgcctgccggagcgcatgaccacactcaccttcctgggcaacttcccggacacagcccagctgctcatgccggtgtgggcggagcgggcagggcggtgtgacttgggaggggatgggcaggaggcaactcccagcctgggctgcggcagggaacctgggagtacttgagcctccagatggaggaggctccaacttatcttacctcccccatcccacccccagcaactgaatgccatcattgcagcctcaatgtccatcaagtcctctgacaaactccgccagatcctggaggtgaggggccaggaggtggggcccacccttgcctgttctggatagtgtgagagggagacccaggccctgctcacctgcaatgcaacaaagataacattcccacttctcatgtacatgctgagaaggacaaatctaagggtggtggcgagtgggaaggggtacagcagccgtgtctgtagcagctcacctgggaccctgccggagggctcagtcccctttagcgttgctctgtgagcaacctcacctgctcagtggagggcccgggaaccagtagaaatggctggtggacaggcagtgaccacacagactaggaggggatgctggcaacaagttgtgggttggactagcagaggacaaaatttggtgtgcccatggtgttaaccgtgcacatgtgtgagacctgtgtgtacacacatgtacatgtgctgtggatctgaggggcctgtgcaggagtacagtaggggctgagtgtgtggggcctgctccttgccacctcttctcctccttgtgcaatatgcttaagcggtgtcctcagctctggcattctgctgagcctttctcctgcctctcccagattgtcctggcctttggcaactacatgaacagtagcaagcgtggggcagcctatggcttccggctccagagcctggatgcggtgaggaggggcccctggcttggggactggggctggggactggctggtggcctgtggcttacaatgggtccttgtgcagctgttggagatgaagtcgactgatcgcaagcagacgctgctgcactacctggtgaaggtcattgctgagaagtacccgcaactcacaggcttccacagcgacctgcacttcctggacaaggcgggctcaggtaggagacacacagatccttgggtgtggggaggggccgtgggctggggtaggttgggagaaagctagggggccacagtatataattggtgggagggctgcctctccgattcactgacctgatactgccccatccctggcccagtgtccctggacagtgtcctggcggacgtgcgctccctgcagcgaggcctagagttgacacagagagagtttgtgcggcaggatgactgcatggtgctcaaggagttcctgagggccaactcgcccaccatggacaagctgctggcagacagcaagacggctcaggtgcgccagggctggcctcacctggaggtggggcatgtaggagcactagatagcacagcctggaggggtgtggccgtagctgggaccccttggggggatgcagcaggaatgaggggccaccctgcctgggaggagctcagatcaggtggccagtgtcctgaggggtacaggctgtgagaggtctaagctggggggctgacaggctgtgcccacaggaggcctttgagtctgtggtggagtacttcggagagaaccccaagaccacatccccaggcctgttcttctccctctttagccgcttcattaaggcctacaaggtattcgggtctggggcaggctgggagccctgtagggcactgaagcctttctactgggcagcggaggggtggggctgcttctgtttagggggtgggtagggcagtagggagggccaccctcatggagactgccttggcccacagaaagctgagcaggaggtggaacagtggaaaaaagaagccgctgcccaggaggcaggcgctgataccccgggcaaaggggagcccccagcacccaaggtaggcaactgctcctgggcttggtactgggctgcagggatgcatggcatctcatcaccctctggtgccacccccacaccctcactgttacagactgaccctgccccaggagcctgggatgggaaagggttctttctgctcaagccagctgtccttgctgtgggggaccaggcagatattccagggttttggtgatggggaggcatcctggagctggagctataaattccccctagtcaccgccaaaggcccggcggccacagatggacctcatctctgagctgaaacggaggcagcagaaggagccactcatttatgagagcgaccgtgatggggccattgaagacatcatcacaggtaagggcttggccaggccttggtcttatcctcagtctgtccttctatgctttcttctgacccaatgcgctatcctctgggggactggctgccacactgcttcttgctaccttttctgtttttctttcctttttcctttctctactccccttcacctgccccacccccactcagtgatcaagacggtgcccttcacggcccgcaccggcaagcggacatcccggctcctctgtgaggccagcctgggagaagagatgcccctctagcccctcaggtacccagatgacctggcctctgataccacgctgcccacagcccctgggacccttgggagaactgaggcatgctgccttctcctgggccagtggatggctgggatgtgatttgtggggtggaggggtctggcaaacataaacggtacccctgccatgtgcacacaatctgagtccttaggaggctaagctttgtgccctggagccatgctcccagctctgggcggactcctgaatggtaaatgtgtctccttcggctgccagatctgcggaaccagccctacatccgcgcagacacaggccgccgcagtgcccgtcggcgtcccccgggccccccactgcaggtcacctccgacctctcgctgtagccgctatttctgcaggtggattctgcaggggtgtggggccgtggacaggctgaggctcaaggaaggtggtcctcagctcggctggccgggcagcccctcctccgctgtggcccgcctcaaacgggctggtgcatcctcctcttggccacagagggcagcatcgcccgccccttcccccaaatgctgcttgcagcacccaccctaaagccccctccaaatagccatacttagcctcagcaggagcctggcctgtaacttataaagtgcacctcgcccccgcaagccccagccccgaggaccgtccatggaccttatttttatatgagattaataaagatgtttgcaaaagatccgcgtcggctccatgcctgccgcagccacccgcagcctgtttccgctcagcaaacgctttacttgcacaagctcttcatagcaggcctctgcaaaccagcgggcgccggggagaagggctgcttcttcactagagttggcggcgagggagcccgcttcgagggggcggaggctttcgtggctggcccagtatccctgcgggaggccggagggggcgagcgggcagctggggttagacacgccgggccagccccgcagcagttctccttccggctgccccgccccatttgcgccagtcctgcctcccacccgggcatctggccccttttcctttcgccctacccagtacttagtgacgccataagtgacctcgccttacatctccgcgcgtgccgcctccgtcaccgcctgccgggtccccatttcttccgggcctgcccccgctcctcgcctgcccctcccctccaccagccagtgtcgccccatctgtctgtcctccgggcacttgtcccgcccctcactgcgtgtccctcccccgcccgccggctctcacctaggccgagacacgccccgggctgggcgggatcttggggcggccgggctagtagggctggatcaggcggaagccggggcccggggctgggcttcgtgtcctgcgttccgggagcgccaacccctccaggttaggaatctgagagtacgggctgcgcgcacctggggcgggtgcctgggaggaggtggaggaggagacggtcctcagaacgggtcctgggggtcggaggcgagggcgggggttgtaagtggccgggagaggtccctcccgcgggtcccggcgccccccgccccgtcggggacgcacctacttcgtgcagtttgtgcagcgagcgcgccagctcctagttggagaggtcgctgatgcgcgccgcgtggcagaaggcgagccccgcgtgggagcgccccccaacccccgcagcctgggctgagccgcagagcccgctgcttcttgaagtagtagcttggagaagagaggcggggcggccgcctcagacactcccagccctctctgtctcacaggtgcggaagccaaagcagggccggaagccgctgctttgtctttgtcctggggcgacttggggcccaggaaacagactcagaattcagggctcccgtctctagggcaggaatatcaggggtccctgcggggggcagggtttgctcctcccattgtgggcccaggagctggtatggttgtgcccacctcatcaccccccgtgccaacttggagggcacaaagccccggcccagcagcttgaacagcatttccaagaacagggtctgcagtccctgggggtacagagctggctgttcctcacccggcttgggggcaaaaaaggtgaaggagggtgaggagggggcaccccctaagccaggcccacccctcctccaccagccttgcccctcacccatgcactgagccaagcggtggttgtcatcgaagacacccaggaagtcaatgaagcttacgattccatcacctggggagagaggagagggggtgctgtgggtgcctgccccctgcagaaggcctgccttgcacatgcctgctggcagttccaggtgttagagaatctagtcctgcctctagccaagggcagaccccagtttcaatgggggagaaacggcccatgccttgggggttcccaaatcaggattaggatgaacacagcagcaacgtttacaggccatgagataggtgtgttggtcagggcaggcttcctggaagagggaactttaaaataggaccaggccaggattttgtgggaaggggaggcattctttaaaagaatgcctggaggtgggaggggacaagaagacagggttggggcacccaccatccaagtctgcctgccgcagagcctcgaacgtctcctgtggactcagctggatacccacattgcccagggcaactttcatgctgtgcatgtccacggtgcctgttg

SEQ ID NO: 15438 - DNA, 50776 bp, Human
  misc_feature (1)...(50776): n = A,T,C or G
agatgggaactgtttcttcccgccctgccattcttcccatgttgagatctttcccaaaggcaaagatcatttccctttttggccatggagcactctgatggtaagaattagtcctctcatcacccaccacactcaacccgaataggaaatttccaagaatgggaaccatgtctttgggcacttaggcgagattactcaatcaaaagagtgagactcagggactgaaacattcaatcaaggttaaaaacagattaaaatgtggcagttaccttttttcccctgatatagaatacgcactggagtcacagttaccttttagtaactgatttccttgagtgaatagtgtatcagaaaatgggacttttatggtggcaaagaattcagagggcctggggcacacagatctggatttgtataccgatttgccacttaaccagctatgtgactgtgcaatttaccaacctctcagggccacattttttcatctgtcaaaaaggtcaatatggccaggtacggtggctcacacctctaatcccagcactttgggaggccgaaatgggcagatcacgaggtcaggagttcgagaccagcctgaccaacatggtgaaaccccgtctctactaaaaatacaaaaattagccaggtgtggtggcgtgcgcctttaatcccagctactcaggaggccgaggcaagagaatcgcttgaacccaggaggcgaaggttgcagtgagccgagatcgcaccactgcactccagcctgggagtcagagagagactccgtctcaaaacaaaacaaaacaaaacaaaggttgaataataataataggacctatattgtagacttgttgagaggattaaatgagataatgtacgaaatgccttactacagagtctggcacttattaaagaaagagttgatgtgggctgggtgccgtggctcacgtctgtaatcccagcactttgcggggttggggtaggaagatccttagaggccaggagttcgagaccagcctgggcaacaaggcgagaccctcgtctctacaaaaaatatataaattatccgggtgtggtggctcatgcctatagtcctaggtacttgggaggctgaggtgggaggataccttgattgcagtgagctgtgatcttgagccattgcgctccagcctgggcgacagaaggcggccgtatttaaaaaagaaaaaagaaagaaagaaagaaaagaaaagaaaaaaagggtcgttgtggaaaattcttgtggggaattaaagggaccacgtgtgcgcgaaagagcttggcgaagataagtacctggaggccaagatgaggcggcgagccctgcctccctagcagtgtggtctcctggcttagggtcagtgcttcgcacaaaaaaatccactgcctctcatgagaccttgaactgccaatgaccgcaggttgcccagactcccgagtgaggaaggcggccaggagtcaactaggcttcttgcggaaaagcccactctaagaaggcctggggcattccggctccaggcaggtagcacccgcgggcctcaggccctttcacttacccgggaaacgtaacggtccttaacggcagccaataacggctcccagcggcccaggcactggcaagggcaggctgaaatcaaacctcggattttggaacctccacgcctgaaaccctaaaccagcatcgaactacaactcccatcatgccaggcggccgcccggttcccaagggtcggtcccaccaaccttgcgccccttctttcctcaaagcgtggccgaatgcctaggcttccgggtatcagtggccccgcctcttaatccgaccggagccgtccctcgtgattcctgggtattgtagtcagtttcctgggaaagagtcgctcctagtggcagctcgcttcgccagaaaaactacaaaacccagaatgcagcgcaaattccccttgtccaataggaaccccccatgtagtggggcgcggagccctgctctcgcaactcaagatggcggacgagagtgagacagcagtgaagccgccggcacctccgctgccgcagatgatggaagggaacgggaacggccatgagcactgcagcgattgcgagaatgaggaggacaacagctacaaccgggggtaacgaaatcctcggagtccaattcccgtccagcctcccacaacctgggtctctggggtgcggggaagtcaccgggagcttagtctagccccaccctcatgttcttattggctaagtcactaggattctgcctggcgattggttattgcctttgtcatttaccaagggtgggtgctctggatattaagggccggagacgttcagtacttttattatataaaagttctatgcagtgttccactcgtgtgcttcaggccattcctgggaaaagagcatgttggacgatggttttcgatggtacaacacaggacagtctagtaacagtacagttcaaagggaacgttacttatagacgtgttgtttgaacaacgtgactagcaataaacgaatcataaaacatttcgcagcagttcaccctcagtgaggaaactcatcagactatacaaactgtatgtataattatattgtaaaatatcactaccagagaatcccaaaatataaactcaccttataaacctatgtaattaacggtatggtaatgctttgatttacatagtttccattgctccaaataatccataagtatcctgaacgatatattaatataattaagtcttcgaacatctttgccttgttacctttgcagagcagccccaggcttcaagaaatgagcgatgttgtttcttggagagtatttggaatcctcgggctccatactgcctatcctgtactttagggtcttgccattagttactatttgttcctagggatgaagaaacacaccaggcatttgaatgttgaattcttttcccaaattagtttttacttctgtaagccacagcttattcatctttcttcacatggttagtgcctggcactggcactcacgctgtctctccccatcttcctgtctatatttgtagatatatttttaaactgaaagtcgtgagagatttttgggtgtataacttgctgagtctgaggtagtctgattttcgtagccagcttgttattcgcagtattggtggcagtgcagatataaaggtataaagaccaaggactgcgtagaagagatggtcccacaagattatagtacatatttttattgtatcctttctatgtttaggtatgcttagatacacaaatacttaccattgtattatagttgcctgcagtactcagtaacatgcagcagcctattgctcctaggctacaaacctgtatagcatgttactgtaatgtacaccatatagcctaggcatttagtaggctataccatctagatttgtgtaagtacaccctataatgttggcaaggcaaaaatcacctaaccatgcatttcccagcacatatgcctgacgttcagtgaagcatgactgtatttaagtggtttataatctgcttgtggtaaatcttaggttaaaagatctagcttttatgttcttcagccggcattaaaaatcacaggaagggccgggcatggtggctcatgcctgtaatcccagtactttgggaggcagatcacgaggtcaggagatcgagaccatcctggctaacactgtgaaatcccatctctactaaaaatacaaaaaatttagccgggcgtggtggcgggcgcctgtagtcccaactactcgggaggctaaggcaggagaatggcgtgaacccaggaggcagagcttgcagtgagctgagatcacgccactgcactccagcctgggcgacagagcgagactccgactcaaaaaaaaaaaaaaaaaaaaaaatcacaggaagaaagtagaggaataggaagcttgccaaatttagtttttataagactgttctgttgctgtaactcacaacagatctaatgtaataaaagtcttcttttgaagtttgatattcctaaaaatggaagagctgagaaagaggaagtaggaacaggaagaagggaaagtgaagctctcctgagtagagatctgaatcacagatgagagttggtgaatgtgaaagtcattccagaagtgaaagtgtggcattttctttgctctttttgtagttgcttttatttttatcttcttaactgttgtcctgaccagtgtccttaggtttgtgccctataatctgtgaatcacttttcaaaactgtgtgccagaaagttattttattggcctggcgtggtagctcacacctgtaatcccagcactttgggaggccgaggcaggtggatcacttgaggtcagcagttcgagaacagcatggccaacatggtgaaaccccgtctccactaaaaatacaaaatttagctgggcatggtggcgtacgcctatagtcccagctactccggagactgaggcaggagaatcacttgaacctgggaggtggaggctgcagtgagttgagattgcaccactgcactccagcctgggcaatagagcaaagccctgtctcagaaaaaaaagtggcacacagtggctcatgcctgtaatcccatcactctgggaggccgaggcgggtggatcacgaggtcaagagattgagaccatcctggctaacatggtgaaaccctgtctctattaaaaatagaaaaattagctgggcatggtggtgcatacctgtagtcccagctactcgggaggctgaggcaggagaatcactcgaacccgggaggcggaggttgcagtgagctgagattgcgccactgcacaccagcttggcaacggagcgagactccatctcaaaaaaataaataaataaaattattttatttgtagtagaagtaagtgataaccttaaaaactttgacagtttgcagtggtgtctctgtgcatggttatggtctgggtgaaaaaattatgtttattagcgtcccaaatctaaagatctgtgaaaatgagtttggaggtagtaggtgaaaaaccaagggcctagtctggaggagagagtctaattctggcactaagaatctggggtagagtcaacatttttccatgaactttgagaggaaatggttttggggagaagcagcaatgtgggaaaatgcagcacggcacagtagaaaagcatggactttggaataatttaaatctggtctgaggccaggcgcggtggcgcacatctgtaatcccagcactttgggaggctgaggtgggcagatcgcttgtggtcaggagtttgagaccagcctggccagcatagtgaaacctcatctctactaaaaatacaaaaattagctgggcatgatggcaggcgcctgtaatcctagctacttaggaggctgaggcaggagaatcacttgaaaacaggaggcagaggttgcactgagctgagatctctccagtgcactccagcctgggcgacagagcaagcctctgatctcaaaatctcatctcaaagcttggctctgacacttaacagtcctgtgaccttgggaaaggtacttaactcagagttgtagggattaatgagataacatctggaatgcactccttttcctccctcctcctctttcttcagatcgtccctaacctcccagcttgcccctctgctcttatcacatactgtattgtagcttttatcgtaacaatagttataataacaataaatataactacatgtttggtaatttttcttaatgtgtctggtacctgtctcatctgacagtaaggagcatgtaaacaggattgtgtcttcgaaatgcctagcacttagtgggcattaatgagtatttgctgtatgaatgaatggcagatattaaagtgcctagcccagtattagtggagtttcatctcccctcaccaagtgagaggatgtcagatttttcttacatacacattttctctccccaaataattctcattgtaagcctcactacagtttttatgaaatacctacagaggcagggcatggtggctcacacctgtaatcccagcactttgggaggctaaggcgggcgggatcatgaggtcaggagatcgagaccatcctggctaacacagtgaaaccccatctctaataaaaatacaaaaaattagccaggtgtggtggcgcatgcctgtagtcccagctactcgggaggctgaggcaggagaatggtgtgaccctgtgaggcggagcttgcagtgagccgagattgcgccattgcactccagcctgggcgacagagccagactctgtctcaaaaaaaaaaaaaaaaaaaaagaaatacctacagaaaccaggaagctccaatttgctgtggagctttccactgttgtgtgctttccactgtgttttgcttcttgaaatgttttttgtcttaatattatttaaaatgttctcaaaaatcatgtaaaaattgacagagaagttttcctttcaatgctagagagtctaaaatgtgtaatatataataaaggttaatgatagttcgagctaacccttattctcctgggcctttttttttttttaaagagactgtgtctcgctatgttgctcagactagtctcaaactcctgggttcaagtgatcctcctgccttagcctcccaaagtgctgggattgtaagcatgagccaccacacccagcctcctgcccctttttttcaggaactaaagtcatagtactctatgctaataaaatgagctaaattcatgtactggattctgttgcccgggctggagtgctgtggcgcgatcttggctcactgcaacctctgcctcccgggttcaagaaattctcctgcctcagcctcctgagtagctgggactacaggagcacactgccacacccggctaatttttcatattttagtagagacggggtttcaccgttgttgcccaggctggtcttgaactcctgagctcaggcaatccacctgccttggcctccgaaagtgctaggattacaggtgtgagccaccacgcccggccagttgtattagttacttatgtctctttgtatatgaatttagttcttgacttttctggtcttgtgtttcctccgtaattaaatcagcataaacatttggtgaatataaaacttcatgtggttgtgtgtagtggctcatgcctgtaatctcagcactttgggaggctgaggcagaaaaatcacttgagctcaggagttcgagaccagcctgggcaacatggtgagaccccatctctataaataaaaacaaaaaaacccaaacccttcatgtatacatataggtatacatgcatacatatgcagtgtgtatgggtgcgtctcttcagtttttctatttaaaaattttttaatttaattttaaaattattgttattactttggaaacagggcctcgctctgtcgtccaggctatagtacagtggtgtgatcatggcttactgcagcctttgacctgggctcaagcgatcctcccacctcagcctcccaagtagctactaggattgtagacatgcaccatcatccctggctaattttctttttaaaaagtttctgtagagatggggtctcactatttagcccaggctggtctcaaactgctggcctcaagtgatgctgccaccttggcctcccaaactgctgggattgtgggcataagctcctgcatccagctggttttgtttgtttttttactgcactcaatttcccccagttacgtgcctagcgtaattatcctgaacaattgagaggagagtcagataagataacctttatgcagcatccccctgtagttcgtgattcatctatatggtttaatttgatttttttttttttttaatgagagtctttccaagaagtattgccaaagaataaatctcatcagttggcagattttaatttgggggtaataagtgaagattgtctgagtgttttggaacaaaaaagaacttttagactattgtgttctaggaatctttcggaatttattttgcagtgtcttcagtgtcattgagatcctggtaagcacgggtcaagagccctctgacaagaggtgtctcatctccatcctgctctcttactccctgggacaggttaacatggattctttataagttctcctcatttcctggttgtgagatactatcccttatgaaaacttaggaggagagaaaagtctttctgaaaataaattccataaagctagccttacttgtttttgtttttttcttcagcttctccaagagtcgttctttccctatttatttgatggcttatagctgcagctagctcttggaaataagaaatctttttagttcctttttaatttctcccttcaacttttggtttttcaaaactagatcaaagcagaatggaaagagaaacctcatcactgatatcaaataagtgttctaattttgtttcccaattaaatggcaattaaaaagaaactaatcaagagctgcttcaaagagaagagactggaaagcagaagaaatggaaagtaaatgagagcctatttcagggactcgctgctcatggcacagcagttttgctgatttttcacattgttcaactaatatgctcacgctaaaattccccagctttactaagttggcagttaaccctttccctatagagcccatagatttatgagccatacatttagtaacttcaggaggatgcttctttaactctttctcttcagctttttatctgaaatctctacccttcaggcctctcttccaattcctcaaagaagatgtccttgtgattgttacatttaagggacaaaaatatggtgttctctattgagagcgccaaaaatactaaaccggaattcctccataggctcagtatttgcctcaaaaatgtcccagcactttgagaggctgaagtgcgcagatcacttgaggtcaggagttcgagaccagccgggccaacatggcaaaaccccatctctactaaaaatacaaaaattagctgggcgtggtggcacacacctgtagtcccagctacatgggaggctgagacaagagaatcacttgaacccgggaggcagaggttgcagtgagcccagatggcgccattgcacttcagtctgggcgacagagagagcctccatctcaaaaaaataaacagaacaacaactttctagagctgctctcttgagagacaactgaggagtcactatggttaagtgtttagtaaatgttactattattactacgtagtgggcattgtgctaagccctttacttggattatatcctccatgatttcacttatgaagactttagcgatttttgtttgtttgtttctttttttgagtctcactctgtcgcccaggctggagtacagtggcacgatcttagctcactacaacctctgccttacaggttcaagcaattcttgtgtcttaacctcccaaatagctgggatcacaggtgtgcaccaccattcccggctaatttctgtatttttaatagagacacggttttgccatgttggtcaggctggtctcgaactcctggcctcaagcagtccacctgccttggcctcccaaagtgctgggattattacaggcgtgagccaccatgcctggactttagttttttgtttttttgggtttttttgagacagagtctcactctgtcgcccaggctggagtgcagtggcgcgatctcggctcactgcaacctctgccacccaggttcaagcgactctcctgcgtcagcctcctaagtagctgggattacaggtgcctgccactgtgcctaactaacttttgtagttttagtagagacggggtttcaccatcttggccaggctggtcttgaactcctgacctcgtgatccatcctccttgtcctcccaaagtgctgggattacaggcgtgagccaccatgcctggccagactttattttttattatttatttatttatttatttatttatttatttatttatttttgagacagagtctcgctctgttgcccaggctggagtgcagtggcgtgatcttggctcaccacaacctccacctcccaggttccagtgattctcctgcctcagcctcctggatagctgggactacaggcacatgccaccacgcccagctgatttttgtatttttagtagagatggggtttcaccatcttggccaggctggtcttggaactcctaatctcgtgatctgcccacctcagcctcccaaagtgctgggattacaggcatgagccaccactgcgcccagctagactttagtttttatagtgaggcttgagatttgcatctccactggtctctttgacatctcagaggatccattctgaacttgctaggtttctttcccctgctgaattgagttctgcatcttgagtctgcagcagtgtgaatcctatctttggctccatttaacagcctatggacgttcccaaacttgggacccagtttgtctcttcatgatagacaaatattattttcagaagtcattctaatcgcaccactgcactccagcctggcaacagtgagactccatctcaaaaaaaaaaaaaaaagtcattctagtaggtgagatttctgccagcattgagccactgctcaacatattcttgataatggtctctgaacagcatttgattttaccttggagttgcaaagtcaaagtctaactcgccaaacaaactcagtgtggaatatacacatttgtctcattccggttttaaggagtttagtataccagagcttttgtgacctctaaaaagcagttatcgtccatgacaagaattggctcgttcaccctcagtactctggcttactatcccagggagggccgagggtggcagcaaaagtggtcttttgtaatccctttttataacctgctgttctcttcacagacctcccagggtacctttttttgtgtgtgtgtgtgtgagatggagtctcactctcacccaggctggagtgcagtggcgtaatctcggctcactgcaacctctgcctcctgggttcaaactattctcttgcctcagcctctcaagtagctgggattacaggcacccgccaccatgcctagctaatttttattttttatttttgagacagagtctcgctctgtcacccaggctggagtacagtggcgcggtcttggctcactgcaagctgcgtctcccgggctcacgccattctcctgcctcagcctcctgggtagctgggactgtagtcgcccgtcaccacgcccggctaattttttgtatttttagtagagacggggtttcaccgtattagccaggatggtctcgatctcctgacctcatgatccgcccacctcggcctccctaagagctggaattacaggcgtgagccaccgcgcctggccaatttttgtaatttttagtagagaagggttttgctatgttggccaggcttgtctcgagctccagaccttaggtgatctgcccgccttggcctcccaaagtgctgggattacaggcatgagccactgtgcccagccccagggtaccttgatggcagtactaaagtgtttttatttttcccatcatttgggattcacaagcagtttttgatataactaattggtgggaatgtgcggagttgggggtattgcactgagtgatccttagccgcagaagtacagagactagacagctgatactgattcatgccatgtcatttccttctgggcatctttgccatttcattcacctctctttggtctttctgagtactaataggattattagtgaacttaccatacttcaagagttaattgatttgcaaaaggatttcctgatgtctaaaagtagaatcaaaaggatattagaggttagagtttattttaataagtttctctggaaaatttgaatttctgcccaaaaaattcattttttatttgagacaaggtttcactctgtcacccagatcgtagtgccatggtgcagtcctcctacttcagcctcccgagtgactgggactacaggctaatttttttgtctgtgtgtgtagagacaagatctcactatgttgcccaggctgatctctaactcctgtctttttgtttttcagaggtagaaaacaagtggtggctggtccaagtgcagtggtgtttacgactaatttgtcataaccagttatagatttctttgttccttttccactcccactgcttcacttgactagcctttgaaaaataaaagtaaaaagcaagtggccatgagatctgagagctacagtgaaaaagaaaagtggccaaatttgtgaattttatttcccaaacttttttttcttatgttgtaaacctgtggtctgtgtttaagacattgaaaccattagaagtagttacattagagcttttttgtttgtgctttatttacttattagagatggggtctcactttgtcacccaggatggagtacagtggctattcacaagcgtggtcgtggggcactactacatcgtgagactcctgggctcaagagatcctcccgcctcagcttcctcagtagctgggactacaagttcacaccaccacacctggctggacctgttttagcttctcaaggagtaggacagagcctaaggagagagaagacaatgaataagaaaattagggctggacatggtagctcacatctgtaatcccagcattttgggaaattgaagcaggtggatagcttgagtccaggaattcaagaccagcctgggcaacatagagaaactttgtctctacaaaacatataaaaattagccaggtatggtggcgtacgcctgtagtcccagctacgcaggaggctgaggtgagatgatcgcttgaacctgggaggttgaggctgcagtgagccatgattgtgccactgcactccagcctgggtaacagagtaagaaactgtctttacaaaaaaaaaaaaactcagtatttttttatttgagatggagtctcactcaggctggagtgcagtagtgtgatctcagctcactgcaacctccccctcccaggttcaagcgattcttctgcnnnnnnnnnnnnnnnnnnnncccaccttggtctcccaaagtgctgggattacaggtgtgagccaccgcacctggcctatttttttttttgagatggagtctctctctcttgcccaggctggagtgcagtggcgcgatctcagctcactgcaagctccgcctcccgggttcacgccattctcctgcctcagcctcccgagtagctgggactacaggcgcccgccacgatgcctgcctaattttttgcgtttttagtagagacggggtttcaccatgttagccaggatggtctcgatctcctgacgtcgtgatccacccgcctcggcctcccaaagtgctgggattacaggcgtgagccaccgcgcctggcctattttttttaataaaaaaagaaagttgataatttaaaatcccaatcagtagctcaagagcacagcatttccattgctctcatagaatattaacacagctgtcctgtgcaaacagaactgaagatgttttgctgaccctcttttgggctctagcttttcaaggtcttattttagtctattatgcctgtaaagcatcagtcaagcatataattgttgaactgttaactgtgtgctcagcacaactagaggcgctgtgggaagcagctgtataagatgtagtctggccgggcgcggtggctcacacccgtaatcccagcactgtaggaggctgaggcagatcacttgaggccaggagttcgagaccagcctggccaacatggtgaaaccctgtctctactaaaaatacaaaaattagccaggcatgatggcacatgcctgaaatcccagcttttcaggaggctgaggaagagaatcgcttgaacccaggaggcggaggttgcagtgagccaagatcacgccactgcactccagcctgggcaacagagcaagactctgtctcaaaaaaaaaaaagatgtagtccctattcttaggaaattgttaatgtcatcgggaagccaagaaagcaatatattattatatattaagtgttttaggagattatagttttaaaacaggcagacatcagagaactagaatagtcagagctgactttctggataaaacatgactcactttcctcattacttctaatgcttgctcctctcaaacaccaaagctgtgttctatagcccagtgtgaggaaacaatattctcttggctttggaggattctcaaatcaattcttacagggaacgaagccatagcctttggggggaaatggccccaagccaagtctttagagattgatggctcctccctagatgctagttggttggttgataaccaatttgcctcacatctctgggccttagtttcctcatctgtaaacaacaagttaagccagatggttctgagattccagtgttggaagctcagcttcccctcccctacgatagagctttttcttcccaggcatgcagttttgagcggattgcatcatccagtaagactgagaggaggcccacatatggaccctcgctgctcctgttgtctagaagttcctcttctcctgccgttcatctgccagcttacccttacctcccacccgctcacatacccagcattgcgctctatttctagaaataagtactgaagttagttttccatctcctccccaaggtctgaatttatacaggagcatccttaggatgtcttacatctttgaacttgtaacattttggtcttcattaaaagatgactttttttttttttttttgagacagagtctcgctcagtcgcccaggccggagtgcagtggctggttctctgctcactgcaagctccgcctcctgggttcacgccattctcctgcctcagcctcccgagtagctgggactacaggcgcccaccaccacgcccagctaatttttttgtattgttttttagtagagacggggtttcaccatgttagccaggatggtcgcgatctcctgacctcgtgatctgcccacctcggcctcccaaagtgctggtattacaggcgtgagccatcgtgcccggccgagatgacatttcttgattgcttttctgctctgttcctggatcttttattctaattcaccctgtatttgctaggttggtcattgatgacttcttgagttgatcaactttagaatataagtctcacaatttttgtatgaactgccatctgccttctgggggaggaggcacttctgttgctgcaccaaggcaaactttactgaattctctactctttattttggaaccaagtgaaacaagttggactttggtttgctgtattctaagattctggttctggccaatctcagtttgaaataaggtgactggcagcttagatctgtgagagatttctatttcagtgtgccgaatcgcagcatgccctaggattcccacccagtgggtgtggacttcaaatccctttaaaaaggatgccagccaggcacggtggctcattcccataatcccagcacttttggaggccaaggcaggaggattgcttgagcccaggagtttgagcccagcctaaaattagccaggcatggtggtgcacacctgtagccccaattactcaggatgctgaagcaggaggattgtttgagccaggagttggaggcaggagctggaggctgcagtgagccatgatcgtgccactgcactccagcctgggtgacagagcaagaccctgtctcaaaaatgaacaaacagccaggtgcggtggctcacgcctgtaatcctagcatgttgggaggctgaggtgagtggatcacttgaggtcaggagtccaagaccagactggccaacatggtgagaccccgtctctactaaaaatataaaaattagctgggcctgatggtgggcgcctgtaatcccagctactcaggaggccgaggtgtgaggatttgcttgaacctgggaggtggaggttgcagtgagccgagatcacaccactgcactagaggctgggcaacagagcgagactcttgtcttaaaaaaaaaaaaatggctgggcgtggtggctcacgcctgtaatcccagcactttgggaggccaaggctggcagatcatgaggtcaggagttcaagaccagcctggccaacatggtgaaaccccgtctctactaaaagtatgaaaaattagccgggcatggtggtagtcccagctactcaggaggctgaggcaggagaatcgctgaacccaggaggcggaggttgcagtgagctgagaacacggcactgcactccaggctggcaacagagcaagactccgtctcaaaacaaaacaaaaaaagaggccaggcacggcggcttacgcctgtaatcctagcactttgagcggctgaggcaggcagatcacctgaagtcaggagttcaagaccagcctgaccaacatggcgagacctcatctctactaaaaatacacagattagctgggtatggtggtatgtgcctgtattcccagctacccaggaggctgaggcagaagaatcactggaacctgtgatgaggaggctgcagtgagccaagattgtgccattgtactccagcctgggtgacagagcgagactccatctcaaaaacaaaaaacatgaatcaagaaacaaacaaaaaatgatgccagattcctggagaaggattagcctggcttctgtggggtcctctagttttgttttcccttagtccaaattgaggccattcttctgtgaagtggcgttggcttgctaggatgctttttgaagttctactctcaaggcctctgagcttggttccctatgaataattaaaattattataattaccatgaaagctaactggagtgggctccttggaagtctggttttgctgaattggttgtcttctgtttgggggtgttgactgtaagactatgtgtactcataatgtgtcctcacggatggggctcaatacttggtagctcagtgaaaatgactcattaaagaaaaaaaaaaaaaagtggccaggcacggtggctcatgcctgtaatcctagtactttgggaagctgaggcaggtgaatcacctgaggtcaggagtttgagaccagactgaccaacttggtgagaccctgtctctactaaaaatacaaaaattagctgggtgtgatggcacatgcttataatcccaactacttgggaagctgaggcaggagaatcccttgaacctaggaggcggaggctgcagtgagctgagatcgtgccattgcactccagcctgggcaacaagagtgaaactctgtctcaaaaaaaaaaaaagaaaagaaaaaacaacttccctgtgttcttcagccgtgtgcttgatgtacaagttgaaacaggatttttgctcagtaactggctgcttgtacaaattcaagccaatataaagaaaatgaaatttgctctctgattttagtttcggtcttggagatttctagatacttgtattggcaatgcataaagcagaacaagagttcagcccaagatccttccacaaaaattgggttcatgaggtgatagctacatggaagtatctccgctaaataggaagaacaaaggcaggaaggtagtttttacagtgattttgcatatttgtaaagacttttaaagttggaagaagtaattattttccccatgtgaaattatgtttagtaagtatccagttggttaatctacagcagttcttcaccttacctttttgattctttcttttgtagaattataaaaagttattcttatggtaattcatattaccataatttgttccataagctgttatggaaccagctaatttgtggttatggaccagataatttgttccataagctgttatgaataagaatttatattataaattgtatccaacaatgggacactgctttgtctcctaatatcagccaggtcttgtttgtttgttttttgagatggagttttgatcttcttacccaggctgtagtatagtggtgcaatcttggcttaccacaatcttcacctcccaggttcaagtgattctcctgcctcagcctcccgagtagctgggattacaggcatgtgccaccacgcccggctaattttgtatttttagtagagacagggtttctccttattggtcaggctggtctcgaactcccgacctcaggtgatccgcctgccttggcctcccaaagtgctgagattacaggcgtgagccaccgcacccagcctatgagccagtttttaaatcttataatgcttcacgtaatcctgagactgaagtgaaaatatctggagtaggaaaaccacagagttgtcctaggctgcagatggtcctgtgtgcaataacaaaattgagttactaagaagaagaagttatctttaggccataaatgactttatggtttctgttgtttgccatggccttgggggttttgctgagcatctggttttaaggaagttaccttatttcccctttgaatgttctcagtcttccttccatgttaatgccttctgggtctcattaatatcataccaagtaggtgtacttgcatctagacttcatgaccttatgcttggactaaaggaaccttcagacttaactggatctctccctgtcacagtctttctgcatcaggggcactgagaggcccggccagatggaagctgtgggaggcaagagtggacagcgtaagtgggaaatgagggtgataggcctagggaaaaattgggcttgataccttccaagttaagaagccgctgttactctaggatttcaagcatgggggggacacatggaaagccattttcacagaggtgagtcccacagctatatagagttcaggtgatgcagaaagattgtgaaggcaaagagatccagaaaaggctggaggtaacttaagtccaagggtaaggtcatgaagtctggatgtgagcattcctcccaggaacaggaagagataggagaatctgaagacattctgtgaagagaattggcagcatgtgatttcagatcactttctccctgtatatatatatatacacagtatctgtctgtgagatgatagtaatattcataataactccaaggcattttgagaccctgaagtctttctgaattataaattgtatttaacataatgttaatggaaaattgtattttatattgttttaattcttgggggttttggtgtttttttgtttgtttgtttgtttgttttgagacagtgtctggctgtattgcccaggctggagtatagttgtgcgattttagctcactgcaggctcctcctcccaggcttcaagccaacctctcaactcagcctccccagtagttgggactacaagtgtgcaccaccacacctggctaatttttggatttgtgttagagacggggtttcgccatgttgcccaggctggtctcaaactcctgagctcaagtgatccgcctgccttttcctcccaaagtgttgggattacaggcatgacccaccatgctggacctttcaattatttgaaaattgattgtctaaaatatacagttaaaattacctctgtgtttagctgattctacagattaggattcactgtactcaggttggactcctaattttgacttttctttttttcttttcttttctttttctttttttttttttccccaagatggagtcttgctctgtcgcccagagctggagtgcaatggcatgatattggctcactgcaaccacagcctcccgggttcaagcagttctcctgcctcagcctcccaagtagctgggattacaggcgcatgcctccacgcctggctaattttgtatttttagtagagacggggtttcaccatgtgggtcaggctggtctcgaactcctgacctcatgatctgtccgccgcggcttcccaaagtgctgggattacaggcataagccaccgcgcccagccaattttgacttttcagtgtggctaagaggctgagcatggtggctcacacctgtaatcccagcactttgggagttcaaggcagcaggatcactcaaacctagaatttgagaccagcctgggtaacatagggagacccctgtctctattttttaatttaataaaacattaatgaggctaagaaactttttgcttcattcatggggtgtgtcatgtaggggaaagcagcacaaggaagtccccttgatcacgtgcacacatgcacacgtgcatacacacagacatgtttcttttatttatttatttatttttattttttgagacggagtctcgctctgtcgcccaggctggagtgcagtggcgcaatctcggctcactgcaagctccgcctcccaggttcacgccattctcctacctcagcctcccaagtagctgggactataggcgcctgccaccacgcctggctaattttttgtatttttagtagagacggtgttttaccatttagccagaatggtctcaatctcctgacctagtgatccgcccgcctcggcctcccaaaatactgggattacaggcgtgagccactgcgcccggccacatgtttcttgtaatctctccatggcaggagtaactgggtgctattgttgttttagtttcccaagattcctaatgctgggttttgccagtggtgatccctcagtctgagcttgccgacagttgtcctcaatcctgcagatctggtttaggcatttcttttttttttcccttttttttttgagacggagtttcgctcttgtttcccaggctggagtgccgtggcgcgatcttggctcacaacaacctctgcctcctgggttcaagcgattctcctgccttagcctcccgagtagctgggattacaggcatgcgccaccatgcccggcttattttgtatttttagtagagacaggctttctccatgttggtcaggctggtctcgaactctgcacctcaggtgatccgcctgccttggcctcccaaagtgctgagattacaggtgtgagccaccacacccagccttttccttttttttttttttttttttgagacagagtctcgctttgtcacccaggctgaaatgcagtggcatgatctcggctcactgcaagctctacctcccaggttcacaccattctcctgcctcagcctcccgagtagctgggactacaggcgcccgccaccgtgcccggctaatttttttgtatttttagtagagatggggtttcaacatgttagccaggatggtcttgatctcctgacctcatgatctgcccgcctcggcctcccaaagtgctgagattacaggtgtgagccaccgcgcattgctgccttttcctttttttgagacgaggtctgtctctgtcatacaggctggagtgcaatgacgtgatctcaactcactgcaacctccacctcccgggttcaagcagttctcctgcctcgtcctcctgagtagctgggactacaggcatgtgccaccaggccccagctaatgtttatatttttagtagaaacagggttttgccatgttggccagtctggccttaaactcctgacctcaagtgatccacctgcctcggcctcccaaagtgttgggattacaggtgtgagctaccacgcctggctgatttgggcatttctcatgactgaccattttggacacagattgtggcaatgttaatgtgcctttttcctcatccctcactcccttttcatactgtcttgtgctccagatccagctggggaaaatcatgaaacctaatacatttgggaggtggaggaaggaagggcaaagcattccagaaagcccatcactgccttttggctgtcatccttttacattcagagttcaaggaagtattgtggtatgaatgccttgttaacaattatcattcgtctttggtgccattaccctggcaatataaagaaaataagcaacataaaagcaagaacggaaaaggccctttcacacaaataggacatcccttgcccagcactccctccctgaaagccgagggggcgcgagtcaggaggagtgctggtgtcctccaaatgccctttctggacctgggttcttcagcctgcttctgaagccaacaggcttgattaaggaaggtctggctccacagaaagctctttgtcaggggtagcacaaaacagattttttttaaaccctgcattagtatttactttttgttacagtggtttgagtccagccaatgacactggagccaaaaagaagaaaaagaaacaaaaaaagaagaaagaaaaaggcagtgagacagattcagcccaggatcagcctgtgaaggtaacaaggaggttctgttttttgtgactcagtcactttttcacatgagagagttttgaggtgaatgtataggatcaacttggattgacgttctccactggtattacttcaagatggaagagttggatcccagtgctgtcctctgctgccctagacctaggtgatgaaactgctctcagtaccctaaaagacacagcaggtcagacactgactcccaagcatggtgcccatcagaatggacaggtgcgtactgcatgtgctgctgtgccagtgccctggggagctacgtgtgacagcccctggcgcctagagcagtggttctctgtcttaagtccccaccgctctgacaatgaaaggccccccctttctttttgagacagagtcttactctgttgcccaggctagagtgtagttcatgattatagctcactgcagcctccactcctgggctcaagtgatcctcccacctcagcctcccaagtagctgggactgcaggtgcatgccaccacacctgtccagtttttttttttttttaattttttgtaaagatggagtctcactatgttacccaagctgggtcttgaactcctgggctcaagcaatcctcctgccctagcctcccaaagtgctgggattacaagcgtgagccactgcattcagccaaagacttcttcttaagacctttatatatttgcaaacattctcttaatgccatagtcattataatgaaagccatgagtcccacagagtctttctgagttctactccatgagaaccactggcctaaaggcttacaacctgagagtgatgcactggcatgaaacccagagatatgggtaaggattgttttgtttcttaaataaaacaacattacaaaataaaacaattgcaggtaagtgttgtcttcttcaaagtaggctgacagaggcagggggacaactcaaacatattcataattcaccttttaaaactgcctctgagacctggggtggtggtttatgcctgtaataccagcactttgggaggccaaggcgggtggatcacctgaggtcaggagttcaagaccaccctggccaacatggtaaaaccctgtctctgctaaaaatataaaaaattagttgggcgtggtggcaggcgcctgtaatcccagctacttgggaggacaaggcaggagaatcgcttgaacccaggaggcagaggttgaagtgagctgagatcacgccactgcactccagcctgggcaacagagtgagactctgtctcaaaaaataaaaattaagtggccaggcatggtggctcacgcttgtaatctcagcactttgggaggccaaggcgggtggatcacgaggtcaggaatttgagaccagcctggccaacatggtgaaaccctgcctctactgaagatacaaaaaaaaattagccaggcgtggtggcacgcacctgtaatctcagctactcaggaggctgagacaggagaatcacttgaacccaggcggcagaggttgcagtgagccgagatcacgccattgcacttcagcctgggcgaaagggtgagactttgtctcaaaaaaaaaaaaaaattaaaaaaaaatttaaaaaaaggaacagcctctgaaacagtttataagcctcgcaaaaatccatattcattccaatatacccacactttgctgtatgcctcaaatgttatgcctcagcttgaatctgctaccttattgagatatgacttcaagtaatttttttactatttccaatataaaacccgctatgaaaaaataccattattatttaataccatgttgcacttcatttaaattagctccaaaccatcaccatccctacaaggtaggtaggggtcttccctttttattcatttaatttatttttgagactctgtcattcaggttggagtgcagaagtacgaacatggctgaccgcagcctcaacctcctgggctcaagcaatcttcccacctcagcctcccgagtagccaggactacaggtgtgcaccacgacacccagctaatttttttattatttgtagacatggggtctccctgcattactcaggttgatctctaactcaggctcaagagatctgcctgccatggcctcctaaattgctgagattacaggagtgagccatcacacatggccgagaatttatttaataaactgcaaggggaagaaaattaaaatgccacttcccaggcctaagcaatatgaacatattggtttatattctttctttcctttataatctaagtgaaaaacagaaaactaaataaaaatattagaagaaaatgtatgtagttttattaatctaagtctgacataggacccagaagccataaaacagaaattgacaaatttaaaactttgtagaagtcaaaagataaacaataatctgggaaaatatttgcaacatatgtattagtttaaaataattgaatgaataggcagttcagaaagaaaaaatgtgtaatcagtaaataataagatggttaaagtcataatggaagaaatgaccattaaagcaataattatttctcttagattggcatagattaaggcttggtaaactttttttttttttttgcgagacggagtctcgctctgtcgcccaggctagagtgcagtggcgcagtcttggctcactgccagctccacctcctgggttcacgccattctcctgcctcagcctcccgagtagctgggactacagccgcccgtgaccacactggctaattttttgtatttttagtagggacggggtttcactgtgttagccaggatggtctcgatctcctgacctcgtgatccacccgcctcgacctcccaaagtgctaggattacaggcgtgagccaccgcgcccggccacttttttttttttaatagggacaggggtctcactatattgcccaggctggccttgaactcctgggcttaagcagtcctcccgcctcagcctcccaaagtgctgggattacaggtgtgagccaccaagctcagctgaggcttggtaaatctaatggtgagggtcaggagctactctcatacactgttcgttggattactgatagtctctttttagagagcaaattgatgataaatcatttcaaaagtgcataccttttgacccagcaggcctctttcttaacttcatcctacagaaatatatatcccagtgggtaaaaatagatgtataagaaaatttatgctgggtgtggtggcctgtaatcccagcattttgggaggctgagttgggcagatcgcttgagcccaggagttcgaggccagcccaggcaacatagtgagaccccgtctcgacaaaaaaacaaacaaaaaaattacctgggcctggtggcacacgcctatagttccagctactcaagaggctgaagtgggagaatcccttcagcccatgaggttgaagccgcagtaagccatgattgtgccactgcactccagcctgggcaacagagcgagaccctgtctcaaaaaaaaaagaaattcactgcaacattgttgtattactaaagaacaaaatcaccaaaatgcccatgagtagggggctggctaaatatactgtggtccatacatacagtggacttggtagaatgggtaggtccaggtgttttcacctggaaaggtctctaagacagtctttaaagagcagtttgtacgataatattatatgatccaattttagtttttgaaaagtgtgtgtgcatttggaacttgtatgcaaaaaagtctggaattatatttgcctcttctcaccttcccaagtgaagactattgatcacaaagattatatttgggggatgggattgttgggtgtttactttctatgtgtcttacacatttctgcattgtttgaaatttacattgagcatgtattacttttgccatcaaacaacataagactaataaggggagaaaccctgcgggcagcacccacccatcatatagctcattgtcaaccactttttctctggttgtaatgacctctgggattaggacagaggaaccaaaccccttctttgaattgtaccctttaactctttttttttttttcttttttgagatggattcttgctctgtcacccaggctggagtgcagtggtgtgatcttagcttactgcaacatctgcctcccaggttcaagcaattctcgtgtctcagcctcctgagtagctgggattacagggacacgccgccatgcctggctaattttttgtattttagtagagacagggtttcaccatgttgcccaggctggtcttgaactcctgagctcaggcaatccacctccctcggcctcccaaagtgctgggattacaggcatgagccactgcgcccagcactctttttttttttttttttgagacggagtctagctttgtcgcccaggctggagtgcaatggcgccatctcggttcactgcatcctctgcctcccaggttcaagtgattctcctgcctcagcctcccaaaatagctaggattacaggtgcccgccaccacgcctggctaatttttgtatttttagtagagacagggtttcaccatgttggtcaggtgggtctcgaactcctaacctcaagtgatctgcccgccttggcctcccaaagtgttgggattacaggcatgagccactgcacccagctccccttaactcttgaactcataattaatcaaaagtcttactaacataatgggccttttttctccccaactttgtcttgtccagatgaactctttgccagcagagaggatccaggaaatacagaaggccattgagctgttctcagtgggtcagggacctgccaaaaccatggaggaggctagcaagcgaagctaccagttctgggatacgcagcccgtccccaagctgggtatgtacatgcttgctttctttgccaggtcaggggcgagggatctgcctcagctgtgccttcatgagggtttcatgctgaattactgtagggagggcagtagagtcctggagttccttggtagttgttttcagagggtggtttttaaaaatgcagcataaagactatcattcagagaccttaccattttatagcagcacaccttgagaacaaataatgattcttgccaacagcactggctcacacctataatctcagcactttgggaggccgaggtgggaggattgtttgagcccaaaagttcgagaccagcctgggcaacatagaccttgtttccacaaaaagtaaaaaaaaaaaaaatagccaggcatagtgacatgcacctgtagtcccagctactcaggaggctgaggtgggaagatcacttgaacctgggaggtcaaggcggcagtgagctgagatcacgccaccgcactccagcctatgtgacaggagtgagacccccaactcaaaaaacgaacaaaccaaaaaacccaaaaaaaaaacaaaacaaaactattggcacatgaagagtgggaatgtctgcccagaggtcttttttccacttaggtttatagagactttgtcttgtttgtctgggcacatgtttattcctggaatgggcaaagtccccagcctcttcccctttgtctcctagccaatgcatgcttactaaatgcaaagtggtttgagattttgcttagcagtgatggttcaacaacaggaatactatatatagatttcattagcaccccttaaaaaagctataatgaattgctaaaggggtggaataggcagaatatctaaaaggattctggaagggactggatcctgttagacgtgcctgccaagactgagccaagccaaccttgatggctgacttcaggactcagctgacaaagtttctgaagtggttgtaacatgattctggacccattggtggcctagttcctgttttctttgtgactgggaaagtaagtatgttgaaaaaaacatattccaacaccaaatgtaaatgactttcagcttgtccacattactgctcccctccagaaacacaatgagacttcactagtatgttcggtgcagaggaggagggtggggcagggccagacagggtagggccaaagactggtgaggtgaggaaggcagctgtgcccaaggagatttgtttgctgcagaggttgggagcagctaatccatgaggcctgcagacctgcaggatgggcattgcctaattgctagtagaaatgcagtttgtcgggccccaccccaaagctgcagaatcagaactgccagaggatttctgtccactttgaaagttagagaagctctgctctagagcggatgcagttcttagaagcttggtcacaatagaagcaagctgaggaggtgcatccccacgggtgagggagagcagagcactgcccaggtggacaagaggggtgctgattcccccatcaccgtgtgtgtttggctgccctcatcggccaggtcccaggcccactggctaagccctccagcaaggctttgggccacagggtagggtcccagtgaccagtttctcgctgaggagcaggaaagatgcagagagccacacatctcacctctgaatgaaatccctgatgaggtgttgtgtggtggctgccatgtatcttggctctgttttcagatggcattttggagttttggtttgattttatttttcctgaggaatttgcaaatgagtaaccttgctacattcttcacagatagtggcacttgggaaagaggcagattgaggctgggcgcagtggctcacgcctgtaatcccagcactttgggaggtcgaggcaggcggatgacctgaggtcaggagttcgagaccagcctggccaacatggtaaaacctcgtctctactaaaaatacaaaaactagctgggctggtggcatgggcctgtgatcccagctacttgagagtctgaggtgggagaatcacttgaacctaggagacagaggttgcagtaagctgagatcgcaccactgcactccagcctgggcagcagagcaagaatgcatctcaaaaatgaatttaaaaaaaaaaaaaaagaggcagcttgggattaatttgcttctgttcctcttcagcccagcatactttgttttcctttcacctgtaaatgtagaaagtgcttcagtttagttctcagaaagctcaagagaaaaccacacagttgctcatacgggccctgacactttgaggaaggaggaacaaggtctggttttatttcttctggctttgccttctgtgcagtgtgtggtgtcggactccatggaagagcagtcaccctgagcatctgactagtctgcctttgaggtccagggtcagtcaagccccagttagattcctttgtttgtgtcagcctgtaaaaagtgccaccttggcaggcgtgttagcctgcatggctgaggcgtcaccctagttctgagttttctcaggggtggtggtacctacagcttcttgccctaatttttttttcacttaattggaggactaatgattataaatctcgtgcatatcagctgcactgtgtttttacagtactctccaccttcttgggagagttttaattagatggtattccactaaagaaacctacaagtctctctgatttatttatttatttatgagacagagtctcactctgtcgcccaggctggagtgcagtggcgttttctcggctcactgcaacctctgcctcccaggttcaagcagttctctgcctcagcctcccgagtagttgggattacaggtgcccaccaccacgcccggctaatttttgtatttttagtagagacagggtttcaccatcttggccaggctggtcttgaactcctgacctcgtgatccacgtgccttggcctcccaaagtgctaggattacaggcatgagctaccgcacccggccctctcttttattttcttgagacaggatctcgctctgctgcccaggctggagtgcagtggtatgatcatggctcactgcagccttgatctcctgggctcaagcaatcctcccaccttagcctcctgagtagctgggactacaggtgcctgtcacatgcctggctaatttttaaattttttgtggagacatggtttcactatgttgaccaggctggtctcaaactcctaggctcaagctgtcctcctgtcttagcctcccaaagtgctgggattataggcgtgcagctgcacctgactgagacctgcaattctttagaagcttaaaattatcctaggtttaccatggaaaggccttcttaggccgggtgtagtggctcaatgcctgtaatcccagcactttgggaggccaaggcaggaggattgcttgagcccagcagctcaagaccagcctggacaacagggaaagacctcgtctctacaaaaaaatttaaaaattagccagacatggtagcacatgcctatggtcccagtttctcaggagactgaggtgggaggatcgtttgagtcctggaggtcgaggctgtagtgagccatgatcgtgccactgcactctagcctgggtgacaaagcgagtccctgtctcaaagattaaaaaataaataaataaaaatgaaaggccttcttagcagaagtgttttagtctgtgtaacaactgtaagagccgcagatgaacttttgatcccccactcgagatcatgtcgttcttctttttaaagtcacccctttcccactcatgtcaacggaagcagtatccttttctgtctttggtcagtggaatgcagtgtggccactctgttttaaaaagtcactatcaaagggaggatgtgcactcacctggtttccatgggtcccagagagaagcttcccctctctttttcctctccttggcctttgtttggtttaatgttttccgcatctcagacattctcatttctccgaagtccttcacagttgcaccgcattgcttagttttgggtctctgatgtttgatgtcatggagagaattttgagggaagagtgtgcagaaagaaacccattgaaagctcagggttttctttaaacttccagattcttttaaagcaagttcgaagtgtcatccttagtcatttattggttcatgttggccttgagagaatcagctgcattcttgctgtgctctgcagagcagccttccacccctgctcagcaggaggtactcaaaggccattgtaagggagaaggcaggctgctccccacagagcaggacaagcagaggccatgatgctggcaccacaccgaggacagcacaggagccttgggctgcttcttggcatcgagggcactccacagtgggagtctagtaaaagtggctgctcccttttcagtgtttcctgtagctctactttttcacacccaccctgccccacatagtccacctgcagcctggctgattcctaattatccttgaggtcttgtcgttagatatttcctctgagaggtctttcctgacacacacacacacacacacacacacacacacacacacacacacacacgtcccatagcaccctgtacttcattcttactggccctcaccatgccgggtggcatgtgcatccttgctcatctctttggtgtccatgatggtgaggacctgtgtctgtttcattcgccagcccctgccacagaactggcacattctaggattcagtgaacacttggtgaaggagtgagtgaatggaagtgcctgttgcgtgtaggacctagtagccagcctaaatgagaagatttagccttgaggttattttagtacaatagggaagaccatcagtattcttggccatggaaataattcagggggaaaaaaagaaggttctgaagtgtataggaaaaggtataaattcaatacaagttgggaaattagcacctagataagactagagggtctggccctcagttttgtaggctcaaaaatgtttttttaatatacatagctgtcagttggaagcggattgacttaaattcacaagagctactttatgaataatcaaatggtgggttttggctgggcgccgtggctcatgctataatcccagcattttgggaggccaaggcaggaggatcacttgagtctaggagtttgagaccagcctgggcaacagtgagacctcatctctatgaaaaataaaattagccaggcgtagtggcgcatgcctatagtcccaaccactcgagaggctgagatgggaggatcgtttgggcctaggaggtcgaggctgtagtgaaccaaggttacgccactgcattccagcctgggcaacagagcaagaccccatctcgccggtcatgagtttcctaactagggaagaaaaatatgacctctctcccaagcaaacctgttgggaagcctgattaccaacagagcaggctgcttccctgttgtgtgtccctgcactttccagatcctgacctgcagcacgtggataatgactcatttatttactatttccccagaagatggtatgtctcatgaggacagggacttggtcctttttcctgctgtacactaggggctggcatggtcactgagtcactggtgcacggttggtgctcagtaatgtgtctgatggaagagggtgagatgatcagtgccagcggtggtgtcgtgtgctgcagcctgatgcagccctttccaccacacttgccccacagattatcattctgggaaggtctagagcttcctgttacatgttagaatgaaatgtttggactttgggaggccgaggcgggtggatcacttgaggccaggggtttgaaaccagcctggccaacatggtgaaactccatctctactgaaaaaaaaaaaacaaaacaccaaaattagccagcgtggtggcggacacctgtaattccagccactcgggagtctgaggcaggagaattgcttgaaccagggaggtgaaggttgcagtgagccaagatcgcaccactgtactccaacctgggcgacagaatgagactgtctcaaaaaaaaaaaaaagaaaagaaaaaaaaaatatttgggatcaggagtctgaaagtcagtaaaagcatgaattgagtgcctagtctatacagagccctttgctaggaacactgttactgggttggtcccttttgaagactccattttccaaaatgcactaaacattgcattcttcccagtgtaaacatgagtgagcccattgtagaaccgaaatcatcccaagggccagaattcagtggtgaatctctcagcatatatgagtccgattgagctctggataggaatgagggctgtgtctttggagcactccccacatgctcccacagaggaggggcctatcctgctcagggaggggatgttgtgtcagggtgacttcccggcagcactgtgtagacttggtgattcagcccaaaggcacttgcaggactctaaacactgagggcctgagttggcagtagcagttaactggctcacgctgctgaaagccaaggctggcagggccacgattgagcctggcgcctagaagccatcatctggttcagaaatgggcccagtacattgttgttgctgttgacacaaaagcagccttgttgtgactccttacaaacccatccagactgatgggcctgggccagggccctgacagcactctttacaccaaccaggaggcaggaagccaaattactaaagataaatgtttgtcattcagtgacccaagggagatttaaatggatttccaaaacacgaaccaccttggatcccagtgattgtcctgaggttttgccatgaattggccctcagttaggggctaagggtagctggaaagatggtttgcagttgccaagcacagaatgttcttcagatagagggctcctagggacaggaggaatttgctctggttgagttttgaactgagccctttactgccccgagggggcaaagggtgaggctcacagctgtgctcttctttcaggcgaagtggtgaacacccatggccccgtggagcctgacaaggacaatatccgccaggagccctacaccctgccccagggcttcacctgggatgctttggacctgggcgatcgtggtgtggtgagtgggccctcagaaggttacacctgcgggtaggagccactttcacagtaagccctgcagtctcacctagactacgtttactcgagccctagagagctgagccaaggaggtctgaacagactcccgtctgtaacttcctggggcatggccaagactccacataaatagctcttagcttttctggcaggttggaagttaacctctgtaggtccccgatgtggatacctgtttttcatttattcttttttgttcattcatttcctcattttctttctagtctgtctcctgactggagcagctggggctgctaaatgaggccctgtcctcccctttccaccccggccacccagagccccttgttttgacctgagggatttatttcccttataaagaatgatgaaaatgtcgccgggcgtggtggctcacacctgtaatcccaccgttttgggaggctgaggcaggcggatcatgaggtcaggagtttgagaccagtctgaccaacataataaaaccccatttctactaaaaatacaaaaaattagccaggtgtggtggtgtacgcctgtatcccagctactcaggaggctgaggcaggagaatctcgtgaacctgggagggggatgttgtagtgaactgagatctcaccattgcactccagcccaggtgacagtgcgagactctttgtctcaaaaaaaaaaaaaagtcaacagaattttttttttttttgagatggagtctcgctctgttgcccaggctggagtgcagtgacaccatctcagttcactgcagtctctgcctcctgggttcaagcgattctcctgcctcagcctcccgagtagctgggattacaggtgagtgccaccacgcccagctaatttttatatttttagaaaagatggtgtttcaccatgttggccaggctggtttcgaactcctgacctcaggtgatctgcccatcttggcctcccaaagtgctgggattacaggcaatgagccactaggcctggcttttttttttttttttgagacagagtctggttctgttgcccaggctggagtgcagtggcgcgatcttggcttaccccaacctccaccttccaggttcaagtgattctcctgcctcagcctcccaggtagctgagattacaaccatctgtcaccatgcatggataatttttgtatttttagtagagatggggtttcactgtgttggccagtctggtctcgaactcctgacctcatgatccacccatctcggcctcccaaagtgctgggattacaggcatgagccactgcgcccagtcttttttttttttttgagatggagtcttgctctgttgctcagactggagtgcaatggcacaatcttggctcactgcaacgtccacctcctgtgttcaagcaattctcctgcctcagcctccccagtggctgggattacaggtgtctgtcaccacgccaggctaatttttttattttttagtagagatggggtttcaccacattggccaggctggtcttaaacttctgacctcaggtgatccgcccacctcagcctcccaaagtgctgggattacaggcttgagccaccacaccgggccaacagaattttttaataccaaagttgggccagcagatggagatagctgagaaggcagaaaaaggcctttgtggttgggtgtggtggctcacacctgtaattccaacaatttgggagtctaaggtgggaagatcgattgagcccaggagttcaaaatcaatcagccgggtcaatatagtgagactgcccccgctacaaaagaaaaaaatttaataattagccggacatggtagtatgccccagtagtctcagctacccaggaggctgaagtaggaggatcgcttgaaaccaggagttggaggctgcagtgagccatgatcacaccagtgcactccagcctgggtaacagagtgagagtctatcttgaaaagaaaggaaaaaaggcctttgtttgggccagatggtaaaaaatcagacaaggtgggaaacagcagtgactctccgtggtaattccttgactagcttcgagagtcgtccctctatagcacttcacagaagctgagaccagtggctctccattgttgatggcgcagaatgatgaagtggttggttagttaggtggcattctcggtctgccactctaccacgtgatggctcagttttctactataactagggtgtttgctccaagagttcctaccatgccagggggcagaaggatttgtgagactccacgtcgtttttggtagtttgcttcatccttctgaaaagcctagagccccagggtattggagttggtctactacctggcagaatacctccaagtgagctgcttatttctttacagctaaaagaactgtacaccctcctgaatgagaactatgtggaagatgatgacaacatgttccgatttgattattccccggagtttcttttgtggtaagttgtgggggctttcttgaggttcttgagaggaaggcatagagcagatccaccagagggcaccagagttttcatccctgccaggggccaacctttgaatggcaaattagtgtgtcatttttgagttcctgcatctgaaggacacttgctttcattagcacttagaattgcagccttgtttaagacaattgactgggtgagggagaccttcgtagagctagtacccagggaagaggtattcattgtctggtgactttatataagaaaggaacgggcatgagacctactaagactgaaagaaaagaaggcacattttctatctagttcctgagcatgctcagttgtatagccttgcctggctgagccatccacctgcccaggccacgtttaatatccaggaagagagaggcatgggccgaaatggagagggactacctgaaagggaaggaagaatttgtaccagaaagagggagacaggacaccagagctccagggttgccacagtcagctctcaaccatgggacccactggcctccgaaccaaagatgccagtaccttggttcaagctgtcaaagtgaacacagaaattggatcaggcatgaaatcctcagtatgataaccttgggttggatgagtaactaggccaaatgggatgagcagccagaaatggtgatggctcgattctgtgtgtccaggagggcttggccctaaagagaatccagctattaaccctcagggaggtggtagcaccaggtccgaaccaaatttggctgtggagcccaagcggcttgtccagcctgccggcaagcagcacaaccaccccagcctctcttttccagggctctccggccacccggctggctcccccagtggcactgtggggttcgagtggtctcaagtcggaaattggttgggttcattagcgccatcccagcaaacatccatatctatgacacgtaagcacctgcacctacccccaccccccacaacaccgccatcctgcttggtctgggagagagtagaaaaaggctgcacaatgtgccccatgaaaggaagagggaaggtctcaggaagggaggatgcccaggtgcggggactgcagattcatcctaggaaccacctgttctgctcagagtcccagccagctcccttgtttgtggcccaggttggaaggagcccaccctgaggcctggtgtgcctgctcagcagaggcttgtttttgtttttgtttattattttttacattttatagaggcaaggtcttgctatgttgcccacgctagtctcaaactcctgagctcaagtgatccactcacctctgcctcccaagagtgttgggaatatagacgtgagccattgtgcctggccagaggcttttcttagtctcactctgttgcccgggctggagtgcagtggtgcgatcttggttcactgcaagctccacctccagggttcaaacgattctcctgcctcagcctcccaagtagctgggattacaggcatgcgccaccacacctggctaatcagaggctcatttttgaacgcctgtaccagtcacacatggaagcacttgaacagcagcagaaatgggccagagcgagtgtgacccagattcagatagtccttggggcctgtgatctctgctcttcattttccctggaagtgttgaaaccatctgcctgccacagtcttcagggcttattaccagctgtgttcttgagggaatcagaacccttgaaaccctagaattgccttgacctgccccgtgggttccctgtgctgcttccctgcatgctaaaggtgggattccccagccaactcctagggactcatcagggagatgctggtggtaccttcaaataaaggtgtttgcttgggtcccaccttcctttggaaatagattctgttgaagtgaggcaggctccttgcctggtggagtgtggtggggagtcccagtactgagtgcaggtggcagctaaaagtacacccgtgctgcagacctggtccttctaggtgtggctgcacgtgcttgatgggatcaccattcccttccctgttaaaaaccttgtcacctggatttttccccctcttagagagaagaagatggtagagatcaacttcctgtgtgtccacaagaagctgcgttccaagagggttgctccagttctgatccgagagatcaccaggcgggttcacctggagggcatcttccaagcagtttacactgccggggtggtactaccaaagcccgttggcacctgcaggtaaaactgtcttcctgtaaggccccaaaaatgcgggtgtctgcactgtagttgaggagcatgtgccactgtgagtcacagctccgcccttagcatcccacctctggcgtatctggtaaggcgggcacttggtgcctgcaggagccagatggggagcatggagagggcgggagggttgtagggatggcagattggcaagtccctgccttgtctggagggctcttggtgtctgctggctgctgccatttggagatggtggggggcggtactggtggtttgtttttgtttttagggatgagcccaaatctggatttttatgggaaatgtcctaaagttttaaatggttggctcaaattgttttgaatattgtgtgcaccaaatagagcaagtcagctatgtgatctaagggcaacctctgccttagaaagttgtttaaaacaattgaataatctctccttagagaactttaaaagtaaaaacaccaggtgtgaaagcagaaggggaggagggaggagggtgagtgcctctgccatcatcttctgggcatgactacagtccttttccgttgacttgattctaggagtgaggattggtctccccagacaaccgctgtagcaaaggaatagtttttgaaattgagcaagaaaaatagggagaaagaaaatccaggaggagctttggcagcactcactgtggggagggggaggctggcgagcagggtgacaccactgactccggaggcacctgatgtgtctctcacgccacctgctggccagctggggtctccctgccattgtccttgtaatagggattggccagaaccctgaggacaggacatttgtgtccccacaggtattggcatcggtccctaaacccacggaagctgattgaagtgaagttctcccacctgagcagaaatatgaccatgcagcgcaccatgaagctctaccgactgccagaggccagtgctgccccgggtggtgggcagggggcagagagagggcaaggagagcctggctgtcagcaggagagaagggctctgggtggagagggagctttctcctactggaaaagcgaaccagcccatagtcttcagatttcctggactttctatttctgttatctgaagcaggattttattttagtttaactttctcagttcctctgagtctgtgcctggactagcttctctgccatctgttgaaaggctcagagaacacctattctctgtaattttagcctaagtaaagcataaatagaatgatgaatccacttagtgaaccttcatacacacggcagcgcgttccaaagcccagcgcagatgcactacagggtctgtgacgcccctctgccgggtcaggtaaagggtgacctgagcttgtgagggatccccgatttctaatcccaatttccccacccagatttggctgaaggactgggcaaccttaaagtgagctgcttttctgttctgggtctcagttttcctagtttcccaaagaaacaaatgctccaactgtggctggcttcaggtagggattcttttttttttgttttgagacagggtctcattctgttgcccaggctggagtgcagtggcacagtcacagctcactgcagcctcgacctcccagactcaactgattctcccacctcagcctcccaagtagctgggactacaggcgtgtgccgccatgcccggccaatttttgtttttatagaaacggggttttgctgccaggcgcagtggctcacgcctgtaatcccagcactttgggaggctgaggtgggcagatcacgagatcaggagatcaagaccatcctggctaacacggtgaaaccccgtctctagtaaaaatataaaaaattagccagtcgtggtgtggtgggtgcctgtagtcccagctacttgggaggctgaggcaggagaatggcatggacccgggaggtggagcttgcagtgagccaagatcacgtcattgcactccagcctaggcgacagagcgagactccgtctcaaaataaaagaagcccgggcgtggtggctcacgcctgtaatcccagcactttgggaggccaaggcaggcggatcacgaggtcaggagatcgagaccatcctggccaacacggtgaaaccctgtctctaataaaaatacaaaaaattagctggtcgtggcgtggcgggcacctgtagtcccagctacttgggaggctgaggcaggagaatggcatgaacctgggaggcggagcttgcagtgagccaagatcgcaccactgcactccaacctaggcaacagagcaagactccgtnnnnnnnnnnnnnnnnnnnnacaacaacaacaaaaaaaggattttgccatgttgcccaggctcatctgaattcctgggctcaagtgatccacccacctcagcctctcaaagtgctgggattacaggcatgagccactgtgcccatcccagtagggattcttaaaatcccttctcaggtgggcggtggctcacgcctgtaatcccagcactttggcaggacaaggcgggtggatcacgaggtcaagagattgagaccatcctgccaacatggtgaaaccctgtctctactaaaaacacaaaaattagctgggtgtggtatgtgcctgtaatcccagctacttgggaagctgaggcagcagagttgcttgaacctgggaggcagaggttgcagcgagccgagatcgcaccattggactccagcctggcgacagagcaagactccgtcgcaaaaaaaaaaaaaaaaaaaaaaggaaagaaagaaaaaatctcttctctttcctcggagtgcttcttcctattggtcatcagtgcacacagtcactgcgttcctgctgacatgaggctgcctgcctggactcctcagcctctaaacaggattgatcactctgaaatcaggctaatccacctagtgattggggtcattagtgtcccatcttgagagactgctgcagtaccgttagacactgccaaaagcacaggcttgggggactgtggtatgtgtcttctcccttctgttctcatgacagatctgccttgcgttctaggccggtgggcaggcaggcagagagcattcttagagtgctgcagcagcagaagaatgtctcacccatgtctgggtggaaaccccagcatggctgtgttttcagtccaggatttgaggtatcattgtgggagctgccatgtagaatgaggtcattgagcgttcccctaaagagacgaggatttagcaaggaattttagaggctggaggttctagaactgaagttttaaaagcaattcctgcactgggaagcattgtgtcaggcactgactgaggcctgtaaactgtgacaccaccctgtttgcagattgccccaaggccacctttgtgtatctgagcctctggggatgttctaccagccccggtatttgctccacaggatcacatggtttcattccactgaagcatttttctagcaaaagcagctgccgggtgggacgctgactggggataaaatcctgggagtatgctgcttttcttctgaatgtaacccacagccgtgtctctctgggaagtactggtgtaatagtgtctgggtgggcagaccctggctgggccctggggtctgtccgcgaagtgctctaagtctagcagagaaagagcagtgagtgtgggatggcatcagtcacagttcagtgagaagcctgtgaggactgttgggctgcgtgggcagaaggtacagctagaaaggccaacctggcccaagggtagaaattcttgtcttctggggtggggagtttgaaacaagggtggagcatgaagggttgtgttttcttagggagtcagcctggggccatgtagatggttgattgatgtagcagtctgagtctgcctggactaggagggaaagggccagaagatacggaagaggcaggccctgtgcctgaggagatatgcacgggggtgcagggagccgccgaatgaccagggattctctcttgagggcctgatctgtccttgccatggatagatccagggtgatcagctcatctcactccatctcttctgtcttgcctccagactcccaagacagctgggctgcgaccaatggaaacaaaggacattccagtagtgcaccagctcctcaccaggtacttgaagcaatttcaccttacgcccgtcatgagccaggaggaggtggagcactggttctacccccaggagaatatcatcgacactttcgtggtggaggtgagtcagggagtggtgttccaggtctctaacacgttcccagagaggcacccccctgagtggccgggttcccagggctcgagtgttggcaccttagacttccttgaccatccgtgtttggtcctccctaaaaacagggagttggtgcttgaatttgctgaaaagatacctctggatctggcttgagcccttctccccctctgccccactttgataacacaaaatagagagaactgagccccgcttaatccttcaggaaagcctgcaattccctgcctgtcccagcttaacccagtgctgaccagacataggagacacagtctggggggatgtgagctgcaagaagaggtccctggcggtgcccatgctgggaaagaggtctggcaggttcagcccacgatcacggctctgtcctcaagtgccctgagccaatgtccctcctcctccccacatgtcctgttgcagtttccagccatttatctagaggggcagagctgcctgaaggtggagtgagagaaacattttgttcccgggccgcagtgccactgtgcatgcttgacattgcctctttattgccttcccttcagaacgcaaacggagaggtgacagatttcctgagcttttatacgctgccctccaccatcatgaaccatccaacccacaagagtctcaaagctgcttattctttctacaacgttcacacccagacccctcttctagacctcatgagcgacgcccttgtcctcgccaaaatggtgaggagcagacgggggggtctctggagatgtgcagggaaggggcagtggagccatggtgagcacagctcccgggacgcagcctcccatgggctggaggctctgagccctcctcatctgttctgcttaggcagggttcccgcagtttttaggcagaaactcaaaacttggagggaacaaggagcatccgaagtgaaggcattgaactcctcctgattcatttcagtgagtttcgttctcacaggaggcgccaccaaggagcctgaatagccaggccttccctgggaggacagggcttctcctcacagctttcccagcgtgggaaaggggtgattgctgtctgtcgtggtgagtcattggagcatccaactgccagtagcggatggcgagcccgtctgtcagtgctttgctgtgggttctggtaacctgtgcccagcccagcccagcctgctgtaggcaatctggtccctgccctgtgagagcttctgctccagttggtgaggtttaggaagcatcttcacagtctccaagcaacacagcaggtgtcatacaacatgaggtgcactgagggcctgagagttggggcatccatggagtaaggaagcaacacaaaccccatgtagctgaccagagccagcttctcagaggaatgggctcagggtttggactccagagaggactgtggaaattactagagtttcagggaggcataaccaggaatagcaagagccccggcctggacactgagtacatatgtgtacactctgagggacactgggcagaggccaggctggagggggcgctcagagtgtcctgagaaccacccggagagcggggattaacgtggaagcagcggagcttctgagggaaccttgttcttgtggctgcccacaggacagctttgaaatggcagcaaaggggtaggaaggaggctgtccccacctgtcctcacctgttcttgtttgtccctgctgctttgcagaaagggtttgatgtgttcaatgcactggatctcatggagaacaaaaccttcctggagaagctcaagtttggcataggggacggcaacctgcagtattacctttacaattggaaatgccccagcatgggggcagagaaggtaggcgacacatagccagagtccaggctgcccggcccagggtgtccatgtctccagcagaaaccgggccatgggttgaggagacagccgcagtctgggtccttgttacctcgagttgaacctttgaaaatgccctccctctgctggccagaccagcaggtcagcgttcccctctcagcaactggtgtgaggatggcagaggggacagagccacacagtagcacgaagatcatctccaatgaggccttcccacgtgagggaaccgtggaagttgagttgcccacggtttgccaggagggtagggctgggggaactctgaggaggtttcctctcctgagctgctgccctcttctggcatgacactttcttagcccttcctcccccagtgccacaggggacataggggtgagctggagcgtgggccagttttccctgggaggtctgatggacgtgtgaaccctggtgtggaggttgagtgtggggccggctgggtgtgagtctgctcccacagcacaggcggtggacccgggcccagccactcggaacttcagggatagggggtgtgggagagtctttgggccactgtcaactcagctctgcctctccctgttggctttcctaggttggactggtgctacaataaccagtcaccagtgcgattctggataaagccactgaaaattcgaaccaggaaatggaaccccaccactgttggtccaattttcacacacgtgagaatccctggcaaagggagcagaactgaaccggctttaccaaaccgccagcgaacttgacaattgtattgcgatggcgtgggctgcgtgacgtcacctccggtcgtgtctctggtctccgtgttttccagttaattacatcctcatgcagccgtgatcaagggaatgtaactgctgaaaactagctcgtgattggcatataatggagttaacgggtgaataataaaagtatatatatatattatatatatataaatattttaaatatctttcatgttccaaatgtacaaggatgtttggtctttaatgaaaagctgaatccagatcattcctcagaatgaggacccgaggacagtggcagacagacgcgttggcacagttcatggtttcctccagaggagacattggcttatcatggggaaaaagaggatctggagaacctcatccagctccccttctgaatcagctgggatgactggctttgagaaggaagggaagatggaacaggctcagatctcatgggatagcacgtggagctcttggctggggctgaccctgggcagggactttcctgcagggccagacctgcctgcattctgagacaaagcaatggacggtccgcagaagcagacctcattgattgagtcctttcttccatccccttggcctgctccctgtaggaagtcatcctgccaactgatttaaaagggctctttagccagttgttgccaaccttatagggatgagtcccctgtgagattttgcttttccactgcctgggatgatgcagtttgaagaggcccttggacctccttgtaacatcagggacctttggagaccattatcagtgtaagccctgcttagctcatcttagagcaaagagccagcaccctgatgtccctggggtggctaggcaggagtggcgtggggccaatacccagaccccttcagccaccagcccctggcctgtgccttccaacccattagccatttcttgttgtgcccctttccaagatacagcctgcaagtggtagcaagaagtgattagaggcagatctggacttggcaacagaagtggtttcccatctccattgtctgagtctgattttcgctgatgctgttttgtggatttttgtggtagtgatggttgtcagtgctgccagtttcccaaaacgtaatcaagcctctggtcacatggctgtcgatgtaggcattctggagtggtgttcagccaagtgaccgggcaaaattgggctgtgaaattgtacttccaggcttggatgtaatttttgctctagagagaagcaagtggtgggaaggaggtagcatgacgtgtggtgtgcgggtttccttgctgccgtcacctctccgctcatacaggaatgaagccttagccaggaggccaggctcagccctgtgccactcaccgaagccactttctacaggccagcaggggcttgttgcaggctgtgggttttggtgtggtttgtcagaggctaattctgcagagtttccaaaaccagaagacatcgtatgcttgggatgggggccgtgccacccgtgggaatgctgcccgctctgcagactgctgctagagccagcaactccactaaggtggattttcatcaggggcctgcagggccctcccttttcccattgttcctgcgctgcaaattgcaggccccagcaatcgtgactgacgtttgctccttgactccaagaaactgagaccaaagaagctgctgttcttagcaagatgcgcactgcattccacaggtgggaggagtcggagaggcaggggcttgctttgcagccccacagacaacagttgcacagtgcctcaagccccagagtggctcaccctgtccagacctttgaggatatcaaaggacaaagtgcccaagtctttcctaccttgggggaacctggaacttggaaaggctccctgtcctagtcttgatctgttctgggccaggtcccagcttgagctgcctctgagatttgggctgtgcggatctctggagtgagctctgtttcggttgacccaggtcatggaatggaaacggtgaggccccagtggctgttctggaagaaacagatctcctggcaaaggccccagcatctccctcactgaaaccaggtgcccggctcctcggactctgctttatgttgcggtgagaactctgcccaggtgtgcagggtttggcttgtgggctgcttgctgctcatctgatttttgtcccagtagtccctgcgttcttcattcaaccccttctgggacttcagctcagagagcaccatcccgggggtcagggcctccccacaggagccctgcagtgtggtagcgccatggctgtctcaaaccaagcaaaggaaggaccctgaggccttcacgctaaccctcctcgagcaactgctgttggaaggcctccctgggcctggcccccaccctctgccacccagtcctcccagctgccatgtttcaaagacgacctttacctcctgcctttggattgactctgcatttgaccacggactccagtctgtgtgtagggagagagctgagtaggaggcctccactctggatcgaggcctgtatagggctcgtttccccacacatgcctatttctgaagaggcttctgtcttatttgaaggccagcccacacccagctactttaacaccaggtttatggaaaatgtcaggccttccccacaactcctgtctaactgctgtcgcccccctacttgctggctctcagaagcctaggggagtccctgtggtcctgaattctttccccaaagacgaccagcatttaaccaacctaagggcccaaaggccttggacaactgcatggagctgcactctaggagaaggaggggaaccagatgttagatcaggggagggagcaggagtgtccctcccgtcagtgcctacccacctgtgaggcagccttctgatggcctggcccaccttccccagaaccaggggaggcctgaggcttcagttttactctgctgcaaaatgaaggcgggcctgcaagccgactacacctacggaggctgttgaggacaatttcattccattaaattaaaaaatactgactggctggcaggcaggtgccatgtctgggaacagggacgggggagcttcacctttttgtcttggcttttctttgggctgtgggggggcatccatttccagggtcggggaggaaataccaaatgcattgttgttctgctcaatacatctcacttgtttctaataaagaaagcagctgaacaaaaccttctgtcctggtattcctggtcagcaggtggcagtggaagaaatggagtgctggagcctaggctggagccaggacgacagggcttggacacaaagtccctcaagcccacagcaccaggccagcttccaaaggccttcctttaaggctgcccttcttccagggcaaacttggtgttgtcagacccttcccacccgccagagacgagctgctattgacccaggttcactccaagttagagcagcaactgggctctcagccagcacctgagcacctcagcacaggagccggcccaggcttccctagctgggcacagagcagcccccttggtccaggtcagcagtggctcctctggtggaggtgcaggccccgtgccttcccactgtgcccaggtgccacatctctcctcctgcaccactggccgggtggttctttgagtcactaggggtgcattttaacatggcaagttgctgggccccagtagctgtgtttaagacttcccattccccctcttctcatcctctggaacttacccattccctgaccccctgatcctttcaggtccatgactggtgcctccaagcccctttccagggaaactgagaggacacaggacctgcctgacccctctaaagccccccaaccctcctgtcccaaaccaagtcactcaggctcctatggcccatgccttttttcctgcccttagctttgggctgagagaacatagccctatgtgttgtttctacccatgggcctctgggataaaaagctgtgatttcaggctgggcatggtggctcacgcctgtaatcccagcactttgggagggcgaggcgggtggatcacgaggtcaggagatcgagaccatcctggctaacactatgaaaccctgtctctactaaaaacacaaaaaaattagccgggcatggtggtgggcgcctgtagtcccagctacttgggaagctgaggcaggagaatggtgtgaacccgggaggcggagcttgcagtgagccaaggtcgtgccactgcactctagcctaggcgacagagcgagactccatctcaaaaaaacaaacaaaaaaaaaaccctgtgatttctcccttgcttctgcttcccagttcacttccttaaagactcttgcccttttggctgggtgcagtggctcacgcctgtaatcccagcactttgggaggtcaaggcgggtggatcacctgaggtcaggagttcgagaccagcctggccaacatggtgaaaccccgtctctactaaaaatacaaaaattagctgggtatggtggcgggcgcctgtaatcccagctactccggaggctgaggcaagagaatcgcttgaacccgggaggcagaggttgcagtgagccgagatcacgccatcgcactccatcctgggggacgagcaagactttgtctcaaaagaaaaaaaaaaaaagactcttgccctttcaaggcagccttctcagtattgggccctcatcctagccttcac

SEQ ID NO: 15439 - DNA, 124701 bp, Human
atttcaaatacttctgtaaggtctaggtgtaccctgctggtgtttgtgatgtcctacattactcttgatctacttttgaactatgaaacaagggaaaaattggaggtccagagctcaggattcagatattattacctctgctactcacagcagagcaagtaacttagcctgtgtggaacttcatttttctttcttttttttcttttttttttttttttttagacagagtcttgctctgtcacccaggctggagtgcagtggcacgatctcggctcactgcaacctctgcctcccaggttcaaacaattctcctgcctcagcctccagagtagctggggttacaggtgcacgccagcaagcacagctaaattttgtatttttagtagagatggggttttgccatgttggccaggctggtctcaaactcctgacctcaggtgatccactcccaaagtgccgggattataggcgtgagccactgtgccaggcccactgtttttgttttttttttttcgtgatgacaaatttaaagtcatctcataggaatagaaaatagctttttagtagaagctcttggaatttaaattgagactgaatggaaagatgaaagaaaataaacttattaacatttaatgagaaccttcaaagaactaggcatagtaccaaatggttttatatttttaaacctcatttattcctctcaaaacacctgggaaggagatatttttgccatttcacagctgttgaaactgaggctcaaaaagactaagtaacttttctcagctacacatgtggctgagccagtatttgaacccagttctgtttgcagacagaacctgggctttttcacacctgcaaactggaaacattaattggttcttaagatcatcatcgatgtgataaaacctgggacagaaattagtcaagactagctgcatctgccttttcctctggtgggtaggaaaaggaggagtataatgatttcctcaggcatgaaggtcgatgatgagcaaagtgtatactctctaatctaatgtcataattcatattgtggagtaattatctggataagtgtagggtctctgacctcattctagatattgtacattccatggctattttcattttggtccatgaactctctttgctctcatgagcaccatttttatcccaatctaatcctgtatgtttgtgtttttacacagattagtttttaaatgttatatataatttgcttctgaaacaccattgctcaatgactaccaaatctttctcattaccaaaatccttctatgccaacttcttcaagaaatttgatcacctttagatgaattgttaatgaaaattaaagctatagccagcaacatgggtatctttgggctaatggccaaccaacaggccatctgtgtgaaagaaaacaggctaacaattttggactctggtctcttggggctacattgagcattgacctcaccggtgctcactgaaattaattgcttttcaggttgtattttctcatcacggaaaccttcttttcccaattcaaaccatgtgggttaaaatgagaaaacaaaagccaaaacggcttcccacacccaaaagctccttctgtcagagatcccagtagccccgggagagctgttagaagtctgagaaggattggtcatcatcgcataccatacataggtggagggcttgttattctcagtttcccgcctatgagaggatacccctattgtttctgaaaatgctgaccgggacccacacttccaacaaaaattcctctgcccctacagcagcagcaaaagcagcagcagaagcaacagcaacagataagtgttttgatgaattgcgagatggatagggcttgagtgcccccagccctgctgataccaaatgcctttaagatacagcctttcccatcctaatctacaaaggaaacaggaaaaaggaacttaaaactccctgtgctcagacagaaatgagactgttacagcctgcttctgtgctgttccttcttgcctctaacttgtaaacaagacgtagtaggacgatgctaatggaaagtcacaaaccgctgggtttttgaaaggatccttgggacctcatgcacatttgtggaaactggatggagagatttggggaagcatggactctttagccagcttagttctctgtggagtcagcttgctcctttctggtaaggtttggctttattttttttaatttagtattttaaaaaacagagttagtgatttctgggtgctctccccaaatctcatcagtgctgatgaacaaggggtggctgtagcaaaggcaccatttctctgtgagtctccagtcaatatgtgtggaaggattgaaatgcaaaggctctgtggcatgaactgattttgctagtttgtcttctgggtgattggcccctgtgttagaaactctttgaggaccgattaaatcatcttatttgaagagatccccttactatcatgcattattttcctgctcctcattctggagtgtttttcttattgatttttttttaaagaaccggttttacctgctttaaagaaaatcttcagtaaaaaatgaaattcatgctgagaaatacaggggcccaattaaggcagtgtatagattgtcactgttaaaagggaacaaagatgcttttctgtaaaaagattttatatctacatcctattttaagcaaagcaatgaaattgtaggcttttttttttttttcttgtagttagggtcagggagattggggctattagaatttttgttttattttaaaaattgtttgccatgtagtaattcataaagggtttactggcccaatgaaacaaaaatttaggcagttaccaaaatctttaacacaggagagtatatgaagcctgttgtagagtgaaggagtggttggccagtgtgttgggttcagtgtgtttattgcttagatactccagatagtggtgtgcctctgtagctcactcagcctatgtgacataggtagaaggcagtatccaaacctgaactacagatcacaaatacatttatcattgccatcagtctctccccttcggtttgaaaacattctaattttaataacgaaaatcgaattgatattggagatgaatttgggaaaattcactaaacttcatggatatagggcatattaatataatttgatttgagtatacataagtatctgctatattttctaggtgtttgaactattttattaaatattcaaaaaacaaatccaatgaaataactgagttgaatacaatttgttttatagctctcaacaaccaatattttgagaatttaataatattctttaagaatgtgtaacacaagttgctaaaaattaaaagattttaggtggcttcagtatttatgtggaaattgtttaaataatgttgacttctccaataatatgtacttcaaataattatcatgattccatttttgattttttttttctgagtgccattatttaccagtgacatgaaatctggaacttactctataccagggattatagtgatgtgaagcccaggtgtctatagtttctctgaggtactttgtaggttaatacacacacaactgttttcattcactttttttactcctaaagcaactgtgttatagcactttgcaatacaggcttagaagaattgtcataaaatcaaacaaaaaggtatgtagccaaaatagttgttccatgtctagaccttagatccctggaaaaaacagcactgcctttaaaagggagaggaccaaggagaggaagtaggtcatgttcttgttaggaagggtgacactagcaaggttagtttctgaggtaagtctgttgtcttgatcgtagcttgcattcctagtctaagcctccatgagcatgactgctcaaagcttgataattgcaacaagaatccagctagatcatgtccacagccataggagcccgttcctctagtcaaactcctggtagactatagcagtggagcaaggggcttatggcttaaaggtttatctctctagtccagtgggttgtttcttgtttcttttttctgaacccacagactgaaaaaaaaaaaagccacttttttttagtgaaggtggctctggatgacagagttgtttacccataagagggctggaggggatgtgtagctctcagaagctccttacaaatactcctagattctgttgctttccttttctgaattgagaatcattgctaacttcagctttcaaacaggttctattatattagcttttccctactcttctatcctcataaaaccaggctgttctctttaaaaagctgtatatgtagaaaactaacaaaaaaatcactgtgatttatcatagtatcttctacgtgatcaacaatgatctaataggaagtctctagtctcatgctttcatacctctttactgtgtcacttgactttttttttttttttttgagatggagtctcgctctgtcacccagactagaatgtagtagagtgatctcagatcactgcaacctccgcctcccaggttcacgtgattctgtgcctcagcctctcgagtagctgggactacaggcgtgcgccaccatgcctggctaatttgttgtatttttagtagagacggggtttcaccatgttggccaggctggtctcgaactcctgaccccaagtgatcctcccgcctcggcctcccaaagtgctgggattacaggcatgagccaccacgcccggccttgtcacttgacattttaaataacaactggattcagagatagcagacatcttgtctggggtggcagaggaaacagttgtaaggtcagggaagtgctcccagatgaaaccccctttttagggctggtctcagaaggctagtgtcaggtctgagtaatcaagggtggaggtctgaaagctgggatcggagacaccctttggaattattctcagagggaggagcttgcttttttcacagatgctcccttccaagcattgtctttattgtttgttaggtctcagcatttccctttcagccctgccctgggagagcttcctggaagagtctagttcttccaaggcgtctctccaggagagaaggagtcttctaagttcatctcaaaagactatgtgatgttctctggggaatttaggtgggtgggctctaaattcttctgaaattatcagtttgcctcctgagcctctatctccccaaaggatatctgtgtgattgtatcacctgcttattctctgtagatggcttactggtgagctcacagaatcaggatttaaatagattgttctaggctggaagggtggaaaaccaaaacaaaaagataccatttcaaaataggtaaatgtctggttctgtgtttgggttcaagaaataagttatgtatatttaatgtgggagagacctggtttgttgaaagttcttgtgaatgacacctaggttttggggatacacaaaagtcatggaagacaacataggctctgcttgctaaaaaggtactgcataagctgtcatatgttgcattagcagaaatatgaagtccaaatcagaaatggtaatcacttcactgaaatctactgctaagagcacatccatgaagcactgaagacctgagaaatttaacagcgaacatagcaggcaaactgaaggaggaaacatggattacaaagtcaaagcccaacttggataaccataagcaagttatttaatttctctaagccacatttttctcatcttttatggatgaaatacccattttccagggttgtgatgagaatcaaatgtgataatgcctgtgaaatgcttagccagtgagaactctcttaataaatgaagcttggggcctggtgctgtggctcacacctgtaatacagcactttgggaggcccaggcaggtggatcatgaggtcaagagatcaagaccatcctagccaacatggtgaaaccccatctctactaaaatacaaaaattagcaaggtgtggtggtgtgtgcccgtagtcgtagctactcgggaggcttagacaggaggattgcttaaacccaggaggcagaggttgcagtgagctgagatcacgccattgtactccagcctggtgacagagtgagactccgtctcaataaaataaaataaaataaataatgaagctagtataatcaaaagagaagtgttgctatgagaaccactgtgctagtcaagactgatctaatctgccccaggatgtaggagaaccacttaatattcatagatgctgtctctttctacaaaacctcagtataatcctgtctctcaaactttgtgctggccaattccaactgaataaacccaaacactttgccaactacccatctaccctcccctcacttatccatttatccctgtttgtatcttgtctgcttcaaccaggcccatctccacaatctacacattctttcctcttggctcttgttcatgctgttccatccatttagaaatggcatctttcatctctactctgcaaacacaattcaactcaatttgcccaggccaactcttcctcctgatgttcttcccctaagtttaggctcctttaccatgcagattgtgtctttgagctttgggcagccagatttagcccaattagcctctaaatctctcacaacagatattatttcttttctattctcattagtacatgtatttaatgtttagtaatttctgttgaatggagttttatggtcacagtaagaaaatgttggtacttcacagcggagctgaaaggaaaagagaacattgtagaaaggatctcagtaacatcgaaataataatattacattgggccaggcacgttggctgatgcctgtaatcccagcactttgggaggccaaggtgggcagatcacgagatcaggagttcgagaccagcctgaccaacatggtgaaaccttgcctctactaaaaatacaaaagttagctgggcatggtggcatgtgcctgtaatcccagctactcggaaggttgaggcaggaaaatctcttaaaccagggaggcagaggttgcagtgagccgagattatgccactgcactcgagcctgcatgacagagtgagactccgtctcaaaaaaaaataaaaaaaaatttaatattaggttggtgaaaagtagtggtaaaaactgcagttacttttgcaccaatctgataatcaattttatatatcttgtaaatgatattcactctcatcttaaaagtttagcttatattaaatgtttgatgtaaataaagttgaaagaaagtttcttctgttaggtgtgaaacataaaagatatactcataaaagtggttctaaccagggccttacttaagatgaggtattgtatgattgttgaatattacctataacatagtcgtattttctattcaatagatatttattgagttactgtgtgccaatcattcattcattcattcactcatctatcctttcaataaacaaagacttattgagggtttcctttgagccatgtactgtcctggaaactaggaatataaataaggataaataattttttccctttgctaagctcacattttagtgggaaaaatgaatataggcggatgaattgtaaaatgttgtgataaatgatttaatagagatattacagcaaataaaggtatttacaaaatctgagcttttcaagggctgtaaaagtttttattgggtccaatgatacaaaatgaaatagcaatatctgaattgagcataaaggtctggtgcagtggctcacacctgtaatcctagcattttgggagactgaggcagacaaatcgcttgagcccaggagtttcagatcagcctgggcaacgtggcaaaaccccatctctacaaaaaatacaaaaattagcctggcatggtggcacgtgcatgtagtcccagctactcgggtggctgaagtgggaggattgctggagcctgggaggtcaaggctgcagtgagccatgatcataccactgccctccagcctaggcaacagagcgagacattgtctcaaaaaaaacaacaaacaaacaaacgaaaccaaattgaacataaatatttaattaaatgtctaaaaacgtggaatgtcaactaaagaaaatgagtagtattttgaaaacaacttgtaggttgatttttctgtctttgcaagaactcctaaatagttgtgaatattgccaaaagtcaggtccagttatagttataacttgctcatagccaaatgattttgaaaccaagatgaaaaggaaaagggaagaaaggacatagagggagcaacctatataaagggggtgtgtataaaatagcagggcaggcttaaggaagctgagtgaagctgtaatgtaggatgaaggtagagaattaaagttggggtcagatcaagaagggcctcacaggccattttaagtaggttgtccctcattctgtacatgttgaaatttagcagagtgtttgttctatcatgtcatatatcagatttatgtcttgaaaaattcactctaataatagttttcaggatggattaacatggtagagaccataggctgggaccaagttggcttcctaacattccaggcaagaggactgtgaggataacagggggcttgagagagatttaggaggtgaaactgcaggagttagtgattggttgtatatggaaggttgagagggagggaggagaataagtcattgctccagcattctgatttggataatggtggtgccattcagtgtgctgaatggaggtgggctgggataaggcaaataattattttgttcatgttgattttgaggctacatgtaaaggaagtttttttttttgagactgagtcttgctgtgtcgcccaggctggagtgcagtggcacgatcttggctcgctgcaagctccacctccccggttcaagtgattctcctacctcagcctcctgaataactgggattataggcacctgccaccacacccggctaatttttgtacttttagtagagacggggcttcaccacgttggccatgtcttgaactcctgacctcatgatccacctgccttggcctcccaaagtgctgggattacaggcgtgagccaccgcacctggccataaaggaagatatttatcaaaatttggctgcccacatctgaagctcagaggaaggggattgggcaagagattgagatgtagaaatctttggtatatggtaagtgaagccacgggcatggctatatttcaagattgaaatgaaggaacgagaaagagcagatacccaaaaatttgatgaagaagaaacaggtaaggagctgacaggagaagcaaaaccaatgacattcctatcctgggactttagagaattgctgctgtagcagccatggaaagaaatttttttttttttttttttgagtcggagtctcgctcagtcccccaggctggagtgcagtggtgcgatctcggctcactgcaagctccgcttcccaggttcacaccattctcctgcctcagcctcccgagtagctgggactacaggcgcctgccaccacgcccagctaatttttttttttaatttttagtagagacgtggtttcactgtgttagccaggatggtctcgatctcctgacctagtgatccgcctgcctcggcctcccaaaatgctgggattacaggcgtgagccactgcgcccggccggaaagagaattttaagaagacagtaagatggggcagcagagtaacagcctccgggcctgacactggagcaccagcctgcaggtgtgttattttacagagagccagctgcaccggcagcatcaccaaaccagagctggaagagagcagctggcttcactcctggctttcaggaaagggaatgtctaaagttgcctcccttatttttggaattttgaactgataaccctattcttacccatctggccagacgattccttaactcgtgttacacctgcagaatgagttttagatctagctgtgacctcttcccccagccccacccccattgtccccttgtgtgccttcaggaatctgatcattcttctctcctgctccttcccaaaggctgcaggagcaggtgtgaagacgtggatgtgccagatgcagagtcctgacacttttcaacacatctgcatattagaggaagtacatacccattgcttggtggtttcatgtctaatgtggtatgagtgtgacaaagagagggagaaaatttggactagccaaagaagccagtcaggcgtggggtttgaagggcatcgtgggcggctgtcatttgctctctgcttgtcacagccccttgcccagggcttgaccagtgaggtgtatgtgctggtcacacccatctcagcagatctgtcagctttcccgcttttgttaaagggtgatatcatgcttcctggggggagcactggaagacaatgctcggccactttcctccagatacaataggcggagtcaggaaggcagtattgacattgctggggctggggaggcactcactgctctgcggccgtcagatggtgaaccagcttaaccttggcacacagggcctgggttgtgcaaggcgtctggctgcagagccaaaggggactccaccctggggacaggagtgctttagacatctgggaatctgggatgggcttcaaattctgatccctgtgtcagaaacaaccacaaaacaataagagtaccagtaataacaaaaatgactaccctaggttgaatgcctttatgtgccaagtgttaaatatgatttttaatatttcacaactttacactataggtattattatttttttaatagacagggaaaccaaggctcacaaaggttaagtgacatgtccaaggttaaaatgtaagtgaccagccaggtgtggtggctcgtgcttgtaatcccagcactttgggaggccaaagcaagcagattgcttgagccaaggagttcgagaccatcctgggcaatatagggagacccatctctacaaataatacaaatattggctgggtatggtggcacacacctgtggtcccagcaacccgggaggctgagatagatggatcgctttagcctgggggttttaggctgcatgaatgtcgtgatcatgccgctgcattccagcctgagtgacatagtgagacctcatcttaacaacaacaaaccggaaaatggcggccatccattattttggatgcctaacatttcaaactttcaagaactgccgtgctttccctctaggtgattctgatgggtctgccaatcactggtcacagaatgtcccagccaactaacaacagcagttggttcaaacagaagatgcacaacccaacagggccagttagactctttccctgggaatttatgagcactttgaaagcaaaagcctctctttcttcatagaggacactgtatccctggagctaccaacttcgctgaccacttgaaggaagctagtctttagtacgagagaatgaggccaataacaaaagatggaccaagacaggcactctgatagcatttgagacgtgggtccaaggattttcaaacacgcagccctgcctctttcagttctgtgagctagtttcttttatttgtttaagctattttgagttagcttctatcccttggaagtgaatcatcctgactgaccacatgtctcagtaggaaatgatggagacaagagttacactgaaaaatgacctgaacccgaatcctgggctctttaaaacacctcactgtgctgccttcgaactagtgtttcatggtcacctcaggttagttcctagaaaatgaagctaacagcatttcttcatgtggttttggggaagaccttttaaaaaaaataacttaaaaatacttagaacagtgccggctcatagttagcactcgataaaaatcagatgttattaagatttgcttataaatgaaactggtgtctcatatgttaccttatgttactcctttcaaagcacatttttatccacgagggcaggcaacccacattccatgcagatgaggctccctggcttcccttggtgtcctaagtctggccttatagtggggacaaggtgagagaggcttacacctgtgggttcttgggcttctgctaaaaatgtggagagtcgggtggggagattcctctctgttgctcaacgagctggcaacattgggctcccaatctttttcctgccagcccccagtttcctctcatttctgggtcgtgactgatcacgggctctaggatgatctgtcatttgaaggttcccacctcatttatcccaaacctattgattcctatttcttgacattttttttacttctagtggaatctgcctcacttgtgactaagcttgttgcatttttggacccatcctggtgtctgtgtgcacatgcgtgtgtgtgtgtgtgtgcatgtgggtgtggatgcacacgtgtgagagaaagaaatagctctccctccatttcagcacatatttgctctaattccaccttcctttagtctccattctactttgtgtccaataccccttgcatctggaaaggatgttctaatcttctggggttgatttaaacatccatctattttattaatcattgctaccacttcagaatcgaagaagacggtggtggcagtggtgattgcttgtggtcagcagcttttcaggagacagtctttgcctgcctcaccagcctctcgtggttctcagtcccacatactatgatggaagtgtactcaagtcataccagactctttgcagtttccaaacattcatgttcaagcatttatgcctttgtgtatgctggtttctctttctagcatgcccttgtcacctcttcttcacctgctttacttatttatgattagaggtttagctcatgtgttatatcttctaagaagtcttctttaacctcctcgcatggattagggccctgccttagcctgaggcgaaaacatggcctgaaggccaaggcatatgtgcaggtggattatgtgggataatgatcccaggaagcaagagtgagggactagtggaatgaaactctacaaggatgcattgtcaagctggctgcagcgacagaagcctggtgctccagactttctgaggagccttatgaaatgagacttagaacttcatccgcaaatgaaaaggggaggcattcatctattgctattccctttgttcaagggttatgtagacctaagaacctagcaggttaccataggtgaggaagtaagatatactcgactgggctctaggtgagctactttgagactgcacctgctcaaagatcagaagtggcccttgcaggagcagccagggcaaaagctgggatgaggagggtttgcactggtgcctaagaggtttcagatacaggcaccttggtacttgcctttgtcataatacttagaaaatttaattacaatgtgcagtttactggttggttttgcccgctggactatgagctgtgtttggcatttcagtatttccagtacctgacttgatgtactagctgacgaagaaatgctttaataaatagctttgctggctgggtgctgtggctcacgcctgtaatcccagcactttgggaggctgaggccagcgaatcacctgaggtcaggagttcaagaccagcctgaccaacatggcgaaaccccgcctctactaaaaatacaaaaaaaaaattagccaggcgtggtggtgcacacttgtagtcccagctacttgggaggctgaggcagaagaatcacttaacccgggaggcagaggttgcagtgagctgagatcgtgccattgcacttcagcctgggcgacaagagtgaaactctgtctcaaaataaataaataaaaaaaatagctttgctttgtattaaatgttctgagttagggttaccttaagtgtgttgtatatattactgctggcctgcaagatgatttgtatatatatttcataaataaaaatttattttattttataaatatattttataaatttatatacatattttatttgtatacatatgtatttttatatgtataaatatattttccatattatatgcaatatgcaaaattatttacatatataaacatttatttgcatctgtttatagatatatgtatatatgtgtgcatatgtatcatatcagtcatgtgatttcatgattagtcctcgttaatatgaggataagaaaaaaagttaatttaaatataatgattgatagaaaaattgcacaggtgatatgtagactcagtaagaatcacaaaagtgatccatgaatgaatgcaatttgagagacactgctataaccagatgagttagccactcgaatcctgtcctttttagaactgtgtatgtgcatgtgtatccaaagaaataacaaaagcattttgggcgtgtaattaatgctatcctagtgacataaacaaagtgaaacagagtttcacagtgatcgacctgtctcaaagcaccgtcacggattctaattttgtttctcccaggaaacctggaaagtgggtatttgttaataaaattatagacaagaccttgggcacagtgggcttcctcacaaaaggcccagctaacgagcaggcaatgcccgtcagtagagaaatggttggtcagttctactcatccattccagctagcatctactgaaccctttttatgtactaggaatctgctaggcattggagttccaaagatagttaagagagggacttgaactcaagcagttgcagtctggtgggtgagaaaccctgccctaataaaggcagatggaaacatggaaactggagtgagcaattctgagagaaaacagggatctcaccaggagggtgacatttgagaagggagaacaggattatggaagatcaggagtggaagtgaggaggaggggcattctaggcagaggggaaagcatgaaaatttgggataaaatgtttaagagacttttatgcagtggtttttgcggctacacaatgggttcattgaagaaggtggcagggattaaaagtgggaagatgggttggagaaaaggtaatttggtttgagattggccaagtgggcagggacagagacacttataagagcctttagggtataggatgaagcggtgtgaggtagtgagacgtgtctggagataagaggaggacagcaggtaggtctgggaacctacatcgagaggtaatacgggtagagaaagaggagactgatgatcctgaaaggatgtgccaaggaaggaggagcttcaactatatcaaaaattggaggaaagaggccgggcacagtggctcacgcctgtaatctcagcactttgggaggccacggcagctagatcacgaggtcaggagatcgagaccatcctggctaatacagtgaaaccctgtctctactaaaaatacaaaaaattagccaggcgtggtggcatatgcctgtagtcccagctacctgggaggctgaggcaggagaatcgcttcaacctgggaggcagaggttgcagtgagccgagatggcgccactgcactccagcctgggtgacagagcgagactctgtctcaaaaaaaaaaaaaaaaaaaaaaaaaaactggaggaaagagcaggctaggaagagagactagagaattggcagctgggtgctgttgcgaagcatttttagtgaatgggcagggcttgggcttaggagaaagtgggaagggagggagatggggcgggtaagcatagattcctttctgggagatgtctcacatcctggtaggttcctatttccatgtgctttctgtaagcttaattatagggtgagctgctgaaaggggttaggtccttctctctgccgtcataggctcaaggtactaaaaggatatgcgggggtgtaaagggagtaaggaaagagctctgccatcacaggtactctccttcccctgcatgtggtcccttaaatcacctgaattaggcgatattttagttttataaatacactgtaatgagggtaggtattttcatggagaggccacgcacagttacctggagtaacagaatactggaactgtcagagacataaaagattatctagcccagtgtttctgaaatctcttaacagaataccaattctaggagacttgcataatcttttttattgtttttgagtatcacgtggagctaatgttctatattttgaaaaattctggttcagtttaacctgctcattttacagatgacaacactgaggcccagagaagtcagcattttgttcagattcagtcaactcaatagaggttaaatttcttcattttatttattcttttgagatagtctcactgtgtcacccaggcaaaagtgcaatggcatgatttcggctcactgcaacctccgcctctcaggttcaagctattctcctgcctcaccctcctgagtaattgggattacaggtgcccaccaccacacccggctaatttttgtatttttagtagagatggggtttcgccaagttggtcaggctggtcttgaactcctgacctcaggtgacccaccctccttggcctcccaaagtgccgggtgggtggcgtgagccaccgcagctggcgaatttcttcactttaaaagagcatggaaggcaatgtaaattacagcttaatgcacgtacagtgtagtcagacaggctgagcttgcatcccagccttactactgtatcagttagttgttgccatgtaacaaactactcccaaaactcagtggctaaaccaacatttataattactcccatgtttttggctcattcaaggttcagctgatctatgcttgacacagctgagtagctctgcttcaggttgcagcagctggggcagctctgctccttgctgtaggtatgtgggtttcctggatgactctgcgcacatatcatctttcttggatcagcggatcactcagggcatgttttactcgtgatgttagaaacacaagagagctaagtagaaacaagtaaacaagtggggcttcttaaggccttggctcagaactagcatgttgtcacacccaaagtgatgtgcccaaagtcaagggacgggaaatacactctgcccacaacgaggccaaagcagaaatgtggaagcaaggaaggatggagagttggggccaataattcaacctattataacaactactagctttgcactgtggtgcaactcactcggcttcatctgtaaaatatgcagcatgatagtacctacctcatgggttttttttggagggaggagcaagtaattcaggtagttcttataaaccatttagaacaatgcttaaatttagaaaacacaaagaaaattagtgacagtactaatatttaatccatctaaccatcaacacctgtgcatatgaggtctatcccaccagagtggctataggagggttagggttgacttcgcagattggcctagtgtcagctgattctcttccagcagaagggcttgaaggagtgaccttcggaacagtccccagtcgctcatttataagtcccctttttcctctctcataactgcatcatagccacaaactcaagacccaaccagcatgggcttgcattgtgttgcctggtctccccacccgcctcggccctgtgtatctcacacccagagtcagcagtgcttttcacacaaaccatctgccaagagatgtggagctggagccagaaacacacaacagctgcagaagctcagccacattcagaagcctgtagtaatcgcctaacaggcttggatacagctctgactgctgagtaactctagagtatggaagcccatcagtaaattatgattgcagcatgagtaatacatgagttctgccagctgcttctggaatcaaacaaaagacagtgctgttgccagccaggaaaaagtcacctttaagtgcatcactgtcttctttttcaggctaggagagccggtgactaagactagcttctattagaggccccctttttctctcctagagatctttctaatgaaactcatggcttataacccctaccaagcccatcttttcaccttatgcccaggcagttgagaacacagactccggtgccagataaatctgggttggagccccattcaaaaatgtgacagctgtgtgaccttgggtaagttgtttcacctttctgtagcatgaggataacaatattaccctttaatgagggttacatgatttgaagcatgtcaaatgcttagcaaaatataggtgtataacaaatgttcaatataatattaactatcattatttttttgtatctccctgtgctactagggtaattgctcctaagagtaccctgcctccaagaatctgtataaatgttgttccattccatcccacctctctcaacacatctcatttctttccaactctttctattctatacatattttttgagcttctactctgtgcccaacactgagtcaggtactcagaagatataaacagaaaaaaacacagaaacttgcagctaaggaggtttttgttggggtcacagctagacatgcagtagattgttgttattcatggtgcttatgttctgtaaaccacgaacacgaggttagggtcactgcaagcttctggtcacgacattttcgtcaacacattaatacataaccctgctttatttgtgtcttggtgtaaagacaaaccatttggtctccgtggctgattcattaacattgaactcatagccagaggcactcctgcctgaacaaagcttacctaacacataagttttctcctaaggcatatcacagctttgtgatgtttaagaagtagatggcacttcagcactagacttgggaccattgtaaatggtgaaaatggcaataaagagcacaaaaatattaaaaactaatgcactaaatatatcacaaaaaggacacttgtttatagtatgagggctgagcagaagttctgcttcacctgggaatgtgtttatccagggactctgtgcatgtattcaaatgactgggaaagtgcttttgaggttacaaataaattctagccagtagacaaatttacacatacagaatctataaatgatgaggatacactgtatataaaaatgactatgcaagtcagactgcaataaagtttccatagaaatacagggcaatatagcacagaccagagagaaactgctccagtctagggtaatcaatcaggctccactaactgaaatgagacttttaaggacatttctgacacagaggagacagtagtgatggaagcaggaggaattaaaatatgtggctaaatgcagccagattacccagattggggccagaggatggaaggattttggcttccatcactgtacagtgtaacccagatttgactggattccccgaagcaggcctctcctcactcacacccattacaagcaagagccaacacttagagatgccaaaacaacataaaacagatgcaactccgtgatgttagctagtaacacaactttttttgttttattatactttaagatctggggtacattttgagcagaaagtgcagttttgttacataggtatacatgtaccatggtggtttgctgcagctatcaacccatcatctacattaggtagttctcctaatgctatccctccctcaacccccaatcccctgacaggtcccggtgtgtgatggcccccgcacccgtgtccatgtgttctcattgttcagctcccgtttatgagtgagaacatgcagtgtttggttttctgttcttgtgttagtttgctgagaatggtttccagcttcatccatgtccctgcaaaggacataaactcatccttttttatgaatgcatagtattccatggtatatatgtgccacatattctttatccagtctatcattgatgggcttttgggttggttccaagtctttgctatcgtgaatagtgccacaataaacgtgtgtgcatgagtctttatagtagaatgacttataatcctttgggtgtatacccagtaatgggatggctgggtcaaatggtatttggtatttctagttctagatccttgaggaattgccatattgtcttccacaatggttgaactaatttaaactcccaccaacagtgtaaaaacgttcctatttctccatatcctccagcatctgttgtttcctgactttttaatgattgccattctaactcatgagagatggtatctcattgtggttttgatttgcatttctctaatgaccagtgatgatgagcattttttcatgtttgttggctgcataaatgtcttcttttgagaagtgtctgtttatatcctttacccaattttgatggggttgtttgattttttcttgtaaatttgttgaagttctttgtagattctggatattaaccccttgtcagaaggatagattgcaaaattttactcccattctgtaggttgcctgtccactctgatggtagtttcttttgctgtgcagaagctctttagtttaattagatcccatttgtcaattttggcttctgttgcgattgcttttggtgttttagacatgaagtccttgcccatgcctatgtcctgaatggtattgcctaggttttcttctagggtttttatggttttaggtctaacttgtaagtctttaatccatcttgaattaatttttgtataaggtgtaaggaagggatccagtttcagctttctgcatatggctagccagttttcccaacaccatttattaaatagggaatcctttccccatttcttgtttttgtcaggtttgttaaagataagatggttgtagatgtgtggtgttatttctgaggcctcttttctgttccattggtctaggtatctcttttggtagcagtaccatgctgttttggttactgtggacttgtagtatagtttgaagtcaggtagcttgatgcttccagttttgttctttttgcttaggattgtcttggctatgcgggctcttttttggttccatatgaaatttaaagcagttttatctaattctgtgaagaaagtcaatgatagcttgatggggatagcattgaatctataaattacttggggcagtatggccattttcacgataccgattcttcctatccatgagcatggaatgtttttccatttgtttgtgtccttttttatttcattgagcagtggtttgtagttctccttgaagaggtccttcacatcccttggaagttgtattcctaggtattttattctctttgtggcaattgtgaatgggagctcgctcatgatttggctgtctgtttgtctgctattggtgtataggaatgcttgtgatttttgcacattgattttctatcctgagactttgctgaatttgcttatcagcttgaggagattttgggctgagatgatggggttttctaaatatacagtcatttcatctgcaaacagacaatttgacttcctcttttcctacgtgaataccctttgtttctttctcttgcctgattgccctggccagaacttccaatcctatgttgaataggagtggtgacagagggcatccttgtcttgtgctgattttcaaagggaatacttccagtttttgccccttcattatgacattggctgtgggtttgtcataaatagctcttaatattttgagatatgtcctatcaatacctagtttattgagagtttttagcatgaaagggtgttgaattttgtcggaggacttttctgcatgtattgagataatcgtggtttttgtcattctgtttatgtgatggattatgtttgtaacataaaatttttagcaggtcaaaggaaaagatgatttgtgctgtacagtgtgtaaaataaaacttaatacatgcacaagtagatatctctctgttcttatgactaatttcctttccagttcccagcctactctttctcttctcttccacagcccctactattcctggaaattccagttttgcacatacatccccatgccacttcccccttgcatatataccacttggcagaacaaaaaccaggtagttatctaagcccatctcctctggaaatcttagcaggagctctgtattgttactcaagcatggctttcagtttttactccatccttcattgagccccttccaaggggcttatgcaaatattcacccaataaaatatttccttcatattttggcacaagcaataaagaagtacaaggtcccagatcagttgcccctccctatcattgcctctgcctgttattcctgacagaataagcatttttctcatcttaaacgcatgatccatggtttctgcaatttctaaagaccctagaccaggctctggccacactggatattcaataaatgaatagatttccactaaactgatggctttggggaaagagatattgtataatattttcttccataaaactcataggtaggtttaagtattgttttcttatatatttcacagcaaagtttcataattcgtatcacataagttctaagcattgccttctaataactcttatccaatcacctaaagatattggttttgaaatttaacaaaataattatacactttgtcttgaagaataagcaggaagaatagctgaaaaaattctgaaaaagaaaagtaatgtcttgagaatagttttactggatcttaggtggaatatgctactgtaataacagtgttacagttccaggaatttggatgcacagatcaacagatgaaaggccagaaccagacttgagtttatataaaatttaaataatcttataaagcatacaaatcaatggagaaagaaataacaggaaaactaattttctgtttggaaaaaagggttgtttaaaaaaaccatctcttaccacacaccaaaataaattcaaaatggattaaaatgttaaatgtaaaaaaactcaagccatcaaagggagaagatggaaatgaatatatattgaattttcatatgggaaggactttttaagtttaaaacacaatagaagaaaccacaaaactaaaaatcagcacacttggctatgtaaatatttaaagtgtcaattcaagaataataaaaggcaaagaacaaaaagagaaaaatacttggaacaaatatggtaaataaaagattaaagtacttttttttttttttttttttgctcactgcaacctccgcttcctgggttcaagcgattctcctgcctcagcctcctgagtagctgggattacaggtgtgcaccaccacgcccggctaatttttgtatttttagtagagatgggatttcaacatgttgatcaggctggtctgacctcgtgattcacatgccttggcctcccagagtgttgggattacaggcgtgagccaccgcgcccggccaaagtactttaaaaaacaaaacaaaacaaaacctcattgaaagtgatagaaaaaaataaaaacatcaatagaaaaagagaggaacaagtaattcacaaaaggaggaaatacaaatggcttataagcatgcgaaaagtttaccctctaaaacaaatttaaatcaaatcaaaacaagataccaattttccacgtcaaactagcgaagattaaaaacaagtgaaaaggctcagtaatacatggctgaggttggtgaaatgttcactctcttacatactacacctttttagaaataaacttggcagtgtagaccaagagcttttaaaaagttatgataggccaggcatggtggctcatgcctgtaatgccaacactttgggaggccgaggctggcagatcacttaaggtcaggagttcgagaccagcctggcctggccaacatggtaaaaccccgtctctattaaaaatacaaaaatcaggtgggtgtggtgctgtagttccagctacttgggaggctgaggaggttggatcagctgagcccaggaagcggaggttacagtgagctgagatcatgccactgcactccagcctgggtaacaggacaagaccctgtctcaaaaaaaaaaaaaaaaaagttatgataaaattaagtaaaaattcgaatatgaaacagtatttggccaggcgtggtagctcatgcctgtaatccccgcatgttgggaggatcgtttgagcctaggagtttgagaccagcctgggtaacataaggagaccccgtctcttaaaaaaaaaaaaaaaattagccaggtgtggtggtatatgcctgtagtcccagctactcaggaggctgaggcaggtctcttgagccctggatgtagaggcttcagtgagccatgattgcaccactgcactcccgactgggtgacagagtgagattttgtttaaaaaaaaaaagaaagaaatttgataaagctatatatgtttgtttctgtagtttcccctctaaatagtctaggaaagaaatgaaagttatgcatcaaaatgtcagcaagggttaaaatgttcctttctaaccatttcgtactgtgtttagatagaatggatctagtgtttaaagaaggatttcacaatgatggtatatatttctaaataatttatatttggaatgttctaagacctctgtattatttttgtggttttggagacatcttttatttttattctttttttttttttttttcttgagacggagtcttgctctgtcgcccaggctgcagtgcagtggcatgatcttggctcactgcaacctccatctcccaggttcaagtgattctcctgcctcagcctcctgagtagctaggatcacaggcgtgcaccaccacacctgactaatgtttgtatttttagtagagacggggtttcaccatgttggtcaggctggtcttgaactcctgaccttgtgatttgcctgcctcggcctccgaaagtgtgatttttttattcttaaatcagtaccaattaacaggataaaaataattatagaagaacccatatttatcaggactgctattttgagtacataaaatatctaagactatcatacatgaattaatgcagtattattatggaaaaagattccagagacagtgtctttcctggatatttttattgggacaccggggcattcagatggcctattgaaatgagacaaggagagacagtgagaaatgtttctttcatagtattcagttgatttttaaagtttgggaacaaaaactataaaatgagaactctgagttatttcaaactatggcatttgtgtgctttagcttccttaaaatatacatttttctgattataaaaatagtttatgttcaggtgggaaaatgtagacatacagaaaaatgtttttaaatgtatggtcaccagagttaacaaatgtgcttctttaatgatacaagaaatctatatctatagcaatcaagagggaggtagaaagagagagagacagagaaatagagagatgacagagagagagacaggtttggctgtttggtttaaacatttggtaattattacctttaaacataaacacaattgtacatgttctgttgtatgatggtaggggtagctaaaaaagaggaaaacagtttcaaccataggatcattgactataaaccagagagatctcatggaaagtaaagtcacagaactaatccaggtcttccgaagctgccatattgttactgagtaatgcctgaaataaatacttccttcttttctccggacctcctctcatcacttagacttaaccctgaaggatggagtgaggaatggcagaagtgtgagggtaaataacagaaatgggattagaatgtcatatatacaatatttgttaatgaaaaaaatctggacaagtcatggcttatttttaggatcattaaatagttggaaaggtctaagaatttctggcatcaaaagggcatctttcaaaatgtcgtgtacttctgagtctgtcttttgcccttcactttaccattttccttatgagccttaagagccacagtcggctgagtttgagtcaggtgaagcctacagccttttgatgccctctacaatcttccaacatagcctcctttgttatgtcagtgaccatatgatgcatccaacctgaaagccagtgtcctccacttattgctattttttagtatctgtatccaaatcaattgctagtgcatgcctcatctttccgtaaatctcctattagattgcaggctagtggctttcatacttgctttatggagctcgaggggttccaaaggagatgcctgtgggactgtcatggatggtgagggtgagacccatgcctggacgtctctgggatctttacccctattttaccccaatttcaaccagagtaattatacttttctttaggtgtaacatattgtcttttacataatatttaatttggtaaaacgatgcctctgcttaaataaaaacacattggggaacccctaacataagttgcaggatttgctcagacaaagacagcccagagctggaagtgatggataggtgtcctgtgtgaggagttactggccaagccaatagtcgttagaggtacaggtttgaaactgaactgtgaggcatgggaagttgacttgtattttccactggctgtagactggaaaccagataatcatgctcgtatgtagaggctggtaatgcttagatcgaaggtttgagtgacaggctgttctagtagaggggatggattttaagtcataagctttatgacattgatttttgtcagtggtatggttaagcatgtttgctagaaagcaaagttttaggtagatgaactgttactgtattcatattaacattgtatgtacttggattagagagttaacatcagctcatttactctgtgagatatactgcccacaaactcaaggatttgtaggagtttagggactctattgagtgtacacagttatttccttctaaattgacattaaaaatttaaaattcgccactcaaatctcagcaaccaagttttcgtttcaatcacacaacagagcaaaattttgcttttctttgaacacattctacgttacacagtctaagaactaaaatcaatttaacctagtttctatctcttttatgagccaaaattaggagtatcaaaaatatgatttgaagcctagggctcttgctgactagtcatattttaaaattctgaatctagagatcttagacttcagttcctagagtacatggcaaacttcattttccagtgtaaccctagatgatacatgtatgccatccttagaaggagtcagatatcatcattaaataatccataaactaaaacttgttttcatgatcccctactagaagtcaagtccatttaaagatctaataaagagaagagaaaccttagcaatgtgctcagaataccagaacataggaggaatataggtctgagttttcagaaatacgtatgctgctgtggctcatttcttgcccatgtttgtattgcttctctgggctgttactagatttaaaagaaacaaaaagggtgcgtaataaattgttataatcccagcactttcggaggccgaggcaggtggatcacctgacgtcaagcgttgaagaccagcctgcccaacatggagaagtcctgtctctactaaaaatacaaaaattagctgggcatggtggtgcatgcctgtaatcccagctacttgggaggctgaggcaggagaatcgcttgaacccaggaggtggaggttgcagtgagccgagatcgtgccactgcactccagccttggtgacagagtgagacttttttttttttttttgagacaaaggattcttgtcttagtgtactatttttgagctggttggcattcattagcccacccttagacctcattttctctccatataagataaaaaatgccaccacaaacattagcttttccttgtgatgggctctgtagggtaggttgccaccttaggagggtctagttgtgactgttttgcaggggaaaaaaatcctgtttctcttcattagtctcaaaattttagggaatcacaaatcatcatcacctttatcatcatgtctttgtaatcatttattgaatattccactatttgccacatactgttaatacagcctccataaaatttacgaaaattttttttcgtatgtatgtatacattgatacatcctcagggaaatgcttagaaataagtaccaccagcttcattttacagatgaccaatctgaggcacagaggctaaataacttaacttgtaagtggcagatctagaattcaaacccaggatggcttgaatccctggactctgaccatgaagcttcctggtctatctcagagcagaccttaatctgatctgagataggcatagcactgcacaggcacttagaagcagagaggacgcctttaaaacatcaccatgatgaaggtgctaatataaattccaagactaaatgtgcagagcccaagtcacttgcattcctgccaaaagattcaattttaaaaatgtttatctttttgttctgtgtgtaccgtaccgtcattctgagatagccactgttaatattttctagataagattgaattttatatccttttctgcggaattcaaatgccctctacgaggtttcctctgtgaattcccagggcagttattttttttttttttgagatggagtctcgctctgtcactcaggttggagtgcagtggcacgatcttggctcactgcaacctccccatcccaggttcaggcaattcttctgcctcagcctcccgagtagctgggactataggtgcatgccaccacgcccagctgatgtttgtatttataatagagacgaggtttcaccatgttgcccaggctggtctcaaacacctgaactcgtgatccacccacctcggtctcccaaagtgctgggattacaggcgtgagccactgcgccggtccctacttacattcttgtagttacctctgacactgagctgcggcttcaattgactttactttaattcactcactcttatgcctctctgttcaaattttgtcaacccagatgtgcagctcagccttctacctcaactaaaactaagaacgggagcaatttctccacccccagacagacacacaggtacagatggacatacagccacaatcataaatacagagacacggggactgacatacatttgtgagtattgtgagtacaacacactgaactgacgactggagacaaagaagcagtttctacagaggcaatgcaaagaacttcacaagtatcagtctcccctatctgttcaagtccttcagctgcatactgtattgcttggccattctttttttttctctttccttttgtgccatccattggaatttcaatttggattatattaaatttatgaattaatttaggaagaattatcatctttccaatgttctacctttctgctaaagagaaaaaaaatctctccatgtttttaaatctttgtttatttatttatttttgaaatggagtctcgctctgtcaccaggctggagtgcagtggcgcagtctcggctcactgcaacctctgcctcccgggttcaagcgattctcctgcctcagcctcccgagtagctgggactataggcgcctgctgccacgcctggctaatttttttgtattttcagtagagacggggtttcaccatgttccccaagatggtgtcgatctcttaacctcagttgatccacccgcctcggcctcccaaagtgctgggattacaggtgtgagccactgtgcctggcctaaatctatcttttgataaaacttcatggatattttcatatgtaccctatgcatttcacattgtgctattacaattgtgatttactaatcagataccctagtatctatggaagataaatcatttaataagtcgctgaaataatttgctaatattttatttgggatttttgatttttcacatgtaaggagtagttttcttttttcagctattttaggttagctaacagaattctactagcttaaaagaatagatacctaatttaaaacaaagttcttatattacataaactcattagcaaaaccagctggccctatggatttttggtgagataagttaggctttttactttttgagttcaactttaggaatttatatttcctaataaaaatcattttatatatatttttaaacttacctgaaacttgtacatagttcccgtatgattaaagcatcttcttaacaagatttacttcgttttactctcaattttagttacaaagagatcccagaggctcactattgtgaattctacccacacctaagaacatcttttagacttctcatttttctctttagttaggtttattttttctctctgcctttcctggttgtattagttcttttgtgtccggaatttattcattccggtgggttcttggtctcactgtggacccttgcggtgagtgttacagttcttaaagatggtgtgtccagagtttgttccttcagatgtgtctggagtttcttccttccagtgggtttgtggtctcgctgacttcaggagtgaagccgcaaaccttcccagtgagtgttacagctcttaaaggtggcgcatccagagttgtttgttccttccggtgggttcgtggtctcactgacctcaggagtgaagccgcagaccctctcagtgagtgtttcagctcataaaggtagtgcagacccaaagagtgagcagcagcaagatttattgtgaagagcaaaagaacaaagattccacagtgtggaaggggatctgagcgggttgccgctgctggctcaggtggccagcttttattcccttatttggccctgcccacatcctgctgattggtccattttgcagagagctgattggtccattttacagagtgctgattggtcctttttacagagagctgattggtccattttacagagtgctgattggtccattttacagagtgctgattggtgcatttacaatcctttagctagacacagagcactgattggtatgtttttacagagtgctgattggtgcatttacagtcctctagctagacagaaaagttctccaagtccccacttgacccaggaagtccagctggcttcacctctcacttttaaaactgttgagcagagttcttgatttatttatattcaatagtaagcaaagtatttgaaactatacctgacacttgaataacacaagtttgagcttcatgggcccacttacacccagctgtttttcaatcacagatggaaaatacagtattcacaggatctgaaactcacataaacagatgggtccaacttttcgtatatgcgtgttactagagtggagtacaggaattgagtatgtgtgaatttggttgtacacaagtggtcctggaaccaatcccctgtgtgtaccaaggaacagctatgtaatgttttagattcactgtagcagttttgaaagtaggattcttagatgggcacggtggctcaagcctgtaatcccagcactttgggaggccgaggtgggtggatcacgaggtcaggagatcaagaccatcctggctaacctggtgaaatccatgtctactaaaaacacaaaaaaattagttgggcatggtggtgggcgtctgtagtcccagctactccggagggaggctgaggcaggagaatggcgtgaacctgggaggcggagcttgcagtgagccgagatcacgccactgcactccagcctgggcgacagagcgagactctgtctcaaaaaaaaaaaaacagtaggattcttattttttattgtctaaaaatcctgtctttttacttttgatttttttctgagaattaataattatttggaagacagctttaacaatttttttttttttttttttttttgagactgagtctcactctgtcgcccaggctggagtgcagtggtgcaatctcggctcaatgcatgctccgcctcctgggttcaagcgatcctgcctcagcctcccgagtagctgggattacaggtgtgcatcaccatgcccagctaatttttgtatttttagttgagacggggtttcaccatgttgccaggctagtcttgaactcctgaccttaggtgatccgcccacctcggcctcccaaagtgctgggattacaggcgtgagacaccatgcctggctgacagctttatgatttttaagaagttggttttctttttttttgttcaacaatatattgttaaacttgatttactgtgttgtggtgtgggattgttttgttgtggtttgagagtattgtatggaaaatttcttttgttgggcttcagtgagttgagagggagaggaagagagagtgtgtgtatgtatagtacagcaggagtaacaacagggttgatattccacagttgtatactagtttgtctgtattagttgttaaaagagtgaaataattgtgtatgatttggtaaataactgctgcatgggccgcctatgttccccctgtcctgccaccttggcttccccagtcccgctaccttagactctctagacttcccagtaatttagcaatgaaagggttaatgctagcccattagggtttttcagatccatttcctggtgctcagatcagtgtccattttaatcggttggtccaggttgaatttcacctttgagcaacaccaaacttatttaagttaggcaaattcaactatataattcttgatcgaaaacatgtagaaaataagtataatataaacaatgcaggtgatttcacttgccctttcacttcatatgccccacactgagcttagtcccaattcttgtggtctctcatacgctcaccatgtttgaaggcatacatactttttatgctgtctggttcctgaacaccactttatctggttctcacccaaagaaacagggatctgtttgtgaaacttacattagcaaaaaagaaaaaaaaaaaaaaaaaagaaacattaatctcttccaatgctggaggaaaacctacctgtttcattggtgaataaatgatatatgtccacatttccctttatgggttattttaaggattgccaagagtccttttgtctatatacgattgcactgatctttgtaacctcgactcctatagaatgtgttgctccactggctatatatgtaattataaagacatatatcttatatatgtcttacataaagatatacatatctttataattatttaaatgttatatttgatttttagtctactttatctgtcaaaatgggagtggtgtggtgctatcttctaaaactattatgttttccttacatttttttgcttttaacagtttatcctttatatatttgatcctatatgatttggagaacaaagatacatagctgttatgcctctactgtggattttactttctagcaacataatatgagagactatgttctactttatgccttcaatcttgagttttaccttgtctgaaactagtattatttttgctttcttttctttcttcattcttttattggtccttttttcttttaatttattcgttaagttctctgcctatctctgtttttaagattttatgatttttgttctaagtgaatgttccacaagcatcatcttggaagatttaattttcttctgctgtctgaaagtatttgtctttctataggtcacttaaaacatttacctttaaatcataaatgctagtcaatcttaacttctaacatattgttttatactttattttttacactttcctgtttttcctttttggtttttgttttctttcttttgcttatttggcttatattttgtttatatttatcttccctggttattttgatgtatacatcctgttttttattttattaatggccaccttcaagtttttcaaaagtgttatttaacctgtacttctctatttctagtattaaatagtgaaagtatattttgaacactcatgtgtcaatgaggaactctgcatactgtaactttctctcatccttccttttcccttccaagtctttgctaatttaccatgaaatctgagatatatgttactttttgcagtagttattttcaagaggaactttgacttaaaatatactttcatgatgaaaatacatttttcagtctaattccattggcctttatggttactagatgtgacaataagtctattgactacttggttagcactgtagttacaatttttaaaaaatattttctcatctttagtgggaagttggaagagactgacaaggatgctagtcaaatgacattttaaatctgaggtccggacttcagaattaagtggatatacttccattacatgatgctgttaattaaatgtgacctaacattggtgtgttttaaaatcctttgttttctttaattaaaaaagaaacaggtataatgggtttggatttttagttataacagtctgcacatttaaactttatttttttgaattgtgcaaagtaacagaacataaatctctattaccattgagatttcagctgcatcttggaagagattggacttcagcagataaacatatgtagagaagggcatccttggcaggagaaataatgtcacaatgtccaggaaaggaaagcttgcagggagtttggggctaaaaagaccaaaggtaaaaatttgcagtagttgaagtgagagaatgaggatatgaaaaggaatgtgagggacaatacagagctagaatggacagacaatggactggatattagcagtgaaagagttgttgacaataacttggagtttttaagcatctgtacttgtgaaggtgaatctttacgatacaatgagagaaagagtgaaggttgagaggagagaagatactaagttcttactggacatgttgcatttgagatgcctatgtaggtgtccagcaggcactttcataacatgcatttattattgggaagacagaattagagacctagatttggaacaggtgctaagcaaagtcctgaaagttggtgagatcactgtgaaaacggaaatggggacttccgtagcactggtcaggccataatttctgggctaaggccatagccacttgctgagttttggcaaggagggtgaatgggaaatgagatccaagagaaatctgctattttagattcatagtcttacatgtggtccagagagtactcgtgtttctactgggatgatcaaagtactaaggcaaaggggttcccagtcaaacaatggatatggagaagctactgtgcccaactttgttaggaaaaaggaagagttatgaattctatcactgttccggatgttttacatttgagatctcctttagtcatcgctgttgcttattttgtctaagccagtttcctcatccgtggtatggaggtataatgtctaattcatatggtggttgtgagaactcattaaaaacaatgcatgttaaagtaactagactgtggaagttacttaataagttaaagctattgttaatgatttttgtaactattcgtgtgtcattgaaacactgctattgtgaaacacaactagcaaacacttgatagtagtgatttgcacactgctctttaaagagccgctctagggaggtacccaaagggagtgcttcaagattgagggagcatgtacaaagctgggcttctgtttctttatcaacccacaggaagcatggtgttatctgtgtgcgttgcttgaaatgagcgtaggtagacctaaaagcaccaggggagggagcggtgattgaaactagagagagcattggcaagagagggttgtccccaagaactgtggcttctgtagatggctcaacagagacggagctgggaaaataaatagcctgaccacactgtccttccacccttgtatgtcctgctggcactttctgctacctgaacccagtgggacataggtagccatcatggatccagggttgagtggagaagggaggagagcagccagggagggggcacaccttgtcagaatgaagagaagaaccgagaaacagcctggttttagcaagtgagactcatacactgtgatgttgaaatttgtgtactaaatgtgacttaagaatagagccagcccatgaccagaatatctgatttgaacatttaatgaaattgcctctctggctttcatgttttagatggcttttcctcaagtgactgcagagataggctgtgtctccttacttccagaacaacatatatatatatgtacacacgcacattgtctacataggaagataaaggagaagttgttttcctaagccattagtgtcatgaaatgcatggcagctgctgtatataggatcatggcctgtcatactgccatacctactggctaccaggtttatatagtcagtaagacataaccccttccatgtggcatctggcaggtttcccagggtagaggaaagcatgagccaagtcttgaaggctgagcaggagttagccagttgaatgtggagagaagagaagtgttggaggaaggcaatgcagacagggagtatagctcatgaaaaactggaaaagaggttgggcgcggtggcttacgcctgtaatcccagcactttgggaggctgaggtgggcagaacacgaggtcaagagatcgataccatcctggccaacatggtgaaaccctgtctctactaaaaatacaaaaattagctgggcgtggtggtgcatgcctgtagtcccagctacttgggaggctgaggcatgagaatcgcttgaacccaggaggcagagcttgcagtgagccgagatcacgccactgcattccagcctggagacagagcaagactccgtctcaaaaaaaaaaggaaaaggagaatatgtaaagagcgtagctcatgcgaagatgctatggatgattcataaagaagagctcccagtgtgtttggaatgatgttactgccatcggaatgaatatggggactggtaggggcccatggggattacacttaatacatttatacctaaagtttctcaagaactctctcttaacgaatgcgcataggcctccgactcttgagatatttaggcctgcagtttgatagaggaaaaacagacataaaatccagttggaatttcacctggcaaatgtttatctgtcgtttggaagcacacaggattttttttttaattgaggcgagggaatgtgatcagacaagctacttcccaaataggtggcacacaatcacagaaataattcacatatggcctggaagacaatagattccaaaattgtagtaaagcaattcctaaactaaatggtacaaggctggagggcctctgagccctcttccagtactgagctaagaatatgtcccctctagtgagctggagaactgtgcttcagaacctagagctcctgtcctgttcgagagggaagaaaagcaacatatagggagggaaaagagaattcttggagcaaaatattgggagagtatatttcattgtcaggttgaacaaacagaattccacaagacagtgttgccaggaatagaatatcgactgtgcacacacttctaaagatgaagaaaatgtaagtgggggttcttgggcttagagacacatatgtgggctctttgggttaggttaggtgagtggtctccctgaggttcagctggcaaagacccaagaagcaacttcttaagctcatctccaaatagccccctgatctccccaaggctgccaccacattgccaggctggttgtgaaactgcttttccagaattgcttgcacgtgcagagaactggtctcctgttaaggtcagccctgtaaaaaagggggcaagaatcaaaggactcttgaaggaaacacaggaactcttccttagctcttgatcggcctgtttcctgcccatgtgggtttgaagtgtgagggagggtaagcacacagcaggacacaaagccatgagccgtccttccttctaagggtgtcttagctccaagatgactttaaaaacagtcttcctctggggatgacacaggccataatttcacacagatttacttgatcaaactggctttgtgccatgataataccaatagtcctttacacagaaatcaatgatttagaagctatcaccctgttttacacatgaggaaactaagacagaacttcaagaccaaagttcttaatgactccactgtcctgttaatcatgtcaggcaattagtaattcacaaaatagtcacctgggtttaagatgtattactttcagttactgctagaattgttccagttcaactcatacatatttaaaatgagtagtctgtcaaacacagtgcttggtgctggggcgttgaagacagaaagctcattgtctaaggaagaagacagacatgtcaatatttaattagaacaatgtcattagattgattagttgtgtgtgccttcctataaataaaaatctttattttaaaattatagaggaaatgaaatacaaaactaagcatgcaaagcaataagtgaatatcttctatggtgctgcttctctcagcccccatgtgcctgccagttttatcagcaacaggtaacactgttatcaggttggtgtatgacttctaagcttagatgtcatcgtactgttctacatcttgttttcttcactttatatttcaaggctcatgcaaacttataataccctattacatgtatgtaccgttatttatttagagatgcttctgttgatgaactttatattgtttacagtttgtggctatatgctgcaatgaatatccttgccatatctttgcatatttttactggtaaatatgaaagatacatttttattataattgttaaagttaatatacagtataattggcttttgtgtgtatacaactctatgagttttaacacatacactcatgtatctgccactaagaacagcgatcaggatacagaatagtaccatcaccccaaaaatcttttttgtgctgcccctttgtagtcagatttctcccagccctaatccttggcagccactcatctggtctcatccctacaggcctgcctttcttagaatgtcatataaatgcagtcggacagtaggtagaagatgattttagcttcttcactcagcataatgccatgttgctgcaagtagcaataggttttttcttttcattgttgagtagcatggatatactatagcttgtttatgtatttatccactgaaggatatttgggtgcttccagtttggggtgattatgaataaatagagctgctataaacattctattttttttttttttttttttggcgggggggacggagtcttgctctgtctcccaggctggagtgcagtggcgtgacctcggctcactgcaagctccgcctcccgggttcacgccattctcctgcctcagcctctcgagtagctgggactacaggtgcccaccaccacgcccggctaattttttgtatttttagtagagacggggtttcaccgtgttagccaggatggtcttgatctcctgaccttgtgatctgcccgcctcggcctcccaaagtgctgggattacaggcgtgagacactgcgcccggccaacattcattgtatgaatgtacattttcatttctgaagggtaaatgcctacaagtgggattgttgggtgatacgtaagtgtatgtttaactttataagaaattgttaaaccaatttccacagtggctataccacccattttaaattacttccatcaatggatgagaattgcagttcctacacattctctttagcactgggtattatcaggttttcttttttctttcttctttttttgttttttgatctgttctaataggtttgtagcagtatctcattgtggtttcacttagcatttccataatgtttaatgatattaaacatcttttgtgcttatttgccatctatacattttctctggtgaagtgtctcaaatcttttgctcatttaaaaaaattgagttgttttcttactgttgagttttgagagctttttatgcattctagatgcaagtcatttgccagatatgtgattagcaaatattttctcccagttcatggtttgtccttttattttcttaacaatgtcttccatagactaaagttttaaatcttaataaaatttagcgtaacaatttcttttttattcatggtgtctatgacagctaatttttggtgtcatagctaacaatcactttctaactccagtgtcatgaagattttcttctatatacctaaagttttgtattttaatgttttacacgatgtatttttagtgaatttttgtatacatgggtggttttaggttagggctctttttttgcatattgatgtccaagtgttccagtattatttgttgaaaacaacttcattgaattgttagacatttttgacgtgagatggtgtaatatagtttaattgttgaaagaatggagtgaaaccagtccacctaaatttcagtctcagctctgctacaaattagctgtgtaacaatcaccaagtatttaatctttctttgtcatagtctccttttctgttaaatggaaacagtcatagtacctactgcctagattgctatgaggattgagttattatgtgttgacacacttagagtagtacctgacataataagtgatgaattagggttagcttttatataacttttcagttattgtagatattgcgagcacgtcctgtaaacatgttttactaattacactgcccatcaacaatatagatgtttctattcaacagccagcaccagatattatgaccctctccattctttgacaatttgataggcaaataatgagatgtctttttagtttgtattttgagatctgtggtcaggttaaacatcttttcaacttttcacatgttgtgagtatatcagcttttgatgagtaacaaggcatccaaaacataatggtaaaacagcaaacatttattatgacttatgcttctgtatgtcatctgggaaactctttggcttaagctggattggtctctcatcctctagcgggttagtcttggcgtctcctcatgatggcctcagggttccatagagcagcagcaagagtgcaagcccagtgggagagcccagtgggcaagcacttttcaagcctctgcttatgccacattggctaatcctccattgatcaaaagaagtcccatggccaagcctagattcaagagatggagaaagaaactccacttcttgatggaatgaaatgcaaaatattgtgaccactttttcatgaatctactgcgactggctgtttgtgtttccttctctgtgaattgctattggttcaacgacttatgaaatttctttatatgttatacatattaactccttaagttttacatgtaacatacgttttacatgtaacagtatttttctacttggtcatttaacttcatttatataatcttttgctgtatagaaggttttggctttttctgtgataaaatctatcagtgttttttcttcatgacattggatggccagaatgtaagctttttgaaggcagaaaccatattttattttttattattttcttgacccacagaaagcagcacagagcccagcccatagtaataaaggtttattgaatgaatgcattcactgaaggccaatctcactcactcatttatttatttattcattcatcaatgtttatggaatacctattataaaccaggcattgtgctcattgttagagatacagcgatgggcaaaattgacttttagatggtgtttagactaaagcatggtaggtagtaatggaacttattatcaatgagacataggttcaaattgtatctttctacttatgtgaccttgggcatatccctaaacattcctgaatttcagggttttttaacctataaaattgagtgtaaatgctttccttcaatagtgtgagaattcaagtggacaatgtttgtaaagcacttagcattgtgtttattatgtattatataataaaaattgtcagcttccttttctacatggtataatctcaggcctactaggaaggctaggtgacttcttttgtcaatctcctcttagcaaatataatcctgaatttcttccattatagactcgtttctttgatttgctcctccaatcgttctccgtgaattgtcactttgagcaattcttgcttattctcctctttgtgcaggcaagtcagtcaaattgccttctctgttgggagcagaagaacagggcactgaggagacactgaattttgttcagtgctgtcttggaagatagatatgcttggttgtgggtgtgggtatgtacgtctttgagcagcataagggtagttgggaacttggcaggtaattgaatcaggagaagagcccagaaaaaggtggtctggttccaaagatgcatttttcccataccgggtatcctggtgctgataaacacagtgcatttagagagcatcccactcctgagacaaagtgagtagggaagatgatgaggcagcactgccaggcttaagggaatctgtaaggtggccaaaactcctctctagatattctcaatttctctgtcctgtaccctttctagctttttagccacctctcctcaaaatcttttttctcttcccccaatttctaccaaactccaggattctccaggcgccctcctgccagatgtatatacattccatattccctcacactaaggacttggctgttaacactgctactctggggtgacagaaagggccctggagagaaatcagcacttgagggctggctctaccactaccctttgtgcaatcaccaactggtctcttttctatatgcctcagattgcctgttataaagtgtaaggcttggccaggcatgttggcttatgcctgtaatcccagcattttgggaggccaaggcaggagcttcacttgagcccagaggttcgagaccagcctaggcaacacagtgatacccccatctctacaaaaaatttaaagattagctggggggaggggtgttgcatgcctgtagttctggctattcaggaggctgaggtgggaggataacttgagcccttgagttcgaggctgcagtgagcagtgactgtgccactgcactgcagcctgggtgacaagagtgagacactgtctcaaaaaaataaggtgtgaggcttgcaccaagcagtctgtaaaacctcttccggtgtaaacaatccttgatttgatggaaccatgcttcctgcacccccactgcctcacagaatggagtttgcatataaatgaatgttcagtaaagtctcgttgtgtggatgctctgtctgttccctggaaataaaaagtttcctgccagctgactgatcctcattctaactaacacatgtgttatttggcctagatggaaaatttccggcgtttgaaggtggcgagaggatgtcattccctccagcagacagacaagggtgccatttggctggaaagcagggatgggaaacgggcatggcctttggggaaactggcttggtacaactcctgggtgagcacaggagtttgttgttagagagtcacagcccagtcacatccaggatgcccctggataactctgaactcccagctatacaataaaaatgttagcaacttcctttagttatttccagtcttgtatattttggtatcttcttgttagctgcccaatatcttcttggaaggaatcttgaggaagaagttattgctcagagacttactacatacacaaaaggaagacagagaataaaaaaggattaaagtgttggaaacatgcctgggaactggatttcttcatgggagacaagaaggcagaaaagatactgaaaatactttaacataagggttgacacagaggaatagtgctggtagttcttagggcccaacagaaagaaattaatagcaactttaagatagagaaagaacattctagaattgagtcctactaaaaactcatttttgaaaaatgagtaactactgctcagtagttaccattttggggaagatttttctgattatcttctcatctctctcttgctttgcctggctaaccccaactttcctttagactaaaagtccacaaaccctccttcaaaacagtcaagtctgataaagtttaccattatggtgtctcataagcatcttgtaattctctctcttagtacctgtctgtatttatgtgtttatgtgattagttttccatgtctgtctcctacatttgcctataagctacgagacggttgtatattcactgctgtgtctccagggccaagtgcagtactgggcacaggggaagcatgcaataagtctgcgtggtaagtgaatgaatggacacataaacaacttaatgagtgctttttgaactgaagataatttttctttttcaggacagcaaaaacaaaaaacctaaactaaaatccaaacaatttcgcaaaatatcctggatagtttgggagttgtctttgcttctttggctcattgccacggccttaattccagaaatgcttttgactcagaccttttcagttcattgccagttccctgatttctgaaatgcctttggccaaggaagtgctaattggtatttcaaatatttagaactttaagatacctacttctgttacaaagatgaaattaccatgaacaccttttgaaaaatttaaccatagctaataccaaatttccaaaaaaccatacagtgaccatacagttagttgttctgaagacatgacgcattattccaaacacaccttagcagaattccacccaatactacaattctgaggtagtaagaagcacaagggaataagcctgcgatgcaataatttaacctgcctaaaattgtctcctagcttgccaacactttgaagatcagggaactgggtaaatcaggacttgatttcatctgcagctgtatgtgaactggaatgtggaaaaaaaaagaagctaattggagcaagcatgttgtgctgcagtggagtgtattttcattgatatgtttaacctttcatccccttcatctgtgaaaaaatgaaaattgctgacctttgaggttttatgtttttaattaagcaaaatttttttctttcaaataaaatcttatatgaagcccccccccccgcaaaaaaataaaataaaataaagttgagcagctcactgggagtgggtgagggtgtgggtctagagtccattctgttgatttcacctcttccactctcagaaacttctggagcacctttttagaaaatgagaaattacagtttctttaaacacagtttaacatggctctgtctctaatttctaatgtaattaaattctataatatgggtgttgattcaggcccacaataatttccataactatttttaaataaaaatattcccatgtcttagttaatggctcattattcatagcaatattgaatacaagaaaatgtaaatataaaaactagagttaaacaacattttgagttcaccataataagatttagtgagaagacgctactaagaaagattagatactgttcaatatagaacacagaaaatacagtgagcaaaacattttagaggattgttatgcttcacttgtgatgcttggttgttaacttggtagacgtcatgccacaatgccaagtagttccttataaacaaggacacacttttatgcaaacattgaaaaagtgtttgaggctgggcgcatggctcacacatgtaatcccagcactttgggaggccgaggcgggtggatcacgacgtcaggagttcaagaccagcctggccaacatggtgaaaccccgcctctactaaaaatagaaaaaaaattagctgggcgtggtcgcgggcacttgtaatcccagctactcgagaggctgaggcaggagattcttttgaacccgggaggcggaagttgcagtgagcccagatcgcaccattgtactccagcctgggcgacagggcgagactccgtctcaaaaaaagaaaaagtatttgagagatctttgttaaggaaaaatagcattaatctctaaaacttataagatgtatgatattaaatatgcatcttgtttcagcaaattattagccttcatgatagaagtatgaattaaactattaatgaatttgatcagagccttttagatatggttgtgatgaaacaactcactatccgtccccaacatgatttggagaggatagcgctataatgtaagaaagggtattaagcagagagattgatattggtatgagcccagataggatctgtcttctggcaatgattctcaggaaatgtctctattagaaaatgtcttgagtggcaccagatatgcagtggcagccatgcctttcatggtgtcagcagcagaactctttcaagaagccacggaccacagttgtactcgttgtcgtggagcctctgctctattctttctgaaaggctgtttggctactttttttttcagcattaagttttaactcctttatttttcagcattgtgagataacatcacatttcctattattagttcaaagaagagagaaagagaaaaatgcattatttggatgtaatttgaaatttggagtagatatagggctgaaggatgagacataaagggacatgtatgtccatggctcttgattcttttccagctgccatttttttctctctctctttctgtctctcttttatttatttatttatttttattacactttaagttcttggatacatgtgcagaacgtgcaggtctgttacataggtatacacatgccatggtggcttgctgcacccatcaacctgtcatctacattaggtatttctcctaaggctatccctccctgacctcaggtgatccgcctgcctcaatctcccaaagtgctggaattacaggcatgagccaccgcgcccagcctccagctgcccctttttaagaaatgggccataacacttttttttacgtttaatttttatgtgtgaataatagtcaaattgttcaaaagccagtacacacaagcatatagggaaaagtcttccttttaccattgtgccccaactacccagttcccccgaataggtcatcgttgttcttctttttatgtgtcaccttctagaaattctttaggcagatactagcaaatacaactatagattctcattttaagaaaactaagcaggtgattttcaagactcatcctaggaagctggtaggtatgtcttcttatacccaaagctcacatagaagatccttctggtactgtaaatggggttacaaaggacagagtactggctggtggaagaggtcttccttaaccggcatgctgaacaagggtagcgaagtatagtcaagtccagactcccagaggccacaatttccttttccgtcactgaaagtaaagggagatctctgaaaggagcaagaggaaaaagaaactagatacatacctagaaataatttatacatagcttggttgtcttttcaaatcaactgcattttgtattatttcctaaagctattaaataaaccacggccactgccaccgctgggagctcagagcagatcctgtggttttggcaagactcttgactggccctagaaatggggctggattgaactggagttgaaagaattacagtgtttccttcctcttgatgactctttctggaacatgcctggaatgtgtgagtgtgagagatgaagtggtgttcactcagagtcaggcctgggtatgtacgtggaaggggaggtgtgtgctggtgttatttttggaggctgtaattccactgttaggctttgtagctcgtcgtctctttcaatgtttttactatcctaacttgtattctctgtcctgagatcttaaaagttaccaatgaggctagaagtaaaatggatgcttcaaggccaggcttgggaactcattctagtggagattttctccctcaatctcatgtaatgagttaatattacaataaaatgcaggtgtaactcctgcttacacgaagacttgactttgaaatttttctttctaatcattcagataaaggtttaatttgtaccaagattatcctcaaaacatcactgaatacagtaaacactggcaattgccattaaaaacaaattatatgaggactttatatcaggtacaatgcttgacataagtaggtgctcaaaaattctggtaaatgaatattagccttaaacgctcagcagtcattggtcacttttctttggcattttgtaaaaattgtaatgtttttttccccaaaacattgggaataatgtttttttgccccaaaacagttaaatatgggcaaggaggtcagttcagactcgggggagcacttttgtttttttttttttttgagacagaattttgctctttgtcgcccagtctggtgcgcagcactggaacctctgcctcccgggctcaaatgattctcctgtctcagcctcccgagtagctgggattacaggcacccaccaccacacccagctaatttttgtatttttaatagagacaacgtttcaccatgttgaccaggctggtctcaaactcctgacctcaggtgatccccctgcctcggcctcccaaagtgctgggattgcaggcatgagccactgtgcctggcccgcactttcatttttaaccttattattctagaattggaagccgagcaaatggatggacttcagtcaggcagatctgaaataaaatttgcccatccatccatcccattcatccatacactcatccaacaaatacttaagtcctctatatgttgagattacggagaatattccattgtaaaccaattcctaaattcctcttcctatacagaacatttggagtttatcatttagagggagagtaaataaaataatcacaaattatggtaatctgtatgaataaaacaggaggccaaattagaggtcaatgggatgagagtgtataggtattatagataaggcaggtagagaagccttctatgagaaagtggcacttaagctgagacccaaaggacaagcagaaggtggccatgccaagagtggagaaaaacattccaggcagaaggaacagcaaaggctttgaggtaggaaagagtatcttgtatccaaggaatcaaagaccagtgagcatttgaatcccagctctgccttcaatagctgtggaaaatgaaactagctgctcaatcttttgagccttcatttcttcatatttaaaattgagataatggtgcatacctcacagagttgctgaatttaatgggtattcaataagataacatgtagcttatttgaatcacttctacacaaaggtctctgagactctagttgggccctcatcactcaattgatttttctagtctcctgattgttttatgcacatttgagagccaaccatcactggagctagagaacattttccatccctgatatttccacatttaaagaggagagaatagacacagactctatctgctcatgttagaacctttagaaatcaaaaaagggaggggtggggaggggagagagagaaagaaagagaaatagtgagaaaataacatgagaggattttctttttaaaagtgtacttcctcatttacagaacaaattcataaaatttaaagtttgggtaaggttttgtttttgtttttacatttggggagagggtaaggtttggggctaagtgttcaggaaacagaataaagagaaatgaaataataatcactgagtatgcaatatataacagacagagtggttggcaagttatgtattttatcttatttaatctttacaagaatcctgatggagtaaatgaggccctgagggaaatgaagacttcacttagtcactgtctgtcacttatcttgaggtatttaatgtggaattgtgcaattctttaaaaatgagaatctataaggcataagtttatgtagttgatatatttctttagaatactttattattgtgacagtatcacattagcatcaattgataactaatagttaaatgaataatgataatgtcattattattaattcatcttaatactacatacatttcctgaatacccagctatgtctagtgcatggcttgttgggggaataatgggtagtccattgcaactagggtatgcagtggggcaggagaggttagcagggtctagctgatgaagggtcttgatgccttggtaaagagttttggattttgtccagtggaagataggcacatggtcagaatagcattttagaaagaatcctcacacaactttaagacaaggctttgtgagcaccagtttacccaatggggtcatgttaataaccttagtcatacattattgtctctctttccttttaggaactgtggaaggtgccatggacttgatcttgatcaattccctacctcttgtatctgatgctgaaacatctctcacctgcattgcctctgggtggcgcccccatgagcccatcaccataggaagggactttgaagccttaatgaaccagcaccaggatccgctggaagttactcaagatgtgaccagagaatgggctaaaaaagttgtttggaagagagaaaaggctagtaagatcaatggtgcttatttctgtgaagggcgagttcgaggagaggcaatcaggatacgaaccatgaagatgcgtcaacaaggtaacatgcccctaagttttgggcaggtgaggcccactgaggaacacacacaccttttgtcttggcagctgctccctcaggggcagggcatgcactacctgaatgtagagcttgacgatcttgcctgtctctttccatgcatcaccgtgtctggtacatggaatgttagagataaaggagactacccagtccaaccccttaactagatactgtgcctactttgtgagatgaaatatttcatatgttctaagggcatcatggtacttatggatagttgactgttacatgtatgtaatatgaaaatcatagcaatgaaaacaagtgttcattgccaaactactattttgagctttcttatttgatttttcatgtgatacattgctttgcttgtccctaaatacccttaatggaagttaatattttcaggagaaaattaaatataaataagaattttagaaggggaatatccatcagtaacttaatttaattagttatttggtatatcaactttcttttcctttttttttttttttgggggggtggagtctcactctgtcaccggactagagtgcagtggcatgattttggctcactgcaacctccgcctcccgggttcaagcgattcttctgcctcagcctcccaagtagctgggattacaggcaagcaccaccacacccagctaattttttatatttttagtagagacagggtgtcaccatattggccaggacgatcttgatctgtagacctcgtgatctgcccgccatggcctcccaaagtgttgggattacaggcgtgagccaccatgcccggccagtgtatcaattttctattgccacaataatgctgtgtaacataaccacaaaccacagtggcatacaataatgagcatttatagcttgtgagtctaagtcagctgtgttgattagatggatgtattgaccttggttgggattccttacatatatggtgttgcctggctataggcttagtaggctggccttggctggggcaactttgctcagttccttatactatagcaggctaaggtagtataaggtcatagtgtacaattctcagcttaggttgccaggagcctcatgtgtttctatttttttgtaccactgccatctacatttcatgtacatgagatgtagacatgaggctctttgcaacctaggctcagaattgtacactatcacttctgcttcattttatcaacctaagccagttaagtagctgagcctagtatcagagtgagagggcactacaaactgaaatgacaaagagtcagggatacagggagggatgaagaattagggccctctttgcaggctaccatttttggaaaaggaccatgatttaattttagcagtcgagtacccaggtccagctcagaaaacaccagaattttgccggaggattttgaaagcctcctctaagggaggattattaagacttgctaccaccccacaaggtgatgatgtgatgaagtcttcctcccaaaataaaagtgggccttaagctaaatctttagaccagtccacctgtgtgatggcagttgaaggagatggtgttgcaaatattatttaataattgtattataaggttccagtcctggacaggcaggcagacttctggtgctcttgatgctgtctgctgggaggaaggtacagaattccagctaaggtgacctctctttgttctgcctggaatgatctggcctctcccctatcagccactttgtctgggctgctgattcctaaaatgaaggagtcttttccaaattagtatcatcacaaccacaggagctgtggactgaggacttgtcattacataaaataatgacattgtcagctgtttagggtttttttttttttttttttttttttttaaagacaagggtcttgctgttgcccaggctggagtgcagtggcacaattacagttcactgcagccttgacctcccgggctcatgctgttctcccacctcagcctcccaagtagctgggactacaggcatgcaccaccatgcctggctaattaaacgaatttttcatagatatgggggtcctgctttgctgcctaggctggtcttgaactactagcttcaagccatcctcccactatggcctctcaaagtgctgggattataggtgtgagcccaccaggcctgacttttagaaagctgatccagttaagtaacacacctctgcacattgctgattggctgtttcttttataatctaaccatctgtagtctgcattttttttagatcaatgctttttaaagttgaacatgcttacagatcacctgtagttcttgtaaacatgcagactctgatttaataggttgtttgggacagtcctgggattatgcagttctacccaggtcccaggtgatgagaatctgctcgaccatggaccacgctttgagtagcagtttagagttagcctctaacttgggtccagctgaaaatatttctttgaatttactaatggtagtaatgaaaagatttgaaggcagcaaactcattttaaggtcaaaagtaataaaattgctgttcattccaaatgaaggaaagggttttcttagcaaaactagaatgttcacctttaaatgacagcagggcaagtgggaaaagtgcacaacagaaattcccaggaatgcagctctccgttgagggaagagaggttgaacaaagggatgtgaggtgtgccaaagctatcatggctgaaagtcagctctattatttttcacatgtgtcattttggatttgacttgtataaagactaatattcttctgctgatgtttccacattctaaaggaagatgatctgagattatgccccagtcatttcgtgggaacaaaatgtgaagtgccactgtgtccttgctgtactgtcctgaggtcatccttgacaatgtataaataagaacatgtaaagcaaactggaccagaacattgggagttaaaaacccgctgtaatgatccccccaaactgagaggctaggtgatcacaggtaaaggatggcttaacttcagttaaataaggcaaaggcagacctggatagtgagaaacactaacgagaagatggcttttagaattatgctcacttgagttttaattcgttctccatcactcaccagctgtgtggcctttggcaagttatttaacttctattggtctcatttatcatcatctgtgaaatgggtataataatacctacaaaattgttttgttttaaataagttggtatatacaagaagcattgatttacacagtgaacgttgtccctaaaagcttaggtaaagcaatatattgcagaataaggtacatagtaataagaataatagcagcttgtaaatggtgggaatggcatttgatgccgagtgatctgacttcagagccagtatttattaccactacgctaccctttggatatcattctcacttaatgttagcaactctccctgattctgagctcttgttttataaagtacaatgatcctacctgaagtcctaaaaagcaacccagggcacagagtagaggtatgagagtggaagtcagacagatatgggttcgagtctacctctgcaactgagtggtgtggctcaggacaagttacttaattgaagtcatattttttcctcatgtgaaaagaaataaggatagagattttatcacacatatttggaaattaaatgaggcacttaactattaccaattacattatctgcttcacagtaaatgtttaacaactgattattgtaatttctttgagtaataggtgagataattttccgactcaattgtagaaatttttactatgcattcacatattatggagttttacacaaaatggaaaaataggtatgttctctcctgtattttaacaataacagcatctcaggctgatgaacaggttctgtttttcttgctgaccatccagtgggggaaatctggtttgaggaaagtgaaatcctttatgatgaatcaggaaaaacctccaaaactatgttttcatgtcactattaattcgttattaaaacatcatggaaactcagaaatgcctgcctagggacacagcaggataaaataaacatcaatatattcctgcttgctgctgactcgtacatctgtggaggaagtggaaaatccatttgagatgtgccaaaacacagcttaaattggctcacacactccaaacagacaaactggattttatcaatggcatcatccaaaatagtcaacagcagtttgactcaaacctccttggtgatttcatttgggggtaggaaattatatataaagtttgaaacgttttcagatccaaagacctgtttcaaactgatccattagaagaaacagagggttattttattcctactttcatttgagaaatagctttatattaagaatatcaaacttcccaaacataatttacgaagttgttagagaagagccatttgcacctaaataaccaaaggaatatgttaaaagcatcaagaaaatgggaaaatctgaaacagtttagttcatttatactttcattccacaatttttcttttcttttttttttttagacggagtcttgctctgtcacccaggctggagtgcagtggcgcgatctcggctcactgcaacctctgcctcctgggttcaagtgattctcctgcctcagcctcccgagcagctgggactacaggtgcgcaccaccatgcccagcttgttttcgtatttttagtagagacagggctttaccatgttggccggggtggtctccatctcccgaccttgtgatccacccacctcagcctcctaaagtgctgggattacaggcgtgagccagtgcgcccagccaccacaattattcttgagcctctatttttgccacatgttttcctgaatacttgtatgcctgacattcccctagcaacttcatatgtattactaacttagtctttatcaaatatatatcagatgaggacttttaagaccccactaataatagatgaggcttggctattgtaacttaacgtgcatttactagctagtgagtgttggatctgggaaggtgaagtcaggcccgattctagaagcctggctttaaccatcaccctgtgctacctttcaaaacagatgtgatcttgccctcctggaacacccaatctagtaggggatatataccatgagtggggctataatgaaaaaatgcagggtatttagggagtagctatgagggcgtctaacctgtgttccaggtgttgtgtgaggtctctgaaaattcctaaatggaaactgatgaatgagcaggagctggtgaggctgaggagaaaaggaggagaaaagaagaaagaaaactcatgacttggacatgagtgatgagatctggctgaggaactgaatacagttcaaagtggctggaattgagagctaaggatgtggacctggagaatgataagtctggagaactaggggtggaggtcttgagtttgtgtctcaacttccacatttattcactgttgataggccttgggtaagggacttagtcttccttaactccatctcccatatggataaactgtagctatactgtcttcacaggactgtggtgaaattgcacaaaataatcacagatatgaaactacattatttcctgtagtacttacacaacaattaaattgaaaggagatgactgaaattgagctcacttgtttttcatctgtgttttcacttgtgtataacttttactaccacctactttcttctccagaccttatggaataaggaattatatttttagttaagttctgcccatgaattagcccatccaaatgatcttaagcaagttatcttccaacctaggcctcagcagtatcaaatttaaaatgaggtggttggaccttaaagccttctgagtgctaacattacataatctatgaaagcatccagagcgagattccttggttcaaatcctggctctcccatgtatatgctgtgtgatcttggacaggttacctagcttctctgtaccttaatttcctcatctgtaaaattaggataattgtagtacctatctcatagggatattataaaaagtaatttttatttagttggagtctcgctctgttgcccaggctggagtgcagtagctcattacagtcttgattttttttttttttttgagatggagtctcactctgtcactgaggctggagtgcagtggcgcaatctcagctcactgcaagctccgcctcctgggttcacgccattctcctgcctaagcctcctgagtagctgggactacaggcgcccgctaccacgcccggctaattttttgtatttttagtagagatggagtttcaatgtgttagccaggatgatgtcgatctcctgaccttgtgatctgcccaccttggcctcacaaagtgctgggattacaggcgtgagcaactacgcctggcctacagtcttgatttcttaagctcaagtgatcctcctgaacagctgggactacaagcatgtgctaccatacctagctaatttttaaatattttttttgtatggagcgggggtctcactgtgttgcctaggctggtctcaaactcctggccttaagagatcctcccaccttggcctcccaaaattttgggattagaagcatgagccaccgcccccaggttgacaattaaatttgtgtaaagtgcttataacagcacttggtccatagtaggtgctattaaaaggtatttatcgtttttatggcctagtcaagtcacataacatcaatatatgtgtactgaatacaagccaggctcctgtgtcatcagaaagcccaaagtagaacatgaatgttggatttccttcgttagtactcagcagagagcaatcagcctagagacattcatgcagaggtaaactctggacagcagtgaaactctggtgtgataatgcccctaagaaaacgggagcttaaaaagcacagtcctaaataataaagagccacagagtggtggggggaaagctacttggaattgagcctactggggaaccttggttcctttcagaacacaatactgagtgagaagtcccacggtcagctaaacaattctcacacaaaggagcagaaaatataaacaaaccatatagacaggaacaacagcatgaaatggtcagaaaaaaattctcgtaggagtccaggagcatgccacagagagcaagagctgcatgcatttggaggtctaaatgaagcacttggcaacgtgagcagaagccccacaaagacagcccccctcaccatccagtcccctgtctgctcttcctttatggctggctcattttagtgctctggagaaaagtgtccctcatgctcatatcacaaatgtcagcacagcagtgttgctgtttatattagaaggataccgacctcttctaggcacctcagggcttagcctacatcacttaatattactaacaacctttgaaggtaggtatcattacttttcaattacacatgagaaaactgagatttgcagaggtgaagcagctttcaaaaagggtggcagagggtggatccaagcccaggaatgtgtctgattccagcgctcgcactgctggaatgatctaccccgtgctctctctgggtttgcccccaggtcatcatctgcaccaaaggcattcacatacctgaccaccaggggagtctgtgcaaggcacccatgctaggatccgcaggcacagcccacagccgatgaaagcaagcaggcaaacctaaagcccaggtccttctgagcatggttcggaggcatcttttgccctcacagggtagttgtctcagccagtggcgcgcacagcgcttgattagtctttctcaaaccaccatctgaaagccacggatgagatgagaatgagggcacagcgaccagctggttcatcacaaggtcctcagcaggatccctatgatcccaaggcttggtcctggtctgaatctttataggaattcttactttgggggacaggatgttttgctattaatttctaatttaggtgcattctggtcagagaattttgttattaacagagatgtgctttgtggataaacaggcaatgttctggtaaataatgtgtatttcaataactgagcaaggggttaatgaatattcaacagatctctaatagtgttattaaaatcttctaaatatttccttagtaattttcagtctttttgattaatttctgaaagtttccaccgtgttcacggatttgtcagtttctttaattctgacactttttgtttcatgagctttgaaattctgttgttagatgcatatataatttcaggattacaatatcttcctgaacatgacacgtgaataaaatctaacaaggttttatcagttagtagatggttctgttttatcattacataatgaccatctatatccctaatttttagctttataataattttttctgtataaatgttgcaatactagctttatttagtattagtttgctatatatttttatatccctttattcacaatcttatgtgccattatgtcgaatgtatacttcatgaaagagcacacagttttatgtgtgtgtgtgttttagaattgagattctagaatctaagattttctgatctgaatttgatgtgagctcctgtcttttaacatacatttggcataatgtctgccaccttatcctatcttttccacaccatgattttctctggtcctttttttctcattttatgtcttttgtttccttatcttctctcttgccctcttgttgaggaaagttagatagactgtttctcttcctttagtggtgatccttatattgttaacattggcttaacttaaagcctaaagctaatgcctccttatgtcacagagtttggctttctgcagattatgatataagttaagggaattcagaaactcttgttgctggaagaaagttagaagattttattcccatatcttgtccaataagccaagggaatcagtcaatgttgcatggcaagcttgacacagtaacagaaattttcaatcaattggcttattttattttattttttttttgagactgagtcttgctctgttgcccatgctggagtgcagtggcatgatcttggctcactgcaatctccgcctcccggattcaagcaattctcctacctcagcctcccgagtagctggaattaaaggcatgtcccaccgtgcccggctaatttttgtatttttagtagagatggggttttgccatgttggccaggctcgtctcgaactcctgacctcaagtgatctgtctacggtggcatcccaaagggctgggattacaggcatgagccactgtgcctggccttggcttatgattttgtaagtcaaatataaaataattttcccagttacatgtcagtactgtccagttccataactgtgtcagttcatacatatataattaaaaggtagaaggcaagatattagattccatccttgtctttattcttcaatcttccaatatttacaccataagtagtaagtccagcattttgctcattttatttgagcaacgcatggggcattctaaagcaattagaattatttggaacaacagcaacacaaaaggaccaggggaaaagccatttggtaaattttttttctctttcactttggggaaactcagatttcattcatgttttttttttcccactttaagaatacttgggattggagaaggatggcagattcatagttaatatagtttattgttagtatcaggacttagtttgataataggtacagtttgagtgttccaaatccaaaaatctgaaatctgagatgctccaagatccaaaaatatttgagagccaatttgatgctcaaaggaaatgttcattggagcattttggatttcagattttctgatttgggatccttagctggcataatgcaaatatttcaaaatggaaaaataaaatctgaaacacttctggtcctaagtatctgagataagggatattcattctgaactaatcaacacaaagtcctcatctccccaaccactgaatagaaaaattgtgtataggcatattgtttgtatatatttacactcttataaaggaagtgaccatccctttcatcagattcttaaaaaggtacataatgttaagaaaggttaaaacgcattagccaccactgtttttcaccttccaaaaaccatctgacacctagcaagtgccagccctcattttctgagtctcaaagctcaattgctcctggagaaaatgtgtgatcccatttttggtatttgttttctctcttttaaaagcttccttcctaccagctactttaactatgactgtggacaagggagataacgtgaacatatctttcaaaaaggtattgattaaagaagaagatgcagtgatttacaaaaatggtgagtatgtgtttcattgctttccccagtatgatgtgagatatcagataacatacaacatattgaatcattttcctattgtggtcttgtgggcagatgtttgaattaaagctgctatgatgcaagctttcaaattctgtgtatgatagaagccctcttaggtgacatatttggttacttaaggatattaaagtggaattcatatatatgaatgtacatggtgtatgtacatacaataaaaccccatcataatgtgagatcccaacttcagccatataaagtgtgagtttctttgattgtgacattgttgattgcaaggtttaggaaattaccacagtaaacatgggaagccaattgttagcagttctggcagtccaactgtgtaatccaaatgtgtctaggtcctagctatggtttcgtaccacccagtgtcagttgcctgatccagctggaatattgatggggatcattctgaagtctgtgagtggataggacttccagattggagtagcgattatagatatctcctggttaattggttagttgacagggttacctatcatttttcacctaactttgcctgccaactatgttcgcctctccctgtagaatgtaagaacttagaccacccccatcttcatgtgtttggtggtagatcccacagactaacctatctgttctatcactatgactttcttgactattgagagagtactgaatagttcagcattttcattcttctcccacatccaatatgtgagagcacattttcttgaccatgtcagggaaagctaattaagtggagaaaccagacaaggaagcaggtatgtttcagtgtgacctacggttcttcactcttccctcttactaggttccttcatccattcagtgccccggcatgaagtacctgatattctagaagtacacctgcctcatgctcagccccaggatgctggagtgtactcggccaggtatataggaggaaacctcttcacctcggccttcaccaggctgatagtccggagtaagtgatggagaggccaccatttgtgatggtgtagttgttaggttgttaggatttttagttgcaaataacagaaactaaccatggcttcttaagcaaaaaccaggcattggttggaggttgtattagtctgttcttatgctgcaaagcaaatgaataagagatagcaatcattagaggaatgacagagaaacccaggtatttagacctgaagacttaaatatttaatattacaaatacttgatacagctggggaaaactcagggcaaatcattttcttttctcagggcaaatcatttctaatttcacatgctctttattgagacatacctgagactgggtaatttattaagggaagaggtttaattgactcacagttcaatatggctggggagacatcaggaaatttacaatcatggcaaaagaggaagcaaacacatccttcttcacatggcggcaggagagagaagaatgagagtgaaggagagggggaagcaccatattaaaccatcaaatctcatgagaactcactcactatcatgtgaacagcatgagggcaactgcctccatgattaaatgacctcttacctcctactgggttcctcccacaacacgtggggattatgggaactacaattcaagatgagatttgggtagggacacagccaaaccataccagacggggacactaaggactcttaataaactgatgggaaagctgaaaagtggctgggtacggtggctcatgcctgtaatctcagcactttgagaggccctttgagctcaagagtttgagaccagcctgggcaacatggcaaaaccccgtctctacaaaaaatacaaaaattagccaggcatggtgatgcatgcctgtagttctagctatttgacaggttgaggtgggaggatagttcaagctcgggaggtcgaggctgcagtgggccaggctggttgaaagagcaagaccttgtctcaacaaaaacaaaaacaaaaactataaagcaagttccagaaaagataagcttcaaggaagagctgaggctcagttgtggtgggtgtggggaggtaagggagtgggctttctctctaagatgctgcttttaccatgtctcagcttcagcaatgtttctttcacttccaaattttgaatttccaggataaataatcagattggcctaacatatattagatgtctatcagcctagaccagtgagctatagacaagggtggagtcacgtactacacgttacaggcactagaagctcacatttgtacagcataatcatccatataaaaagggggatcacaatgagtaaagcagtctcactgaaacgtgtctgctctagggggatgagttggacctcttgggttagactaacatctgcttaaacattgcctcctgtaaatcccacacttcccaggtcatttaactcttatgtgtgatttttattttcagttttgaaaaatgtaagagttagaactagtaaaaactttttttctccattataactattgaagtgggggcataaatatcaccattacattttcctgtaatttttacaggaacttcacaaatagaaagaaaatgatttgccctgaattttccccagctagatcaggttttcataatattaaatattgaagtcttcaggtctaaatgcctgggcttctctgtcattcctctaacgattgccatctccaattcatttgctttgcgttatgttcccccattcatttaccaaaatgtggtggtcataactctgtgccaagaattgtgttggtgttgagaatacaggatcataagataaatccgtgtcctttgggtcattcccaatcagagtaggcacgtgtataattagctaaataaatattgaaaaatgacaatagaagtatgagaagtgtggttcctctagtttatgctccatgcttagccacctctatggacataaaatatagcaaggtgttttataggcaggactatttgggcttgagtcgaggggaatctttccacgtacccaagacctatttccttctggatgactactgtgcttgacttctattaaatgtcagagcagcctttttgtaatatgaatcttaaaaaatataatttatgatgatagcaaaactgcaatattcagcttctagtagcttgcctcacagctacctttacatgaagtttctgtggacttgggagaagcaagtgacatccccttttattccactactcaggagagtctgaatgtcaaggaagcaatttgcctttatttcatttagctagtttctctggagtctgatataacaccatgtactaggtgtactcagagggtaaatggggtacatcttctaggaaggtcagacatacctatacatgttgatatatagttgtttgagataggaaaaccaaagtgtttttcctaatctctgctctcactgaacacaacacttctgacaccaatgtgcacagattactacgccacttctagaatttctcattcagtaggtcgtggttgggtgggatctggggtttgcatttctaacagattcccagatgatggggatgctactggtcagagaccacactttgaaaaccacagctccagcctgtaaccatacctgcagctccctggacatgccatgctgtcttcccatgccttgtctttgcctggaagacactctccagccttatcttctttgctacttagttggtcctgcagattcagcttgcataccatatcctctgggaagccttcctttatgccctcttctatccaccagacagagttaggtactccttgtctttgtttctgtcgcgatttcctgtttacatgtctgtctcccatattagatgatgagcttttagagagcagagcctgtattttatctttattcaccattgtccactgaatgactgacacacagtaggtgctcaataaagatgtgttgagcgaatgcgctctactcaccacagccttgttttccttaacaaaaggatgtgaagcccagaagtggggacctgaatgcaaccatctctgtactgcttgtatgaacaatggtgtctgccatgaagatactggagaatgcatttgccctcctgggtttatgggaaggacgtgtgagaagggtaagtaaagagacttgataagtaagctgtggatttaaaaagccatcgttgctggatctagaattttagatctcgacacagatgggaatggaagctaaatggcctctgttaggtcagatggtacctgtgtgtgaattagaaaaaggtgccttttcctaaaggttctttaatgccaaccactggaaagttataataaatatacagatccgtgatgtttacagtgtgaatgctgccccctaggtttgtgcactgcacaaacctgcatgattgtgagtgatgtccctgatgtctgctctgtggggcagtttcattatcagtaaaatgggccataagggtatgttcatcctaccatgccacagctgagatttgactgtttcccatattcactagactaggagaaatgaatctaaagaattatgtatttcaaggggttgtatatttgactctgaatcatcttttcttttcctcccaaagcttgtgaactgcacacgtttggcagaacttgtaaagaaaggtgcagtggacaagagggatgcaagtcttatgtgttctgtctccctgacccctatgggtgttcctgtgccacaggctggaagggtctgcagtgcaatgaaggtatgcaccaatcacacccttggacagaggatgttctagcaggtatataaaggagatccagtttgctgtcaatcacaacatcggatatacctggactgcttagctacccactactggacaacaggattttgaatcatggatgtttacatccaatgttaattatactttcacagtaaaaatctagaccgcatagaaagtacttctcataactatcatctggggatctttactaaagcacggattctgatttggtaggcatggactggggcccgaggttctgcatttctaacaggctcccaagtagttccgatgttactggttttcagaccatgctttgagtaggaagaccatagaagacttgttttttttttttggttttttttttttttttttttcagtgaatcataaaatcacagctttagccaggcatggtagcacatgcctgttgtcccagttattcaggaggctgaggcaggaggatcccttgagcccaggagtttgaagctgcagtgagctatgattgcaccactacactccagcctgggcaacagagtgagacctcgtttaaaaaaaaaaaaatcaaaatcagagcttttatgtcagatccagacaggatttggggctcaaaaattgaagaagttaaaatcttacctgccgtggaccttatgcaagtagtactaacatcatctactcagagtccctctgccctttgtaaaataagctttcccatttgaccaggctctgtggagtgcatctgacatccacttttcagtatgcatttcacatctactgttgcatagtagctcaacatgaacctgcagacaaatgtgacagaacctccctaatgtatattaatactgtgaattagccagagctcaaaggcttttcagtgtttatctcacaaagtcagcttttcccatatccggcactaaaggtagctacgatggggtcccagcaacttgataacaatgctccagggcagagcagttcagtagaaatataagccatccacatatagaatttaaaattttctagtgtccacattaaaaaagtgaggagaaataggtgaaataattttgatctattaacccaatatgttaaaaacattatcagttcaacatgtaatcaatagaaaaaagtattaatgagatattttacattccctttttcatagtaagtctttgaaatttcagtttggactagctatattttaagagttccatagccacacgtggctaactgtactggacagcatagctccaggggcttggaggaggaggacaaagaggagagttacacaaaagtaagcttcagccacctgcaatacctcattcagttccctctaaatgctatgtctgccccccggaacatgcagtgagccacagcagtggagaaatcccatctggcctctgaagtgtgtatgttaaggtaaaaggtgactccaggcagggggcagatcccttgtattttaaaaaaaattaaaatgttacgcaaactatgaacactttgctaggacccaggaagcggtgcatgccagcagtctctagaacataaacttcatcagctttgtagtgaatgtgtctctgggcccaggtttttttgtttttttttaaattctttttattattattattattattatactgtaagttttagggtacatgtgcacaatgtgcaggttagttacatatgtatacatgtgccatgctggtgtgctgcacccatcaactcgtcatttagcattaggtatatctcctaatgctatccctcccccctccccccaccccacaacagtccccagagtgtgatgttccccttcctgtgttcatgtgttctcactgttcaattcccatctatgagtgagaacatacggtgtttggttttttgtccttgtgatagtttactgagaatgatgatttccaatttcatccatgtccctacaaaggacatgaactcataattttttatggctgcatagtattccatggtgtatatgtgccacattttcttaatccagtctatcattgttggacatttgggttggttccaagtctttgctattgtgaatagtgccacaataaacatacgtgtgcatgtgtctttatagcatcatgatttataatcctttgggtatatacccagtaatggggtggctgggtaaaatggtatttctagttctagatctctgaggaatcgccacactgacttccacaatggttgaactagttttcagtcccaccaacagtgtaaaagtgttcctatttctccacatcctctccagcacctgttgtttcctgactttttaatgatcgccattctaactggtgtgagatggtatctcattgtggttttgatttgtatttctctgatggccagtgatgatgagcattttttcatgtgtcttttggctgcataaatgtcttctttagagaagtgtctcttcatatcctttgcccactttttgatggggttgtttgtttttttcttgtaaatttgtttgtgttcattgtagattctggatattagccctttgtcagatgagtaggttgtgaaaattttctcccattttgtaggttgcctgttcactctgatggtagtttcttgcccaggtttataagagtacatttcatgaactcatctcagcccattcctggctcaagaaatcaccaagattttatgaatagaactgttctaatattcttccagactcctttcaacaattactatcctgttcattccatccaaaaagcagtaggaaagcaaggagacatttctaacagtaactacttaaggacatggtctcctttaatagtccaggatttagaatagtcaacaatagattgtacactggcaagttttatgtatcagggctggtttctatctgaggaaataagcaataatagaaatttttgaagcaaatagtggggacaataaagagaacaggggaattccactgtgcaaatatgtgataattcaaagtcattcagaacactttgccaggaagaaagttctagtgtattctagaaactaaaaaaatcaaggcttcatgatattttaaggtcttctgccatcccaacagaaacttgatttcagtagtcagatttcctttatgcttattaatagttcttaacctttctaccatctgctttgagtaagaagttgtgattaagtttttttccagctttatcaaggtctaattgctaaataaaaattgtatgtagttaaggtgcaaaatgtgatattttgatatatctatacattgtgaaatgattactgctgttaagctaattaacatatccatcacctcacacagttatctgtgtgtgtgggtgtggtgagagcatttaaaattgctcagcacatttcaagtgtacaatacagtaatattaagtttagctaccacactgtctattagaactccagaacttacttatcctactgtgtaattaaaagtttttgccctttgaccaacatctccccatttcctccaccctgtagtccctgggaaccactatgctactctgcttctataagtttgactttttcagattccacttatagaagagatcttacagtattggtctttatatgcctggcttatttcacttagcatggtgccctccaggttcatccgtgttgttgcaaatgacaggatttccttcttttcaaaggctgaataatatgccattatatatgtgtacacaccacattttctttatccattcatccatggatggacgaatggtcaagtccatattttggctactgtaagcaatgctgcaatggacatgagaaaacagatgtctctttgagatagtgatttcatttctcttggatatataccagaaatgggattgctggatcatatggcagttctattttgagtgttttgaagaacttccttattgttttccataatgactgtaccaatttacattcccaccaacagcatacaagggttccctattatctacatccttgccattctagcaggcgtgatgtgatatctcattgtggttttgattttcatttccctgatgatcagtgaggttgagtatttttcatagacctgttggccatttgtatgtcgtcttttaagagatgtcggctgggcacgatggctcatgcctgtaatcccagcactttgggaggccaaggcgggcggatcacctgaggttgggagttcgagaccagcctgaccaacaacgagaaaccccgtctctactaaaaatacagaattagtcaggcacggtggtgcatgcctttaatcccagctacttggggggctgaggcaggagaatcgcttgaaccagggaggtggaggttgtggtgagctgaggtcatgccattgcattccagcctgggcaacaagagtgaaactccatctcaaaaaatgaaaaagaaaaaaaaagatgtctattcaggtcctttgtccatttttttatcaggttgttttcttgctattaagtggtttgcgttccttatatattctggatattaacctcttatcaggtgtatactttggaaatacattctcttgttccatacattgtttcttcactctgttgattgttttctttgctgtgcagaagcttgttagtttgatgcaatcacatttgtctatttgtgcttttgttgtctgtgcttttgaggtcatatccaaaaaaatcattgcccggatcagtatcaagaagcttttcccgtctgttttcttctagtagttttacaatttcaggtcttatgttgtgtctttagtcaattttgttttgagttttgaatataatgagatgaggttctaattttattcttctgcttgtggttatccagttttcccaggactatttattgaagagattatcctttccctgttgtgtgttcttcatacttttgttgaatctgttaactgtaaatgtgtaaatttatttctgggctgtcaattctgttccgttggtctatatgtctgtttttatgccagtaccatactgtttttattactatagctttgtaatatattttgaaatcaggtaatgtgatgtctctagctttgttcttcttgctcaatattgctttggctattctaggccttctgtggttcaatataaattttagtatcgttttttctatttctgtgaaaaataccattgcaattttgatagtgattgtattgaatttgtagataacttagttgtgattgatactaaaaataaagactgcattttagctgggtgaataaaatacaaaatcaaaacaaatcatcatagccccaaaagacaagcttttgcattaatttttggttagaagccttctagtaatgttacagttgaccaaaataaggacacccagttaacagaatccatttgccatgtaccaaattctaagaattgtcctggcaggtttagtgagctccaagggaaaataatgcttctaccctgtcttcccaggagcttattacaagtatcaaaacataatttgaatggcttaaatattctactataaagaaacagtcttaaaaagctaacattttaaattatcttgatttttagtttttagcagtttaaccatgatgtgcctatgcatagtttactttatatttattctgctaagggcttaacaaatttttgaatgtgtaaatttcaacaaattgggataatttaaaccattatttcttcaaatattttgtctaaccctttctctctggtccttcttggacctccagttacatgtgtgttagatgttttgtctcttgggtccctaaggattaaaaatcatttttttccaacctttttcctacttttcttctttagatgggctatctattgatgttgcttcaagtttattgactctttcttttgttatctccattctgttgctaagtccatacagtgattatttgatttcaaatattgtgtttttcagttttagaattccttttgctttttaaaaatagtttctatttccctgctgaagtttctcattgttgcatttgttatgaacatatcttcttttaccttactgagcatagttattatagttgttttaaaattcttgtctattccaacatctgagtcatcacagttggtctctatttattttcttttcctttaaaaaacgggccttaattctccatttcttctttggattgtatcttgaacattgaaaatgttacattatggagactctggaatatgatacattccttttgggaatgttgattttgttttgttttagcaggcaattaacttggtaggattcaaacctcaaactctcactgttaggaatcaggtcaaactcagtttagttcttttatctttagctgggctgctttgagtctatactgagcatgcatggatcaaggatcagccaaagatctgggacttttctctgactctttctgggttttccctctctctccagtggctgtggttttcctgactctgtctctgatgcatcaggccagtagactgcaggttttctttggagttgtagcttccatacgtggtgtcaactgtacctaacagttaggctaaaagctgaaaattgggaaacacatcattcccatcttccaaatttcaattcccctccagaatcttccaggtcttttttcttcctatcccactcttaagtgctttcaggaagttattttctaaatgtagttgtacctacaagaaagttggcatgataggagctcattcaactttttttggaagcataactccccagctttttaagttcctggtaattcagataaattaccccctaccttacacaaatcagcaaagttgatggcttagagagaaaaataaaactaaacacctgcagtcttagtttcctctcttcccctggattaatactggttttttgatgtctctgtttacagcatgccaccctggtttttacgggccagattgtaagcttaggtgcagctgcaacaatggggagatgtgtgatcgcttccaaggatgtctctgctctccaggatggcaggggctccagtgtgagagagaaggtaaagcaaggtaacactgtagtcagggccatgttcagcatgtctgaactgagctttggtagtgtaattcttgtgccggcattctaagatcctcaagcctcttttgtttccatccagaagttgggaatagtttatcctaaatcctaaagcacagcattttaattctgctctactgaccctaatagtaggctttatttgtctttgcactaggcataaaccacgtgctctttgtagcagcttaagtgatgactggccagctgagagctctcctaccttttctgctcccttctctaggaccaaccttttccctggacatgcgtaacagagaaagagcaatttgggatggatttagacaggggatatttttaaagcaatagaaagaataaaacaaatagaaaagattatgctcaaaatgaaattttatgtcattctagttcagaagttactcttcagcaggagtcagcaaactttaacccacagactaaatccagcccactatctttttttaaacagctttatagagatacattttttatattataatgttcaactttttaaaatgtaaattcagtggtttttagtatatttacagagctatgccatcattgccataatctaattttacaacatattcatcataccaaaacaaaccttgtacccattaatagaaacttccattttccaatcatcctaatttctgacaaccatttatttgcagttgaccttaaacaacatgggggctaggggtactgacccttctcacagtagaaaatctacatataatttttgactctccaaagacttaactactaatagccttctgttgacgagaagccttaccaataacatagtcaattaacacagagactagtatctgtatatattttatgccttcatgacatacctttttcttaatttttttggtatttctaggctacacagtttgtctgtgagttttttcaaattatcctaaatctccaaaaaattttccaatatatttattgaaaaaaatccacatgtcagtggacccatgcagttgaagcctgtattgttcaagggtcaaccatatcttctgtctctgtagattgcctgttcttgacattttatatgctgtaaacaagattgtataatacgtcgtcatttgtgactagcttcatttgccacaccttttttgaggtttatctatgttgtggcatgtatcagtacttcattccttttttatttctcaccatctgttattataaagaaaaaaattttggatcacagccacctccattcatttatagtatgtcgtctgtggctgcttttgtactacaagggcagaaaacatggcttgcaaagctgactgtatttgctctctttacagaaaatgtttgctatccactgtcgtagaatatactttttaaaattaaaagaagcagacatatgtattttcaaacttaataaatatgtattgctttttcaatcatataaatataaatgccattgaaataaatacatatccagtgaaatctacactcacaataatacagctatggcctttttttctgttacttttggaaatcagaacaaatattgggagtgggggtgggatgccagtaagtgttttctcaaagtccttaaactttatattttttcttcttttgccaagcctggactttactacagggcaggaatcagggagtggttagaaagggaaggaaatgccatggggctactaggggattgtattgaacgtgggcagctaacaagtttaaggatttgaattttgtgctttgttccttcccgtctgttcccttctgctgatgctgcaaaaggagtgcattctgatgggagaatctaagacaggttaaccagggtgtcactagggctttcagagagtagctcccttcccagattccactttagcccagcacatccaccttcacccccacccagcttcagaaaatacaaggggacgatgaaggaaagaaatgctttaaaagtgtcaaaacatgtttttcaattcctattcaaatagctacttaggctgaaaaacttggcacgttttccataatctttccaagtttacagatatatcaaggaataaccttgtaagtattagacctctttcccttctcctccacacctttacccatttcattctaggcctgagaagtaggatatcagtataaaatatcattattgaccccgcctcttcccaccaccgataagaaacagtctgtagttactgctgctctgagggcacctctatcgcctacattgtttactgagtgttggacaattttcaaacatgtctcacattcaattacaaatagtccacagttccctgagtccctatggttcagaataaaattggtatatttcagggttattcattctctactgtgtagatgttaggcaagaaatcctgacaccattacctttattgacactacagacatttttccttctttcaatattggcagcaacatttttgatttggctgttgagtggatactgatttggggaagttatatttcacttctttgatgtacttcttttgtgagcaactttattcaccttttcctcttagttatctgctatttgcagacttcccaatgaatgagacatctctcgtatatctaaactgaggtcaatgctgttgaacagcaataccatggggttatttgatgagtggaggaagaactagttttttgtttgttgtatttttgtaatcattcatgtaaaaagaaagagggggattgaacagcaaagtctaggggagatatggccatgataatcattttaatattgagactgttcctccctggtccatgaaaggagcacagcctcatggcaaagagcgtggactctggatttataaagatctgagtctgaatctgggctgtgagcctctgtctcctcatccataaaatgggagaccacaatatcatccacatcacaggtgtcttatgtgatgacaaaacagtaaaatatttgcaaagttcttgcccggtgcatgacttactaaagtagctatttttattattactactgctgctggctctgttaaatattagatttcacagtgctgttttcttccttcaggcataccgaggatgaccccaaagatagtggatttgccagatcatatagaagtaaacagtggtaaatttaatcccatttgcaaagcttctggctggccgctacctactaatgaagaaatgaccctggtgaagccggatgggacagtgctccatgtaagagccattcttaatttgcccttcttaaagcatgagatgcttcagtgtagtaatcaccccactaaatgatagataccattcagtgcttttatcctcctaggctagtgtgttgttggctttgataaaatgccctattcctggagaggcagaactgactcactgcagcctcactgatttcttctgttggccagtactgctctgcatggttgggaatatgcctcctggggaactgacagagctgggtgccaaggatggcacacatcctgcaggactgtccagctggtatggggagaagtacgtgtcaatctgtgcaaagctttgctctcgcagtgtccccatatctctaactactcatatcaggagagtaaggtggtgttgcaacccatgaatcagcagatttacgtgctaccaagtgcaaccaggacatggagttttgatgaccggtccactcctattacgctctttggagcagcagtttaggggagcatagaagaggagagttccccagttctgaaactacaatccacgggatcccttaggtctgaatgcattcattgggtttctacccacctcttccctttgccttcattgctgatgctcacccatggtcaggtaatatcacagcagttattttttgtttaaaaggatcaagctacttttcgaacatgctttccttctctctcccaactataccaaatgcagcagagacaggagccaccccaaatttctcttgtgttgaaagtgatccttaggatattgatgtattttttaatctaaaaatttagaaatacttattatcctatttttctatcaaagatgaccaaaatcagcttgaccagaggcaggtatgagtgaccttctgagggaggaatatgtagaatgtaccattactagggtccacgtttcaatgtccctgattccactcaaacaacccatcaggtagaagaagccaattgatggcttccaaaatcttattggctttttcatgagttaatgaaagtaatggctactatttagtaaggttggccataactatatgtaacttcttacttaacattgcctagtgtctcttttttttggcggaagtgggaactggctgggtgaagttaagtaactaaggaattggtcaaaaatggcaaagagcccagatacggtgactcatgcctgcaatcccagtgctttggaagcctgaggtgggaggatcactttaggccagaaatttgagaccggcctgggcaacatagcaagaccccatctcttaaaaaataaaaaaagaattagctggacatggtggcatatacctgtagtcccagctacttgggtgaggtggggggatcacttaaggccaggagtttgaggctgcagtgaactatgatcactcaactgcactccagcctgagccaaggaacaagactttgttgtctctcaaaaaaaaaaaaatggcagaggtccatctctcttcagaaccctggatttttccagtactccccacttgacagcctctcaaacacttaggaagtcactttgtcctcccacgcagccatctctgtgttagataggaaaggaacaaatcttatgaggaggagtttaaaagaaatcatgcttcaggtgtcttgcttgtaagtgtttaccccgtactcctaaacacacaaatacaacagcaggatctgacagggcatcaatccaaaataaactttcagggctactacaatagctttggaaataagccaataattatattagcattacatttagcttcttgatctctcctaggaaacttcttattaaacaatgagatggggtcaatgttatggacctttgcgtttatgcctccctagaagtttttatttttttgtatttgaccttttcagccaaaagactttaaccatacggatcatttctcagtagccatattcaccatccaccggatcctcccccctgactcaggagtttgggtctgcagtgtgaacacagtggctgggatggtggaaaagcccttcaacatttctgttaaaggtaagttcatttcccagaaaaagggattgtgtccttgatgcattatgtttttgtattgctgcttctagacagaaatgtatgcgaccactaaaatacctttggggtaatttccaggatagtaagcctttaaaaaattatatgcatgaaactagagtgaagaaattaagagtatgaactgtggagtcacacagccccaggtttgattttgtccctaacagctcataatcttgtgggtggccttgaccaaatgaagttacctttttgagtgtctctgtatttgcaaatgaagcataatttaggtacctcttagggttattgtgaagccttgttaaacacatacaatacttggagttgtgtcaggcacaacatatctggtagtgattatatttcacaagaaggttagcattgccgttgtgacttcctattcattattgtagagaattatttggagaatccctattttgaggattactcacttaataagaagcccaggctatgctatataattaacatgaatgtcttttcacattcagggctgtgggcatttttcctgctataaattagtatttcaaaattcaaattaatctgagtgtttgtgtgtagatttgtggcttgagtggaagaactaaaatggaggtaagtccacgttaacttggctggtgtacgtagctacagcaaggaattttaaatccgcaagttacttaatcacctgtttagacaagaatacctaacagctctctggcatatattctaggaaagatactaggctaagattacttgtaatttctgatacattgtaaatgctctgtaaatagttgctatcctgtattgtttagagaataatgagaagaaaaaaagtctgtacatgttcagacacaatttgttttctgaatatttttgatccacagttggctgatccacagatgtgaacccacagatacaaagggtcaactttatacagtagcacacattgtaagcacaaatcttagtattaaacctggatcttctgactccaaacccagcactatctcttctggaccattttgctttctgagtctcttgtgttacagaggaggagactgtgaggtgaccaaagttgatttgtatttggccccctttcgttacttcattagtaatctcttgggagatctcagaggtaacttctataaatgaaatgctgtaaatactcagaacataatctgttttttaaaggccaataacaacagtagcgtaaatgcaaccccatagatttggattctgtgccctgagaatccatatgaaccacctcagaatcctccttcttattattacttttggttataggaaagagcccaaatctgttttatttggtagaacattcacgtgattaaaataatttcttgcatcttgaatgttcttggaagaaaggaaatgatatgcagacaagaaaaattaccctacttttaagcttctgggaatgtttgctacccatggacatacgtccaaaacaaaccatgtggtgaatacacagaagagtcactgggtctagtttttagtttgtagtgaaagacacggcacacaacatcaatgtgtagaagcttctccagtcgtaagtcactgctgtctctttgctgtcacattgactggcagccataaaatgtaaatagccattagggaatttaatcaatttaatcagcatcttttattatagtatttacaaaaacagatactaggctttaacaccagtgtacagattgatacagtcactttggaaaactggcaacttgtactaaacctaaacatttacttagcctgggaaccagcagttccacccctaggtatatgctcaaaagaatggctgtattatgttcaaaaaagacatcttcaagaatgttcagagcagttgtattcatagtagccccaaactgaaattaactcaaatgtccatcaacattagaaaggatacactaatcacaaattgtagtatattcatatgtattagtttgctagggtgccataacaaaatactacaggctgagtggcttaagcaacaggaatttattttctcataattctggaggctacaagtccaagatgaaggcatcagcagagtttatttcttctgcggcttctctccttggcttgtagatggccactgtctccctgtatcttcacagggagattaaattaggacacaggtacagggtcttccctttgtacttgtgtcctaatttaatcctcttacaaggacaccagtcatattggattatggcaaaccctaataaacttattctaaattaattacttctttaaaggccttatgtccagatacggttacatcctgaggtactaggggttaagactttaatgtgtgatttggggggaatacaatttagcccataaaatcatgcagaggaatgttaaacagtaataaaaaagaattaatttccgcaacagtatggatgaatcttgcaaacatgataaccagtgaaagaaagtacatgctttatgattccatttatataaagctaaagaacaggcaatactaatcttcagtcacagaagtcagaatagaggctacctctgggtagaggatattgactggaaaagggcacacaggtgccttctggagggctgggaatattttctatcttaatctgagtggtggttacatgggtgtacacataggtaaagtcccttgagctaaatacacttaagatattcacgctttacaatatgtatgttccatctcagtaaaaatgattaaaaggcaaaaaataaaatagtagattactaagaggaagcctttgtagcaatttttaaacccttgtagaagtatcacagactgacattaatggctgtaataaaatgtgcatctgctggtttaaagaaaggggtggccttattttatcatacaaggaaagcattacttgaacaaatttacttacagcactgccctcctttctagcctaagtgaaatgtgtactcagacttatctaacttaatattggcatgatctgcctccagttaggggatactgcttcttactggctttattatcctgaccttggacaacttcctaagtcgtcacttagtcaatagaatttactttaggcctattatgtttcagcccctgttctaggcactgggaatagagcagtgaataatacagggggaaaaagactcaccatggagcttacattcccacagggagataaacagtgagcaaataaataagtagaatgtacagttcacgaaaatgctgagtgtcttggagaaaattaaagcagaaatgggggtagagaatgctggggcagggctggagtggtgactgtaattttaaatagggtaatcaagccttcctgagaagatatttgagcaaagacttgaaggttatgtctaaggaaggtgagccaaagcattgagacagaaagaaaaggaaaaattactgaacattgcaatgtcctctgaaatctgaaaggttctgcattgtataatacacactcttggggaggaaaaacaaaacgagttatgcatttctaagaaggctgggccaagggaactatagagctcattggaaattcacttcacaaacaataactcagcacctagtcggtgctggtgaacaaactacacagtctttgccctaatggaatttagagtgtagtgtggtgtttcacaacctttttattatcatcccactaaggagctcttttagaaattgtattccagaactctccctcatcaccataagattttattatcacagatgtactttatatctctttatgtactatggctctttggcgggctgcaacccattgtaatatctaaaatttttgcatcctccaagaaccaattttcattgtttctggggcgctgtcatccccattgagaagatgtggtctttgagatggggagattgttctagattatctgagtggacccattccaatcccttgagtcattcaaagtagagaaactttcctgacaatagtcagagatgtggtggtcagagaaggatcagagaggcctgatgttgtagactttgaagggataggaaggagccttgagccaaggaatgcaggcagtctctagaagctagaaagaacaaggaaacagatggtctcctaagcctccagaaaggaacacagccttgctaatgccttaattttagcacagtgagatgcatgtctgacttctgacttctagaactataataaatttgagttgtttggctgaaagagagagatatatatatatagagagagaatgaattatgatctagaagaaagaccaatatcaaataatcaaataatcatactacaaagagtaataaaccctaaaaatcaccatgaaggaaaagtagaggttctgtgaaagtatacaataccttaattcagtttctatgatagccacctgtgaaatattcacatcagagctaagaattaactgggagaataatgggaggtggagcattccttgcagaagagagacatccacaatcaatctaaagaaaggaggttcgtgctttgttagttggatgaagtgaaaggtcagtgggactggagggtactaggtgaggggaagaggaggctggagagtgggcaggggcttaatcactcaaggcctggctggtcacgatatgaatttttggttttatcctacatgtgatgagaatccattgaagggtcttgagcaaaggggcacatttattttaaggaagcactttgaggataatgggttggggaagcaaaagcaaagcagagagcttagagagcaggtgatctcactgagtctgagcagaaaactttaagaggactttgttggacatgtaaaacatatcttctacctctacctaagaacaatcacaaaacctcaaagccgaaggactaatctgccttctgaaattgtatttagttcttccaaagcccctgaatgccccaaacgtgattgacactggacataactttgctgtcatcaacatcagctctgagccttactttggggatggaccaatcaaatccaagaagcttctatacaaacccgttaatcactatgaggcttggcaacatattcaaggtaagctttggacaggatagatgccagctggggatgtggcaccaggagaattatttttctccaaatctagaaattcccttctccctgcctcaatcctctacctcaaggtggtggctgttgcagaggattctgtttcagagtattcaagagagagtgcagggggcccctgagctctggggctaactttctgaagtcactgtgtgctctagaacacagaaccagctcacaccatgagttactatctatatcaatatttctttttggatctccagtcctgtttttagttattctatcttggctggtcatggggaaaggcacttgtttatgccatgaatatggtagcaggaaagtccagagcctgctggaagggcagagaggcttaatctgcctaaatcctgggggtgattgttgctgctgtattgagttgtttattccttttctcatttcatgtcttgccctgtcctgcagactcttaacacagagagatttttgaaggaatttgaacctgcaaagtttgggctgtggcagactggaatgggctcgggggaggacaaggacaggcaaagggagctacagacccctcccctaacttcctgaaagaaaaaaataattgaacaaaatgtgacaaaatgccaaaagttcatgaaaacagttgaatttattttgaaacacaaattacaattatatttgttgtatgataatgtaaaatcacaattttaaaaagcaaagagcattatcagtgaccatgctgcttcaattggactattctgtaaaaagacctgccactaacatgcttgtaggcagcatgtcctcctccgcccatacctttgtcttactatgcctatgatttccttaaaatgaccctctattcactatatggagataattaagaaaactatggaaaaaaaaaaagagaagaggaggagggttttgggctgaataacactagctgacctgggtagaccgaataaaatggtattattactgagtccttcacatactattgtagattctatcaaaattcagaattccagggatgtcaggctgatttgctgaattgctgtttccaacatcaatggctaggtcttttgctgtcatatggtggtaataatccatcacctttgtctacaagtggacatccacaaagtggtcttctaagaactgttaaacacatcccagttttttttcttaccaagtaggaatttatcatatgataaggcagaaatttatctttgcagtatccatggagaaacagaggctgactaaagcaaataggtaaggagaaaagagacagataccatttgtttatgggtgctattttcaaggacttcagaatgcttcattgtaatagtatgaccattgcaaatcagttttctggtcattttgagcaaacctcctaagcatctttttctctcgatagcttgattgcaatcagtgtacatacttgaaaacagtagcaattaaattattctaattgagtattcccccaatctggtattccatatagatttgtgaggttttattctacaaatgaaaagacaaaagcaccagagcagaaatgtgtaagtggcacagaaatacacactttaatgtgtacattgtaacctggaaacatttcaaaagcctaattttcctcatattaggaaggatgaggccttgaagatggaattgcctctctgtttcactaagacgtagttttgaaaacctaaaattagttcacatcgcaataacaacaaccccggcttaaggaatgtaagagaatgccaacttaagtttcctggacgttttctcttctcagtgacaaatgagattgttacactcaactatttggaacctcggacagaatatgaactctgtgtgcaactggtccgtcgtggagagggtggggaagggcatcctggacctgtgagacgcttcacaacagcttctatcggtcagtggaagccaacaggcatttattcatgagctgggtgggagggggaggaaggggaaagaggaaggaagaccaggaagggtggtggtgggtgagtgggtgggtggggatggaggtggcaggagttcgcttttgaatgggtgggaaagtgacaggaaggctagcaacttcaagccaaactgttcctttatttgggttggactcctggtctgtctccctgggggaggaggtctgcagcactctgtagggacagagaaggaagcagatgagccttcaggaaggcagggcctcccctaggagctgggatttacacagcagcaactgtgctgagcttcagctcctgcattttatcactggcttcctgtttccatcttaagggcccagaccaggctcttgccacaggcatattttagaagtcccagtttatttattttcaaaaataatttccaatttttcaaagtaattcatggtcagagtcatgacatcaaatagaataagaagcttttatctaaagaacagcattctcctgctccaccctccacctcccagtcctgcttcctataggtagccactttcatctccttaagctatttcttatatttacctcccttttctaaatcagtggttctcaaacctaagtgtccatcagaatcactcagagagtttgttaaaagatgtttctgggcctcatccccagagtttcggattcaatggttttgaggtgaggatggggccggggttcaaaaatttgcatttctagtagcttcccaagtgatgctgctggtcctgggtccacacgttctagataacatgtgtaaaattacttctggacttctcagtggtgtttggtattgactggccttctattgcgttaattaactctgtgaagcctccttgatgctaacctgacctccagcttcctgttacccaggtaccctccattgaaatactggagtgatcttttgtaaggttccattcctggttctttgaattgttcactgtgtataaccattctgttactctctcttggtcagtactttatactttcaacttcatatatatttgatttatatcacctaggaaagtaagaattatcatcttccctattttacagattgaaaagtagagactcagagtacttaataacagtaagatgcatcaccatactaaatcttcgggcttcatatctttgtcttttagagccaggatcttgctctgtcactcaggctggagagtgcagtggtttgatcaacactcattacagcctctatctcctgggctcaagtcatcctcccacctcagcttcctgagtagctgggactacaggcacaccaccacatctggctacttcaaaaaattttttttgtagagacggggtcttgctttgttgcccaggctggtcttaaactcctgcctcaagcagtcccccagccttggcctctcaaagtgttaggattacagggatgagtcaccactcccagtccaggctccatatccttttgtttctccaattattatttctacctagaatcccaaaggcaccagcttattatcccagttcacatatttgcctgtgttttactccatttactaaaagtagaaggatatgttatgattgagtgaaaaaaccaggaagaacatccacttttcttctgcagagattgtgcacccttaacagaaacatccttccttcacaccacccacctagtttttatgttactagcagcatccttaaagaaccaaatgagactcaaaagctactctgagacttatagaagcattacacacaagtaagaaatggctgcttggggacccacctggttgtgaatataaaaaataaacccagaaactatatagagaggaaaaagggacctctacaaccatgacccaagggatccctgatatgtcatcatgttactgctaaaaggcaaatggtagttaattctctctcaagtcactgttggtgagtcaagaggggaagagcataaactgactcagatggaaagtatttatggaacagaacataaaacacttcacagccccacactgtactgtcttcagccctcagaatgtgttgcagccaggaggtctctcagaatatttcaaagtagttctcaggggtaggcgggaaggggattattgaaggttcttcttttcccatcatttgaattttgctgctgtttgcttttcatttcgtctggcagttgcactgtttatgtgtgttgattgagatggtgaaggccagggagtccgggaggggaaggaagagaacactttctgaacatagtgcagaaaggggcagacagggaggcgtatggggtaatcatgttcccaaagggcgggaaaaggggaaatgactatttattgagttactcttctgtaccaggcacaggattaggaggtgtaaatgtattctccaaaatatcaactccccattctcctttgtcattgcaaacctgcctaaaccactctgggtggctattttggaggttaaacttcagaggttaacaagaggagatggcatcacctctctccatttgcaaaggttacagagaaagggccatcagaccttttgcataatgccaagaaaatgcatgcctagctgctggttctcactagtctgagggtagtcagaaccaggctggtgggacttaattcccagtagatggaaacagacccttcctctcacctcgaaccaagagtaagagcagtgtttctcaacctttaaaaaaaaatgtattgctcatccccagtgagctgtttcagatacgtttatcctagtagatcctgcctcccgtgaaattttaataccacagatatgctctatatctgtttctgtattatggtcctctgtaaacaattgtagtaatctgaaattttctcatacactaagaacaaatttttttgccccataggagtgattgtgtccctactgagaatgcatgaattagaggatctctatcctacgttttggaaggacttcatatctggaatttaaaaatcaatttactattattaactgaaaacacactatttcctcctttgtccagtgacataagacatctcgaaagaaggaagggagggaggaaaccagtgttaatagagcccctaacaccttccaagcattttcacatccattttctcacttattactcctgagtctggaagatggatattttaattttattttacaggtgaacttggagagattatgaatttgcccaaggttgcaaaagtaaagtggcatgttcctgtctctctgattttaaaacccatattgtttctattcagtgatgtcttggtagcccaggctcctgtgggtgattatggccaggcatcacgtagtcatagcggataccttgatgtgatcagagcaggaataggcctggccctgccaccacagctgtatgatttctgaaaatcttgctaaggggaaggaacccctaaattgctttacaatgtattgctcaaaatggtaacagaaacggtaaatactctcccataatcccataaccttggcaaatctactgttttgatttttatcagtttccttcctatccttcaccattgtagacataacttttagcatgcctacatgtacttgaagtctctttattgggctttcatacttatcctagttatctatttttccactgaatggctatatcataatttattaaagcagtttcctattttgagtgtttaggtttcttccaattgtttgctgttataaataatgtaatgaatcattttggtagggaaaaaagtatcatatgggccacttgcttgtgtttctttgatagcttatgaggttgtatcttattctagaagccaaggttactcttaaaaggtgccctttagcgctgtcattgcctccacccttgtattagtctgtacttgcattgctataaagaaatacctgacactgggtaatttggaagaaaagaggtttggctttttaccaaaccaaacagtaaaaacagtaaccattggctcatggttctgcatgccgtataggaagcatctgcttttggggaggcctgagggagcttttactcatggcagaaggcaaagtgggagcaggcactttgcatggtgaaagcaggagcagaagagtgagggggggcggtgctatacactttttttttttttttttttttttactgtttcataatttatttatttttccatggaaattatttaacattttattttctgacaaagctcctgtttattttattttttattttttattatactttaagttttagggtacatgtgcacaacgtgcaggttagttacatatgtatacacgtgccatgttggtgtgctgcacccattaactcgtcatttaactttaggtatatctcctaatgctatccctcccccctcccccggcaattgaacaatgagaacatatggaaacaggaaggggaacatcacacactggggcctgttatatactttcaaatgaccagatttcatcagaactcactcggtatcaggaggacagcaccaagggggatggtactaaaccattcatgggaagtcacactcatcaaccaatcacctcccaccaggccccacctccaacactggggattacatttcagtatgagatttgggtggggacactaatccaaactatatcagccatatataaaaataatgatttttctggattctcctaggactccctcctccaagaggtctaaatctcctgcctaaaagtcagaccactctaaatttgacctggcaaccaatatttccaagctcggaagatgacttttatgttgaagtggagagaaggtctgtgcaaaaaagtgatcagcagaatattaaagttccaggcaacttgacttcggtgctacttaacaacttacatcccagggagcagtacgtggtccgagctagagtcaacaccaaggcccagggggaatggagtgaagatctcactgcttggacccttagtgacagtaagtaattcatgctgctccagcctcatctgagcaataaggggctaccgccatgcagacttagctaacatcactgcaggactattggaaattatgaaagaaagttagttgtgagagaaggctaattagtgccccccacctaatcattttaataacttgcaatatataacatatatttggatttgcaataattcaggcaggtctgtgctaaaatttaccttcccttggtgtgcagttgtttatttagtaaattagtaacaagaagtttttctagggcttgttgaaccatttatggggtagttttgaagaattatcatatatctacatgtacacagatgtcagttaattccagatgggtcttacctaaccataaaaaccaaataactttgcttgaaaccccttgaaaacaggtaattttaaaagttaaaagatttatctaggagtaataaaatcactttttttttccaaagtattttgcatttcaggcttctcaatttcagattggtcatttaaaattaatgggaatttcttgggtttctttgtagtattgaaagtctattcattactaaactaagcagagagttttattttgattcactgaaattagaactgtgtgcatttggaacccttggaaaggtaaactatttcttggccacacacaactaccactgaagtcaggatcatgtggtctatggccttaccaccctgaacacactggatctcattgatcctggaagctaagcagggtcaggcctggatgggagattatgtggtcccttgccacctcccagagtctgaggctgtctttgcagctggttctccacttcctcaggaacaggtgtggaagctggctcagtgtttctttggccactcttttattgcatcagtgacttatgaaagtctgaattgttttgtcagtgtttaggaattcttcatatataatgtttaattctgtgaaatttccaaggtgcagaatcatgctaacagtaacacaacgaacaatcacattcctcccatccagaattaacaactgttaacattttgtcatatttgctttcagcatttgttgttgacttatgtaataacccactacaggtgtatcagtatctcctgcaactgttatccctatctatttctattcccctctcccaagagacaaccaaaattatgagtttgttaagtatattttaatttaatgttgtatgtatatattttttgagacaaggtcttgctctgttgcccaggctggtgagcagtggtgccattatggcttctgcagccttggcttcctgggcccaagcaatcctcccacctcagcctcctgagtagctgggaccacaggcacacgccaccacacctgactttttttaaaaatttttttgtagagatgggatctccctatgttgcccaggctggtctggaactcctgggctcaagcaatcctcccgccttcgcctcccaaagtgctggaattacaggcatgagccactgtgccaagcccaatgttctataattttaatatctctgaaagtatacacatgcatacatatcattcttcattttttgaatggacattatgaattttatcgatccatgtttatttagctttgatgcatgtaattttaacttctgtataatattctatcttatgaatgtatcttgtcattcatcctctcccttttagagggagatgtaggttttttcattttttactatcatgaacaaaatgcaatgcccattcttatgcatgtctccatgtgcatagacaggtgtgagagtttttctaggaacaagtccggtggtggaactcatgggctatttccctctaaagtggttagtcagtgtgtactatgttcaggagtgtatgacagtgccattttccttatacccatctctatgtctatatcctttccctatatcactcgatagtgtcacacctttttactttgcgtatctcaaaagcaaaatatggtgcctcattgttaatttcaattttgatttccttgatagctagcaaaggtgagcatctttttatgttaattgtcctcttttttgatatacttattgatatactggatgtcctcttttttgatatacttattgatatcctttgctcatttggaataggttgtctttcttactgatttgtaaaaattatttgtgtaatctaaatactttgttatgtgtattgcaaatatgttctcctaatccctttattgtaaccttgtttgtggtggcttttaacccacagacacttgacattttgatgcagctggacctgtcagtatttgcctgtgtgatttatactttttgcattttggaattattccctatcccaaggtcataaacatattctctgtgtttttcctagtagttctagtgttgttttgtgtatttaggtctttaagatataaaaatgttattttggggtgcagtatattttaatatttttattttaatcttatttattcacatatggcatgtcagtggtcccaatgccacgtattgagtagtccccatggtgagttgtgatgatttctgtatcatatgccaggttctcatattcattttgcatctatttctggatgttctgttcccttccattgatctgtttgttcctgtaccatttccagcatattaactataaacttgtgaaatgtcagtaactatgggatgaatcactatttcctatttcaaaattatctgaggtgctcactcacctaaactacataagtttcatcctcattagaatgatacactctcaaaatcacactatcattatcatatttataggattaaacaaaaactagttaatagtcactgggagtcgacttgccttggatgattgtatgaagtttgatggagggtcaatgctggtggtggtagtagggatgtgagattggcagggtaggagttgatccctatagggtcaggaaatccgaggaaggaggatgtgaatgagaacatctcatttttacctgaaaatatttgttaatatgctgtgttgtcattgatcatgtatgttcataagtaaaattaatacttccagttataaagtttgtgttggtttccagcctagcaattacatctggtccaggggtaagaagtggagtgaattagatttggcgtatcaccccaatcatatgttaaaaataatatatgtgtgttatgttttcctgttggaaaacatttacatggggagtatttgacccttacaatgactttttgaggaaagtagagtaagaatgattatcacagttaacagatgaggaacctgaggcacagaggagggtaagtgacttgcccaaaattatggaactagtacggcatggggattaggattctaatccacattttagttctatttttccccccaccatgctacaaatgtcttgcacttgtctctttggatgggcgacccactgcttcaaagcaactatgcttctagaggttctttaagtagtgatatcccgtttctaaattgtttaaggtctgattagtgtttcctaaagcattttagaatctattgtagagtcacccagagaacctgctaaaatgtagattgctgggtccagacccgctgaatttaaatcaaaggtttattgagctatccctaagaatgactcctttcaggcataaaatggtaagttggtagatgcaaatttatgatttttagttggcacaaaaattatattcattatttttctaacaagcttctaaaagacactgctgctttttgtgacaggcttagaagaccactggtttatgaagttgaattttttgagccacaactatacaaatattaactatgtgatcatagtaatctgaaaatgttggtatttctattactccttcaatctcctgtgggaagaaaggctattgtatatttttataaaaatatacaaaagacttggtactggatgtaaagaaagttaagacatactgttgattaattgtgatttttggatactgtaccgtctgctagacatagaacataacaatcagatttggaaggttctaaatccaatacctaattctcataaattgccacagtcccctaaagagtaacaagggggagtcaacataatgaaaagaagaaatttaaaatagaaaggatgtaccttgagatacttctcaaaggttctaatttgtttataagcagtaactttcatgtggaaaaacaatggtgtatggaatgaaacagcctatgtctactcttcgcctactgggacgagtacaaaccccttaaacttttgaagtctcagttttctcatctctaaaatgtggatcataaaaaatctcagtactgtgtggttatacaagtcaagagagtgtctgcatgtggaagcacattgtaaatagcctcataaatgtaaggtacagttactattaaggacaagagctcgaatccattcttttcctggatcaaataggcttagcctttattggatcacgaacttcccttctagcctgtgccctttagagtttgagtgagaatgtagtgatgctgcggtgcctgtcatcttcacatgtggaaaacctcaaggcatctctttctcatcctgcccgtgtccctgaatggaatgtgattccacttttccccaaatccctataatactttgtctactaaaagttattagcacattttctcatgtatacactgacctgcctgctgctccataaatttagggcaaggacagaccacatgacactaagactatggactacagagccagactgccaggagttgaatcttgtttcttctacttaacagtagtgtcaccatggctaagtcacttaatctctccagacctcagcacttacagaaagattgctatgaagaggaagtgagttaatatatacaagagactagatcaatgcctgacatattgtaagcactatataaatgccagccctcagaagctttccattcttcccagcatcaagaatagtaagtacaggtttgtggaataacagaatttctaaggccttcatttagtgtcaagatgacagatagatgatatgtgttgccatttctctgtctgtgccactctttcaagtctgtgtggagtccagtagccactaccaattgattggggtaccatatgagaaaacatttgtttgcctttcatgagctgacatgaactctatctcaaaagcataatgatctaggccatggtagtatatcttaagtgaatcttttttctttttaatttctagttcttcctcctcaaccagaaaacatcaagatttccaacattacacactcctcggctgtgatttcttggacaatattggatggctattctatttcttctattactatccgttacaaggttcaaggcaagaatgaagaccagcacgttgatgtgaagataaagaatgccaccatcactcagtatcagctcaagggcctagagcctgaaacagcataccaggtggacatttttgcagagaacaacatagggtcaagcaacccagccttttctcatgaactggtgaccctcccagaatctcaaggttggttgaatggacaagtatttacataggattaccgtgcagccctataggcagctggtttatcaggacaggcctgtgagatgaaagcctatgaaaagtcggtggttgaatggacaggcatttacagagaggtccttaatatcaaaatgcctctgagaaggatccctgttggtccgttttctattattgaaccttagaatagatcagtctatcagcataccccatccagcaatctaagaagaaagctctgaggaatatgaattttaattcctaggagaaagaagaatgtgggagctgcttatagaaggcaagctatgcaagagctccagtaggaggctccaagaaccatgctccattcttcctcaaacactcctttttttagcttggatgacattgtgcaattctgagtcttcttctactttactgatgcaggttattccatgtccaccactaaccccaaccccaggaaaagtatgtgatttgagctagatagagatcctctctggatgccatactgtgcccaccatttgtgattgataaagtctgttgagtgtaattaagtgaacaagggtcccatgtgggtggagctgcagcaggaggattgacttcaagtctgtgcagaggcacctcccggctctctgtgttgtgtacaatgtgtgccagagaatgtagatggaggcacgttagaggcaagttttgaaaatttatgatttggattatagtctgtttttaaagaaaatactataactaaatctgaaaacttcttggttctcttggaggattacctagaccttaagaaacaaaatcaaacaagtcgctttaacactgctgattctttggaacatttttgaaatgttcaaggaatgaagagtctgccaaatatagaaaatcatggttttcaggtcacactcttagtgaatgccccatttttgtaattacttgtgttttggcgaaatgtaacttcctaaattcaagctatacataaaataccaagagaaaacttttaaaacaagacaaaaccaaaagtttctcaccattctagacatctctgtatctgtacatatatagagatagaagaaaagataaatgagaagagagggatacttttaagaggacgagatcatgttctatgtgctattgctaataaaaatatatcgagtttaattttatttaaataaggaaaagaaatagatttgaccatagtctttaatagtttattttgacctgagccctaaatttaatttttcctctgtcttttcctgtcttcctccctccctctctctcttcttctattgggtatcattaggttttcttcattaactcgttaaaacaagacaaacaaaacaaaatatctgatagactgtaagctcttagcatcattgaactttaaagcatttctaggtggggaaattgaggtttagggaggtttagtcactctctcaaagttatacctgtagtaattctccctattattcaacattgttcatttgcttgggattctacttggaaataaaagttgaacaaatgacaactaatgattagcatattgctaattgtaacagcacttttgcatgtttttttttttttttaatcttattacaaccctgtgagtcagactcatctccactgagtttggaatataaatgagtagcccgaggtcatatagtggttaggtggcaggattagggctgctgttaagttcccattacactgtgtcttctcccacatacggtgtgggtctgtttctctatgtaaactaaactacctgcttcacctctgtcttcctgcacagcaccagcggacctcggaggggggaagatgctgcttatagccatccttggctctgctggaatgacctgcctgactgtgctgttggcctttctgatcatattgcaattgaagagagcaaatgtgcaaaggagaatggcccaagccttccaaaacgtggtagtgtctcatcttcctactagctaataagggcaagtccaagtacaggcagaaccttcactttaaagatatggaccaggaaatttacttataaagtaaatatttcccttaggcaagcctcatcttctctttggctttcattatgaaatgggagataaaaagtatgactttataatttcttatccaaaccagaacaattttgagagtgaaaagggtgctcttagtaaattatgcaggaaactaggtctgcccctgcctgctgaaatgagacatatggtcatcctagtagtaagtccccagagatgatatcttgcaacagaataaattgaacatttttggtaaggaaggacagagggtaaccagacctcagtgagataggtaatgacgtaatatattagacaagttttcctcacatttgcctatttccagttcccatttctttctagtaagtccctcaatcttatcacccctcgtatgtgtaagaattatatatacctgtgtgtgtcttccattcctgtgtaccctcagtctgaagtcagagttcctggcacttggtactgcctcattttttttttcatctaggaattctaaccagtagcaaaggcctataaaaatcacactttaccaagaggcatcttatttgagttcttttggtatactaaagcctgaaaatgtatctagtttgtgggttcaggccctgtaaaattaatttgaaccagactttatcaattctgtatataatgcattgagtgcaatgattcaaatgaggtgtaccccatgtgcatgagtccccgagtttcccttccacggaggacaagaggaacttcactatctgactccatgccagagctggctcaactcaggctgtcgctggagaagaagggccagcaagggggttgggagtgctggagcctgtcaaaataccggtgctttttcatggtagcaccagcagctatttgaattcaggagaaagagatactgtgttgggtttggctctaagcttcaatcatcttgtggccagagtggacttagagattctaagccttactacgagagagaaagagtgtgcactaaaaatagagtaggatcaagataatgctaagaaagctctcactgaggcgcaccctgtggctgccccacataggctctccaagttagtttccaaaccagaactgaacgcttgctcatttcacaacactgtagggaactcacgtacaactaacgcaaggatggcaaacacatggaatatgtactgttactccttcctccgtcaccctttacagacattgctaatcaacaggcttttctggggaggcccagaattgtgcccgtgcagccctgtgggcagctggtttatcagggcagtcctgtgtgatgaaaacctatttccctttccagtctagaattaaatacagtatttcttttttcatctggtgtggatgccaaccagaagacattatgccccttagaattatgaaaaatcctgacacaaaatgatgaaataattatttttccagagggaagaaccagctgtgcagttcaactcagggactctggccctaaacaggaaggtcaaaaacaacccagatcctacaatttatccagtgcttgactggaatgacatcaaatttcaagatgtgattggggagggcaattttggccaagttcttaaggcgcgcatcaagaaggatgggttacggatggatgctgccatcaaaagaatgaaaggtcagtggttgaccagatagagtcagcattgcgtgagggtgtggagaaaacttgatttcctgctcattctttcctctatggtcttacaaaaaattggcatggtatcagacatagctgttatttgcaactgaaggttatgcttcctttgaagttgagcctgtgatagtcaggatatcaatacaaaggcaggagccatttaaacatcactgtcttgattcattgggatgagatactatagattcttggtcatatatggctaacttttgcggagcatcattgtttctcttaaagcagtgcttctccaaattgagtgtgcatcagaatcacctggaaggcttgtttaaaaacaggctgttgggccctaccccacaatttctgactcagtctagggcagggccagagaatctgcatttttcattagttttccagtgatgctatcttgtgggtttggggaccacattttgcaaaccacagtcttcataggttaactgtatataagttcctggggacactgttagaaatgcattcacttgggtttcttctactccttgactacatctgagtttcttgggtagcatatgaaaatctgtgttcttaagtggctttctcaatggttcctctgtacactcaggtttgcagagaaaaccactgacttaaggtcataagaactaaatcttttccagctttgttcatctcaagactgtttggtacctacccatctaataatatttgataatatcttcagagaaagcagcatgactagttcactggcaaattagctagctgtcttctcttctgcatgaaagagcagtttgtataagacttgactgtgaggctgcactattgattttacaaaatacaggcttggaatgtggtgcattaaagcagagaatatgatgaactattatcattgtgcagctccatcttaagagctctctaaggatgctggcagatttttctttttttttggaccacactattgaatctatgaattacctctaaatcttattaaatcatctctgctttctgcattgttaggaagactaacaaaacaaaatattatctatgattagaaacagcaatatgtttctttaaaaacaatacaaactacttgcaaaacagccacaaatcccttttctgttttgctactttagtcacagggagttttggggagcagtgaggatagtgagaggagaggggtgtagaatcttatgaaggcagtttttattgggatctattgtgagcctgattttctaccttgtgcccatgtgaagagggaaaatagcttaataaggcaccagggcagataaatcctgcaggcaaagcagtgcatccaaagaagggcagttactgaagtggacaacctcactataaagaactttaaaaaaatattcccaagatattgaccctccatgaggcttctgtagtatgaacagagcacttgacttatgagtaccattagtccctcatgagatgattgtcacagtttctaagcatgagcagccatgtttatggccaccagcacctcactcctttccttgccacccaatgtgtgtttttttttttaaagcagccatagctcattgtccctgactcaagactgatcagtttatgcaccaaccaatagccttctcttcattctggtgcctgctgtgttctccctctggttaaagtgctagtggagagacaaggcaaaaagaatagaagcagatgcaactcagtttcctgattcccatgcaacttccataagataccatttggatttgatttgtttagctcaatcaaccagattgagactggtttgtaaaaaataagttacagttagtgaacaaagaggcatgcattattggtgatgtttcatggaaactttggttctattcctcagttgtctctggatggtagatttagctggaagagctaaaatctaaaagatgatacagctccacctctaccaagtcatttacctgaggatctgggagcttcaacaagaaaactttagagtagtggttctcatccaggggtgattttgcccatgggggcatttggcaatatctggatacatttttgattggctattggcatctagttagtagaggccaggatggctgcaaaacatcttaccatgcacaggacaggcccctgcaaaggaattatcagcccagtgtcaatagtgccaaggccgagaaactctactttagagtaatctctttggttgtatacagttgatggtgactgagggtagctgaaggttcttagggggcaggacgggacagctgattctgaaaaggtgtaacaaagaagaatcacaacccttgactttcttcccagaatatgcctccaaagatgatcacagggactttgcaggagaactggaagttctttgtaaacttggacaccatccaaacatcatcaatctcttaggagcatgtgaacatcgaggtaagatgctcttttcctgtctttcctgccagagtttttataaaacagacaaattccatatggatataaggaaagataatgatcttaagaatgttgcctattttttttaaagttgcatcttctatctgaatgtctgtctagtcccatttatagactgtgctgtggtttgccttgtttttggagggaggtgccgaggctggactatttagcctctgatgtggttcagccattactgcccaaaggtattcatggctcctacctgccccatccttggccatgcagaggttttctccactaccactactattatagtaggggagcccccaccatcagcttcttaattgcctacctttacatttttcctggaaacccagggaattggtattctgaatgttaaaagccatgaatgccagcaatctagtgtaatatgaaaactaaggatggttggattttaaaaataattataagaagctttcatgcgatagtgctttgtttttatccagaatgctttcatgtacaattacaatggagctttacaactatcctgtgttgcacatgcatttaaagttaaatttatgttattaattcaaatgtttattgagtactttctactgtaatgcatgtaattactggtgagtgagtaggtaacaacaaaaatcctctatgggtttacctctgcatgcagcatggccttgtagttctgaatctctgcttaaacttcacttctcgtggaaaagtttgctcccacaaaaagctccatgcagtaattatttacaaacttgacagcctcttgttgactttgcagcacaaacaccaacaatagaaaagagactacttccatttcctcaatttattaaactaaaaatactggtgcttcaaacaatttatcattctatgatccaataagggtgtaattctgaaagccagatcatgtcccttaggttaaataatgaagtaatgacatttattttttgagctacttcctgaaaacagtagtgagcatggcacaggagtgtaaatgaaagttacacacacacacacataccacacacacacacacaccctgctgtccttgctgatagcactcccacaaacatggtgagtgttcttaaaacccgcctgactttctgtacaaaccctacaaatgacacagtacaaaagggcaaggattctctggatgcccagggaaagtggtgttatgacaggaagccaagtggccgtggtggacagactaaaccagttttctggaaaaaggctaaaactacaaagaagactgtgctgaggctttagtgttgaccccactgcagatctaagagaatgctggctcttaagggatccaggcactttgcactaggaggagataagaagagaaatggccagttgatccagttctaagtttcagcttttgttttattctgaggacaataaaatcttgaggttacgtttacttcatctggttgcagttggtctttagggagagaataaaccatgatattaatgcagcttccttcttgggaaaaaaaaccacaacaacaaaaatatatcccttaaaattttgcttcgtcatcacattagcacatagctggctcttaaaattttaagataggccgggcgtggtggctcacgcctataatcccagcactttgggaggccgaggcaggcagatcacaaggtcaagatgtcgagaccatcctggccaaccaacatggtgaaaccctgtctctactaaaaatacaaaaaattaactgggcctagtggcgcatgcctgtagtcccagctactcgggatgctgaggcaggagaatcgcttgaacctgggaggcggaggttgcagtgagccgagatcgcaccactgcacttcagcccaggcgacagagagagactcagtttaaaaaaaaatatatatatatatgaatatatatgtatgaatatatgtatgtgtatatatatatatgaatatatgtatatatatgaatatatgtgtatatatatgaatatatgtgcatatatatgtatttaaggtaaattacctttatctttattaataaatacatatttaaattattttaaaataattcagtaaagatgtgagaaagcacatgtataccataatttaggtctaactttcattatagtgcaacaggtttcaatattacttttcttttttgctagaatttcaatttcttagaagatctttcaagcttttttttttttttttttttttgagatagatagatagggtctcactctgttgcccagtctggagtgcagtagcacgatgtcagcccactgcaacctccccatccctgggctcaagcagtcttcccacttcagcctaagtactcccaagtagctgggactacagggatgcaccaccatgcttggctaatttttattttatttttattttttgtagagattaggtctcagtatactgcccaagctggtctcaaactcctgggctcaagcaatccatctgccttggcctcccagagtgccgggattacaagtgtgagccactgcactgggcttcaagttctaattcatacatcattttaaaaacatggtttgcccaaaaaattcttctttaaaaaaaaccagtaaaataactttaactttacatttttagtaggtataaatgtcgatgtttttagcaagtaaattccctttaaaaaaattttcgcaaggggataatttattttttaaaaattccaagaaaacaaaagtaacaaaactgggcaaataacgttttattaaaaaaaaaaagagagagagaaatgatgtggaacaaaaaagtgacaatgaaccataagtttttctaggaactattgttttattttttcctaaaagcttgagttttctggtatcttgaagcaaaatgcaatctttgaaactaacctctggtggccagagacccaatcagcaatatggtgacttaggatgggttttgaggaggagtagaaggcaggagagacaattacctgttgtggctccttccacatggatatttaattgttgaaaaataataacaacctcaggaatagctagaggcagactagaataacatgcctggctcatgttactaagctccttgatcaaaatggaatgcaaatgaaaaggtgacgtgaagaacgtgtctgagatctggaagagcatgctttgactcactctactgttattactgagtgggtaaaagcatttcaggaagccctctgtgtgagtgcaggtttggtaggaatggagagggggtgggaaggagcaaaaccaagcgttgcagcctggccccttttgagtattgcaggagggtgtcacccgtcttcctcctgtcccccagtgctccctgggtggtgttgctagatgtgttttttagacaaaatggagtttataggcaatttccacagcacatctcttaaatgtcatagctgttcagggccactgatgagtcgatgctctcttccttccctccaggctacttgtacctggccattgagtacgcgccccatggaaaccttctggacttccttcgcaagagccgtgtgctggagacggacccagcatttgccattgccaatagcaccgcgtccacactgtcctcccagcagctccttcacttcgctgccgacgtggcccggggcatggactacttgagccaaaaacaggtttgtccggaggacttcgctttggatatctttcctgtggagttccctctaaagtcagtttcaatatgtttgtagggtctgtcaacctctcttctttaactccttcttaaaatctccctcattttaatctctctgtgaatagtccatctatttaaagaaaaattagtactgacaatatgtttatctagcaattttcataattatgaaaattgtataattttcttctatctaatttcatatatgcaaattttataattttcctaatacgtagcgaggtaccttaagctctcttagcctggtttgcctctaaataatgtgtaataacagagacacactacattacagctggaggatttaacaacctgtgttttttatttgttcgttttctgaaattcttctgccaagatgtggtgtgtcatttggcagaatccattaccagggaattttggaggggaactttaagggaactggattgtgactgtttaaaatccttttttatactattgttttctttcctgttccccaaagttttcagccctggggctttcattaggctgaaaatacataatgttttcaaaaatttcagtttatccacagggatctggctgccagaaacattttagttggtgaaaactatgtggcaaaaatagcagattttggattgtcccgaggtcaagaggtgtatgtgaaaaagacaatggtaagtgccagacacagacactgatcgcatcctttccgaggtactcccctgtctcctgatgttgcttctgagactgtcagtgctctgtggtgactgaagcatctgactgtatgtcccagtagatactgtgtgccctgggaaacattctttctaaatgttggttcctaacatgattgcagcatctgcattaattaataatgaagaaggcactgtcatgtgtgaccaagtgattgaatgttcaaacctagtggtttggggtcttggttctatccagtccagaccccaaggcatctcactcaggaacctctgaggagcttgcacaatcccctttcatgcacagctgacacagcaaggaaaaaaattaacatattttccaaaagtcaagaagacaaactaaatggtttctaaatcaccaggaggctctacagagaaattcataacttctacaggctcatctaagatttctctcttcactgaaacctcaatggtcactattcaaacccaaataaaatccactctcccaaacagtaatattttatctttaagtacaagattgcaggagaacctaaccatacagtcttagaggaagagagatactcattctgcttttggtgcccagtctagaatcacatagtcctagaagtaccgcatccctgcatgttacagctgtgtggatgaaatgtcaccatcctctcttttccttgggtgggcagaatgcaggggccttagggatgacaagccctgcagcctttccatgtgtctggcagatctactctggtggatggctctcccttttttaggtctgatgaacattacttggtcccagctttcctgggatggctccagttgtcataagatatagacaatctttttgcttttgtgggcacaccaaattgtctcttagcaaggctcaggttccggcatttattctcaattccaggcttctttttttcccatcatacttattttagttactgagaagataaagtaaaacaatactcaagaacattttgaaaggaaatcacccataattcaccaccttggcatatatatttttttcattttggcttattgcctttcacagcatacatccttttacatagctacaaccacagtgaacgtaatcattttggatctttccactctcctttctgatgagggtgtgaagctgggtccctttggctcttcgagggccctgcatgcttatcaacatcaacactttcagaagccatgtgtgcctccctgagggctggcttccaggtgatgcttttctccctaaccttttcaggcacactcaaagcagatgcttctctggagcaggggtgggcttgttttcttaaagaagcagaatccatcactcacctacctactccagccttcccaactcctccctcaccacctggtgtcctcaaatctccttcctgaaatccttttccctgctttcctccagcacttgggggatgtgggtaccctgggtgagaaggtggagggataacacaggataactccacaatctacccattctatttggatgctctcctcagcctcccaagactagcactggtttgcttggcatttcataaagggcagtgatttctgcaatattggggttatttacagggggagagcacctatcaggtctcaactctatcttacaatagactaaacagggtaaaggtgttctttagcaccttggggctggggaggaaagggccaggtttgagggaagggggaagaaagaaggattggagaggagcaagttccctgcaagaaaggtgcagtgtggcaagacactcctagagaacacagtggctaccttctctggcagccaattttaaaatcagattttcaattctcattgtacttcaaagcatctgcattttttaaagatccccagatgattgagtcctatcctgtggatattctgattcaattggtctagggtgagaaccctgcattagggttttttttttttttttaagttacccagggtgattttaatactggaagtattactgcaaactactatactaagcaatttggggtttcactatcatagattaatatatccatcccgtcatcatggatttgttagtacaatgtttcatgcttgtgctagattttggggtaacataagtcagacacagtctccaccttcaaagagctcgtagacatatgactcaggattgtaacagttgataaatgcaaagagcaaggaaagcataggtgctacgggaacacaaagaaggtgcactgaaccaagctgaaaggaagttaaggagggcttcctggaggaggtcaaatcctgagtttcatagtaaatgttagataggcagtgaggatgtgagaataagttggatgagctggaggacacagtacatacagaacccctagaggaaaaggaaagcatgaaacctttaggagatgtttaagtaattcactatggctgggggtgtattgcagagaggaagggagagttaaacttcagggttggaagaggaagcaaggataaagtcctgaagggccttgaattccagctaaggatttgggatcttggaaccatagggacattaaagaattttaaggaatagaactacatggtcaaatttgccatttagcatgatcatcctgactacagggtagagaacagacaattagggagggagatcagttaggcagagagaccaggagagattgttgtcatcaggtgtggtatgatggtggactgaactgaggtgatacagtagacagaagtgacgagatccaaaagaagtcaaataaaaaaataaatgaaaaagtgcacaaggaacttaacaattaggaggtgtgaggttggaagccagcaggctgggagtgaatgagggcaaaaagaaaacagataacactgtagagagagttagaataacagctgggagatggggtggtgtggacagagagtgaagggaggaggtgtggatgtggaggagaacaataaataggtagatgtgagaaaaaatacttccatacttgaacctaaaagtacaaaattaccatttagaatttatgtttagaaatgtatgcatcagaatattgccactccacaaagaactgggagacaattgcacattcaggaatcgtccttgggatctagggcagggctggtctcataaatgcatgacctaggagaacacctgctctggagagctgagaaaggtccctcaagtgctcctggttttgttccacccactggctaatctaggtggagatgccactgtgaaagtctggacaaatctctgggagggagggatcaacctctcaatgaccaaccctatgattcttgaatgagtagataggaagggagccccaaatcatagagactttgaggaaactaggaataaaactttaaagtcaagctttacaatgtccaggcacatctcattttgcctagcctgggatcagtaaaacaagatatggggagagcctggatgcagtcaggaccaggcatcgaaaggatcagtatgtctccaaacccaacataaactacactagctacaaatcagctcaatctctactgttacacatgcacactgttccccttgtccagagatgctctttcctctcccatctacctaatgacacctaaacatcttatagaaccatgctgggatatcccgtcctctggacaatctccctccatcatctccaggcgtagttgttctcttcaccctaccccagtttcccttttccaccctgcttcccttttccatattattaatacagttaaattctcactcagtgtctatgcctgtctcccctttcaaacctcggagtgcctctgagggctataaggtgaataaggaatgaccgactaccatgcgtgcacactcacacttccattcatataacgctgctggaccccgaaagataaataggacttatactatttgcatgttttgaaatttgaaaacacatgtagctgggacatacacaaagcaatgatttctgagtctacccagcaatcatttgtggagccacagctcaggcaggctgagagcctcttaaagaccctgtcccagttaagtgaaatctcactttgttctctccagggaaggctcccagtgcgctggatggccatcgagtcactgaattacagtgtgtacacaaccaacagtgatgtgtgagtaaacttcttattgccaagggatttttttttccctcccagaaacatatatatttgacagagattttaaaaagatacaggaatgtcctgtacctctcgggaacaaaggtaactaaaaagctcaggaaataaattagcagaataaagccacagagtagacagtttccagaggagtgcagaatcacttgcggcaggttttgggtttccctctgcatactgaagttgtgtattccgcatgtgcttcaagttgcgaattctcggactcaacaggaagaagggacataccggccttcctgtggctcctctcccagacctagatcagaggaagcaacccagaatagctgctggggacaaaataaggccagacagttgggggggggtcgtctctgcttgcagcctgcagtgatgcatcagaggctggtggtgaaaggaaggattggcttgagatttaggtcatcttgcctcgtaccccatttccaggaggaaaaaccaaggccccgagggtggtggtgacttgtccaaggggttttgctgatgtctgggcatgaggagggggtgggcaattgctgtgtcctcactgtatgcaaggtgctttttatgtttctctgcataattttgaggcagggattattgtccccacttttggaagaatacactaagaggtcccaagaggttcagcaactgtttccaggtcacataagtattgggtggcagagattggatttaactcagatctgtcaagctccacaacaaatttcatctgttttggacagtaccaccttgtagtctctagttaaagtgatttgggggctctggcaaagtgaacactgtttctttgttgtaacccttccattgagctaagaggagagaaacctacactgtgtgcaagggcctatcctaggatgtagacatttaacatctccttttctcagaaagggtgggtctccctggcttttggggcaggaaaatgagtggtgactctgtttgctgattgttggtttcacacttgtccctcctgcagatggtcctatggtgtgttactatgggagattgttagcttaggtgagtatctatgtttatctaccaggtgagactctaggcaaagtgagtggaagcctctagcactcccttgctgcataattccacaggatgccgtttgtatgtggttctaccagatgtgacttggaaatagaaacatagtgtatttattcccatatttttctttttaaaagccttatacctaacgtcatatttaacactaatgacctggaggccatgaactttattatatattaattggctccgcttgtacaagttgccaggttaacttctaaaactcttagattatgcagctattaaaagtcacatttttgaaagccatttaatagcatgtgaaaatatgtaataatttcatgtataccctgatcctagttttatcaatattgcatattttaaaaaactggaaggcactacacagaaaggtaataacatttattcttcatgctttttaatgtggtacatatacaccatggaatactatgcagccacaaaaaagagaggaatgagttcgtgtcctttgcaggaccatggatgaagctagaaaccatcatcctcagtaaactaacacaggaatagaaaaccaaacaccacatgttgtcactcataagtgggggttgaacaatgggaacacatggacacagggaggataacatcacacactagggcctgtcagagggtagggaacaaggggagggagagcattaggacaaatacctaatgtatgtggggcttaaaacctagatgatgggtcgataggtgcagcaaaccacccaccatggcacatgtatctcagaacttaaaatttaaaaaactgttctacaataaaccaacatgcatggcttttgtaattaaaaaactggccataactatcattgataaaatatgagttataaaactatggacttccaatcagaaaaaaaggttaatcttattggtataataaaggttaatcttattggtataatagatgtgctttgtgtggggagacttagaacaggcactaaggaagcctgtggtggttccttcccctgaagcaatgatcatgctttggcatagtctatagtgtaagcccagctttgatgtgcagtgagtttgccaagggaggcatgcaggatgctcaccctctcttgccataccatgtcttcctcctggccccttatatttagaaaccctggacaggaagcattgcttttcatgccagagaggacttagagtggcactgtttgtcttccaggaggcacaccctactgcgggatgacttgtgcagaactctacgagaagctgccccagggctacagactggagaagcccctgaactgtgatgatgaggtgtaagtcaggcctcatcctggggctattttgtcttaccttccccctgtgtgtttctggggccagctgactctagcaaagtcagccggtatacactatacacaaacacctacacacagagatcccaaataggaacccctccccttttattcacctaatactgttatataatacacaagaagtattagctttacaggcatagaaattcaggaggaatttaatgactcttgggaaggttgaaatgaggaagggcaacaaatgcagaaaagctctgaaacaaattctttaaacatacaacactatccttggggataaagatttcaaagctgttcattaagattaagaaggatacattttcgggctggcaagatggctgaataggaacagctccagtgtgcaactcccagtgagatcaacgcagaaggcaagtgatttctgcatttccaactgaggtacccggctcatctcatagggactggttagacagtgggtacagcccatggagggtgagctgaagcctcacctgggaagcgcaaggggttggggaactcccttcctagcgaaggagggacggtgccatgacgaatggtgcattccagcccagatactaagcttttcccacagtctttgcaacctgcagaccaggagattccctctggtgcctatgccaacagggccatgggttgcaagcaccaaactgggtggccatttcggcagacaccaagctagctgcaggagtttcttttcataccccagtggcacctggaacaccagcaagtaagaactattcactcccctggaaagggggctgaagccagggagccaagtggtctagctcagtggagcccatcaagctaagatccactggcttgaaattctcgctgcaagcacagcagtatgaagttgacctgggggaggacgctccagcttggtgaggggagaggcatctgccattactgaggcttgagtaggcggttttcccctcacaatgtaaaaaaagtcacagggaagttcgaactgggtggagcccaccgccgctcctcaaagccactatagccagactgcctctctagattctttctatctgggcagggcatctctgaaagaaaggcaacagccacagccaggggcttatagataaaactcccatctccatgggacaaagcacctagtggtaagggtggctgttggtgtagcttcagcagacttaaacgttcctgcctgccagctctgaagagagcagtggatctcccagcacagcacttgagctctgctaagggacagactgcctcctcatgtgggtccctgacccgacccctgtgctccctgactgggagacatctcccagtaggggtcgacaggacatcttatacaggacagctctggctggcatctggcaggtgcccctcggggatgaacccaggcagcaatctttgctgttctgcagcctctgctagtgatatccaggcagacagggtctggagtggacctccagccaactccagcagaccttcagcacaggggcctgactattagaaggaaaagtaacaaacagaaaggaatagtatcaacatcaacaaaaaggacctccacaccaaaacctcatctgaaggtagataaatccacgaagatggagagaaaccagtgcaaaaccgctgaaaattccaaaaaccagaatgcctctcctcctccaaaggatcacaactccttgccagcaagggaacaaaactggacgaatgagtttgacaaactgacagaagtaggcttcagaaggtgggtaataacaaactccttcaagctaaacgagcatgttctaacccaatgcaaggaagctaagaacgttgaaaaaaggttagatgaattgcaactagaataaccagtttagagaagaacgtaaatgacctgatggagctaaaaatcacagcacgaatacttctagaagcatacacaagtatcaatagctgaatggatcaagtggaagaaaggatatcagatactgaagatacacttaaagcatgaagacaagattagagaaaaaataatgaaaaggaatgaacaaagcctccaagaaatacgagactacgtgaaaagaccaaacctgaaagtgatggggagaatggaaccaagttggaaaacactcttcaggatatcacccaggagaacttccccaacctagcaagacaggccaacattcaaattcacaaaatacagagaccaccccaaagatactccttgagaagagcaaccccaagacacataaatcgttagattcaccaaggttgaaatgaaagaaaaaatgttaagggcagccagagagaaaggtcaggttacccacaaagggaagccaaacagactaacagtagacctctctgtagaaaccctacgagccagaagagagtgggggccagtattcaacattcttaagagaagaattttcaacccagaatttcgtatccaaccaaactaagctacataactgaaggagaaataaatcctttacagacaagcaagtgctgacatattttgtcaccaccaggcataccttacaagagctcctgaaggaagcactcaacatggaaaggaaaacccggtaccagccactgcaagaacataccaaaatctaaagaccatcgacactacaaagaaactgcatcaactaatgggaaaaataaccagctagtgcagcataatgacaggatcaaattcacacattataatattgagacccatctaacgtgcaaagatacacataggctcaaaataaagggacagaggcatatttaccaagcaaatggaaagcaataaaaaaaagcaggggttgcaatcctagtctctgataaaacagactaaaccaacaaagatcaaaagagacaaagaaggacattacataatggtaaagggatcaatgcaccaagaacagctaactaactatcttaaatatatatgcacccaatgcaggagcacccagattcttaaagcaagttcttagagacctgcaaagagacttaaagtctcccactattattgtgaggagtcttaacaccccactatcaatattagacggatcaatgagacagaagattaacaaggatattcaggacttgaattcagctctggaccaagtagacctaatagacatctacagaactctccaccccaaatcaacagaatatacattcttctcagcacctcatcacacttaaagctgaccacataactggaagtaaaacattcctaagcaaatgcgaaaaaacggaaatcataacagtttcttagaccacagtgcaatcaaattagaactcaggattaagaaactcactgaaaaccacacaactacatggaaactgaacaacctgctcctgaatgactactgggtaaataacgaaatgaaggcagaaataaagatgttctctgaaaccagtgagaacaaagacacaacataccagaatctctgggacacatttaaagcagtgtgtagagggaaatttatagctctaaatgcccacaggagaaagcaggaaagatctaaaattgacaccctaacatcacaattaaaagaactagagaagcaacagcaaacaaatgcaaaaactagcagaaggcaagaaataactaagatcagagcagcattgaaggagacagggacatgaaaaacccttcaaaaaaaatcagtgaatccaggagctagttttttgaaaagataacaaaatagactgctagccagactaatgaagaagagagagaacaatcaaatagatgcaacaaaaatgataaaggggatatcaccactgatcccacagaaatacaaactaccatcagagaatactataaacacctctacgcaaataaactagaacatctagaagaaatggataaattcatggacacatacatcctcctatgtttaaaccaggaagaagtcgaatcccagtcgaagaccagtaacaagttctgaaattgaggcagaattaatagcttacctaccaaaaaaagtccaggaccagacggatccacagctgaattctaccacaggtacaaagaggagctggtaccattccttctgcaactattccaaacaatagaaaaagagggatctttcctaactcattttatgaggtcagcatcatcctgttacccaaacctggcagagacacaacaaaaaagaaaacttcaggccaatatccctgatgaacattgatgcgaaaattctcaataaaatactgggaaacagaatccagcagcacatcaaaaagcttatccaccatgatcaagtctgcttcatccttgggatgcaaggctggttcaacatatgcaaatcaataaacataatccatcatctaaacagaaccaatgaaaaaaaccacatgtatctcaatagatggagaaaagccttcaaggaaattcaacaccccctcaggctaaacacgctcagtaaactaggtattgatggaacgtatctcaaaatattaagagctgtttatgacaaacccacagccagtatcacactgaatggacaaaagctggaagcattccctttgaaaaccggcataagacaaggatgccctctctcgcccctcctgttcaacataggattgaaagttctggccagggcagtcaggcaagagaaagaaagaaagggcattcaaataggaagagaggaagtcaaactgtctctgtctgcagatgacatgattgtatttctagaaaaccccattgtctcagcccaaaatctctttaagctgataagcaacttcagcaaagtctcaggatacaaaatcagtgtgcaaaaatcacaagcattcctatacaccaatagcagacaaacagagagccaaaccatgagtgaactctcattcacaactgctacaaagagaataaaatatctaggaatccaacttacaagggatgtgaaggacctcttcaaggagaactacaaaccactgctcaaggaaataagagaggacacaaacaaatggaaaaacattccatgctcatggacaggaagaatcaatattgtgaaaatggccacactgcccagtgttatccccatcaagctaccattgactttcttcacagaattagataaaactgctttaaatttcatatggaaccaaaaaagagcctgcatagccaagacaatcctaagcaaaaagaacaaaactggaggcatcaagctacctgacttcaaactatactacaaggctacaataaccaaaacaggatggtactggtactaaaacagatatatagaccaaaggaacaagacagaggcctcaggaataacaccacacatctacaaccatctcatctttgacaaacctgacaaaaacaagcaatggggaaaggattccctatttaataaatggcgttgggaaaactggctagccatatgcagaaaactgaaattggaccccttccttacaccttataaaaaattaactcgagatggattaaagacaaacgtaaaatctaaaaccataaaaaccctagaagaaaacctgggcaataccattcaggacataggcatgggcaaagacttcatgactaaaacaccaaaagcgatggcaacaaaagccaaaattgacaaatgggatctaattaaactaaagaccttctgcacagcaaaagaaaccaccatcagagtgaacaggcaacctacagaatgggagaaaatttttgcaatctatccttctgacaaagggctaatatccagaatctacaaagcacttcaacaaatttacaagaaaaaaacaaccccatcaaaaagtgggcaaaggatatggacagacacttctcaaaagaagatatttatgcagacaacaaacatgaaaaaagctcatcatcactggtcattagagaaatgcatatcaaaaccacaatgagatgccatttcacaccagttagaatagcaatcattaaaaagtcaggaaatgacagatgctggagaggatgtggagaaataggaatgcttttacactgttggtgggagtgtaaattagctcaaccattgtggaagtcagtgtggcgattcctcagggatctagaattagaaataccatttgacccagccatcccattactgggaatatacccacagtattataaatcattctactataaagacacatgcacacgtatgtttattgcagcactgttcacaatagcaaagacttggaaccaacccaaatgcccatcaatgataaactggataaagaaaacgtggcacatatacaccatggaatactatgcagacataagaaaggatgagttcttgtcctttggacgggcatagatgaagctggaaaccaacattctcaggaaactagcacaagaacagaagaccaaacattgcatgttctcactcataagttggagtttaaggatgagaacacatggacacagggaggggaatatcacacgcctatcggggggtgggggctaggggagggatagcattaggagaaatacctaatgtagatgacaggttgatgggtgcagcaaaccaccatggcacttgtatacatatgtaacaaacctgcacattctccacatgtatcccagaactgaaagtataataataaaaaaataaagatacattttcttgcctagaaccttgcttctgctaagattactttcaaaagtaagatttattcgaagggtaagaataatgaactgtagtgataccagcattcccagaactatccgtggtagaagctaactggcatgtttgaagactgcaaggctctaggttgagcaaataatttattgtctaaatggagctacttctaagagtgaaggaggttgttaatctcactggagcaagaagcatacataccatcctggaaaaacctggacatagttggaccatcactagacagtccctaaaattctaccttttgagattcacttcataaggggtgagaagattttttagtctttaagaaacttatgttaaagtataagctgttctgggatctgtgacaccctaagccaatggttgatagccttccatgcacataaggttccccagagtcatttgttcagcatgtgggctcttggtccccactgtcagtcattgattctgtaagtttagggcaggttccagaattctgcattttaataacagagtagttctgagcacaactgagtaagcactgtcttaggtcagtgtttcccaaactatgttttcacgtgttgtgcaagatataaatacatgatgcaaggggaaaggagttctgcggtcaattactttggaaactttgtgttaaacctgttgtcttagtcatttccggctgctgtaacaacataccataaacatggtggcttataaacaacagagatgtatttctcacagttctgaaggctgggaaatccaagatcaaagcgctagcagatttggtggccatgagccatttcctagctcatagatggccatctttctgctgtgtcctcacgtggcactaggggcaaaagagctctttgaggccttttgtgtaagagcacgaatcccattcatgagggttctaccctcatgacctgatcacctcccaaaggacctaccttcaaacaccatcacatggtttcaacacatgatttttgggtggcatgaacattcagtccatagcacctggttaaacaggcatttttttgtttttaatgacagtgcttctaaaagtcctgcctcttaaagggactttatgtgggtggcattttacaagtttgagcatgggccctttaagagacactaacattttgaaatatgcagcattccaaggcaaatgctgctctagacacatacccagttctttctagatgattgcaatagctgagaccaaggtcctgcagaaacagtaccgagggtaggaactaaatctatggggagttgaaatgagactggcttagggaggtgggagtcctcatagaaacttcctaggggctgtactttggttaagcttcataaccatgcattgggtggcttcattctctcctctcttttcctgccgtgcctaggactgaagcacagttatagaattaaccctttaattctttgctttcgaaggtatgatctaatgagacaatgctggcgggagaagccttatgagaggccatcatttgcccagatattggtgtccttaaacagaatgttagaggagcgaaaggtaagtattaaagtcaggcaggagatctttaattggaatacctgatgtgcccagggtggttcataaaaaacattgaaataattgaagaagttcttcttggcatggccctaagtattatagaaacaaaggatgtccctccacccccgcgactttgaagaagttacaattttggggggaaataagatttctatacaagatatagtcacgtacacactagaataacatacagaattagcctattagagttggaaggaattttcgtcatatagcctgaccctttaattttatagatgaagaaacagactcagaagtgggtgacttgaccaaggacacacagcaagtagacaacagagcctgacctgcaggttactataatgagggtcaggaactccataaaaatttctagaagtaagttggctgtaccgatctgggagtcaaaataaaagtaaatacagtttaaagaaatagtcatcaaaacccaagtggtaattcaactagagatgcaggtgagatcacacagatgtgaaaatgagattcagacagaggaaggaacccagaagaaggaaccctagggaagctgaacacattaggaggtaccaataagacactgtgagaaaggcaagctcagaaactgaggatacagtatgaaatcttacttgcagaacgcaaggggatgcattttaggaagaaagtcatcaaatacaacagagggactgaggacagaaaagtatcccccaagtgcttagtatatgagttgcaacaaactaagaaaaccaaggtattgctgtaactgccgctggcagaggtggaatcaaagcagcctatgtctctgaaccattttcattcttccagacctacgtgaataccacgctttatgagaagtttacttatgcaggaattgactgttctgctgaagaagcggcctaggacagaacatctgtataccctctgtttccctttcactggcatgggagacccttgacacctgctgagaaaacatgcctctgccaaaggatgtgatatataagtgtacatatgtgctgtacacctgggaccttcaccactgtagatcccatgcatggatctatgtagtatgctctgactctaataggactgtatatactgttttaagaatgggctgaaatcagaatgcctgtttgtggtttcatatgcaataatatatttttttaaaaatgtggacttcataggaaggcgtgagtacaattagtataatgcataactcattgttgtcctagatattttgatatttacctttatgttgaatgctattaaatgttttcctgtgtcaaagtaaaatattgttaataaacctaacaatgaccctgatagtacaggttaagtgagagaactatatgaattctaacaagtcataggttaatatttaagacactgaaaaatctaagtgatataaatcagattcttctctctcaattttatccctcacctgtagcagccagtcccgtttcatttagtcatgtgaccactctgtcttgtgtttccacagcctgcaagtcagtccaggatgctaacatctaaaaatagacttaaatctcattgcttacaagcctaagaatctttagagaagtatacataagtttaggataaaataatgggattttcttttcttttctctggtaatattgacttgtatattttaagaaataacagaaagcctgggtgacatttgggagacatgtgacatttatatattgaattaatatccctacatgtattgcacattgtaaaaagttttagttttgatgagttgtgagtttaccttgtatactgtaggcacactttgcactgatatatcatgagtgaataaatgtcttgcctactcacgtctcatccaggagtgtgtctcatagctattgccacatgtccttattatactttaaagaaaaatcgtttaaattatccatccctagcacctagagtagtgcgagtatactccaccagttacggaatctgaagctcatcagattgaaaaggtctcctagaagtgttctactgcttatttctttttcttgcaacaggcagtacacctttgggagtgttccagtgtgaaccaagggcttagaattggaattccttttaattgtgttacaatgttaaataaagtcctcacacaatgtcattgataggtttgtggaaactgcagtactatgtagtgaaaccaattttaccatagagtaactcatagaaacgagatgctatccccatcaagctaccattgactttcttcatagaactggaaaaaactactttaaatttcatatggaaccaaaaaagagcccacatagccaagacaatcctaagcaaaaagaacaaaattggaggtatcaggctacctgacttcaaactatactacaaggctacagtaaccaaaacagcatggtactggtaccaaaacagatatatagaccaatggaacagaacagaggcctcaggaatgacaccacacatctacaaccatctgatctttgacaaacctgacaaaagcaatggggaaatgattccctatttaataaatggtgttaggaaaactggctagccatatgcaaaaaactggatcccttccttataccttatacaaaaattaactcaagatggattaaagacttaaacgtaagatctaaaaccataaaagccctagaagaaaacctgggcaataccattcaggacataggcatgggcaaagacttcatgactaaaacaccaaatgcaatggcaacaaaagccaaaattgacaaatgggatctaatcaaacgaaagagcttctgcacagcaaaagaaactaccatcagagtgaacaggcaacctacagaatgggagaaaatttttgcaatctagccatctgacaaagggctaatatccagaatctacaaagaacgtaaacaaatttacaagaaaaaacaaccccatcaaaaagtgggcaaaggatatgaacagacacttctcaaaagaagacatttatgcagccaacaaacacgaaaaaaaaagcacatcgtcactggtcatgagagaaatgcaaatcaaaaccacaatgagataccatctcatgccagttagaatggtgatcattaaaaagtccggaaacagcagatgctggaaaggatatggataaataggaatgcttttacactgctgctgaaagtgtaaattagttcaaccattgtggaagacagtgtggcgattcctcaaggatctagaaccagaaataccatttgacccagcaatcccattactgggtatatacccaaaggattataaatcattctactataaagacacatgcacacgtatgtttattgcagcactgttcacaatagcaaagacttggaaccaacccaaatgctcatcaataattgactggataaaaaaaaatgtggcacatacacaccatggaaccctatgcagtcataaaaaaggatgagttcatgtccttcttagggacatggatgcagctggaaaccatcattctcagcaaaccaacacaagaacagaaaaccaaacaccacatgttctcactcataagtgggagttgaacagtgagaacacatggacatggggggatgtgggggaggtgggcatcacgcagcggggcctcttgaggagggctagcattaggagaagtacctaatgtagatggcagattgatgggtgcagcaaaccaccatggcacgtgtatacctatgtaacaaaccggcacgttctgcacatgtaccccagagcttaaagtataataaagaaagagacaagagttaagtgtctgtagcatacagtacattatttcacttaagtcagtttccaagaacctattgagaacattgaggacata

SEQ ID NO: 15440 - DNA, 99304 bp, Human
  misc_feature (1)...(99304): n = A,T,C or G
ggcatcaactatatttcttaacctttgggccaaaaccctacaaacccatccaacctgctggacttgcttttcttctgaataacctaattctccaatataacctccatggatggcatagaaacaatactagggaaggtgagcaagtctgttgtaggtattttcagcatagttcttccaaatgtggacattagagtttgtaaataaaagatgttcattttattacaggaatcggaattcctattattctaaactcttaataatttcttgattaattgaaaactaagtgtaaggttttcgccaacttctaaactcccctggctgcatgaaaactaattcctttatcattcttcatatgacctattcaccaaaagttatatcttatgaaacgtatattatcaatatagttctctctaataaagcattaaaatccaaagttatatcctgatccactttggcgggggggtcttcaaacagtacagctctttgaataatgatcattttgtaatgtaaataaggtaatgatcacttattaatgatcactactcttaggcagcagaatatctcatgaagcttatggaacacggttatatgcaggaaatattccttccctccatatgctgcgggtggaaaaatttattagtggatacatctgtgggtccacaatacaatgctaagtgatgctcacttgagacaatgcttttttaataaaaaaaatccatcaggacctggtgcagtggggtggggtggctcaagcctgtaagccccccagcttgggaggctaaggcaggcggatggcttcaggccagagttggagaccatcctggacaacaaagccagagatgctgtctcttaaaaaataataataataattagtggagcgcaatggcctgtctgttgttccagctactctactagggagaccgagacaagaggatctcttgattgcccagaagttcaagactgcggtgagcgatgactgtgcctctgcactccagcctgggcaacaaagtgagctcctgttgcttaaaaaataacaattaaaaaaaatcaatcaggcatacattcaagaggtaataggatagccttatctgttatctaagggctgcatatccaagtaagggctacttcttcacaaggatgaggacaacagtattttgctcttataaggcagagaccctgtctggttcagatatgcaaaaatcactaattttgaatctctggtaaatttctttcaagatctgtaactctaagtaaatctcttaatataactgagtttcagattcttcatctacagaaggggatgacaaaacttgcccaggaatgtggtgagggccacatgagataaggcgagtgaaaggtgttttgcaactgtcaagttctgtacacatgttaattatgtaacagatgttaaacatagtattacctgtatgactatattgtcagtaattttgaccaatttaagcttgctcagaaagttcaggcttttagaaattggaagacccggagattaagctggatgtctgggttccaggcaaatggtgaaatgacagaaaatgtgttttgttcgctttgacccaagaaggtcatttgttgctctgttgtttgttgctagtggtcaaaagctgaccccaagcaatcccagctccttgaaaggttttttctttttgtaccgacactatcattcccgcccttcgtccccaactcctttagtcccctaaggagtgaggggggtacacatttctgctcggtaacccctccaatgcctgaaggggacgatgccgtgacgttgctctgtcgggacacctcttccctcccccgcccgcggtcgccaggttcccccgcggcccgctgtccccgctgcggccccgaccgggcgccacggcgcaggtccgcggcccgagcaggcgcgtcagccgagctcggcggtggcgcgggcggctgggacagctgccccgctcggcgcccgctgcacccttagcagccactgccacctgggcccggagcctccacgatctcgcccggcgattgtgggcaggggcgcctccgggtaagtgccaggagctccacttaggaggaggggacgcgggttggggcggcgacggtggtctgaggacgggaatagacgcctttgcggaaacagcgggtcaagcccggggcggcggagcgcgaggacactgcggcgtgcccgggaggacgcgctgcctgcgcgggagaggcgcgggccctggcagcggcagccgggtccccgctcggtggcgccgcggagacgctccgggtggagagatgcagagggccggggtaattaggaaacgcaaggttggccaggagggctccttgcgttgttttgtttatgaggatcctccagtcaatgcagctgtcccccttgaaagattgggggtgaggacagagcagagtggtgaatttctctgtttttcgaagcgttaggggggctcggccctcctttttgcgggggcaaggatgtgaaagtgggagaagtacctgctgctgtgggcaaggtgtctggaagcaggtgccgctgtcggatgggggaagggagcgtccaatgttgtgaagttgccagaggagaaccttgtgttgttgctgttggtctgatgagccccctctgttgtcttcaatttaaagtacccagggagaagcccctctggcttgcctggagtgtgtgtaaaagataaatatggggggaagaatcctggggggggggggggaagatgaaaaacatgacataaggagaagcaaatttctgagggtgagatgggaattaagttagcgttgaagaatatgacaggtcttttactctgcggaaaacaatgaaagagaaacaatttatggtttggaaatgaaggttgcagaagagtttgaacttctctagtgtaggtagaggcttaattattttttatttatcagaatctctggcaagaatatggttctgatttgagcatgaaaatgttattaaaatatggctaggacgataatttgaaaaaaatgtaacaacacttgttttatttcttgttgtagaatttctgaagtaatctttttgatgacaaatgttagtagcaaataagtaagaaagctttaaagctaacttaagaggcacctttttggggcaaaaaggtagcttgccaatgtaatgtgtttaaataaaaaaagcaatgaattttgaatgtggaactctttgatattaactttttcttttatctgtcttttttaatacttagaatttctttttctttaaaatacattatttttgaaaaaatatacataagaacttcaaacaatataaaaatttaaaaagaaaaagatacttccaaagtactagccgaagataatcattttaacgctgtgttaaaccatgcttccagatatctttctgaacatatttttgatatactgtgcaattcaatatcaatttataattttgtgtagctatagaatcagaaattttatacagtaacctattatatctcgttggcggtcttgttttctatgtgccattatttaaactgacttttactgctatataaaaaagactttacaactactatataaaaaatactaaatatgttgtgaagtattaccacataggactgagcaatgaggatttgatgtacaaatgtacttgccctttgggtagtaatgcttatactctttaaagggacagtcatatagttatcattttcttcataaatgtaaacattttcttgttctctcttgtagatcgatcttctgaaattcaagttttcaagatgaagtttttattgacaactgcctttttaattttaatttccttgtgggtggaagaagcctattctaaggaaaagtcttcaaagaaagggaaggggaaaaagaagcagtatctatgcccatcgtatgttcttcatgtcttatattcttatatggagaaatgttattgcgtgttttataaaagtaaggtggtttatgaagacacacatcaacaaaacttttcatatcggaatgtatatccatctgttacagagacagaaaatgatagggtgaggagaggtttagaatgtaagaattaattcccaatgttcaaggtggttttatagttttctttttttaaatcatgccatgggtttatataatttttatacactgtttacaaaagtagaaaaagtcactatttttttcttatgctaaatgtgctgtgcaactttaattggatactgatatactgtgttttgagcaaataccagttcaaaaagtttttttttaaaaaaaccctaaaatatttaataatattttatttaaaagtcagataggtaactgtgatcttaaggtcagttcatatgtatgcatggcaaaaggaaattcatatgatagatcaattttctaatttagtaattgtaaataggttatattaggagattaggatattttgtagaaagcaggtcattaaatttgaaattacttgaaaacacaaattctaaatccaacacatcccccacaaaagacaaagttttgtggtgtggagtcttgtttattttttttagatgaagtctctttctgtcacccaggctggagtgcagtggcacaattatctactcactgcaacctctacctcccgggttcaagcaattctcctgcctcagcctcccaagtagctgggattacaggtgcccaccaccacgcccagctaatttttgtattttttagtagagacaggatttcaccatgttgacctgtctggtctccaactcctgaccctgggtgatctgctcgccttggcatcccaaagtgctgggattacaggcgtggttcaccgcacctggccaagtcttttttttaataggaaagattaacattactggtcaatgaaagtaaaatagagcaattgtacagtatataagtaaacaactttctcaaaatataacgtgcttttaggtaataatgcaatatatgcagtgatttggaataaaagttaattttctattacaggtcatcttcaattaatatttctcaaatgtaatattgatcatagataacattttattccagcatcattattatttaaatagagattattatggttttacagatgttccataagagatgaggtacattttgggaagtatattttgtaaagaaaggacactagaattggtattttgtaataggtgtttgtatgaatttgtgagagtaaaattctggagagagtatcatgatccacgtaatgtctagcattaaattcagctccatgtgaagggatatttcctgattttcacccttaatagtcctgcttattctagtgctgcagcatattctgatgtcagggccaaatttctgggtatatgacacaatggccctgaattatgtttgtgtgtccctccttggccatctgcccagctggatatcagctgggaacaatggaggcaggttcaggaataaccacaatctacaaccatctcaactcttcactgttactgtttttgtgccacaagctggagattagcattttagggaactggacattgtcaggccttagtattcctaagcgaaaggacacttctttgtgttttagatattctttctattaccttttctttgatgaatgttgggacattaacacaaactgttgtctatgtcatatagtcaccgtaattctatgtatggaatcaagccatcttgggtttctgtatctgagcaagctgataaggctcctgttctcccagtacacccaccccccatcctacatcaaatgtcataatcaaattattctgaagatggcaacagcaaatcttataactaccatatatattacgagagtattttagaggacattctcttttcacaactacattattaaatagccttatgtgtagactgtatatacttacggtgtgtatagttatttaagacagattttcaaagttaaatttagtagataaagagtataacaataagagttctcttctgatgaatatgacatcttcaagtggaagacccaacatatacctgttaagcccacatctcaatattttagatatgttgagtaattaattgaaattttatctttgaatttttacattataggttttttaaaaataattatgagactagatcaagctttattaacagttgtgatgtgatgctgctggaagtctggcttgttaaaaagtggatgtaccttggagagttagagttgtatatttttcatttgagcattttattaagaattctgattgtcactgaattaagaactttagaagactagggttgtccctgactgtgattggatctatcatatcaaatttatttcagatgccttgattaagaatttgagctataataaggggctgtgaaagaatatgcaaattgtatgtatctcagagaatgatccagtttgcttagcctgtgtaagttgcttatttattaaacatcttgactaagaggaatattgaaaattacaaaacccagaaatcaagtacagactaccctaatactcctcaggatggtaaaattcttgcccagtgatgttttcatttgtttatacttttttttttttgagtagagtggatgaagcaatgtgggtgcatagacataagcagttcatgtgcagcaatccagagtgaaatcttccagttttactgttataacaacatttcccctcaagactgtaaatagaggaaacatgttttaaaatgtaggagaaataaaggacttgagttccttgatattctaggatttaatattgatgctgagcttgagtcagatcataaacttttcttggcctctttgctgtttcttttttctaacctgttgtcttttgatatgtaagtgaagcactagtaccagattgacaaagtatctgataaatttgcttccaaaaacttagaaatttaatatgtgttaacaaataagaaatacactttaaattaataaaaatattttaggtaagtccttggacagttacctttttattttacagcttacatttgacattgcctttaatcttttggtctttcctctgatttttcattctacctgagtgattttgtagaaatccatggttgtagttaccatctactcactgttaactcctaagtctttatgtacagctcagatctctctaaagagtgccacacccatacatccaccatttcaacttgaccgtcccgtcatgaaactcaaatttaacttgaaatgataaaacctgaactcagaatcatgtgaataatacaatgaataatcactgtattaagagtggtgaactcctcttctcaccagatgacaccatttccaccttttcattcatactacaatcctggggatcaccttagaccatctctttctaccttagcttctcaaattcagtagtcaccagaactcatcaattactatcactggaatacgtcttacgttttcattcccatgtgggacattgccttagctactccttcccaccctcttcattgactccttttcagttttcctgcatcttatcctcctccattaatttatatgccacattgaccttaccgtgtattttcccaatagtgtcttgagtccagtcaggtcatgtcaatattgagaacactttaaaggacaccatagtgttctggataaggtggaaatttcttggctccacacacaaggttcctgatgaactagcctctgatacctccagcagtatcttccccatcccgacccctgcctctgcctaagcctcacacgcatcaactctcatatacccgtgctctttcacatctctgcaagtgttcttccctttccctgaaatgccaatgtttttcttctttttagttagcctgtgtccatgggtctcatccaaattcatggctgtaactaccacttactgttgatttctatgtctgtatatacagcccgtacctctttgaagagcaccacacccatacatccaacattttaatctgattgtttcataatgacctcaaacttaactcagactcaaaccctattgtcttctttgggaaacctttcctaatcctgaggatttagataatcacattctgtgcccccacagttccccaattgccactcatacataatacagtatgataattatctattgtaattgtctgctttccccactagattgtaagctccatgagagcagtgtcttcattaccttaatcaccagcaagcaacatagctcctggcacaaaatatacatataataaaaatttatttaatgaagtgaataaaaacctaaagatctttgactatctcttattaagtcattacatctggattttgttaagttacctgaaattgactgatatgatccctgtggaaaatttagaaatatggtctcaatataaggatacctaggtgagttagcagctaggtaattagtggaataccttcaccctggattatgttacctggttccgttttggcctcatcatagtcaattatttgtcaatgactgaaataaaactacacagagaaaaaatccacactgaggctctgtgatattcagatatgtagtgaatatgtgagacagaattaggatccgatctgatcttgaagggctaaatgagataggtctaacactgttgaagaataaattgcactttggtctagaagccacttgggtaagtataggatgaggaagaacatagcttagcagagcacatttgggaaaaatattacataataattatcagacaaatgaatagtgttttatatatatatatatatatatataactctctatatgtgtgtgagagatattgtgtgatatatatacatatgtgcgcgctgtgctgtgccttctcatctctctcccaggtgttctcgacaaaataacttatgacgcaggaaatctgtctccgcacaaccctctacaagcacaaataaacgcaacagaccacannnnnnnnnnnnnnnnnnnnggagattgtcgatagcactctcgctctaagccgtctagagtgcgctctagagagataggcactcacacactgatgcgcatgtgtggatgattgtgcgagctctctctcaaaagctgtagtgtgtgtgtgtgtatatatatatatatatatatacacacatacttacaatttagtattttaagaaagacattcttaaaattaacacattcttaacataaaattagtaaaataagaactattttaatagtaaaactattttgctaattttatgttaagcgtattactttttagaactatttaaagcaaggtttacagagatttctgctctgtgctagtgcagaaatatttgcaggagagagaaataagaatagtagaagtaattaaaatcatatcatattaggaagagctgaaggaactgagatacttgaaaattgtctccaaagttttaaaaaactgtgatggtgatgagaaagtagactttgttgcttggcaccaataattaaaagcagtactaatgtatagaagctacggggagggatatttttggctccaagttaagaacttttttgagttctgcctagatgtaattgattagggagggaggtagtgaagttcatgataagtggaggtacgcaggcacgtgggataattacttggtgggcatattttagagaaaggttgagcattacacaggcggttagaccagagactgatataatgtgatttcaacttgtgcaatttttaagattcagtggttctaatacattgtgtttgattacagctttatcattatctaatagcaaagtaacccacagagaattatgttttaaaaattttatcttgatctgtttatttaagtatgtctttattttaggggaattgacttagaaagctctagtacataagataaatgtatgttggtggtgtgttaataataaggattttaaaatcttatttttaaggtttgaaatttcatgaataatgttttttaaaacacttctttcaaacccagaaaaacttttctcttttctgaccttaggtgtaatagtaagaagaaatatgtcaagctactataattttcaagaaataatgatcaggataacaaatgaacaggataacaaatataatgatctaataaatgcctgccataatttataaggcatagttttatggatttatatttgtaggtacatcatatatgaaactagaacatcctaaaataaactttcagatttttttattgaataacagtaattaaaaaaccagaactccctcaattaaaaataaaactgaatattgtttgccatttctatttttgctcatagccgacataataagcactttttaatagtgaatttggccaagctatacaactccttgtcacatactacatatttttgccactaccgttagagaaacttctatcttttgttgaagactgtttgagtttcaaacatttaatagcttacagtaagtgaaactaatatgtttgaaagttgcattggaaatctcacctcttttctcccattttggcccatacttgtatcttaggtctgggaagcttaataacaagtccttaagtgttgagggctgctattatttacagtagtgttagcatttattatcctaccttctaaattatctttccttcaagctgttggaactctagctttaaaataattacataaataacttttaatttttattctcgttctgtgtgtgtgttgagaaaatgtgatttctttgttagttttttcataaactaaaaattgtgtgtgcatatgtaaatggtttgatgccgttatgattttttttgtctccttcagagagagattgtaccattgaatgacagcattttcatacttcagtctgtatgtactaagaagggtaggttactgttgattattcattgattattcaatgccactatatgctgcttgggtattatattagccatcttcctattctgactgttttgtctcctttatcttctattcattaagagatgaaatagattttagtataattccagtttcttacttcctagtggaaatattcgagacaaagacattggccaaaagatgaaaggctgattggaaaaggatatggataatctataaaatggatactattgaaaattgcctgttatcactgttacatatctagattgaatttttcactgatgtttagttatgtattttcttattacttattgaacaattttaatggcatgctgttattttgcaatcaattgaattgatcttctttttccaaaaggaaatcagcatccttattattccagttacctaggcatgagcttaaatggaacctaacattctcttaaaatgatctcctatatctgccatgttcaatttttttttcactacatctgctcttaccattattttattttcctctttggagacaggatctaattctgtcatccaggctggagtgtggtgttgtgatcatagctaactgccgcctccaactcttggcctccagcaatcctcctgccttggcctcctaaagtacagagattccaggcatgagccaccatgcccagccaccattatttttaacgtatgtgttactatatcttcctagttattcaccctagcttttctatcattattatccatcttaacatgccatctgtattttcatcttttttttggagatggaatctcactctgttagccaggctggagtgcaatggcatgatctcgcctcactgcaacctccgcctcctgggttcaagtgattctcctgcctcagcctcccgagtagctgggactacaggtgcgtgccaccacaccctgccaatttttttgtgttttcagtagagatggggtttcactgtgttagccaggatggtctcgatctcctgacctcgtgatccacccacctcggcctcccaaagtgttggaattacaggcgtgagccaccgtgcctggcctgtattttcatgttgttattcttatgtttaaaaacttacaatatcgtactaccagatggttcttgaactccagtacatacttcttaccttgattttcaaggggctccctaacttatatttctaaatttatgtgaaacaactctcttatattatgtgtgtaggtatgtatatatgaatgtatgtttttagagacaggatcttactctgttgcccaggctggagttcagtggtgtgatcatagctcattgcaacctcaaactcctggtgtcaagtggtcctcccgccttgttctcccaaagacttcgcgttacaggtatcagccatacccaagcctactcgcctattttgggaaggcttatctgccgttgttcctaatcttcccttgctattatgtatgcttggacatgtttatgtttggaatgacaacttcttgcttaatatatctaggctttactagtccctcagagctcatcttagatattactttgctttataaaacatttaaaataagttttagttgagaatatgattaatctgaattaatagtggtgtggcttactaatgctttgatgtcttggatattgatagaaatacaatgtttagaaataaaaaagtattaatctcatggtgagtatattacctgaagcattatgttgaattctggttgccataatttatgagagttagaattacatgtgagtttgtttggagaatcttgatcggtatttacacgaatgtgaaagtctgttgtgttgttcgattaattctattgtgcattattttctctgaagaatagaaattaccttctatttgagatgttgtcatataaaataactagactttctttgtatgactccaagttatcgaattaagaccaaagagagaaacagaggaagataagttcaattaaaggaaaatatagaactgtcaaaagagaaaatgggtttccttaggagcttctttgttgctggagtgactgaacatagcttgggtagggacacgacccaaataacatcaatgggaagttaaaagtatttagaacttctttttatgcccaagatctcatgggcctatgattaaaactgaaattaaactccctgttcttgatatttcagaatcccttttgtgcatacttgatgttttgacacttgattagaattagttctttatgcagtgatgtcttttattttctagttggactctattgtgtagttttaactctctaactacattttaagtacttgagatgaaatggttatatatacttttatatcctgccctacttcaaaattgtttgcataagagctccatttatgcttgctagttcaaagaaaattaaatggatagctgatgatatagacaaatcctaaattaattttttgatgggatagtggttcactgggactgtatttagatgtttagagataaaacatatattgtttaaaatttactttgtacgtctactaaatcatgatggcaaagaccttgtataataagatagcagaaagaacaccactgtatctcctttagcacttttgctaattggctgtataactttcaataagtcacttaatctatctgagtctcagttttctcatttgtatagtgaaaagtttgatctcaataatctcctaattttattcattcattaatttatggcagccatatcttttatgatacaatgcggttttgtttacgattgctttggtaactttataatcagggttaactattttagtgttttgttggtgctttttgttccccaatttttaaccattcaagcctgaccagtggaaaaagaatacacaaaattctatttcttggggaagttaactccaaaggaaatctaattccagagttgatttatcaaaacataggtatttaactgaactccaaagtagaagagtaaggtatgaggaaggtgaattgtctgcattcttagcctaccaaattttcacagattaaggaattcgacttactgaaatgtatccttttttttttcttgtggaggcaaataatttctgtaatacagtaaaaaaaggtatatttgcaaaagtctcctatattttccttatgcttctacctgaaatagacatatcattgctctgctaaagagagctgaggtccctttataaatgaattcctttaccatgggtattttatggaagtttacacttagaattcatgaagccaattattcaaatttatgtacatacaaatggttcctctgagaaatgatgtaaatatgaaataatatttttagggctctgattggaataacagtgaagcacttattaaattgctaataaaatatgttggataccttgaaacatctgacatttattactcttcgtataagaaaacaatagtaggagtttactgctcctgggctgattgctgagaataacctaatacaaaaggcttacctattaatgagtggatgtgtggtgttctttatatcatgtttaactctcagtgataccatgggcatggctgacaaaataatctaaaggtcttattgcaacattctttaatattctctatacattctacttgtatgtgtctggaatctctataatattttcgacttaatggtacaaatgtagatgttttcagtgatctagaatcttggttgatttattttgatctagtcttggctaagtcttcattttggttccaaattcttttccttacccctcagaggctctaaatttctctctccacattgtttctgtcttttatcttgttcctttcagtgttagcataacattttaacttttattttaaaggaaaagaatacaagtccttggatgggaatcccctcggtctttcttgattttcattctaaagctacctgaggcatcatccttccttttctccttttctcttgatttagcaaaaaaagaacttttttaggatcccatctccccactgtcttctgagatgtaccttttagcttactttgctcccctatgttttaaattttcttcgtttctttggctctttttttcctaagtgcttacaaacatattaaagggtcacccacctggaaaaatgtatatagtttttatattcctattttattaactgtggttttcccctttgttaattactatgtttcttcaactagtaggataaaatggcctatactttttgagctctaattcactagttcttttcttcacttaccttgaatttccttaaattacaaaagatgtgcaacattattacaacaaatgaaacaatatgtaccacttaatcattctattaagactgactcctgacacaattctacttttaataaagatttcggctgggtgccatggctcacccttgtaatctcaatacttcaggaagccaaagtgggaggatcacttgagcccaggagttcgggacaagcatgggcaacatagtgagaccttgtctctacaaaacattaaaaaaaaattagccaagcatgggggaggggggacacacctgtaatcccagctgcttgggaggctgaggtgggagaatcacctgagtccaggaggacaaggttgcagtgagccattattgcgatcatgctactgcactccagcctgggcgacagagggagaccctgtttcaaagaaataagtaaatgaagatacgaattttattattttaaaacaaatatagtgactttattttaggtccttgttattactcagtaagggctagctatcttctgtaaacggaaacaatctccgatttcacccatcccacatgtggcttcctgaaatttactcactcctggctctttttagccacctctctgactacagctgattaaccaccttcattggctatttcttattgtccttcctgacatattgagttttccagatattcatccttagttcttttagcttcttgcttatcaattttcccctgggtaatatctattggtatctatgattgcttctatatctttatctctatatgtaacttcactcttgatttccaagtaattattttcagcttcctactggacctcaaaattaacatacccaacatattaaactggctttcctatctgtattccccagctctacacccagcctttcatgagaaatgacaaaagcatcttcaaatccttcatgccctttcactttcatcatctcatcaattactcattctgttgatggtttagaaatgattattgcatctagctacttctcctcatctctgcttttatggtctctgtcaggccatagtcatgtcaccttgaatctgttattgcagtactttcctagattcctgaacctgatcctgtcctctctactttgctcatcctctacaacagtggatctcaaattgttggtctaaggtcccctctacaacctagagcatgtttagggacacaaagagctttagtttatgtggcttatactattgaaattaccttattacaaattgaaacagaaatttaaaagattaaatcacttaaaataactgtacggatattaacatgaataacttatttttatgaaaactacattttcaaaaagaaaaaaattaatgaaaagtggggcattgtttaacggtagcaaatcagtttaatggctggtttaatggaagacagcaggattctcttatctgcttctgcattcagtttgttgtgatatattgttttggttgaagtacgtgaagacattatgacttcatgcagacataaaattgaaaaagggaagagtattttaatggccttgtaactgtgaagattcttctttaatgtcatgccaaaatttaaccagtgctagtttcttacaagagaggtgcaatgtgaaatctgaaatcagatcattgaacattttgtcctctgttgcagtaaaatcaactagtctgtcttgcactttgagtggttcttttgtccaattgtgattgattttataacatcatttggaaaatactgattctctgggttttgcattttttccaaatgttgacatattttattatacaacatcaaaaaaatcatatctatctaatatcacttatgatctcattggaatgtctgtgagtgttggaaagctgtcaaactcatggtggctaatattaattttaagattccaatttttgtttggaagttcatattttatcactggcaacaaatagagtagtgtttctcaaagttacaggttctcttcattcacttttgaaaaatattttcctaaatattcaaatctgaattaccacagtttttctatggtgttgcatgaaaatggcttttcatggaactattaatagatagttcaatctatctattaaatctattaagttcagtctgtctagtaagtcaaacaatcactctatctctacatataactacacttgtaattttcaggtaatgtttttgaaacgattataatagtttggcgtgcagcacaatgatttatgggtactctccattttgtcatacaacattaaaaagatgttaagtttcaacatttaataaaattaatattttttattaattcttaaggaacattgcttaggaaactgtcttttaaaattcttgttttttctttctgctactatatgatgttgaagaatgcaatggctgtgagtacatttaagtattattttcttgatttgtgctaaaacaccaacagtttttcccaccattgctttggtaccatcagtgcaaatgtcaacatagtggaaaaaagtaaataacattttattattactatgataaaaatagttttgactctgtggacagtaacagaatgtgtaacactgggtaacactcctcaaagtgttgtccacagaccccctgcaagtgttttgggtaccttcaggagcctgtggctgtggaccacactttgagggctgttactctatagtgtcaacgtgagtgatgctcagtgtatatccaatcacttacttcgttgcttgtgacccaccttttctcttttcaattctgctctgcacttccagtatcttctcctgccatgctgcacttcttggtgttcctgggcagcctgatctcttcgtgacactattctgttgtctattctttaacttcttcctagggtttgtcctgtcctttcccccttaatctgttacatccctccttatccttctagtcccagctaagtcaactactctatgaactccctgccattaacactatacaaaatcaaatgctacaaaaaatcaatgatgataaatttaaggtgaaattggttgaattaatatggaggagaaaatattggactgaaaattcaggagatttgtgttctagctgactgttactgaccaatagtgcatcctcagataattctttttgggataagtgtcctgatctttaagataaaatcattaacaatgtgatttcttagggtaattgagataaaagtttattctggggtttttaatagatggaaatggtatttttgagtaaaaagagataggttctactttagaatagatcacttaatacatttgtgacctagaataagcaatcagtttgcttctctaagactttatctgtaaaacagaaataagaatctgtacctattcacacagcttctctgatagtataatttggaattatatgtaaaattattttctaactgtaatattctacaagttggattacctatgtttgtgatagtagaacctctttaaagagttcaaagtggttttgcatgtttactattactcttggtctcgtttttatttttttgaccattagttaagctaatagttaaatatagaacacctaattatggggaaaatatctgggtcaccttattacacatagctttcctcataaactcagagtgttaggtctgggataggtaaaacatctgtggcatgacttctttatgtgagagttagtgccagatgcttgtcacatgggaggccatcgacttttcacaatgaatctgtactgcaagcagcatcattcagcgttcatatataaagaacgtaggatgtggagagtgtttgtatagctttcttaaggtcataaagtcagtcagtagtagtcaggtggttgtttgaagctaactctttagttgtactgtacctatcagagtcctccttgtttatttggaagtctcgaaaacagtagtcacaaaaggtagtaaaatggctttcctaatggcctaccgctagctagtggcagatttggcagttaaacttcggtcttctgcttcccattccaagttttttcattaatgttcttgccactatatttatgtttagtcattaccctctccagtgggaacacatttttcttcttgattgtcacttagcctttgaatatctttgccattttcaagcaacatattgggtttacttatggtcttttacatacatttaaagtttattaaagttctttctaaataatagaatgctactttctgagcacacaatctgacaatcttccctttcatagatgtgtgttccaccacctaaaaactagtccttagtttgattaatagtatataatttggatgttagctgtcaatggacattttgtaaataagaaaccattcctaagctactgtagtcaggagacaatatatgatttatttcctttccatgctgtatgtatgcatatgtattcatctaataagatcacaaacacttggctaaaaagaagcgaagtataaaatatatagttctggccaggcgcagtgactcacacctgtaatcccagcactttgggaggctgaggtgggctgatcacgagatcaagagatcacgaggtcaagagatcgagaccatcctggccaacatgctgaaaccctgtctctactaaaaatacaaaaatcagctaggcgtggtggcacatgcctttagtcccagctacttgggaggctgaggcagaagaatcgcttgaacccgggaggcggaggttgcagtgagctgagatcgtgccactgcactccaggctgggcgacagagcgagactccatctcaaaaaaaaaaaaaaaaaaaaaaatacatggttccccttggctctgctttcaagggataaaaagcaatagagtagttcttcagagagagaaaagtgagttatcttttaaaccaccgtgaaaaatttagatacaggcatttactttctcatatagaatattacatagagacttagttttaactgatcaaagattataatatcatattttaattgctttatgcaatctctctctgtctttctgcctcaatctgtctatgcatgtgtttgctctctgtatatgtgacacacaaataattaagcacaagtttttttgggcatttatttttaaacctttttgaagtatgtataatatgcatatagaaaagtgcaccaatcataagctttaataaatgttcaccttggtaaccagcacacggatctagaaacagaacatgtccaaaacattagacatcactttctttccaaattactcattgccaactccagtgattaccattcagtaaattaattttgcctagtttcaaactgcatgtaagtagaataatccagtatatatcttttgtaactgcttcttttgctcactaactctgtaagattcattcacagtgttatatgtaacatcagttcattcattgtcttgctgcctagtattccattatatgaatcactgcagtttatttttctgttttgctcttcataaacatttgggttgtttccaaatacacctatacacacataccaataaaaagttgttgagaatatacaaataacttttaggcattattaagaaaaaagcagacaacctaattgaaaagagagtagcctaaaggccaaaagagggtagcctaaaggccaacaaaaatttgtaaaagtggtcaacttcatttgtcatcaagggagtgcagattaaaatcatgatggtataccaatacacacccaccagaatggctaaatgaaagaagaagagaatgtgaagaaccacaatgctcaaatcctgttagtgaaagttcaaaatggcataagcatttggtaaaccatttgtaagcatccgctaaaactgaaaatccatatactctatgaaccagccattctatttctagtgtatacagtactcaacagaaatgtgtacatgtttaccaaaaaaatacgtacaagaatgtttacagaagcactatctgtaattataaaatatatttattttgtcacacttagaagtgctttattgattcaaaagagtcaaaaattttcacactaaaataatattcagcaccacatagattggagaactagaactttggtcgtgctgatctacattgagttggctacaggaaggccatggagatttatagaggagtagtatttcagggaaacaggtgtcaaatacaaaatttctatggcaggctttatgtgttcaaaccacagcacgtagactaggaagagggtgaactatggaaagagtgatagatatgaggtcagaaaggttgtaatggctgaataatatgtgccttggtaggtcatcataagagtgattcccacgttttgtgcctgagcaaaaaaaaaaaaaaaaggtttttatttactgagatatctgttaaaaactacaggaagagtagataggaaatgaggggaaaacaagagtttagttctggatgtgttaagtttgaggtatccattagacatcaggagaaaatatccaataagctgttgaacatagagtcagaaattccagggaatagtctaggctggaggtatacatttaaagagttgtaaattatgaaactagatgaggtcacttaaaaagtgacttagctagaaaagtaaagatatctgagaagtgactgggaatgaggttgaagaaatggaagaacaggtgaaggagaatgaggacatggtgaaaccctatctctacaaaaactttttttaaaaagacataaagctaggatcatgtctgtctcttgcatattgagggctctctgtggactgatatgaactcatactggagaagtaaaagccggctgtgactgtagggtagagcaaatagatcagatcagagagggctgccttggaatgggagtggtttctgtctgaggaggaaaagtcatgctcgaatatttactgtgcctcagatgtggtcacacaagagaccaccagacagcatgagggcaaggacaagtggaagcactggcttggagctcacaacataggaactttgcctaaaagggcctaagtgggtagtggaagcccacagtgtggactgcagaatgtctggggctgatggctggaattgggagtggccagttggagaaaagtcacagtcctttcctgggaattgaaattagaggagctcaaagaggggattttgagaaaaccacaaggatattataagctagccaggcaggggaacagtgcaaaagccaatcacacccccattcctcggcaggcttccctgtctggggaaggcctggctaggaaaggagaggatatcatttttaaatcaagctcagattttgattgttggacatcttacttaaggaagtgctaattttagtgagactgaaagtgccagggggtactttttattatctgagagtgacagaaaatgttatgagatttgctggagatttcatccaggtatattggatagtcttatctcacagagccagtttggataaatgttgtgggaaaacatagaatttctttataattgaggcctgcagattctagcttattcaataaaaagttacattggtttccaaacaatggtcaagagggacaagaagggcttatctttcaatatccagatgccaccacatttatattacgaggtggcagtttatccctcagaatagcattcatgtttgttgcctcctatagcctgagtgggatctgtgcccaggacacataccattgttcagatgtgttggcctgtgaatatttcaatgaagatatcattcaaattcaacagagatagtcttcttgtctctgtattacaactcattttacacataagatattatataaagagaagctgcagaaagtagttaaagcagaaacaggttacatagcaggggtggcctttgaagtcttttcactcagtttattaagtttcctgacaatagcaaaaactttgttatcccaaggcattgtagtgtgctttgaggtaatttactcaaggagctgtgatgcttaaattatttgtttcagttctcaatttctgctctgacttttctttgcttaattccttggttttaagttttagtttgtagtagcaataaactgccctcctttcattgacttggtgccataaatttctagagcattaaaattagagtaatgatttggaaaataagatagatgaatttatagtgtgtggatatatataagaaatcgagatattgtgtgtatttgcttagccaaatcatatattgataattttcaactggtttggactccattagattttttctgactagttttcttattaatacttttgtaacattgatttctctttctctacatgtggcataaaataggttactgtgaattggttatcacacaaagtgttagatgccactctatgttcgttacttttatcgcctaatttaaatctgaaaacagatgttttatgaagaagtgattttcgagaatgataataaacacctatgtattaactccccagcctaagaattgaactattattcttgcaattttaagtatgagagatacaagtatagaacaaatgtttgcttataaattacaaaatttgtttctattgcttgagttaatggaaggctttgatgggctatgtattagggcacccaaatttgtccacctaattttttccatgttttaaaaaagttgagttccaacattcagcaaaatatataaatcttaatggtatggttaatgactttttacatacagctcatgaatccaccacccagacaaacaaatagagcatttctagtagtcaagaaatttcccagccgggcacactggctcacgcccgtaatcccagcactttgggaggctgaggcgggtgaattgcctgaggtcaggagttcgagaccagcctggccacaatggtgaaaccccgtctctactaaaaatacaaaaattagccaggcatcatggcaggtgcctgtaatcccagctccttgggaggctgaggcaggagaatctcttgaacctgggaggcggaggttgcagtgagccgagatcctgccactgctttccagcctgggggacaagagtgagactttgtctcaaaaaaaaaaaatgaaatttcccatatgccctatcctagtcaatacctccttccaagtgttaattactgttctcatttttattgccttagattggtcttgcctcttcttgaccataatataaatggagtaataacaatttatactcttttgtatctagattcctttcttcaatatcatatctgtgagatttcatccatgcttgttggtataggagtagttcctcccttttcattgctgtgtactatttaattgttatgaatatattatactatatttatcgattttactgtcaaatgaaaagacaaatccaaacttaggtaaggagacattatttgaaaagacttttgcaatagggagaatgctctgattgtaagatctattagcctctccaaggtcagaaagggcttctcttttatagcaataaatgagtctggaaggaaccagctgctggggagtgggatgagcaggtaccatgatgagacagtttttctttgctataagctgattcttaggaggggccattaaggagagttagccctttgcaaacaaggatgataatcctagaaaatcacttttttctcttcttttcttttctttttttttgagatggagtctcgctctgtcacccaggctggagggcagtggcatgatctcggctcagcaacctccacctccctggttcaagcaattcccctgcctcagcctcccaagcagctgggattacaggcatgcaccaccatgctggctaattttttttgtatttttaatagagacggggtttcaccatgttggccagactggcctcgaactcctgacctcaggcaatccacctgccttggcctcccaaagtgctgggattacaggcatgagctaccgtgcctggctgaaaatcacttttttcataaaaggagaatgccttccggtgactgcttaacctcaggggcaggagaaaattgagggacatgtagggaagggagaaacctaactaaagtttggtcaagttgagttagtgaacatttagttcagattgatcagtgaggacaaacagctcagctactcgtttatgagacaaagaagggacgtttggaaggtctgtgtctggtcttatcataggcaagcaagggggtcatccaggggtcttgtctaggtcatatggggcagggtagttatttacagtaaggtgcttcctgtaacatgaagactggagttagtttttaaccattcagtattctaggagttcaggtgaagttcagctgttactattgaatattcataatgttttcagtctggggtcattatgactgaaggtgttattaactttttttttttttttcgagacaaagtctcactgtcacccaggctggagtacagtgaaacaatctcagctcactgcaacttctgcttcctgggttcaagtgattctcctgcctcagcctcacgagtagctgggatcacaggcatgtgtcaccacacctggctaatttttgtattttcagtagagacggggtttcaccatgttggccaggctgtctggaactcctgacctcaagtgatctgcccgccttggcctcccgaagtgctgggattacagatgtgagccactttgcccagcctgttatgaacatttttatacatgtattttgttggacataaacattcatatctgttgggcacatatccaagagtaaaattttttgtatcataggatatatgtttgttgaactttagaagatatggacagttttcaaattatactcccatcatcgagtctcagttgttccacttccacataataacttgatattattggtaatcattttaattttaaccatcttctgtgagtataatgttatctcagtgtagttttaatttgcatttccttgatgattgatgttattgagcaccttttcgcctgtaaacttatttttcaaaatgacttttcaagtgtttgcctactttaaaaaatgttgattttcttattaacatgtaggcgttctttatatattctagaacaaatcatttgtcagatatagacactacaaatttccattctttttatgcattttaactttcttaacagtatgttttgatgaattgaagaatttatttttaataaaatctgatttgttactcatttttaattcttttgtctcaagaaatctttctctacttcaaggtaatgaacatcagtttattttgattatttttgctttattactttatatttcacatttagatctgtaatccatttcaacttgcttttctatatgatatgggatagtgttaagactcatttttaaaataggcatatccaattaatacagcacatttattgaaaaatcctgtacattactagtaaattgcagttatgtctttattgtaaatcaattatttgcttctcttttctgcctcactggtatattagtttagtcttgtgccagtaacacactcccctattactaaggctgaatgcctagtagggtatatcctgttctagtcttgttcttctctagtattttcttggctattttaagtcctttgcattttgatgtatattttagagttagcttttccattttaatacacacagaggtaaaatgctggggctttcactgacatagtatggactcaattatttctaatttgtattcaaacattaaattaaaaaaaaacatggaggcaaagcaaacagaaaccagttgggaatgtagacatttactttcagcttggaataatcaccttttcataaatgtggctagatctgggattttggttatatgaaccttagcaaatacaaactatgacactgaatagtacactttgaaaaatgagaactaggaaatttttggtgcccaccctgtggccaattactgttatgaatttggggttgaattccatgaggtcaactgtttttgtgggttttgtttgccagtatttttcctgggctgagagaaatgcctggtggtagtagacacttactaaacatttattgaatgaatgaaggtatctacatgtggcagtcttcagactgtgtagttctaagtatgaattctacaagggacaaataatttcaacacttgaaaatttgcattcaaagaacattttcccccaaaagcagtgttagaaaaatgcagaaaattacaggtgatagatgatattaatcattcatggtattaatcatttactaacagtactgaatactgtatcataatatatttaaaataaattttaaaagcagccacattaatatataacataaaatataaataatatatttttggtgacctataatgttctgaattgttctaaaatacaatgtagtatattccatattttatcttctaggtgttcatgcaagacctcttattttctggcagatacataagaacattgttctcagtttttaacttgaaacttttaaggaggaaacttaatctatgactcaatcttccactaacagacacgcaatctcccctatattgccatttcactccacttctcccctccttacaatgagaaagttctcctttgtttcatctaagactaattcggatgagatttagatctcattgcctactgttttgtggtgaggggggacctgaaattggggttaactttttcgagtttttccttcaactgcatcttctgtagtatacttaggttttctattacagtctattaaaaagagaaatgccaacacatttcttaaccctacacccatctctagttttcactctgtctttctccttttctagagtccatagagtcaaacttgttttttttttttttttggtgggggggagggtttggggttgggtgggggcggttgttaaaaaactagatgtattttattaatttttaaagttgaaatatttagaactacattcattgacatttcatcctggtactattcactttttatcgtgtcatgtgccagattctccttagcagaaagccaagaatttaaattgtgttttcaagtaatagctatgcaaacagttcaaataataataacccaattggttcagtaaaaaggtgccaactaatttttaatggatttttttctgtgctaaattgagcaatagctcaaaaagtcatcatgttgtatgtatacatacagtgtggattgttttgggaggattatcactagaggttgttttattttaaattttattatggcaagaacacttaatatgagttctgctttcttaacagatttttaaattgtacaatacagtactgttaactataggcacatatctagaatttattcatcttgtataattaaaacattatacctcttcaatggcaactccccattttccctacccccagcctctgcaaaccaccattctgctctccgcttctataggtttgacttttaggtaccttatataattagaatcatatggtatttgtcgttctgtgattggcttatttcatttaacattatgtcctcggggtttatctgtcttgttgcatacagtaagatttccttctttttaaaggctaaataatattttcttctattataaacttaaaaattacacaatatataaatttagaaaggagacctttattttaagaaggagattacaatcttcaggcaggaagcacagcctccagcttaaaaaaaataaaagcaagtacttttgatggagggaaaatcgagacaggaatttatgctgaacaggttggccaagtatatatattcagcaggctgtgggaggaactctgaatattcatgaaaggaggttgtatgcaagcaaacatgttacatgtatcccatgttcaccttggggcggagacttggcatttaaatgtgttacaattaggttctctatgtcaaaaggtgaagtaggggctgggggcagtggctcatgcctgtaatcccagcactttgggaggccaaggcgggtggatcacaaggtcaggagtttgagaccagcctggccaacatagtgaaaccccgtctctactaacttgtgcatggggatgcacgcctgtagtcccggctactcaggaggctgatacaggagaatcccttgaacccgggaggcaaggttgtggtaagctgagatcacgccactgcactccagtctgggcaaaagagagagactccgtctcaaaaaaacaaaaaaaaaaaaaaaagaaagtgaagtagggacaatagggacacaaaggcactcaaatgctcagcctctgtgaaactgcccaaaaccagtccatggccagtggtcttcttatcaggagaaagttgctgaaatcagtctctcgtccaatcacagctgtagttatggcttgtggaacagggggtcagttagtcaatgtctggtggtgagctgcagttctttaattgtgcttaccttgaggccagtgcttgtttagctgctaaagaaaagttaaaatcttatggcagttagaacatagtttatacttcaagcatagttctacatttcttaactcttgcattgttctttctcaagattgtttggctgtttgggatactctgtggtttcacattaattctagaattgttttgtaaaaattttctatatgaatttccaatgggattttgatagagattgaattgatctgctgatccttttgggtagtatgggcatttaacaatattaagccttccaacccatgaacatgggctgtctctccatttgtttgtggctttaatttctttcattggtgttttatagttttcggtggacaagtctttgattaccttagttaaggttattcctaaatattttattatttttgatggtattacaaacggaattattttcctaacttccttttcagatattcattattggtatatagaaaagcaattgatgtttttatgttgtgtcctggaactttactgaaatttgtttatcagttttaactgtgtgtgtgtgtttgtgtgtgtgtgtgtgtgtgtgtagtctttagagtttcctttatatagattatgccattggcatacagagacaattcacttctttatttctgacttggatgtcttccttttctttttcttatctaattactctgggtgctaggtaccatgttgaacagaagtggcaagaatgggcatccttgtcttattcttgatctcagtataaaagctttcagttttcactgttgggaatgatgttctctgtgagcttttcatataggacttttataatgtgaagtaatttccttctattcctagttgattgggcattttttaatcatgaaaggatgttaaatgttatcaaatgccttttatacatcaattaatatgattatgtgatttttatccttcattctgttgatttgggtggtttatggcattaattgatttctgtatgttgaactatccttgtatcctggttatatatcccacttggtcatggtgtatgatccttttaatgtgctattgaattgagtttgttagtattttgtttaggaggtttgcatctttgttcatcaggaatattggcctgtagttttcttttgatgtgttttttttttcctctagttttggtatcagagcaatattgggctcacaaagactttggaagtgtttctttctctttaattttctggaagattttgagaaggactggcttttattctttaaatatttgattgaatttgccagtgaaaccatctggtcctaggcttttctttgttgggaggttttgattactgattcaatccctttactagttagaagtctgttcagcttttctgtttctttatgattcagtcttagtggattgtatgtgccaaggattttattcatttcttctagattatccagtttgttggtatgtaatttttcagagtagtctcttacaatcgtttgtgtttctgtggcatcagttgtaatgccccttctttcattttgattttgatttcttcttttgattttatttagttgcatcttctttcttctttgttattctagctgtaaattttgttaacatttatgaattttatttaaaaattttttaaattactattatttcttttcctgttctagtctttattatattctaccttctgctaactttgggctttttttttctttttctagttatttgaggtattaatataaagttaggctatatatttgagttatatcttcttgtctaacatagacatttatattataagcttccctcttagtacttctttttttgcatcccatgttttagtatgttgtgtttttttgtctcaatgtattttctaattttaatatttttcattagcccactggttgttcaaaatgtgttaatttcaacatgtgtcaacttttcagctttccttttgatgctgatttccagtttcattccattgtgtttgaaaaagatactttatgtaatttcaatcttcttaaactatgtaagacttgttttggaacctaacatgtgatctatctggcagaatgttccatgtcttcttgagaaaaatgtagttcttctgctgttggatgaaatgttctgtatttttttttatatttggtttataatattgttaaagttcactgtttctttgttgactttctgtctgattgttctgtccattactgaaagtagggtattgaagtctcctgctattattgtattgcagcctattactcttatcagttctatcaatgtttccttataaatttctgtggccctatgttggatgcacgcacacttattattgttacatcttcctggtggatttacccttttatcattatgtaatgtttttctttgtcttctatgataataattgacttaaagtctattttatctaggtatagtcatcccatgctctaatttggttaacatttgtatcttttttcatctctttgctttcagcctatgtgtatccttaaatcgaaagtagatctcttttttaaaaaaattatatcaaaattaaaataatttaaccatcaccattatagtaatatgatattctttattagactatatataactttaccaagttttacattttagcatcctttcattttaagttgaagaactccctttagcatttcttataaggcatgtctagtggtgatgaatttcctcagctattgtttgttttgggaaagttgttccttcatttttgatggacgagtttgccatgtagagtactcttgggtgagtttcttttcttttttctttctttcagctctttgaatgtattatcccactgccttttgggatgtatgatattttttgcagaaaaatccactgatagtcttatggaggttcacatgtacttgacaagtggcttttagcctgatgctttctcaattctctctgtttttgctcttgacaatgtcattagaatgtgcatgttgatgagatgtcaacttgactacaacaaggaatatcttgagagctcgtaaagcattacctttgtgtgtgtctgtaagggtgttttcagagtagatgggcatgcaagttggtgtactgagtagggaagatctgccttctatgtgggtgaacactacccaattggatgggggcctgaatataataaaacagcagaagataggtgaattctttctctctctctctttttttttcctggagctaggacaaccttttctctttcccttggacatcagaacttgaggctccctggtatttggaacctggcactcagccctctaggttctcaggctttcaatatcaaactaagaattacaccatcaccttccctagttctgagacttttggacttggactgaaccatgctactggcattgcagggtgtccaacttgccgatagcctatcctaagacttctcagcctctttaattgagtcagccaataccactattaaatctcatcttctatatactgcctttttaaaaaacaccaattaaaggtttgcggcaacctgctttgagctagtgtgttggcatcatttttccaacagcttgtgttccccgtgtgtctctgtgtcatgttttggtaattctcacaatatttcaatcttatgattattattgtatctgttagagtgatttgtgatcaatgaactttggtgttactgttgtaattgttttggggtgccacaaatcatgcccacataagagtgcaaatttactaaatgtggtgtgtgaacaactgggagtctgtcttttcatctccctccctctcctcaagccttcttatgctctgagatacaacaacattgaaattaggccaattaatatctctacaattgtctctaagttttcaggtgaaaagaagggctgcatgtctctcactttaaaccaaaagttagaaatgattaagcttaatgaggaaggtatgtcaaaagccaaaacaggctgaaagctaggtctctttgtcaaacggccaggttgtgaatgctaagaaaaagttctagaaggaaattaaaagtgccattctcatagcacatgaatgataaggaagtgaaacagtcttattgctgagctggagaaaggttaagtggtctagatagaagaccaaatgacctatgacattcccttaagccaaagtctaatcctaagcaaggccctaactcttcttaattctatgaaggctaagagaagtaaggaagctgcagaagaaaatttggaagctagcagaggttggttcatgaggttgaaggaaagaagccatttgcataacacaaacgtgtgaggtggcacagcaagtattgatgttgaagccacagcaagttatccagaagatctagctaagatctttgatgaaggtgaatatacgaaacaacagatgttcaatgtagattaaacagccttatattggaagaagacaccattattcatagctagaaagaagtcaatgcccagtcaaagaacaggctaacactcttgttaagggctaatgcaactggtgacttgaagttgaagtcaatgcccatttaccatttcaaaaatcctagggcccttaagaattatgcaaaatctactctctttgtgctctggaaatggaacaacaaagactgggtaacagcacatttgtttacaacatgatttactgaagactttaaacccactattgagacctaccactcaggaaaaaagactcattttcaaacattactgctcattgacaatgcacctggtcacccaagagctctgacggagatgtattatacaaggagttgttttcatgcctgctaatacagcatccattcttcagaccatgaatcaaggagccattttgacattcacgttttattatctaagaaatacatttactaaggctatatctatcatagatagtaattcccctgatggatctgggccaaatacattgaaaaccttctggaaaggattcactcttctagataccattaagaacatttgttatttatgaaaggaagtcaaaatatcaacattgacaggagtttggaagaagttgattataacttttttggatgactttgagtagttcaaaacttcagtggaggaattaactgcagagatggtggaaatagcaagaaaacttaaattaaaactggaacctgaaaatgtgactgaattgttgcaatttcatgataaaacttgaacagaagatgcattgattcctatggatgagcaaagaatgtggtttcctgaaatggactctactcagatcttctggtgaatatactgagaacaatgtcaaaatgacaacacaggattttgattattacatggacttagtttataaagcagcaggagtttgagaggattcactccaattttgaaagatgttctgtagataaaaggctatcaaacagcactgcatgttaaagacacatctgccatacaaggaagagtccattgatctagcaaacttcacttttgtctattttaagaaattgccacagccaccccagccttcagcaagcaccactttgatcagtcagcagtcatcaacatcaaggcaagactcttttatcagcaaaaaagatgaaaccttgtttaaagctcagatgattgttagcattttttagtgatattttaaaattaaggtatgtttattatttaatacataatgctattatacatttagcagactacagtttagtttcttatatgcactgggaaaccaaaacatttgtatgactaactttatggcaatattcactttattgtggtggtttggaactgatctctaaatatgtctgaggtatggctgtatttcctattggttctgtctttctggagaaactggactaatacaatttgtgtgtattactttagttttatctttttgggggctttctgggatttctgaatctgaatgttcatttccttcctcagatttgggatgattttagccattatttcttagaattcgtttcctaattatttctccctttttacttcttctgtaattcccataatgcctatcttggtctgcttgatggaatctgtaggaaaagcctaagtgtgttttttacactgtactctccagtagaatacttctgacaacagatgtgtgtgtggcattttgcttcagatgccaaccagtcagttctctaggggataccaattgtttgtcctataatttatttttaaattctgttttcctggtgatagtgttggatcacacagctcaaaggctcagtccaagaagactgccccacacttcagatgccaataacaagtcccaggttgtgtcctgtacttctgactaactgactgtaaatctggattcccctgatcatgtccttgggtttgattaatatgctagagcagctcacagagctcaggaaaacacttcacttcacttatttttacccatttattgtgaaggaattatacaaaggatataggtgatcaggcaactggagaatatgcacagaacgaggcatgtgagaaggggcataaagcttccgtgccctctctgggtacaccatcctttacaatcctctatgtctccagctttctggaagctctctaaaccctgtgttttgggttttttatggaggcatcatcataaagccatgattgatgaaatcttcagccattggtgatcaactcaaccttcaacctttctcccctccctgaaggttgcggggtgggaataaggctgaaagtcccaactctttaatcatgttttggtctttctggtgaccagcccccatcctaaggctattctaggggccatgaactgccagtcatcttattagcatacagaagacattcatcactccagagtgtttacaggttttaggagctctgttctaggaagcaagaatgaagatcaaatatatatatatcttattataagttacattatcacagtgtcttataagacccttttcttcactcttttgttttttctttttttgctctgaattattttaaatgacctgtctttatgtttgctcattctttcttctgcttattctaatgtgccactgattttctctattgaattttttagtttattatattcttcagcttcaaggtttctacctgcttcactttaaaattttctctttgttgaaattcatactttgtgtattgttctcctgagcatgttgaacattttattatttataaagatatgactgtttgttttaaattttctgtcaagtaattcatatatttccattcgggttggtttttggagttttattttattcctttgtttggatcatgtttgcctgtttctttatttttcttgagtctttgtattgttatctatgcagcagaaaaacctctacatctcccagtttccacagattgatcgtgtgctagagaagaccttcaccattcaacctggccagtttctgtgtgtctctcaaaccttcttggtagtctaaatcactgccttttttaaagtggctcccaggtgtccagagtttgttaggctgtctatcctccaagaaaggtgggtagaagtaaactcctctggtagctcttagagaagttggaatgccagatctatgatccatctcttttccttccccaagaagaatctgggcactggtgttttttacgtgctcactctgtgttgagctcgggtagcatctgtgatgagttctgcacacttgttcaaagcaccgctttgttctttatagccttcagtggtctagtgtatactgggccctatcagtgctctgagacagatgagagaaaagccagtcccttgagtagcaccagaaaaagttgggatggcagacatgtggttcaagtgttctcagggagaagctgggagctagggtttacttccgttccttgctgtgcactgagctttggggaggagctgtggcatgtcttcatgctagtgcaaactgttacttttttctctgtagtcctcaggggcctagtgtgctagtgtatgatgtgctttatcagctttccaagacaggagagatagaagacagtctctctgctagtatgtgcaaaaactgagatgctaggtgtatggtccaactgcttcactccagaggaagaagctgtaagctgaggactccctcatgattatattatgctgtgctggggttttaggggtggggattagggctggagggtgtcttattttcctacgagttcagtgtggctgatttcatactcaactgaggtacagaagactctcaactagttttagaatttctcacaaagaagattgatccatttgttgttgaatttttatgtccttgagggggagtaagagtccagggcttcctttttcactatcttgctgacatcactcttagggaaacagacttttcaatagagtcatatgcagtccctcattcatttcttcacctactacttactatactatccactccaatctagcctctttctcaactgaaaaaaagttctttcttttgctgaatcccatggaaagctttcagtcctcatctcaacctctcagcaacttttggccctgttagccaactctttcatgaaatattcttttttttccttgagttctgttggtgccacacactgctggatttaccccttcttcctgggctatttattctttgaattattggcttatcttttcctatctgcttattaaatattgcaattcctcacatttcaattccatgtctttttttttttaaccataaactctcttttcaaacaagtgattcttctgataattaaaatcatctgaagagctttttaaaaaccctgatgcccgggccacatccaaaactaattaaatctagatatgggtgatgggatgaggtatcagtaatttctagaattcctcagctgaatccaatctgtttccaaccttgagaatccataaacaaatttatctaaactcacagctttaaataccattttttttatatcagaataaagatcatgtatgtttgattctcaagtgcataacctgtacatagcaagtgcatggcacataggaaattctctgaaactgttaaatgaattaaggaatgactaaagtgagagagaaatttagcatattggtggttgcataactggtaaagctccttaaggaaacttagtatttagttgatgttgtaggttgaattctcttagagacagagacattgagatgaaaatttgcatgaaaaaagggattacttttgggaacatgtcttaagagggagtaacgcaggcttaaacacaggaacagtggggttgcaactgagtgatcagtccatgccattgggaactctgaagatgggatggcccttcagggttgtcttaattagtagaaagggacccagccaccttcatatacccctatcaaagtcactgggtatgggctgcctctaggacaagacaccttacttcagccaaaggctattccagaagacactcagctctgaactgtaggcagccaacattcccaggagcaagctcattcctggaggggtgaccttgatggtggggcactgcagcatccaccataggtagaatcagattgtcaaatgaatgagctctgagacctcacctaatttaacctttggtttaaaggtgagtatactgaagctcacagagggtaagtgcttggcccaatatcatgtgggaagcttacagtccatctgagggttagaacactagtctcttgactctcagagaagtgtttttcaattatacccacattttactcaaatttagtgtgtgtgtatatgtgtgtgtgtgtaatttttcatatagatattttcgttgggccaggagggaaatattttaagtttttgctgtatatggaaaattgagaaaagctaagtatcatcgcagttggttgcagagttagaagtcgtaactatggatttgtacttgctgggccaggatgtaattctattctgtagagtatggaaagtaatggcacagtaaacattgtgtttggattgaggtttaactctttatgtcaaagaggtttggagatcattagcaaacccattagaattagtgagaatgtataatgttttacagttgagcaatatacggtataaatagaagatacttctacatggttgtcatagaatgagtaatctcacatgagatatgaagttaaaagtgaccaacagatagccttcaatgagatttgcaaattgctggtattaaaaatctagtatctctccagatagttgcttctactttatgcaaaatattttttctttgagccatggatgatgtaattgtataattggagctagagaagatttgaaaatgtttccacaggctacaacagttcctgaaacccaggtgaggggataaataacatgaatgttgtggaacactcttcttaattatgactcttggcccataataacatgacagactttgccacacacatacacacactcataaacacattcttttcaaataagtttaaactaaactaatcatgtaaaaggtatcactcactgtctgcattcataaaactgtttacagtttaatctgtgaaaacagaatggaaaataaatccagaagctgtcaagagaagtgatagtaaattataggataagtaggaaaatacaaaaataaaaaatactccacaataattacacagttatatgtattcatgaataaccaccaatttaacttattagctgaatacatgaagtatttgtctgtctttgtatgtctatttatctgattatctaaaaattattgcatacagatggaaatgtaatgctgaacttttaatacctttatatttacagaccagtagcagtgtttttttcataagccccagccttaacatgtgatcaaggtttcacttccatgtgattattatatacatagtttgcttccagttaaggctgtggattttggaaggagagagtgcaattggctctcctgactcagtgtctttcctggtctctctctctctttcttttttttttttcaaataaacattttattttagaatagctttatagagttatagaaaaatttccaaggtagtacagagagttcccaaataccctgcacctaattttctctatttttatttttctttagtatggtgcttttatttattttttacaattaaagagctaatattaatagaatattaataagtcaaggccattctttattcagacctctttggtctttaccttaagtcgttttctgtcacaggatcccttccaggatactatgttacatagttgtcatgccttcttgtgcttctcttggccgtgacagtcactcacacgttacttacttttgatgactgtgagagtttagtaaagtatctgtcaaatattttgtggatgtccttcagatgggatttatcggatgtgtttcccatgactagactaggttatgtggtttttgagaggaagacccgcgggttaaaatgtgattcttatcacatcatatcaagggtccatattatcaacatgacttatcacggttgaggttaacttgatcacctgctgaggagagtgcccgtggagtttctctgccataaagttactctttccgcacccccctttgcagactgaactctttggaagggagtcactatgcacagctcacactaaggagtggggagttattttccaccaattagaaagcagaagatctacaccaattatttggaattcttcatgagtgatttgtctatatttccccatttattcaattcttatttttatctgtatggactctggaatttttattttgtactataatacaatactactttattttgttgctcaaatcattgcagctttggccattgggaaccctctcagtttgttccggtgtccttccattgacatatttccattatggtgttttttttttttttttttcctgaacacttctttaatttctgttactgtaagatacctgctctttaaaaaaaaattgtcttctcatttcactttatatgaggttaccagctttaaaataatgactaataacatcacggttgccactatttatagttatattgttttctttgatataattcctttctgagtccttttagtgtagtattcagaaagggaatcttccatctaaaacctccaccaacaataataccttatgttttcttgtatcttgctgtgtctgaaaagcagaattaacagtaatcaaaacatcccacagagtcagaattgcttgctgtagaagggaggatgattgatctgtttccatgaagaatttcttaacttgtggtctactcgtccaggaaccctcagaaacacaaattttgtataccctttttggggaagtgtagagtttttatcagattttcagagacatctgttatctaacaaagaggcaaagaatcactgccttagagcatgagaaatgatacaaccaacacatattacatcctcattctacccttgtgtctgtggctttgtatttggttaagttcatgtccagctgaaagctgcgcagccccacacttactacattcaggtctgagacggcctctgacaattgtcattgcatttattgctctatggagaaataaaacaattcctttagactcagatttctagttttagcaagaagattaatacaatatactcatccacacctgttttgaaatgaaactgtgcactgtggtcactgaagggtcatgtaaaaaaaaagaatgttctacagttaatagaaaactgagcttcctcctttggaaataaatttctggatttttcctttagtgctggaaaatattacatcatacagctatacagtctgacacattccttgcataactttacatattagtaatgacattggttcaagtttaggcaagtgaacaaaagatgactggttgtaaaaggcttttgatataaaactctattttctctagtcatttgatcactttgcccaagtagaataagttattttcttaaattaatgtcatatttccaagaaataaatcctgctttttaatatattggaattgttgatagatttcttaaaataaaacaaaatagcatagtcaaatgcataaaacattggactgagattcagaatatgaagactttaataacaaagcaggcattaagtgtgtgatctaatttaaatcacttaactctcctttttcatgtttattttgtgttaagtaatactaacttactttctaaattataaggagatatatagtaacatacagacaagggaaaatatgttacatgcaaattgttttaactctttaaaacaaagtgactgtatccatttaatctcttatattttagtctgtagagataattttaatgttattttagtattgataagctaaaaaatatgattttaactttttttaggtgggaaaaaccctgagttcatgcatatgaatataaactacatggaattttatttaaattttaaaacatctctgtatttctaatacaaataaatgtgaattgttgattaaacatttatgccaagttacctgcagctgagacatgaaaatatatattgacacaaataagaatagaagaaaaggggccatatgatatttggtatattccctgggttgtttttttgttgttgtttgtttgcttgtttgattttcaaaagatttttgtcaaacaatgttgagtttttgttgctaacgaacaaaaatttgtttttaacagtggagagttgaaaaacatttggagatggtagaagagtgaactgatagaaagggccaatttatattttcagtactaatgatttttaacaatgcttagtaaaatgaatagaactcaaggtaaaatacatatgccctaaagcaatatgtgtatggatggtaataagaagatagataatatttcacttacactatggcaggcttaccatggagcaggtttcattcttggctctaccaccttagaaaaatctcttaaccctgctgtcttagtttcttcatacaccatgtactctacaggttcatttacttacctcttactcttctaccaatgtttttctaccattatctccctcaaaataacagctttctgtgtggctaatatctcttctgtttaatcacgtgaacatgactatcaaatgaaagaatgtgatggacataatggttgattctccaatattcattccgcaccagactattgatctgagccaatcatgaatgtttcttcctccttgctagtagttcagcaatggtcaatgctgggaagattctgagggtgggggaagtcattactcctaagagagtgccacaggacaaaatgttcttcttcctctggaaataacgagtggaactgcttaccccttacagcacaggcaacatgaggctgaaatatacctagaagagatggcagattggaagtacttgaaccaatgtgtatttaatactataaaaacagtagggaactacagatatatagaagccatgaatccctcaataatcatactgttttcattttgtctagttggtaatatactcgtagataagaaaagaaaagctacaaaatcattgccaaacaatatatttattagttcatgtttattagagtaaggttgcatggttgatgcaagattttacaaagaagatgaggtttaaaaggacaggtttggtttagattagtacaataaagaatggaagttacaatattccaggaagagagactgattctgtggaagaaggacaaaatttggtagtgagataaagggctaaaaatgagtttgactgacacagcctacagctagaagcagaaaaatcagctggaaagttctaaactacaaaatttagtgttaattgtcttcatgttgtcttttcattgtttagaaggaatgtacttgtaaaagattttatatgaagagacacaataacagcagtcctgaattgatccaatacaagtgtattttgtaatcaatcaattcttttacttcctttgaatgagaaaacttgtagataggtttgaacgctaatttgcatcctaatatccaattttcccacgtgcgctcattctctttagagttttccatcttttgttaaaggatgacaactggctgtaaggaagttatagttttacctgcaattaattggaaaatctaattaccagccctcaagtttatgaagctgtgatattggagccaataaagccacaagaagcaatttttaaaaatccgtatgatctatgcacttttgggaggtctaactgattgattttcatcttttaaaatgctttgcactctgactgaatttctatttgaaagggttgtctatatcaattcatagtattattaaattatgtcatacatttttttctgttatatctcacctacaatggttgcctcttatcggcagattgtatgaaaataaactcagaaatgcctaatagataaagacttttgatttcaatacaaagccaagcctgttgcatctaagtttccttcatataaattaatataatttatgaaactgagactttttaccatatcaacacagaaaaggctgtgctaggtgcttcaagtagagttttgctcttccttgtgattgtcatggattttgtgtgtgtgtgtaggtaatgggaaaaattattatgcataagactttatgaggggtaaaataaaccaaactcaaacaaaaacaacaaaacattttccttggcttccaagaaagtgcctttctaaaaaagggctcttaagcaaccaccaattttgtcacttatcattattcaaagttaattaaaatagcaaaacaatgcagattttcctcttcttaataaagagttcatgacaaatatatatagaaaagcaataggtagttatctcttatagtatagagtattttacttgtttcatttatctgataatagtgaaaagtattttaccaattcccttctgcctcccaagctgccatattttactgagtgaggaaaatgttcactgtatttcttggggaatatcattttatgaacatcagcatgattgccttatgaattcttagaccatctctctggtcagattgtttttgtgttggcaggctaatattacacattgttcaaaaaatgttctttgttgtttttttctcattgtgtgcactccctttgtacttgcctagatttcaatggcaggttgcttcagaacaagtaacctgtctgcttaattttactttatagaaagtaacatggagtatttagagcaatgtttcatacatttagtaaagttaattgttaaaatatatatatttttaataacaatgtcttttgggtttttaacaatatttactagtctctatttctatttgaaaaccacaatgagataccatctcacaccagttagaatggcaatcattaaaaagtcaggaaacaacaggtgctggagaggatgtggagaaataggaacacttttacactgttgggggactgtaaactagttcaacccttgtggaagtcagtgtggcgattcctcagggatctagaactagaaataccatttgacccagccatcccattactgggtatatacacaaagaactataaatcatgctgctataaagacacatgcacacatatgtgtattgcggcactattcacaatagcaaagacttggaaccaacccaaatgtccaacaatgataggctggattaagaaaatgtggcacatatacaccatggaatgctatgcagccataaaaaatggtgagttcatgtcctttgtagggacatggatgaaactggaaatcatcattctcagtaaactgtcgcaagaacaaaaaaccaaacactgcgtgttctcattcataggtgggaattgaacaatgagaacatatggacacaggaaggggaacatcacattctggggactgttgtggggtggggggaggggggtgggatagctttaggagatatacctaatgctaaatgacaagttaatgggtgcagcacaccagcatggcacatgtatacatatgtaactaacctgcacattgtgcacacataccctaaaacttaaaatataataataataaaataaaataaaataataaaataaaataaataaaaaaaagaagaaaaagccatactatagttgtggatttgtctcaaaaaggcagtctttcctcccaatgagaattacccatttctgttgtttgctatttataactacttatcaggatttttctctctcttatagtcagcagtcagcagaggaccttgcccgagtacctgccaactccactagcaatatcttgaacaggttattggtcagttatgatcccaggataagaccaaacttcaaaggtttgtctcccccatataaatgttcatttttattgtttaaaaattaattttatatgtttagagatttgtgatattttatatgtatatgctttgtgatattcaaaacagtaagatttcaaagtgatatataacaaaaatgtccttaagttcagaacaattcaatgcctaaaatattcagatgagtaaaatatgaattctaattgttttataggttacctgtttttaaaaattcaaaaaaggatatactgtgaattaataggccaacatccgcaatgggttttctaagtactattcttaaccttagtggtttaaaatttaggctctggaaatagacctggctttcattcacagacaccagagttataatttgcagaatgatgattttctcatttagggaaagagaacagttctgatgtatatttagagtctttcttactttttgttattatttcacattaatagaaaattctctctattcttttgctgaaaaaacaattggccgtatgatttttaaaagcatgttagctttgtgaataaaagtgattacgtagtccacaacatagattatttttattccaattagatattaccatttatcacaccttttaaaaaccaaaactatgcttacaataaaataagccatgagcagattgtgcagttgtagagaccttttttgtacttttgatgaattagaaaaaagctgtatgaaaaacatctcctctggaaaactataatccttgttgctggttaaggacaggtattaatgtagatcagattaacattataaggcttgattttttttttttttgcctttagaaaaaaaaaataggtctgcagctgcttctagtcaactgaagttatacaactatgttgtaaaaatgggtttttgttcattaccaggacctattcagttactttcaacaacagccatggtctgggttgtcacatgtctaccatatattgattcaccacctgtttttcatcagttagtggttatgtggctaaaaggctaaattcacattttccctttgttagcacaacgagcagccacaatgagatgaaaaaaaatagaaagaaatttgcaacattataccttagttctcactccgtgaactttcaaattatttttcaaaaggtcaggcaaaaatctttataatgactctgctatgtgtccaattagctttgcattttcatgaattaaaaattaaaataataattacaagtaaaatttattgaatactgttttacctattaaagtaagaatttgaactgattagaaaaatgcaaaaaaatgaaaccctgttttcaaaatgattctttaagaataatttgtagttccttaaagtaaatgtattagggcaatttaaaaaaagatttaaaagtaaatgtattttacagagtctctacaatttaagacataattcttcctgaaaaaaaaaaaacattataaaatataatcgaactcattgctttatttgtattatgattcctatttagaaaaacaagttaatagcaattatgaacatgttatactgagaccatagattttttgcattccatatggattggaaaaaatataataattaaatgtgcaaaccaaaaaaactatgatgattctgaccaagttttttacagctaataaatatattcttaatttttattcataggcattcctgttgatgtagtagtcaacatttttattaacagttttggatccattcaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgatgtattcccccctgaaaaactgtgaattggatacaaacttggaagaaagcgcttatgccatgaagacttcttgggcaacagtttttgttttctaatatgcttatatgttggaacattccaaaatgttttaagtattcaagtttttttcttccaatttcctgaggagaatccttgttttacctgttatgttcattttgtgatatgtagagcagggaattgtaagaagcaaataagaaaattgattttcataagatagggcaatgtgaacgccttgaaaagatggtgcagcaagatgaaagggccgggaaaggcaggtgaagactgggaaggagtgacaagcagattcgtgtcttgaaaggaataggaaagaggttcaagagaggtttggctgttgtccatgataagttggactttagggacaaagttttcagtaaagtaatattagtagatttcctaagcctcttgaaagccattcgataaagtctatttgcttactaaggttttagaatattaaatttgtgctctttttgacaaaccacatggtgaaataatacttcaggtggaagaaagaagacctaagatttattttcctgtatttttgggagacacttttattttattaaatataagattttgattgcaagcctagtaagaatggcaagagtacagtctaattttcctgagaatatctcagactagtgaaataattacttaaaatatttactccattattcctagtagcagcagcatagtacattataaaagcaattgtacattgcatttaattaatgacacctatttttaaattttaattgtgatgagagtgttatttatttgtagaagtatatatttaagctgggtaatggacaaagtgtagatattttagagaattacttaaaagatttggggattatgtccaaaattcacttccagtgactttttacatcatttaaataacatagacatgcattataaatcactaggagacctttctgaaataaaatataaactactatatatgactcaagagacactatagcactcattaactgaaaatgtggttaatctgtctatatacttcactttccaagagtaagagatatcattttctcaaggtaaaactttgcaggaatctatttgatctccacaccctgttctgtaccctggttatctagcacgacaccactacactaatacagaaacacagctatgaagatattgcgtcttataggaaacatccccactctttatcttgcatgcccctgtgatcagatccaagagagttttaggtcagctaatgcaaggatctttttttcttctttgcatatgtcatagctcagtaggtatcattaatgtatctattttgtaataaatactgaattccttccaactatcaggaaggaattctggtaggtctcatcagtagttactagactgtattgagttgaaaataccagggagcatgtaatatttaaataaattcttacagagttttgatgattatgataaaatatttcatcatttctaatatcctctcactcatctgcacagacccatcccagtagttagccaagaataacttatcctcggtaccagattcaataaattctcaccatggagtctttacccttgctttttattcttgatcttcttctcttctaaacagaaattttcatggctattctcactcactttgtgcactcttttcaatctaggtttttcatctctattatttgtctgttactttaatagcttctatactgtaattaaattatttttgtgtgtattccttttattctctaatggactataaactcataaaattagcaataatgtattctacttactcatttttccataaaatacagaagacattaggcactcaatggtgaacacataaataaatatttttatattagccaatagtgagtgaataaatgaacaaataaaattgctatttgcttagttaagtaaaatggttggtggaacaaatttaaacagtagattaatgttgagcatttagatggcttaataacagactgaataatgtcgttactacagagtgtaattttgaaaactttgaaaacctttatctaaaggagtcaaattatttatattcattatttctttgatcatatagcctggatgaaaaccaatctgcccttcactttatattgaccgacatgcctaaatgtttaagatcagaactacactcattaaatagatgtaaatattccattttatcataattattcttttttgcttccagcaatatttattttatatacctttataaagtagaattgtacacatatatcattttacagtcatatttcatatatttgctcagtcttctcaaggcaaatgctgtaataccttgttgtttaatagttaggaaagcataagtcattatagatacataaatgacattaaaatatctttcaaaagaaaaaattcatctagacaacacttcatttcttcataatttgttataaacaatggtcagaaaataatagtgataacacagaagtgtaacccaaaagggtatacatgtctggacaggagttatgttatgagaggatacttcttcaaaacaaacaaaaataataaaaataaacaaaaaaagttccccaaaacaagagtttgagaaagcagagagtattagatttgtctatatataagatgcacattcatggcaatataatggtgggctgtgtgtgagttgtgtcatccaacaggcttgtgtttgagtctgttgtgtccttgctgtgttactaaagggagggaataagttacaaaattaaaacaacggtattttgactggcatagcaaccactatgccagtgatgatgactttttggttgtcatacattagcaaattaatttaaaatttcacagtagtatattatcctaaaaactgaattatttctaattgtattagcagtcctactgtatatgtgtggctttgtctattactagcctcctagaaatctcccctacaaggatgtacaaaaataaaggaattcctggccaggcacagtggctcatgtctgtaatcctagcaacttgggaagctgaggcaggtggatcacttgaggtcaggagtataagaccagcctggccgacactgtgaaccccgtctgtactaaaaatacaaaataaataaataaataaattagctgggcatggtggtgcacaccagtaatcccagctacttgggaggctgaggctggagaatcacttgaatccaggaggtggaggttgcagtgagctgagatcatgccaaaggaagtcttaacatttaaaaagcttcagtattgctctgtgctttcctctgaaattcaaaccattctacttcagcagatagtgcttattaaagaaagcacaatgcagaacacagagcctgggagtagatataacatgaatagccacgagtcaggtgtcagaaagatggagggcaacttttaaaggaagaggggcagcccatttcatcagtggataatgttgattatcaaacaaggaagcaagcaaagttattggcattaatgttattgtcaggaaattttaaccaattctatttggaaaaaatttgtttttgctttttttctctaaatttagatgctaaatgttgctggctaaactagaagtcacctcacattattcataaaccataattgtatagtggaggaaaaattacagccttattaatattccttaaggtcttccatatctctgtggttatacgctgcttcagcctgttttatggcctcattgtgaagctttatagttcctatttctcatgtctgtgtgctcatttgtattttgctaccttacatttttgtaaggtatcattatcaatactataagtggtatttaccaacattaacagtagcatcaccaaaattgtcaaataaatgttatcatcccaatttgaagttgctggaacagtcagttctagttctaccagtttatgtgctactgcttgtgacaactgaaataagagtattcaaaacagtgagaagaatgatttgttaggggctaggtgacatctgttctacagttatgcttacaatatttgttgagtttccattcagttcctaactttggctttaatcagcaggattttcataattgaaaatgtgacctatcgaacttatgtagggaaaactgggtattatcgtgtattgtcataatctatacactggcactttgacttatcagaaatacataagagctctttcatggaaataaaagcctgtttatacaatctattttctttctttagtttaggcatcctttgtaattatattgaattattattgcactataattcatgatcctgtcagactttctatgcctttttgttccatgactttttgtttattttaataatagattgcaactccttttgggaaacacagctgtgactgtcaagaaaaaaattcatatttgggatccactaaaaatgcttgattctagttcttggtaattgctcatctttgttgttttaaaacaattttattttatatatttttatatttagatttaaaatgctttccttaaaacttgcctcagtttactatttatattttgtttttgttgttaattttaaagcatgtactatagaataatagaatttactgtagaataatattagacatatttgtcccattttttatttcacatatcttagtagattttacatcttagatgtaaaatcataaacattaaactgatttcatatttatttttctcatgttattcatcttcagggtttgcactctgttgttggctgaataatggccccctaaagatgttcatgtcataatcaccagtaatcacaattcttatatgaaatttctaatctcactagaggctaaattttatatccttttcaaacctgtggatatgctgttttatatgttaaaaaggacatttcagatgtgattaaattaaatatttggagatcgggggagagtatcccagtttcttcaagtgaaccagtgtaattgatagcgttcttgtaagacagagacagcaagatcagggtcagtggtagtagctgtgatgcaggaagcatgaagcagttgtcatgcaaggaagggaccatgacttaaggaatgcaggtgacctctaggagctgaagaagccaaaggaaagaggttcattcctcagaggcttcaaaggaaccagcccctcagacagaacaattgacttcagctcagtgaacatgattttggtcttctaagctacagaactgtaagatactaaatgtgtggtgcttgaagccactatttttggtaattttgttacagtggcaattggaaactagtacatatgctgatgagcatttgttagtaatttttttccttctgaattctgctggaggtttatctgattgcatataacttcctcccaagtccagctgaaggattatctgattataacataactttttccatatatgaaaatgccagactaatcagttgtattttattgagtaattacttaaacctctcactcattaaggttaattctattaaggatgtaatttttaaatatctatatatatgtttttagtagttaaaatatactttattcctttgtgtcaaagttacctttttttagtgtacgtacatgaaactcaacaatttgttatggatactttcctcattaccttttttcttcaagttacattatttggaagcattggtgattaaatttcacaagtaagagtactgtattaggcattgtggaaggatgaaaaatgtccaagttttgttttctctttctagtaatttgattattgttattagtggatatgaaaaaaattaatggtgtgaataatactacacaacttcctgaactgaactgtcaacatgatacagaaggcatttcctcattcctgtatttaatagaagtgtattggatgctttttatactcagcctcagcaggtctctattctttatggggtttccagcctagtgtggcaccatagcaccacctagcaggctctcctaatagaaatggactatgaacatagatctagaaaaattaattatccataaggttttattgaagaatctttaattataaaccttgaaaaatgatatattgagaaaaatcactactatataacctaagagtttttacaggcatttgggtaacttgcaattcttatatggaattttaacctgacttgaggctaaattttaaatccttttcaaaccaggcttttaatagccctattgacagaactttaattataatgctgccagatgctataagagctgatctcttttatttatttgaatgctaatttttgccataatgcaaagaaaacaaatgaattaaagattatatatgtgagctattctaacaacattacaaaatataaacagttcttaatattaaaatatcatttatgaaacttaaccgattatagtgtcttgttgtgaaatgttttattgccttgaagaaatggtttaatttgggtgttaattggttctaaaagtttttggagaccatccattttttcagataatgattaatagtgtgttatttggaatgaacaatgaatagtatttgtcaccagtgctttaaaagcaattaagtaatttcccactcataaaagaggtctgtttctgatgggaatttgtttcttgcaagataaatgatagagctataattactgtgattgaataattgaaaatgaaaataaataggtttcaaagatggttatcttaatataaagcatttgaaatgccaataactagtaattatttgaaaatactcataaaacactaaccaaaacatgtaactaatgagcttttatcttttcatgaatgttcaacacaaactattaacttaaattgtaaaaatttgaaatattcttaaaagatacataagcttgctggaacttgcgtggaatcatagtattatatggcctcataactaatagaaaagaatctttgaagcactttcataatgaaataagacataataatcaggatgatacactgaatgaaccagtgaagtaggcaatttccagttttggtgatgctcattggaatatgactctgatggaattctatttaaacaaaataattggggtagagacccatttgagctttttttttgtggtgtattgaggtgacaatggtgcagcttaaagcaagaagagtttaggagatgctaaaaaatgtgtgttagcactgtgttgagatttgagatctagaggtgaatgactgttcaaaataattgtaggtagatcatctcagtatagagaaacccaaacatgttacactatatgcagaattttttgaagcaaaaaagcatattaagcactctacaagcattaaaaaggaataacaacaacatgaaggatatttcctaataaaatgaaaaagttttttagcacctaatatctccaggtgcagttcatgtactttgcatataacatctcactgaattcttcctaaaactctatgttgtgagtgtatgattattatccctatcttatatggaagggaactttgtcttccattcactccttaatcccctgcaattttgtttttgatacaccactgtatcgaaaatgtttttgctgtaatcttcagtggcttcctcatttgctgaaagtagtcagtgtttttgtttgtttgtttgtttttgtacttgaccttctgtggcacttactgctgttgaccatcacaaagcttttgttcttttggtttagtgaaatcacattcttaggatttttttctttttcagtcttctagccagccctttaagtgcttaccctcccaggtatttttgtgtttcttgtttttgtttttgttctgtattcctgctctaagtaataattttgaacaaacctattcttagtcttgatatttttttggtaatgttttgaaggttcatgcatgctgtaacatgtgtcagaatttcattccttttttatggccaaataatattccattgtgtgtgaatgtacctaccaaattttggttatttgtttatctgttaatggacatgggttattttcagcttttggctgctgtaaataatgttgctatgaacatgggtgtacaagtgtatctgttggagtgtctgctttcaatttttgggggtatatacctaggattggaattgctgaatcatatagaaattctgtgtttagccctttgaggaaaatatataatttttaaaagtttaagacagacttatagtgaagacatatcaatgatttatttgatgcactaataagggaaccaacagcatagtgaagctgatccaaggaagaattcaagagactgcagtgaaagaaataatgctgaaattagattgttaaatttaatacaaaacttgttaatgttatacagagacgtataggcatagtcttgaagaattttttttctacaagacagaaatcattagtaacatcaatttttaaaagttatctaattttacagtcataaccctaatcaatagaaagtagcaattgaaagttacattgtcctggagaatcacaggcactaaggtgggcttgttagacattgttttagtgtgatattgaaagaacaaacaatatttttgccttatcttaaaacttgggatgttttttcttaaccttgtatttcttgactttgattttgtttatggtattttttgcattcactttttaagagtagactcgatgtagacattattgtagctttattcataattgacaaaaatgtcacttagtaaatgaatggataaacacaccaaattgatacatttgttatcaaacataattagacgttatcctccaaagtttatcttttatattaggtttcattcctagtttagaacattctatgggttttgtcaaatgtataatgatatatattcaccattatagtatcatacagaagggttcactgccctaaaaatcatctgtgtttgcctctttatccctttctcctctctaaattctggaaccactgatctttttactgtctccatagttttgccttttccagaatgtcagataattggaatcgtacattatgcagccttttcagattagcttctttcacttaatgatatgcatttaatgtttcaccatatcttctcatggcttgattgttcagttctttttaacactgaataatattccattgtctgaatgtaccacagtttacttacccatttatctaccgaatgacattttcatcaattatgaataaaactacaataaacatccaagtgaagggttttatgctgacatgttttcagctcctttgggcaaataccaaggagtgtggttgctggatcatatggtaaaagtatgtttcgttttgtaagaaaccactgtctccaaagtggctgaacagtttttgatttttatcaacaatgaatgagttttttccactttttccacatccttgcgttcgtttttgtcagtgttctggattttggccattcaaataggtgtgtagtggtatctgattgttgttttaatttgcatttccctgatgtcaaaggatgttgaacatcttttcatatgcttatttgtcatctgtatatattcttgtggggtagtatctgttcagatcttttggacattttttaattgagttgtttgttttctgatggttgagtttcaagagttctttgtatatatcttggccttgattttaactcctacctttccactgtctcttgcttgacccctgaattatttgggccattttctctatcttgatatttaatcattcttattatgattgattatattgtattgttgatgaaactgattaagaagtggtatctttttgcctctgtcttttttttgcttttcccacatgtcacccaccacctgtcaaagtttttactctttgggaaccccaccagctttaagttctacagcctttcctgatcgctggtgtctgatgtgatcatttattctctcaacaagtattgctttgttcttacatcccttagggtctttaccaattgtttcatgacttgtttaatcatcacttcctgaggatatggaccccatgttcttatccctctcagatagctcagacctttgaacatgggaagtctttattaatgaataactgttgaattaatgaacaaacaaaggaatgaatgattgtttaacagagtccggcaaaatcaattcttaaataagcctctttaatcactgaatttaatctggaccataataacaagtagtccacacaacaagtttgccatgttacttcatgtatctctagccagtgaaatctgaataatagtctgaaaatctcagatttgttttctagtaccattttgtgttgatctctgtatggctagcacctaatgtagtgcttgatttttagtacatacaaaaaatgccttctaaaagcttttgaagaattagtaaaatgttagctttaataatgtttagcagccaactaaaacttctaggtaacatctttacaacaatagaaaaggaatgctgtcaatagtaatgtatgcatattcaaaatggtgataatagacataatgataataatgttaataatacatataataaaagtaataaacttttgtgagtactcacttggggccaggtttcatgctttcagtagagtatctcctttaattcttagagtaactgtggactaattttattgacaaggaatttgaggctcagagaagttaaataacttgacttaaacccatatagcaaattatttagcacagaatttagacccagatttctctaactacaggtctcagtataggtatcaattcattagttagcttaaactgatcttcagagtcaaaattagatgtccattgtgaactggtttttgttttatgtttacatagcctttttcaagttatgtttgactgatgttcaatatcccttatagttatttttttaaaagcaaggggagctcacagctttatccttgctaactagaccatgaaaattaatatgtcattaataaataatttttgaatgaatgaactaactagtaaattacctagggatttagatggaatttaaataaatgttttctgaaagtctatgatctaatctgtagctggattcccaaggatgcaaaatgggaagaaaatgaaggaaagctgcttctgctgattaaaatgcttagacttaatatactgataaaaaatacaaatgtattcttgggttgtgtagaaacattcataagatttcaagaaggatttaggatagtaaacttcacatggagaaacactattaaaattcctaaagaaatttaaaaacaaagctatttttggtatgtaattttagattagttaaccataccattttgaaaataggtagaacatggaattatgcttccaaaacatgtgtgcgtgtatggaaattttaaggggaatattgtataatacaggcttaatttatgaactttcaccccaaaatacagaatgacttcttttttagttatgcaaaacatgttgaagttaaatactagcatttctttaatttctgtcagataatactgtgaacattattataaaatactgatataaaatctttagaaattaattactgagcagccaaccagtatacattccaaaagatatttgttttggtctggataaagaatactaatgagtggctgagtatggtggctcatgtctataatcctagtactttgtgagaccaaggagggaagtttgcttgagcccaggctttcgagaccagccaggccaacataatgtgatatcatctctatacaatttttttttaattacccaggagattgaggctgcagtgagctgtgatagtttcactgccctccaacctgggcaacagagcaagaccctgtctcaaaaaataaaaataaaaatctaaagtaaataaataaagaatacctataagattttaatacttatatccctatacatatatgtaatattctatcaaaaggagatgaactaatattaggctgaaataaagcattctaactctggaagccacattggcaatatttcttggcagcaacacccaaataatactgaaatgctcttgtcaagaataaagcaatatctcaactgttattttattttctatccatccctatttcagaaagagttgaggtatatgataagaaaaatacaatgaagtaattgagaaagaactgaatgtgtaggagacatacaatggtaattgcaccaggatatgagagagaaattgttaatgcaattggtagtagagttaatgtttagcttcccagctacaagactaaaagaaaaacacaattaagtcttattttccagtcatatgaagcatatgaaagcatcaggagagcattttgatagtgtaaactctgaggattaaatgtgattttgtaaagcacttaacattaagtatacttagcacatggtaaatacctatataatggtatgatagtaatatatttctaacaacttaaaaattaaataaggaattcatcctgtgtattttgatataagggtcattgatcacaataaagggtcacagctttaacaacaagtatgtaaaatatacctacacagcttcatctggttatttcttatactgaaccttaatatcaaattaaggacataatattttatcataatattatgaatgcttattttaaatatagcaattcaaagttacagggttttggtgatttaccttgataaaacacagcacctaaaggtggtgatatggtttggccatgtccccacccaaatggcatcttgaattgtagctcccataattctcacatgtggtgggagggacctggtgggagataattgaatcaagaggggaggtcatttccctgttgttcttatgacagtgaataagcctcatgagatctcatggttttataaaggagagttcccctgtacgtgctgtcttgcctgccaccatgtaaatcatgcctttgctcctccttcaccttctgtcatgactgtgaggcctcccatgccatttgaactgtgagtcaattaaacccctttcctttataaattacccattcttaggtatgtctttattggcagcgtgagaacagactaatacagaatgtaatagaataattttcagtgtgtatatttcaaggaagatttttagcaaataatttgaaatgaattatattgagtgttcaaaataacgttaagtggctatcagccacatgctttggctaaggtagtataattcatattttattagaaaatgcttgaaactaatgtgtgttccctctaaagtagagggccatgcatgtcttcctgcaatggataaaaacgtttgccacgttgtatctgttgaaagccttcactccatgagatagataggttttagtcttagacattcttgaattaatttttgtaggtgttgcaataatcatcagatattaagtaataatctaaatttcattatgaattttaattttaagatatgtgtatacttggacaaaaagttttggggaagaatgatagtaatacttagtgattctcaggcttttatggtactaccatctaatcaactgtaataattggtgtttgtataaaggtaaaggaactatcaacaaggttatattctgatgtttgagctagcaagtgctacggaatgtctgcagagagtaattacatagagacaagtgtctttatactgctaatggagctctcctttagtgacacagttgttgtgatcttggttgatgttggaagaacaaaaatatttgtgccactaatcattgtaaccctttttgttttggggccgaataagttcttaaaaatagcaataaacatacacatgtgcacgcatgtactttttcttcaggactatagagttaacatcttcctgagacaaaaatggaatgaccccaggctgaagctccccagtgattttaggggttcagatgcactgacagtggatccaacaatgtacaagtgtttatggaaacctgatttattttttgcaaatgaaaaaagtgccaattttcatgatgtgacccaggaaaacatcctcctctttatttttcgtgatggagatgtccttgtcagcatgaggtactcttttatatttcatatttgtgcatttatattttccttctaaaatcaatggatgacagagaagtatattaaattatttctaagacccatttctgcttccaggttatctattactctttcatgccctttggacttgacattgtttcccatggatacacaacgttgcaagatgcaactggagagctgtacgtaaatgagaacataattgattatgaaaataaagtgtttaaaatgtctgggtaatacattctactgacatcttagacaacagtggtaaaactagtgctttgattataaatagtcattaaaataatttatttagggaaattatagttactcttttattaatactatcttaacttgtattaagataaatcatttttgtactagccttgtttcagttcattgatgtaggtgtatacttctaacattccagttgccattgttatttgagttggtaatacaggcaaggtaaaagagaaaatgacatcctaatttcaatagcatttctgatgttaaaaccagattttcttagcagaaaatttggaaaacattgaaaaatattctgtaaatccaactgagcattcattctctatgaaagtaaagaaatgtaaacaacttttttacaaaattgtattttttatgtttaattgatcatatatttttcatttattaaaaggtaccctaggtgtattaattgaaattattatttatctatacaatgtactaattaatttcccatgatgcttatcttttgaaaataaaagtagaacataaacctcaaaaaaaaaaacacaaatgcaaggaatgtttagcctgaatacatggatcatcttataataaggtcgtctatttcttcagagagtaaagaataattacctggcaaaacatcttgcatatgtattctaggttatatgtctaaagttactttgtggttgttttttaaataatgtaccgaaatggatcctaaatttgagcagtatttatttctttctaactataaaatgagattttgcacatgtatgtgtttatatgtttgcacatgtctgtttatgtttttgtatgtattgtatatgagtgcctgcatgtcaagatgtacttgtagaaaacttccaacagtgcatttacattttgatcccattactggatgcactaaaatattactttcaaaaatacatacacttttgagttcgatactagactagtgtatgctgtaaaattctttaaattgtagccacatacctaagcccaaaatgtgtgtgcttcagggtgctgaaatgatgctgtaattatgtccctttgagggattattttattggccttctatggtgatgcaactcctttagggaattttgcagtgatcataatgatgatgatgattattttttaaaacagagtcttgctctgtcacccaggctagactacagtggtgcgatctcagctcactgcaacctccactttgcgggttcaagcaattctcctgcctcagcctcctgagtagctgagatcacatgcgtccaccaccgtgcctggctaatttatgtttgtatttttagtagacatggggtttcactatattggccaggctggtctcgaactcctgacctcgtgatccacccgccttggcctcccaaagtgctgggattacaggtgtcagccaccgcaccaggccgatttcttaaaagaaatttagatgtttcaatgattacatttcttttaaaaatcccagggagcatattacatgattgtaaatgtatacgttcagaaagcttgcatcacttatttattagctttttattgatgaccattaaaaactaattctgacatagagaaataagttattgtatatgatgccctaggattttaaatctgtgccgtatgcttattatttaaacttgttctttctttaagatgaatatctttaactcttgtactagtacttccattagtgaccatgggttttacctctttacattttaaactacaatttcatataagaaggtcttattttctttcctttgctatgtttaagatttgaattatgaaaatatttaaaaagcattattaattatattttaaactaacatttatttgtttttgtttatagttggttacacaactgatgatttacgatttatctggcagtcaggagatcctgtgcaattagaaaaaattgccttgcctcaatttgatatcaaaaaggaagatattgaatatggtaactgtacaaaatactataaaggcacgggtaagtaatattctttaaataaaacgaagttctatttcaaagatacattttaattaatacatagccaaggggagagtagaaaagaagtggccaaaacttaaaattaaattagcaaatagtttatctttacattcatatgtttaagtctttcacagaattgtattcactagagttttttgaacttttaattattagatagacatgcttgatttttctttatgtaattcttgtggtgagaggtttttgtttatgttagtaatgaaaactctctcaggtagtggttttcagatgttgtcaagaaattctacttctggcaggattccacttggggctgaacattttagatataaacaatataatccatatatgttcacccattgtcttttgggtagtttttagatggtggttggcccatattcttaattttaaaaagcattgatccttatgctatgcaggaagcaataagaatgtgaaataattggacatcagtaaatattccctgtacagtcttcttgacctaggtcacagaacagccaattatgaaaaggaaaacaaattaacctcattcactaagttgcatggagcttttgcagaaagtacagtactcactactcaatactgtcataatatgattagtgttcaaccttttattttctgctagtagttctaggttagtgagggttttagatactgaatatagtgttatttcacttagcaatataaagaagattattcaattttgattattatattagtaataataatcagttcaacatgtaaattattgcagaatcctaattctgcctttggaagtaaatcataacaaaaatattcagaaatagatataattaaagctttattgcaaaatgcatgttgacttgaaataataaaatatatatagtataattgtgtaaaactgagagagatcagatgtttgtagaatgctgacagaatgagctagaatgctgtcctcatgatgtcatcaaggcaacatataatttaaaacattcctgttaatattaagaggtggagagaacatttacatatttacaatgctgtgataaagacaatgctaggcagcttggggatacagttaaacatctattgttgacttcaaaatacattagcaaatgatataactttaatatgtaagcattccttcttaaagcttatagtacattaggaaaacagagataatagtcgaatatattgctaaataattatggaggtttttaaaagtaaaaaatggagagctattaaaaatttgaccatcaaagtattcaatgaagaagtcatagataataagatatggaagtgatctaattgataattctgagccactcctttatttaacacataaaataactgaagagcagagtgaatacattacttattaaattacttattactggtgacttattacttattaaatgtcaccaggcaaattactgtcagccttgggaccaagagtagtattccatctcccatttgtacttcaaattaagaagattatagttcttagagatttttgagactgtcatataagaacacgtacttagtagataggtttttgatctctcgctatactaggcattgtttttagttctttgcaggaattatttaacttaatcatcccaacaattctatgaattaagtacttttattatcctcattgtacacattaggctaatgaaatagacccttgcccaaggtcatacagttacagtgatgctgtgggagagggagtctgatactgttatacgattaatacctgtggagtcctattatagtttgaaaattgttacccacatccagattatatgcttaacatttcaaaaagagtagtgtctaaattgttttgagaaatttgaaggagactctattggattttttaatttcttagagatgaaaatgacactagcaattttatttgtaattttatgtaatagcatatgattatataatagctttgaaagtcctaggagtgttcattttttcacttttaagctctacattaaaaaaaatctccatttggggactcagtagtgaataaaagaaaggtccctgccctttagagagccatatttcaatgtggtaaacaagtaaacaacgtaaaatataattcattttagttcttagaataaaattagaaggtgtgctatggtatttgggtatggaatttgggggattactcaagagttataagcatttctgggaaattttttgagtcataaataattcactgaaatctcattagctacagaaaataacaacaaaacaacttatgcctaacaatattttttggcacttagtatgtttcagggacttgatcagtacttttatgaattatcatatgaatataagtaaaatatattttaatgtttggataattagaaatctagttagaaaaataagacattgaaaatacatgcaatagttaacagcatagaaaaatgggaaagtataaatatatatatgagcaatatataaaaagatagccaatatttagtttgtatagaaataataatgcagcttcaactttattaaaattatgcttttttatgattatagaagtaacaaaagtggagaaatatgtgggaaagcaagtatacaaaaatactcaaattggaagcctgagtgaataatgggataaaacttcacaggaaatagaaagtaaattgaatttgcccaatgaacatttatatcaattagctgcccacctgcctctcataaatgttaataatactaggaaaagatcaaaaaaagatcaagaaatgtttctcataaaattttatggagcaaatcactataatatccaagcatgtattttactgctaaatgcatccaagtcttgtgaagctcccctagtgggtaccttcataaaagggacacgatggaaacttgctccaaattgcaggactcatgtgaatggactatcatttaaacatagtgggatggaatggaaaattttattttaaactatgctactttgtagtaaatcgttataatatttgtgacaactgagactacctaaaaatatataatttgttgagaaacatttcatatgcactaggtgaacagaaaactaatttgacttagtgatactattacaaagtcgtgtacttcagaatcagttttaggaaatattttgagccttctcaattgtagcaattgtacttatgaaagattctatttttgaaatattgcacatgattgttagttagaaacatatgttcttatttgtccaggcagagagttaaggggaatggtgggaaaagaaaagaaagggagatttttcattgttatgttttttacatcctttgaaaacctgtgaatgacttgatatattgcctaattttaattaaattcaactgtaaaaaagaaacacttgcatttcttgtctttaatataatatggaagcatttggcataaatagaatttgcttcagtcgaaagcaactatttttgttacatattagctctactgtctgtgtaacctctcagaggtggcaatgattctaaatcacattgggaaaaggaaagatttctaatctatttgttgaggatataaatagccattcttttatttcatgtttattaaggtcctattctgtgcaagtactgctgtaggtgctattaatgaataaatatgtagattattcttgtgttagatatatgtatattcttcccagttaggaagaccaggtaaatattgtttttaaactgtaaaataggaaaaagtaacattattctttcccccataattgtttcatttatttattgttcattaatttgtttcaccattttaaaaaaattatatagagtttaaacagaaaacgattatagatattttattttgctatttatgcacaatcttacatttgtaaaatggcaaatgacattcttctctaaattaagcactttcggcattatatattatatttaaatagttaactgaaaagagcaaacatttaagaaataatctcgaacatctggaaataccttttctatttgaatgcagtactgtgagcatattcgtgttactattttctttctcaaggcggcaaaggctattgtgaggctgcctgtaattggtgattaatttgggggactagttgatgtcatggccactctagaattaggttgtaaaacaatttctgcatttgtcttggcatgtgaaaatgaaagttatttccttcagttggagtacctttgagagcctgaagtagaggtgggcaaagaattgagaggaatatccgatgtttgcaccatatacatcttttatgtatatggattgaaaacactggtttcctatacttgctaatgtttacttccaatactttcttaatttttaaggtttatctatatatgagagtcagtgtatactgccatccatcctagataagaagtggtacatatggctgaaaaattatactgataatgtgtagtcccggagtgtttctttttaagatttgttctactttgatttactactgcctgtatgactcctttagatcattgccctgagaggacccacgggtaaagaaaagttcaactctattgccaattctctgaacaatgacctaaaaggctagacactgacacagtagagcagcatgtgggatctatttctcaatgtcataatgaagttgcgaaaggtcagctgaaactggttccataatgtcacccttttagatcacataaattatatatctgcaaagaaaaacttttttttgaggcatttcctctgtgaaattgcctcagatggaagtgacttaccgtttccaggtctgtcattgatgtttgccattctgtgtgggtgaaaacctcatgccttgaatgtgtttgcttctgaaaggctactacacatgcgtggaagtcatcttcaccctgaggaggcaggtcggcttttacatgatgggggtctacgccccaaccctgctcattgttgttctctcctggctttccttctggatcaacccggacgcgagtgctgccagagtgcccctgggtaaggtgttccatgcttttttgtcacatcaggaacagattatatctttatctaacttaccatataatcaactactttgaaacaatgagttttagaattgttagccaccaatttcggtgtttaaagactttcttcaaaacttgatattgaactagattttctcaatgtttatgcactctataattaagctaagtttctcttttcatgtccttggagtattataagcagttaatctatttttctgtcatgaaataattatttataagtgattttcacggataactatgtctaaaaccttcggtagtgccaaacttaaaaatgaataactatttcgaaggaagtctttctgaaaaatagtatgtattatcacatactcttagggaatagtaatctaatttactttttaaaaattacgaaaaattatgtagccatcattttcccaaccattggttattgtgtgctatatcagggctggttgcctgtcccttgagggccattgctctccagtttatttttaatgctttgtgacatagaaataccaccagccagtcttttgaaaattgtgtctgtataatggctaaaaagcctttgcttaaggaaataagcaagcgcccttcctatggataaattgaataaacttcaaaatatgtacattgcatcaacaaattttggttggttggagtgtttcaaaattttttattactgtgtgtctgtgtgttttctgaatatcacctggaactcacactggtaagactgtgaactgtctgacctcctcagtgagtatgtagttgctacatttaaattttcttccatcgaaaaggccttgtgcaaatctctctcctgacttactggaggaattaaatgaaatacagattttaaagagtaggaagctaggaaagaagccatgaaaatggcaatgtcatctgaagaagaaatttgttttttttacatctaattgaaatcacacagaccaaatttataaccaaaaatgtgagaaatttcatcatggataaaaactatgtattattacatgtattatatttactgggaaaataaccaaaaaaacctgaatttaaattcttagacttgtcaaaaatatatatttctctcaaataatttttgttgttgttattcattagaagtttcttatgttcatgcagtgatataaatgtcaggcttccaagactactttggagacaactcaatttctgacatatcctttaagaatttttcatctccattcattgcaggacttctgataccaggttcctgagctgtgacttgatatccaggctgaaagttcaatggctgaaagtcagtctctagagttaacttgggtttgaaagccagttctggatttactagctgtgacaagttggacaacagatttaacttctttaaaaataactctgctgaaatgtcaatagggatgataaaaatacccaagaagctccagggagtattaagaaaatgagtgaaagcctatattacacattcaggagttaataatgagctacatttttatattgctttacagtttgcaaagcagttctacatattttgattccttcaacaagtatttgttttgtgttatgtgttaggtactattaaaaaagatggggatgttgttaacaaaataaatagctaataaatagttaataaaatgcattaaaacacttcttagcttcaatgagtatatatgttattgggaagaaacaggcaccaaataaatataatatatcatatgtaagatagtgatgtaagatagcaagtttggaggtagcaaactgcttgttagaaaggccacagtgagagggtaatactggatagagacaagaaggaggtgaagaaatgagtcatttctaggacagagtgggccagacagtgatcatctgggctgcattcctgaggcaggagcatgcttggacattgggggaacaaggaggccactgtggctggagcagaacaagtcaaagggagagtagtgggaaaggaggtcagaaagataacagcgatgaggggtggactatgtagcatctgctgaaaaatcctgatgattttgagcttttttttttttgatggagtcttgctctgttgcccaggctggagtacaatggcatgatcttggctcactgcagcctccacctcccaggttcaagtgattctcctgcctcagcctcccgaatagctgggattacaggcacccaccaccatgcccagctaatttttgtatttttagtagagacagggtttcaccatgtcagccaggctgatatcgaactgctgaccccgtgatctgcccgcctcgacctcccaaagtgctgggattacaggcgtgagccactgcaccgggccgattttagtttttattcagcatgaaatacaaagtcgctaaaggcttttacacatgatctgacttaaattttaaccagatctctttgcttactttgttgagaacagaatgacctcgggcaagagcagaagcaaggaaagcagttaggagacaattgcaataattcaggtaaatatttggtctagtgagtagtagtgcaggtgctgataaatatttgatgatggggctgagagcagtggctcacccctgtaatcccagcactttgggaggcaaaggtgggcaaatcacctgaggtcaggagttggagaccagccttgccaacatggtaaaaccccgtctctaccaaaaatgcaaaaaattagccaggcatggtggtggacacctgtaaccccagttactcgggaggctgaggactgagaaattgcttgaacctgggtctcagaggttgcaatgagctgagattgcactactgcactccagcctgggcaacagagtgagactccatcccccacctccccccgcaaaaaaaaaaattagatgatgggtggtagtgaaggttgagataaaaggtatttgtaggtatcttgaatgtgagattaaagaaagtagaatcagggttaacttcaagattattttggatgaaaaactagaaatatgaaattgaccttagccgagatgggcaaaggtgcaagtaaatacagtggctttgagaagatgggcaggccaggagctttgctttagacacgttaaggttccaatgtcagttaggtggagatatcagataggcagttggatatgcaagtctgggtttaattggaaatttcaaaactggagtaggaatttaaactttgtcaaaatatagttggttttcaatctctggttggaatcacaggggagtgagcgtaagcagagaaatctaagagggactgagaaaatgaggaacaaccagtatgatgcagtttcctaaaagtcaagtgaacaaagtatttctaggtcaagaaagtgaccaaccaactgttcatggatcaatgacttttagagctaaagattaccattagactaaaggagctggggaggtcattggtgtccatggacagtttctttgaagtgagaagaagaaagcctgattggactggcttcaggaaagaagatgagggggggattggagatatttagtatacataactcattggaggttgttaactataaaaagaaaaagaataagaaaatagctagggtaagaataaaagtcaagaaagtgtttttcattttttaaaggtagatgaattcatagtatgtttagtttgtttttgatgaaggacaaccagtagtgaaggaaaaactgagagatggaaaaagtgcaggagcagtgaccttgagaaaggaagaggggatgagatccaggaaatggagatattgccctttgctaggagcaaaatgcatttgccccaaaggtaagcaaactcctgtagaaggccagagagtagaatcagggttgacttcaacaaagtcaatgaaccttcatttgaggtttgtgggccatatgctttctgtcattccgttaaactctgctcttacctgttctatggtaaagcagccatagacaatatataactgaacgagtatggatgtgttaaacaaaactttatttataaaatagatgggtcagattggcctacaggtcatagtttgctgatccctggtccatagtatcagaagagaaggcagagtatatggacacaaagggaggtagatgggtagatatttaaacagttgtgtgggctacctcctcttatttggtgaattataccaattgatttctagatgttagatgagttgtgaattactagaacaaaaagtgttcgtagtactcccttttccttttaatgttaggctgtagtagtaatgttccatctttcattcctgatattattaaatagtgaattttctgtttattttcttgatcactcaagctaaaggattttttattttatcgatattttcaaagcaccagcttttatctcattaattttctctatttgtttattttcctttttattgatttttagctatgtttattatttcctttctacttactttgcatttaatttgatctctttgtaattgctgaaagtaggactcagacaattggttttagatctttctccttttctaacatgaacatttacagttgtaaatttctctgtaagcattgctttaacttcagtacacaaattttggtatattgtattttcatctttcagttgaaatatttcataacttatctttgatttcttctttggcccatggattctttagaaatgtagagttttttatgggtacctgaatatgattgctttctaacttaattccatctttgtcagagaatatactcacggatttcaattcttttatgtgtgttgagattttttttaaacagcccattctagcatatgcctcctggtaaacaccatgtgcacgtgcagtgtgtattagtcattgtttgttgtgttctgtaagtatcattaccgtcaagttggttagtagctctgttgaaatcttttatctcttttgtgtggttattgttattggtgagagatgttaagatctccaattataattatggaattacgctgcaggtatttggaaggtctgttattagaccctaaattataattttatctaaaaagaaaaggaaataatactgactcagactaaatttcaggatatccagttaatatagctgttttgattctgcatatctttccttactctactatttttcccctacattctcccaaaggattaaataaataagtttaccagtctcttttgttatggcctgtagtttttatgttctaaaagttagcagacaacatagagcataaagtaattactttaaattgccctagattcattttgcttttttaaaaaattagttttgtattctacttttatttttcacccagcctttttgtgattaactttccccattgttaacaaatatcaaagattccctggagaattttaggtaaggacttttgtcttaagctatttcgccaagtatggaaggaactatgcacagaactattgaagtaacgttttgtaatactcttaactaagtaaactatactgtatctttttctgttacacaaaatactttagtttctgctaaagggaatactttttttaacaaataactttcaattataaatgcaaaaagattaataatttgggtcaaagttccctttccttttagtattctttaactaaaaattatgaaatgataatatgctaatataatttattaatagtagtacttttaaatgaattttcattttattaacaacaatttcaaatgtacaaatttggtgattatcacagtatgagataaattatttggagttgagacaggagttggcatgtgtgcacttgcaattgctccttgacctgctctgttgattcatggcattggttattaatagcaaatgccatactgtctctgccttccatttcttttcttttcctttctttcttcctctcttttctttccttattttttcttctcttttctttttctagttttcaatttttctcttttcaccaatacattcctagtatatatgctgttagggaattattttgcggattcttcctctgtgattggatggacaagaaatctgtggacattccatagacaatcatagaggttactgtatatatcttgaaaaattgagatgattttgtcattatacaattctgtctccatgttgatgagctaaataacttcaaccctgacttgtttatggaagattttgctcacttcaacctccttatatagcttatttgatatatgctatataaggctatattatgataatgctaaagtatttttacaaagtagcattatttgctcagatttcttatttttagctagaaaatgctaataggtgttttctattataatacgattttccaaagataaggcacatagtgtgtgttcactttcttcttcttaacttcttcaactttccttcttatatctgatatgataaaagtcttgaattcactaccattgtttctaaccgaatgtgtggaattatgaatactccccttttccctccaaaatctataaatattctgtcacaccttttaaagacaatcctttcatctgtttcttcaatcagtcccccttttctgacaccaaaacatctttacctcacaaagtcctctctcttttcagacatctatttgaatgatattggctaatcttttcaaaaagttctttcagattctcaggtgcaatgtgctgtgtcatgatcatcggttctttgttccttggcctttatctaatctttcaatgttttcctgacaaagtcatcttcttttctataggccccttccccatcttttttacggaaattcttccagtcatcctgttcataactttgtctcaattttttccttcttccttgaatcagtaactgttttcaaatgttttctctgctttttttcacatctgtcctatcataacgtaggccttcatttccttatactttgtttccccaactactaattttctttctcagtctattttgtatatccacaccaaagtaatgctacttaagtattcttttgataatgtaatttctctttccttaattccaaatttctgaatattctctaccaaacatggtataaaaagccactacagaactctgaaggccttctataatctgaaattattctctatttcatcataaagtttctaatctatcaggataaatattcaggtatacagctaagcttactaaaatttaatatcttctaggttattaatcagcatgaaatactatggaaacagagaggatagtgtcaaaatagtttatctcaaggaaataagttaggcttgtttttgattggtaatttgactcacaaaatttggcaaagaatagaaaaattaacttagaatgacagtttgccaagttaattcccatggctataatcaactgtagtttagggcagtaattgataaggtcttggatttttatgttactttccacttttgaccacagtttgattgcactgtggtctgagagacagttaatgtaagacctacattaacttttaaaatacaattctcttaattagtttttagttttccttagggccgaggataattattgtaaaagtaaactaggagcttatcaagttgttatatattgaatattgttttcatctgcagaagttatatttgcttaacgtgtttccttctaatagagagtatcttaggttcttgaatgcaaaaaacacttttcagaagcttctgaaatgatgcaattgatatatttttcaatgtttaactgattattaatactaatatagtgtttgtaatttcatgggaagggaaaagagagccaagtagacatttaattattatggtgatatatatacattaattctcataagtggccaaatctaagaagaaaaaattatactcaacccagtatgtgagatggactcacagagccaagtcagatctgttttctatttcaagtaaagtgagtctcccttgacactgaatgaggttccttttctgactcagcatgttcctggtagcccatgccaataggttatagctataaaatatatttcatcatcttctctcttgaaaatacgaaggaaaggaaaaagagagaggaatggcagggagagtggcaattgggaagagaaagagagcaataaattattgcaattcttctttggagtctgacaattacttgacttaaattagtgtataatgtgttagctttcattgaagggttaccattacatggagcagaccttcatacctttctttggaaatctggaatcatatgttctccctaaacaggaatatttcctgctgtgtcttttctattagttttttttattatgaaccttatcaaaacattgctttatatgttctgttcttgctctgatttagttgctcatggggacaaaactcagctctataactgaaatctttctcaaacaaagctgaaaaataacatacataatctgtctcataagagagctctgtggcttcctcagagatactatacaatagttttagccatctttaatattgaaaacaggtccaaattatatttttataccctggtttaaatttctatttattttttaaaatcctaagtatttacaaaatcctcaaccatagtcaatagtccttacagaaaaggcatgtacctattatttattctagtctttgagctttaaggggacctgacaaattgttcatgggtcattggaagttactggagacggatttagtcaaagagtaatgaccccagaacatctcatagggataaaaagcaactttcattcctctttctgtttctgtaggtatcttctcagtcctcagcttggcctctgagtgcacaacccttgccgctgagcttcccaaagtttcctatgtgaaggctcttgatgtttggcttattgcttgccttctctttgggtttgcttccctggtggagtatgcagttgtccaggtgatgctgaacaaccccaaaagggttgaagctgaaaaagccagaattgctaaggctgagcaagcagatggaaaaggtggaaatgtggctaaaaagaatactgtgaatggaacagggactcctgttcatattagcactttgcaggtaaggataaaattatgccatgaaatcatttcccccaaccacttcatagtgtcaagagagagacacctttgtgtatgtgacaagttttgatggaattggcatttgcttgtttttctctcacagatgaaaacaaactgagcacaacacaatttttgggaaacgtgctttttagaaaacattcagaacgtttaggtcgaataccacttaaggaaaaaagtaatgccttattaaattttttgaggactttgcactgagtttaaggattcaactctgctttgatggtcaccattgaatttggagaccttgctggatggagcacagaccttcctattgtttctcattcaatgtatcttaatgaaaggcccgaggactgtggggcatcactgatcatctgccttacataaaaaggcttggagaagcccatgctcatgattaaatcacccaccattccccattacattagagagcttcacatggagcatgtcaggcaggctacttgtttattggatgtctggctcagggaaacgatgcctgcagttaggaatctgtccctcccagcagtgagtggcaggagaaggaatatttaagattttaccccataaccctgccttgtcaattaattatgggtttaagaatagtgggcaatggtaaatttcaacgtgccaggctgtgtaaaggattgaggttagctgtccatttaccccaatgtgcccctcattgatgccttctggatgggtggaccagtcaaccagaagaccatttccattgagctaagagcagtaaattccacagaagaccaataggtccattccatcctacaaccttgaaaatcttaccttccgtgcttttcctctggtcccacaattgctctatcagtttgttaatcaccactagtcccctcacctagaatgctagactagtataccgcatgcggttcttagatgcagaagcaaaggaaccatgcttgtatggtgctgcctgtggcctttaaaaaatggtttaagtcatttatactcattttctgagcctaaagccaagaccctctgcaaatacttagctgaaaccttcagggaggcttcttgaggccttagaactcttttctgcctttcatgaagaataaggataaaatttgcattaatccagcactatcttggccttaaagatgtccttaatatatctttttcatacttctacatccattatttctatatcattatatttgaagtgagtttcttgtagacaacatatagttggtgtttggtatttaaactgctctgccattctcttatgtttgaattggtatatttagatcacttccatttaacgtaattattgatatagtaaggttttctctatgttttatttttctttgttttgtttattttggtttttgtttctctatcttctttttcctttttttttttttttttttttgagatggagtttcactcttgttgcccaggctggagtgcaatggcgtgatctcggctcaccgcaacatctgcctctcaggttcaaacgattctcctgcctcagcctcccgagtaactgggattacaggcacctgccaccatgtctggctaattttgtattttcagtagagatggggtttcttcatgttggtcaggttggtcttgaactcctgacctcaggtgatccgcccacattggcctcccaaagtgctgggattacaggcatgagccactgcacttggccctctttttccttttttaatgtgggttacttgaacatttttttagaatttcattttgagctttctatgttgtttttaagtgtatctctttgtttaacttctttagtggttggtctggataagttatgcatgcataacatcacgatctactagtgtcattattttgctagcttttgtgatgtttaaaaatgttacctctctttcatcccttaagctgatgtttataattgtcttaaatacttctgcatacatttagagccacattatagtttttgcatcaccatcaaatataatttagaaaactcaaggagaagaaaatgttattgtatatttttgctatgtttttctttcatcttcatatattccaaggttatatctcttttattattttctgtttagagaatttccttgttttttgtttttgaggcagagtctcactctgtcacccaggctggggtgcagtggtgtgatctcagctcatgcaacctccacctcctggattcaagcaatcctcccacctaagcctcccaattagttaggaccacaggtgtgtgccacaccacacttggctaagttttatatttttagtagagacagggtttcctcatgttggccagactggtctcaaattcctggcctcaagtgatccacctgcttcagcctcccaaaagtgctgggaatacaggcatgaaccaccatgccttttcgggaatttcctttacccatttttggataggtctgcaggtgacacatttttttcactttccctttatctgagaatgtcttgatttctccttcattgttgaaggatattttctctagatgtaggattgtaaggttacaattctatatgcatttcttttagcgcctaaaaagtattgtgttcacttccttctggcctccatggcttctgatgaaaactaattgttctaattgcttttcctctgtaggtaaagtgtcacttatctctggatgctttcaaaaagttgtttggtcttttggtcgagtagtgatcagaagtttaattatgacatgtctctgtgtggatttctttgagttgatcttgtttgggatttttctcagcttgttgaaaatatagatgtatgtttcttgccaaatttggagttttcagctattatttctttgtgtacttttcctgccttgccctctctcttctcttttcaagactgcgataacacaaatgctagatttgtgatagaattgtccctgggtactgtaggagactggttttaggactcttatcagataccaaggtctgctaatgctcaagtcccttgtataaaatgtgaaacttggacatttattaattttgcttatgattgctttggctattcaggctcttttttagttccgtatgagttttaggattgttttctctaattctgtgaaaaatgatgttggtgttttgatagaaattacattgaatctatagattgctttgggcagtatggtcattttcatgatattgattattccaatccatgagtatgggatgtgtttccatttgtttgtttaaggttattctaatttttttgctgctttgtaagagaaattgagttcttaatttgattctcaacttggtcattgttggtgtatagcagtactactgatttgtgtacattgattttgtaacttttgtacattgattttgtagactttactgaattcgtttatcaaatctaggagtcttttggaggagtctctagggctttctaggtacacagtcacatcattgttgaacagcaataatctgacttcctcttttctaattcagacgccctttatttctttctcttacctggttgccctggctgggacttcttggacaatgtcttctgttatctgccagtacactgatttttttcctctgccctttacattttcctgttgatctaatctatgagttttacagtttccatttggtatgtgtgtatttttttcatttgttccaatcatgttcataattggtcactgaataatttttatcatgaatgttgtaatatctttctcagatttctcagaattctcagattgttgttgcacagtttgaaatcttttgttatacagtttgagatctttcccagttttttgtatgatgagtgattttgtattgaaacttggacattttgatattatattatgagactccaaatcgtgtttaagccttctgttttaacttgctttctctggctctgttctgtcaggggaaggatgagtgctgcttcattacttccaagcggaggtacaagtccaggtttcccacttcgtcagggtagagctccttgatactgctgggcgggattgggggtcaccagttccccatgttgtctctaccaacacagcagcaggggttgccttcctgaccaattggtgttggtgaaagtcctgaccctccagggccccctgtgacatcacctcagcgtggaagaggaggagcctcttgttactgctgggtgtaggtttaagtccatactccctacatagtttccacagacactatggcagggatcagggccttgttactggtctacagtgatggaagtcctcaatcaccacttgacactatacttcagtgtggatcgggctgcctcgtcacagacttttaattattacactttaaattctagggtacatgtgcacaatgtgcaggtttgttacatatgtatacatgtgccatgttggtgtgctgcaccccttaactcatcatttacattaggtagatctcctaatgctatccctccccgctccccccaccccacgacaggccctggtgtgtgacattccctaccctgtgtccaagtgatctcattgttcaattcccacctatgagtgagaacatgctgtgtttggtgttctgtctttgcgatagtttgctcagaatgattgtttccagcttcatccgtgtccctacataggacatgaactcatcctttttatggctgcatagtattccatggtgtatgtgtgccacattttcttaatccagtctatcattgatggacatatgggttggttccaagtctttgctaatgtgaatagtgccgcaataaacatatgtgtgcatgtgtctttatagcaacatgatttataatcctttagatatatgcccagtaatgagatggctgggtcaaatggcatttctagttctagatccttgaggaattgccacactgtcttctacaatggttgaaatagttacagtcccaccaacagtgtaaaagcattcctatttctccacatcctctccagcacctgttgtttcctgactttaatgatcaccattctaactggtgtgaaatggtatctcattttggttttgatttgcatttctctgatgatcagttatgatgagcattttttcatgtgtctgttggctgcataaatgtcttcttttaagaagtgtctgttcatatcctttgcccactttttgatgggtttttttttcttgtaaatttgtttaagttctttgtagatcccggatattagccctttgtcagatgggtagattgtaaaaattttctcccattctgtaggttgcctgttcactctgatggtggtttcttttgctgtgcagaagctctttagtttaattagatcccatttgtcaattttggcttttgttgccattgcttttggcgttttagtcatgaagtccttgctcgtgcctatgtcctgaatggtattgcctaggttttcttctagagtttttatgattttaggtctaacatttaagtctttaatccatcttgaattaatttttgtataaggtgtaaggaagggatccagtttcagctttccacatgtggctagccagttttcccagcaccatttattaaatagagattcatttccttatttcttgtttttgtcaggtttgtcaaagatcagatggttgtagatgtgtggtattatttccaagggctctattctgttctgttggtctatatctctgttttggtaccagtaccatgctgttttggttactgtagccttgtagtagagtttaaagtcaggtagcgtgatgcctccagctttgttctttttgcttaggattgtcttggcaatgcgggctctttttaggttccatatgaactttaaagtagttttttccaattctatgaagaaagtcattgttagcttgatgggatggcattgaatctataaattactttgggcagtatagccattttcacgatattgattcttcctatccatgagcatggaatgttcttccatttgtttgtgtcctcttttatttcgttgagcagtagttcgtagttctccttgaagaggtcctccacatcccttgtaagttggattcctaggtattttattctctttgaagcaatcatgaatgggagttcgctcatgatttggctctctgtttttctgttattggtgtataggaatgcttgtgatttttgcacgtagattttgtatcctgagactttgctgaagttcttatcagcttaaggagattttgggttgagacaagggggttttctaaatatacaatcatgtcatctgcaaacagggacaacttgacttcctcttttcctaattgaataccttttatttctttctcctgcttgattgccttggccagaacttccaacactatgttgaataggaatgctaagagagggcatccctgtcttgtgccagttttcaaagggaatgcttccagtttttgcccattgagtatgatattgggctgtgggtttgtcataaatagctcttattattttgagatatgtcccatcaatacctaatttattgagagtttttagcatgaagggctgttgaattttgtggaaggccttttctgcatctattgagataatcatctggtttttgtctttggttctgtttataggatgggttacatttattgatttgcatatgttgaaccagccttgcatcccagggatgaggccaatgtgatcatggtggataacctttttgatgtgctgctggattcggtttgccagtattttattgaggattttggcattgatgttcatccgggatattcatctaaaattctctttttttgttgtggctctgccaggctttggtatcaggatgatgttggcctcattaaatgaattagggaggattccctctttttctgttgattggaatagtttcagaaggaatggtaccaactcctctttgtacctctggtagaatttggctgtgaatccatctggtcctggactttttttggttggtaggctattaattattgcctcaatttcagaatctgctattgatctattcagggattcaacttctttctggtttagccttgggagggtgtgtgtgtcgaggaatttatccatttcttctagattttctagtttatttgtgtagaggtgtttatagtattctctgatggtagtttgtatttctgcgggatcggtggtgatataccctttatcactttttatcgcatctgcttgattcttctctcttttcttctttattagtcttgctagtggtctatcgatttttttcatcttttcaaaaaaccagctcctagattcattgatttttgaagggctttttgtgcctctgtctccttcagttctgctgtgatcttagttatgtcttgccttctgctagcttttgaatgtttttgctcttgcttctctagttcttttaactgtgatgttagggtgtcaattttaggtcttcctgctttatcttgtgggcatttagtgctataaatttccctctacacactgctttaaatgtgtcccagagattctggtatgttgtgtctttgttctcgttggtttcaaagaacatctttatttctgccttcatttcgttatgtatccagtagtcactcaggagcaggttgttcagtttccatgtagttgagcggttttgagtgagtttcttaatcctgagttctagtttgattgcactgtggtctgagagacagtttgttataatttctgttcttttacatttgctgaggagtgctttacttccaactatgtggtcaattttggaataagtgtgatgtggtgctgagaagaatgtatactctgttgatttggggtggggagttctgtagctgtctattaggcccacttggtgcagagctgagttcaattcctggatatctttgttatctttctgtgtcgttgatctgtctaatgttgacagtggggtgttaaagtctcccattcttattatgtgggagtctaagtctctttgtaggtctctaaagacttgctttatgaatctgggtgctcctgtatcgggtgcctatatattcaggatagttagctcttcttgttgaattgatccctttaccattatgtaatggccttctttgtctcttttgatctttgttggtttaagtctgttttatcagagactatgattgcaacttctgcttttttggttttccatttgcttggtggatcttcctccttccctttattttgagcctatgtgtgtctctgcacatgagatgggtctcctgaatacagcacactgatgggtcttgactctttatccaatttaccagtctgtgtcttttaattggagcatttagcccatttacatttaaggttaatattgttatgtgtgaatttgatcctgtcattatgaagttagctggttgttttgctcattagctgatgcagtttcttcctggcattgatggtctttacaattcagcatgtttttgcagtggctggtacaggttgttcctttccatgtttagtgcttccttcaggagctcttttagggcaggcctggtggtgacaaaatctctcagcatttgcttgtctgtaaaggattttatttctccttcacttatgaagcttagtttggctggatatgaaattctgagttgaaaattcttctctttaagaatgttgactattggcccccactctcttctagcttgtagagtttctgccaagagatccgctgttagtctgatgggcttccctttgtgggtaatctgacctttctctctggctgcccttaacattttttccttcatttcaactttagtgaatctgacaattatgtgtcttggagttgctcttctcgtggagtatctttgtggcattctctgtatttcctgaatttgaatgttggcctgccctgctaggttggggaagttctcctggataatatcctgcagagtgttttccaacttgtttccattctccccgttactttcaggtacaccagtcagacgtagatttggtcttttcacatagtcccatatttcttggaggctttgttcatttgtttttactcttttttatctaaacttctcttctcgcttcatttcattcatttgatcttcaatcactgataccctttcttccagttgatcaaatcggcgactgaagcttgtgaatgcatcacgtagttctcgtgccatggttttcagctccatcaggtcatttaaggatttctctacactgtttatttcagttaaccattcatctcgtcttttttcaaggtttttagtttctttgcaatgggtttgaacatcctcctttagctcagagaagtttattaccaccaatcatctgaagccttcttctctcaactcgtcaaagtcattctccatccagctttgttccgttgctggcgaggagctgcatttctttggaggagaagaggagctctgatttttagaattttcagcttttctactctggtttctccctatctttgtggttttatctacctttgttctttgatgatggtgacatacaggtgcggttttggtgtgtatgtcctttctgtttgttagttttccaacagtcaggaccctcagctgcaggtctgttggagtttgccggaggtccactccagcccctgtttgcctgggtatcaccagcggaggctgcagagcagcaaatattgcagaacagcaaatgttgctgcctgatccttcctctggagggttcgtctcagtggggcacccggctgtatgaggtgtcagttggcccctactgtgagatgtctcccagttaggctactcaggagtcagggacccacttgagaaggcagtctgtccattctcagatctcaaactctgtgctgggagaaccactactctcttcaaagctgtcagacagggacattttaagtctgcagaagtttgtgctgccttttgttcaactaggcctgcccccagaggtggagtctagagaggcaggcaggcctccattgtgctgtggtgggctccacccagtttgagcttctcagccactttgtttacctactcaagcttcagcaatggcggacacccctcccccagcctcgcttccacctcgcagttcgatctcagactgctgtgctagcagtgagcgaggctccgtgggcatgggaccctccgagccaccatgggatataatttcctggtgtgccatttgctaagaccgttggaaaagcacagtattatggtgggagtgtcccgattttccaggtaccatctgtcacagcttccctttgctaggaaagggaattccccaaccccttgcacttccctgtgaggcagtgccccaccctgctccatgggctgcaccgacagtcagacaagccccagtgagatgaacccggtacctcagttggaaatgcagaaatcacccatcttctgcatcactcactctgggaggggtagactggagctgttcctatttggccatcttggaacctatgatcatcacagcctttttaaagtccaagccttggccccctcacctcttggacattgctggcatgtccgttggggtggggtgggagcacatttttttctgtagtatttggcaagaatagagaggttaatatctaaaagtgttctgtattgctgggctgcccctttctttgtcttctggctaaacatcggaggctgttggggtttttatgtctgtacccattggcatttccacttgctggcttctttagctccaaatctgggattatatgagacaaaagggggaatgcaggaactcaccattttatggttcctgggatcctgagtccccaggctcatctgcttcctcttctctcccttttatagtctgtctgtgtgagtgtgtgtgtgtgtgtgtgtgtgttttaatataatgtccaggattttttattgaacttagcaggaggaataggaaaggtatgtctactctatcttcctggatgtagaagtcctctatgcttttcgaggccctcagcatcctcatcatacctgcaccctgcctaccacactctaataattaaatagatttatcaatgggctactcttaacactttcattgttgttgctgttctgtctactgggtcatttcagacttactaaaatcctacaccaggaaaacaaacatttggagtaattattattccctttaccagtattttttttttttgtctctgttaccacccaagtctaagaagccacataatatccagaagaactaagggattgcttaagggcatgctttggcatgacgaagaactggtattgaaagcatactgtttgtgagaaactgtgcttccccttctaaagcatacagttatttctccaggccagaaatggaaggaagattacctgagagccttatgttatgtggaagtgttctctacctgattttttgacacttgttatctactcctcgatttacatctccctatcttttaccacttcctcacatttccagcccaccaatcccctctaacttgacctctggttaagagatttggatacagaaagcaaggatgctctatagaacaggtgcttgattcctggtaatccctacgatcagctccattggctggtatattataggtcctcaataagcacaggaattaaatgtagtaacaatactaataagcaattaaattaaattctgttactacattaaattaaatgtagtaacagaatactaatgtgcaatgatcctgataccttaatctattccatcaagtaggggtactgatagaaggaggctatctagaaccagctttctagagcattgtagaatacattcagattatttatgaacatggatagcaaggatgagaggatccatgaagtagtaaacccaattatgttattttaagtttatctttaaagcattaaaattaaaactaataattaaaataattacccaataaataaaagttaaacacatataagaacttttatattttaattctctatgtttttaactgctcatagaaacacacttgtttgaattctgaaactgctgtgacattttgcttcaaaagacaacgagagatgcatagagttaagaattgaccagaaattttaatctttagaaataaatgtaaattacttttattctttacaggacaaaaatgcactttccagaataaactttgtacccatagaatatttgtttcctgagacaggcttcaaaatgataacatgagtctaataataacttacatcaaatgtgtaacttgatgagtcataagattttacatattgacatatgaaagaagatataaaagtagaaatttataaattattatctttttaattcaatggttttgcaatgaaaaatgtaattaaacttttggtttcaaaatgcattttttctaatgtactttgcctttctaaatgcaaacttttgccaaataatttcaatattgttattcaatagaataacaataataattaacagaagtgtaatataatttggattgtaggaaatgtttgaagctgatgtataaaataatattgtgcttcctaaggaaatgaatgatttaaaaagtagaaaaaaattaaatgataatgtatagcttttactatgaggtttttataatttgtggcctgtatacaaaaacatgttaccatgcctatataattgtctggaggattttttttcccagtaaaagtggtgctttttcagtcattccaatatcttggttacttttgtttgttcattcatgtattcctatttttattcaacaaagcagttaagaacctactgttgttaatgtcaccctatttctaacactagtatgtgccatacacaaaggttttatgaataaaagacaaagaaaatagtacctatgcctacaattttatataaattagaaaataaaagctgctgtttatatgtaaaggagatcttttaatggtaatgatttaatggacttaaatttagcaaaatatatacaaattattccctctgaacatattttattgtctgtagaggatgccattattgacatgaaatcgtgcctaattattctggtcaagaaatactgcataaagttatttgcttttaaatttgtgtggaatgaaacttaaaagaaccacaaagaaaatcttagaggctaaagttggaggcattagaaagttattaatagcatcgtttttttattcttgacagtttcattatcacactacctcatttttgttgccaataattttcagaagtgacagaagtttatatgatgaaagtaaatgagacacatatttgtaataaggaacaactgagaaattattaattgtaggttaatatagccaaattcgcttttaagaatgtgtgttaagtagggttaatgtcttgtttataagcagtttatttcatctcttttcatgtgatgttataactgtttaaaatagtatttatagtgtaaactcttttgtactttcatgtatatatttgatatgataataaggtgtaacagaaaattttctttgtgtaaaatctgtgatgaatggggcaaggagactagccaactacttaatgaaccatgacctatttaagaagccctgagtacttctcattagggaaactaatcttattctttattcagtatgtcattatcattaaaaattacttctgtaatagaggttccgtccaccccacatgtgcacctctacttattcttgaatacaagaatcttcaaatatatctccgagagacgttttaaagacttaaatggctagaaacttaatataaccaatttgcagcttttttggaatgctttgtaatgttatggcttcaacactgaaaaaattattctcttactgacatgtttactataagtaatctctgtgaataaacataatattctatatctatagtttgaataaactggatcaaatcctaatattatttaaattgctggcagaatttatatggttatataaataaaatagattagaaaattggaaatatttatttgtggcctaggttataatattatataaatttggccatttgtttagttatttacagatactaaaaccacacctaaaatgatataaaaatatgatttatagcaaatgcatttctacagtatattctaaatatacttggttttaagccattaagtctataggcagaatctagagtactcctttgttatgataagtagcttcaaaagcataatgagtacatctaaagcctttataatggggaattctaaagggagaaagagcaactatgatacacatagaatccttgattttaaagatttctctgaaagtcttagggcaatgcaaagatttgatatgtacagtctgttctccacttctattccaatcaagatagtgagttactctttacaaaagttcactgatacatgtggagactcacacattcctcaaactgcactggaaaactgaagattaaatgtggtcttctctctgatgttctgtctgtaacaataatagggcagatgtgagtgtgcaagtctgtgtgtgtgtgcacatgcatgcatgcctgtgcaagtactgttggaggtgaggtggtggacaaattgatgaaagtagtcttttaaaaattcaacttagataaatggggcaaaaattagatgtatatttgtatatgtttctgtgtgtgtgtgcatttcctgaagtcatatttaaagagtttagattttagttgctactttttctctctctcactctttcgacttgtgtatagtccgttttgtgctgctataaaggaaatacgtgaggctgtataatttataagaaaatgggtttatttggcttatggttttgcaagctgtactagaagcatggcatcagaatctgcttccaatgagggcctcaggaaggttacagttatggtggaaggtgcaggaaagctggcatgtcagatggcaagagtgggagtgagagggagggcaggtgctaggctctttttaacagtcaattttcacttgaactaacagagggacaactcattcattaccccagggaggacaccaagccagtcatgagggatctggccccgtgacccaaacacctcccactaggccccacctccaacaccgggagtcacatttcaacatgaaatttggaggagacaaatatccaaaccacatcaaccagttcctatttttttttttttgtcagacattttgctagatacagagtataaattgatagggactaaagcctgtccgtacttcttgatgccatgcagatgtaggcactgctctttcacactcagttgagctctcacaattggtaaattgtaactgcacattaaaaaagtggagtgagggggtgcagacaagaagccacttttttcacattggcctacttcttgacacacattcttagaagcgaatttggctatattaacctacaattaataatttctcaattgttccttatgaatatgtgtctcatttactttcatcatataaacttctgtcacttctgaaaattactggtaacaaaaatgaggtagtatgataatgaaactgtctagaaaaaaaaatcatgctattaaatactacctcaaagtcctattgaacaaggatgggactatgtttccatttgggctattttataatgaacaattgctaaataagtcaacatgttggtgatttacatcttttttttcaaatatcaaatgtatagaaaggtgaacttctagttcctcaatccctattcctcatcaacattttttgggtatttttctgcaaacatatttacataaatatctttttaaaagtttcttacccactggcattttacaaatatatatatggcataaagtatataataacaaagccaacatttgtatgctagcttaagaaatataacatcaatatatgctcataattagagaagaaatggtaataatttaaatgtataatcacagaaggatgtataaatacatttaacttgctttgtcagtcactttatcttgggcatttttgctatccacctttgaacactgctatctggctcttgtctaggaaatatatatataaatatatgtgtattcaggtaaaggatagtctcctggtacctaaagtactgttgaggaaagatttgttttatttattgtgtgaggtatagtgtttttaacccagctataatttagtaaatgtaaatagaatctatagaattagtcaatgtattaattatattaataaagcagttactagagtaactgtgatatactaataatatacaattaaatggtttccatgttcaataaaaattgagtaaatgtcaatagtgaagattctgaaggtgaatagcaaaactcaatggtaagaacagtgagaaaatgaagcaatctagccaagagctaacctttttgtggacttttgtaatatgtaagtgctattctcaatcattggtattagcctactcctctaatctaagagcattttgattactagagagagttcagcataaaatataattgtccttttgtatctgtggggaattggttccagtatcccctgcagatatcaaaatctatgcatactcaagtccctgcagtctgccctgtggaacctgtggatacaaaaagttgaccctctatatccatggattttgtgaacactgtatttttgatctgcatttggatgtaaattcagaacctatagatacaaggggcaactgtatttattgaaaaaaagcccatgtataagtggacccttgcagttcaaacccatgttgtaactgtaattattttatatattatagggaatttattcaaatttaataattcagaaattagtgactgaataataatctctgtagcatatggtctatctgaaggatacataattcctttgtattgtctgagcgtgattggttaagttcagccaacaagttgggaatgcctatcactagtaaacgtttgattcatgacaattgtgaccattttttagtccttgtttgtgaatgtggcttagagaaagtctgtctcattggagagataaattacttagcatttataaaccgctctacttggaaataggatctataaggaagtcaaaggctagtaatatcagaacatttttataatccatacattgtagaatattgtctctgtcatggttaaatattggagcaaaaatggatgtttatttattagtcctacaactgagaactttcacaagcctggtagcacctaaaattaatctgagctttgattccttagcatgaaataaccaatcaaaagttcattccatgacataagccttattatgtaggcaatattttagagccctaaatgctcaggcaatctgatggtttaatcagataaccattctctctgttagttctttgtgacataagcaaatgcttcttgtagaaactagcaattttaaaaatatcgtttgaagagatgtgtttcgtaagtagaaaagttttaaatacattgtcttcaatatttattcttaggttggtgagaccagatgcaaaaaagtttgtacttctaagtctgatctgagatctaatgacttcagcattgttggaagcttaccaagagattttgaactatccaattatgactgctatggaaaacccattgaagttaacaacggacttgggaaatctcaggctaagaacaacaagaagcctccccctgcgaaacctgttattccaacagcagcaaagcgaattgatctttatgcaagagcattgtttcctttctgcttcttgttcttcaatgttatatattggtctatatatttatgataaatcttttccatttgtacaaaataaaattccatttcattgtgacctactcctttcataaatgccaatctgtgagaacttttgaattttcatagcaacattgcattttggatgccatttgattgtaataaaactgtggcaccttaattttgaatggcagcatgatcatgtaatatctgtgctctaataacgatgtatatatgtatagtgaacatattgcttagtaacaaatgaaggacaagcatactacataatataatccatacaattctcttcagttagtgtaaactgcaaatactacagataattctgataataaaatgatatgcacgctgaatcctgctatggtcaccattctaatgtatgtagtatttcaaatttccttccttgtaactttcaaagaaagccatcttattcttgtaaaattttagatggtattatcacagatttaaaaaggttgtattacatattgtttaaactttgtaagtagaaatatatctgttataattatacaggctctgtggagaaataaagttcaaaatatattaatttgtaaaatcagctcgttttaaagtgtgcttgtgttgtcaaaaatatcagatagtaatacacagtgagcatttttaaacaaagggaaacctatatttatgtaactgtatactgaattctgacaaaataaaaaaagataccttattgacgaaatatttaggataaacaaaattctatttaatccaccttaaaacctaaatgtattttcatggatttcatttgttggtacatattacacaaaacattgtgccttaaaatgagtcatacatcttttaaattggaatgcagtaatagatatgtgattttacatcatttttaagaaaccaaggggaagtaataagttgaaaaagaaatccataactattaaaagattttaacttttttattttattaaaatgcttgcatattttaagtaaaattaaaaatgtttactgaatttatttttttatttgaatattttgggattagttacaaaatatttagagattaaataaataatagctttgtttgtgttagacttcacttctacttgtattttctttcttgttaaaagtctagacaactgagatttacttactttgaacttgttccaatccaaaagtaagcactaagtctcattttatgagaccaccatttcttaatatcacatccagtgcacctttgtctttctgccatatctgaaataaaactatcagtaattcacatagataaacataagactaaagaagtatatttacattatctggagagttttgttgcagctacgagtttgtatggcaaattcaataataaagtattgtttatgcaaattgccatatgtaattcagtgctattcaatttattgaagccttgcatttttaaaagattctcactgattatattatttttaatgggatataatcgaatcctttgtagtccttcagcaccctctagttgtaaaggtgatatccggataattttacagtgctacagttaaccctgttgatggacttaatatcttctaagacccagggcaagagcattttaatggaactgtggtaagaaaaaaaaaatgaataggatttaaatcacttaaaatgtttacttgtaataattatatttgcttataatctgattcctttattttggcaagtttcattcatattagggaatttgatctagatatagagttttaagtggaagatgtaccatattgaagacgtatctcattatatagaaatttatttgtggaaaatagcataaatgaattacttttctgtaatataatattgcagcctcttaagaccaattttaatacccaagtatatatgaatcgctatcccaggattaagtgtgtatgtgtaactacaaatggaacactagaaaaagatcataacaaagaagtatgagtgtctgctgacagttgttttataattcttctaaaagatttagtcacagaactccagagtagttctgatctgtgtgctttcagtattatatatttctaggagattcacagtatatctacctggagcatctgcggatacctcaaattcagtgtctttaaagtaaaaattatcatctcaaaaatcaggttctctcattttttatttctgttaaagccattgctaatccagttgcccatgttaaattcatcttcctttctcacacagtctgtccctttaagtatcaagtcctataaattctccctcttatacctatcatctcctctccattcctactgacaccctcctaattcgttttctcattctatgtaatcagactctttcagcagtctacagtctcacgctaatataactctatttttgaactaacttcgtaatttttgttttttagttgcataggtaatacctgaatatgttgaatattacaaaacaaacatgtatttagagtcagtatttaaagttgctgtccatagcctttttccttcaaactattctgtctcttccccagaggtcatcattgttttgtatctattcagaactcat

SEQ ID NO: 15441 - DNA, 5749 bp, Human
taactctctttaattctaggaaggatgagaaaggtgaggaagctgcagaagaaaagttggaagctagcagagattggttcatgaggtttaaggaaagaagccatctccataacacaaaagtacaaggtaagctgggcgcggtggctcatgcctgtaatcccagaactttgggagtctgaggcgggcagatcacccgaggtcgggagtttgagatcagcctgactaagatggtgaaacctcgtctctactaaaaatacaaaattagcctggtgtggtggcacatgcctgtaatcccagctacccgggaggctgtggcaggagaatcgcttgaacccgggaggtggaggttgcagtgagccgagatcacgccattttattccagcctgggcaacaagagtgagactccatctcaaaaaaaaaaaaaaaagtacaaagtgaagctgcaagtgctgatggagaagctgcagcaagttatccagaagatctagctaagatcaccgatgaaagtgggtacactaaacaacagattttcaatgtagatggaacagccttctattggaacaagatgccacctaggactttcctagctagagagaaaaagtcaatgagtggcttcaaagcttcaaacgacaggctgacttttgttaggggttcatgcagctgctgacatttggttgaagccagtgctcatttaccattccaaaaatcctaggacccttaagaattatgctaaatcagccaggtgcggtggctcatgcctgtaatcccagcactttcagaggctgagttgggcagactgcttgagcccagcagttcaagaccagcctgggcaacatggcgaaacccgtctctacaaaaattacaaaaattagccacgcatggtggtgcatgcctgtgaaactcccagctactcaggagaatgaggtgggaggatcaccagagcccgggaggtggagggtacagtctgtgccactgaaccccagcctgggccacagagcaagaccctgtgaaaaaaaacaaaagaaaagaatgatgctaaatctactctgcccatgctctagaaatggaagaacaaatcctggatgatagtgtgtctgtttgtggcatggtttactgaatattttaagctctctgttgagacctgctgctcagaaaaaaaaaaagatttttttcaaaatattgcagcacagttcaatgacactgaatacatccacattgttgcgcaaccatcaccatgtgactttttttttttttttttgagatggagtctcgctctgttgcccaggctggagtgcagtggcgcgatcttggctcactgcaacctccgcctcctgggttcaagcaattctcttgctcagcctcctgagtagctgggattacaggtgcatgccaccatgcctggctaatttttgtatttttagtagagatggcgtttcaccatgctggccaggctggtctcaaactcctgacctcaagtgatccacctgccttggcctcccagagtgctgggattacaggtgtgagccactgcgtgtggcatggccctatttttaaaaatttttagagacaagatctctctatgttgcccaggctggtcttgaactcctgggctcaagcaatcctgtctcagcctcccaaactgctgggattacaggcatgagccacagtgcctgaccaggtaaacctatttttaatattttgacgctgggcacggtggctcacgcctgtaatcctagcactttgggaggctgaggtaggtggatcacctgaggtcagcagttcgaaaccagcctggccaacatggtgaaaccccatctctcctaaaaataccaaaattatccaggcatgtagcctgtagtcccagctacttgggaggctgaggcaggagaatcgcttgaacttgggaggcagaggctgcagtgagccgagctcgtgccattgcactccagcctgggtggcagagggagactctgtctcaaaataaataaataataataatattttgctttttcgcaacgggtttgccgccagaacacaggtgtcgtgaaaactacccctaaaagccaaaatgggaaaggaaaagactcatgtcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagacttcatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgcccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgccccggtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattaggttttaaaatcagtactttttaatggaaacaacttgaccaaaaatttgtcacagaagtttgagacccattaaaaaagttaaatgagaaaaaataataataataataataataataataatattttgagaaactgccatactgtttccacagtggctgcaccattttacattcctctttttatgttttacacatctgctgtttggtgaaattttctacagagtagcttttaactctgagcgctgtacttcctttgaccctggacttcacgcccaaacatcagtaaactgtcacagaaggtagtaataatgtgtattcctggaagccatttctacatgggatgatcagtgataactattaaattaaatgactgcaagccacacatgcagtccattcaatccaaactaaatgcattcccaattcaacttcccctcagtcaaattccccaaatgcctgtgactgcttcagtgtctcccaacaccaggggacatgtgatagagggcaggtcccatagaaagagacagcaggctggctgtggtggcttacgcctgtaaccccagaactttgggagacggaggcaggcggatcatctgaggtcaggagttcgagatgagcctggccaacatggtgaaaccccgtctctactaaaaatacaaaaattatccgggtgtgtgtggtggtatgcctgtagttccagctactagggaggctgagtcaggagaatcacttgaactcaggaggtggagtttgcagtgagctgagatggcgccactgcactccagcctgggcaacagagcaagactctgtctcacaaaaaaaaaaaaaaaaaaaaaaaaaaaaaaaaaaaaagaaagaaaagaaaagaaaagaaagagatagcagtttaaattgcagttaaaatcttgtgttttcagtttttataaaaacatgcctatgtgaatacaatgataagggacctaccagggccttcaaaaagtacatgcacttgagggaatctgatgcttaaattgtattagctttattataaatttccctttgcctggtacattttaaaaaatatttattttaggaatataactctttatgaacagactttgaaaatcagtactatatgtatgtaacttaattttgcttcagaatgacgaattggttaaaagggagaatatcctttggaacaggttgccccacttggaaataaaaagaaaattgtgaaatatctgcataaaccccatccccaggtccccatcatttgccacccagtgttggaaccgtgtgggagtattcttggacctggatgtgggtgtgtgtatggtcggacgtgatcgggagcaggctggtcccccctggcccagcacatggcttccatgaggctctaagctccccaagctgggttcaccttccgtcgctacttcgccctttcttccaggttgtcatgggcactgatggtcaccaggtggcgatgttgcccaggaggacgctctgttgccatctcatggccaaaattcaacactacactcttcctcctgctcagggtgcaggaatccgttccagaccagggaatactaaataaatacccactgtgtgcttcacagactgacctagcatcccaggaaggaatattcagattctgggacccgaagaaaactttttttttgaggtggagtctcgctctgttgcccaggctggagtgcagtggcacaatctcagttcactgcagcctccgcctcccgagttcaagcgattctgctgcctcagcctcccgagtagctggtactacaggcgcccgccaacacgcccggctaatttttttttttttttttttttttttttagtagagatggggtttcactatgctggccaggctggtcttgaactcctggcctccagtgatccgccttcctcagcctcccaaagtgctgggattacaggcgtaagccattacgctccggtgcaaagaaaacatttttgaaagccctccttgtcttcagttagtagaggatcaatatccccccacccaagccccatcacagaagggcctccccagacagtattaagtattcaaggccccagacagaagtcaggtgtggg

SEQ ID NO: 15442 - DNA, 5749 bp, Human; identical to SEQ ID NO: 15441

SEQ ID NO: 15443 - DNA, 39243 bp, Human; identical to SEQ ID NO: 12316

SEQ ID NO: 15444 - DNA, 145928 bp, Human
  misc_feature (1)...(145928): n = A,T,C or G
cctgtcccagttgaatctagtgatccatccagaattctgaccatgtaaatcccctgctctaagtccttccactgctccctactgccgtcaggataaagtccagacactttgcagtggcctgcagcattctgcccactcatccggccccaccttaggcttctgcccactgcaggttactttatggttatcaagtctttggaaatctgttctctgcctggaatgaaacttgctcacttcttgtctgtcactccggttcctactaacccctgtcaaggccctgcagctagcaggcttatgaactgtctctgagctcctggcacaaccctcatctctttgtacagtaattatagatttgctggtcccctctcccctacccctgaagggagactttatctctgaatccccaggaacagcacaggtaccggtacaaaacactgggcagaaatgaaccaatacaagatgaacgtcttggatgccctggacattccctgtcttcctgacccaaggtctagtttggctccctctagggctccctggtagctcaagtgtcagtccagacattgagacctcggcaaagagcttccctttaccctctcttcccactggcctttgtgggcggtgtggaatgtgctgtaggccttgcgagagcggcatttcttttttttttttctctctttttttttaacctattgtagcctctgagagggcagcatttttgggcgcacctgcacccaagcctctgacagtgccctgggttcctccagcaacgcgcatctagggatgctatgccctgtgggccctatgcccggggcacggagctaggggaggcggtcaccctacttctctcacgtccctgtccaccttgcgcctcagcggagccttaggtaaacaagccaggctcccagtccccaaggacggccttcaccccagaccccaggaggaggcgtcttgggccatctcgggaaggctagcttgctcgggaggggcagatcacgaaaacggttctttaggcagtgtcacttcctctccactgccagccacccaatttaggcggctccatccctcccgctttcatggatatgcagcaggatgcagagagcacagagctgtgattggcacgagctcacaacgggctttcccgctcaatctactcaacttccagcaagggacaggccctgcccattggggttcgctgaggcctcaaacgcgcatgctgtcaagggagcagctgcgggggcccgctagtggggacaaaggcgcagccaccggggcgaaagctccgccccgcagagggtgggcctgcggcgaccgcgagctcagagtccggacttgtcgcgcaatctgtctccttcggttccaccccaacctagctggactctcggtccggtccctgccctctggagactcagccattaaagttgaggtggggggatgaggatgtgggcggcgtccaggtaactctgaggggccctgatgccttccctagagccagccatcaggagtaacacgatgcgcccccacatcaccgaacccagaacctcagtgcttcagcaccccttcctcgacatgagctccgcccaatgaggagaagggtcttctgcattggccggtggtggtcccctatccaattagagaggctaacggccttctctcgtctggtttagaaggaatcgccgggggaatacaggccaaactacaattcccgagaggtagctgggctctgcgggggggggggggggggcgcctgcgtgttcacgtgacttccttccttctcgcggagaccgagttacgcgataggcctgtgagggggcggggcccggcgcctgttcgccgtgttagtggccaatcggcagccaggcagggtgggcgcgcgtagggggcggggccgggcgcgcggcagggcgcgagagcgcacccgcggcggcggtggcggcgactgtgggggggcggcggggaacattggctaagccgacagtggaggcttaggcaccggtggcgggcggctgcggttcctggtgctgctcggcgcgcggccagctttcggaacggaacgctcggcgtcgcgggccccgcccggaaagtttgccgtggagtcgcgacctcttggcccgcgcggcccggcatgaagcggcgttgaggagctgctgccgccgcttgccgctgccgccgccgccgcctgaggaggagctgcagcaccctgggccacgccgatgactactgcaaactgtggcgcccacgacgagctcgacttcaaactcgtctttggcgaggacggggcgccggcgccgccgcccccgggctcgcggcctgcaggtgggtgccgggccaggcgggaccgtggagcgaccccgcttctcgctcgcaggatctctcgctccctccctgttcccttggatgaccggagaccgataaccctgtgtgtgtgtgtgcgcgcgcgtgtgtgtggtgagttaaaaacggatttaaatcgctgaggaggcgtgtgggtcgctgcgacgtggaagtggtggcgggcttggctggaagcaaactagtggggaactcgactccgggacgatcggggtttggaggcccagggtccgggctgctgcccaagtggcgtctggttgtcgttgctttgccagtgtgttgcaaggaaaatgttgtccctgtgaattgttagcgcactgggtttttcatctattctaggtcgtttcttgaaattttagtttgaaagatgcttatttttcaacggtaggacccctctaaaaatcaggcacgtgtttttttaagtctactttgctagaagagtaatgctttcgagttaacgtccactcgtgcaagtttatgacccacaattaattcgaagtgtaactgtaacgggacttttctggaaactggatttccttacttgaataaagtgttccggaagattttttttttaatagtgggttgcttttttcataattttcctagaaagttctagaagtcgatttttatttaaagaaaaatctctccttggaagatattttaaaggaaatcttgaattgggaaagctgggcaccatcatgcttgcaggtcagaccaatcaggaaatagaaacaggatgactggggacttagagctcttttgtgacctggtttggaatactgtggttcattaagttcagtttccctgttacatatgcatacgaacttcaaaaaggaaatggataagagtaatccctattttttcttgcctggtatgaggtgaatttcttaatgttcatgtttgatgttcagtagactgttctgtagagttgcattgaaaaaacatacctgaacgtgaggcatgaggattctctaggcggtacttattttatcggtccttttagtcttcatatgctagatgtctttttcactgtagtacataatttataatagttatgtgttggctgcgtttattttcaattccattaacataatttgagcacctattacgtcgaaccactcttacggaccctgtagtgttatgatgaggcagaggactgaggcttttcaaggagtttgggaaatagttggaggagacacatagtccaagtaataactgtactactaggaagtctgtgaatggtgatgcattttatagtagaggaagaaacaggaaaagtggcatttgtggagagtgtagcattgaattgtatctagattatcgggacttgaaagaaaaacagcttgtttgagtatttttattgtaaaagagataaacagttgatgatgtcagcagattttattgggcacaaacttgattagagcatatatacaaatatatgatcgataagggtgttaaccaaacatatgaataataaaggaattgtgtgactacataagtaggaattgtatatacaaccaaaatactgaataacatttcaaagctatgaaaaaatttttaatgatctttaccatacgcaaaagccattttgatattaaaataggtctaaaaggagttatctgtaacttgatttataactgaaatttcaaaaggtaaacatcagcagttttatttgtcacataaagtccactttaaaatattttaagcaggtaattttttttaaagtttttttaatattaaggcaaaatacatatgaaaaaacaaaccttcttaaagtgaacaattgagtgcattcagtgttgtgcagctactgcttctgtctacttctaaaacattttcttcatccaaaagaaaactcagtacccattaaacagttgccccatatttttccttccctcctcccaacccctagtagccaccagtctgggatctgtctctatggtacctcttctagatattttatataaataggataatataatatgtgaccttttgtgtcggactacctcattcctttctatggctgaataatattccatcgtgtgtgtgtataaaggaacacaatttgttcaccaattgatggacatttgggctttttctgccttttggctattgtgaatagtgctgctatgaacacatagcaattaattttgaaattctgttgaggatgtgttatatattcacagctaagttttcagaattacttgttcacaaaataagttttcattttactaagcataattatgagtatgtagtttgaaggaacaaagtggattcactgaaatgattttaggataatatatgcagtaaagtggaaaataagaataaaatggttagtagaattcagatccttgctgggttatatcagtgtgtttgccgaacttatttttggattctcttcctcactggaatggaagttccttgaggtcggggatagtgtctgtatctttttcagttatattatcagtgcctagctagcacagtgcctttacatagtaggcactatatatataatatataacatatattatatataaaatacatatatatttacatatataatgtatatttcatatataatatataatgtattatatacattatatactcatatactatataatatataaaatgcatataattatatataatatatgtagtgtatataatatatattttatatattatatataatgtttattatatattttatatatattttttcttttttgaggcagggtctcgccctgtcgcccaggctgggatgcagtggcgtgatttcagcttactgcagcctcgacctctggggttcaagcgattgtcccgcctctgcctcctgagtagttgggattacagtggtgtgctgccacagctggctacgttttgtgtttttagtagagacagagtttcaccatgttggccaggctggtctggaactcctgacctcaagggatcctcctgcctcagcctcccaaagtggtgggattacaggcatgggccactgcaccctgcccaatatatatatttttaaatagagatggaagtctcactatgttgcccaggctagtctggaactcctgggctctcctgttctggcttcccaaaatgctgggattacaggtgtgagccactgcacatagcccctatattttgttaaataagtgaataaataacacctaagttttgaatcattgctcactgctctttcgtggtagaggaaattgacgagaattgtttcagttctttggcttttattgatgagttccataaattagatcttggtaatttggggctgcagtggttttacatctctgaaggtttgggagtacttgtatcacaactaaatttccatacagtgagaagatttttgaaaaatagtgaggtaagtggatagagagtgaggacaagccaagggctgaatttagtgaatgtcctaagcaagcttgttaaagtgctaattagatgatgtgagatggacttgataacgcttaataatgttgtatgttgtatacatttgtgactgacgactgactttttaagactactgtttgcgagatattttgagatttttttccattaaagaaaatttaagaccctagagtcgtcagctttcttatttatttatttttttagacagtcacatttagtagtggggggttgtataccaactttagtgacgctaatgttaatacattataataactctctaccgtcagaccagcctaccttgtttttttaaatatgacagtgctatctctgatttctgcagttaaaaatgaactaaacttttttttaacattcttttacttaatatctagctctaaatagatgatatacctcagtagtaaataggaaatttaaaataggtacatgtttaatgtattccattaacattgtttgccattataaagggcagcctgtggtactctattttagtgtagtgattgtgtatctctaagtttgatgttataataatctgtactttgcaaattcagagtttcattctcagggttcattactaaatattgactttctagtcctgaatgagagttactggaaggaatgtgctatatactatgtgtagtatcttatctactactgttttttcaaaggggagaaatatcttagatacaatatgtatttttgtaagaagtttactcgatgataagatatgtgtaatttttttcagataatcctttaatacacaactttttcatatgtcaagttgaggaactattcctagaaattgtcttagaatttaatctacaatgtttttactttgtttagtgcttggagatgtgatccaatttactgtctcttagataattttattttctcacttttcagtttttattgatcatttttagtcaaggtttttgttttatcttgtgtaaatgagataatgtatttaaagcacttagcacagtcctggtcctatttaagtggtggtaactaaaatttttttaaacacgcaacccccccccccaacatttctttaaaaacacacacacacacacacgcacacacacacgaataggctagtttttacttccttctctttgctagacccttctccacatgctaaattaaaacattgagagatagtagggcatttacaaacagtagcattttaaaaagaagaaaaaaagagattagggcagatgagagattcagcaatttaaaccttacatgagttagaatatttggtcttaagacatttttatctgtttaattctagtcttttaaatgttacttacctcttatattttatcaaatactgaaagtaatacacttttaattatatttttccactttcttgaattaagttcttagtacaatgtgaaagttggttgatctgccaaacatttaagtatataattggatatttaaatcagtatgaaaaggaggaagttggttggtttcttgtagaaatttaatggtgtgtttgtacagcccattaggaactgtaaaggaggttttggatgcttagtagctttattttcttaccttaggccaacgttttctgtagagttgaatgtagtgagaatatgtattagacgactgagtcgataataaatattttaacatttcatttggaagaatacaactctgtttctttgacacatttcctgatgttgaaggatgcttctgggggtaactggcagaattttgtggtttagattagtgaaaaaatgtgtttcagcaagtatggggaaaaatcgaggaaaaatttcaatgtcatgtttttgttaaaaacattcatcattgcaagagctattcctgtactttcttaggtgttcctatttgccaatccagaaaggatactttggcatatattcttaactattagtagaagtaatactgtagtagttttattaggtgttataaaagttaaaacttgggtattatatacatagccaagaagttgtgggggttaagtaaggcctgtatcttaagcgttcaagataataatttaaagtaagctgtagaatcaacttataataatgacttgcctttctttggcaaccagtaaactttgcctaaagttgtatttgtttttattgaaggcatagtccaaattctgcttttgaggtttgctctatatttattttttaaatgaaatggaattgtaaggacatttttggtgagaaaatgtagtattactttttcttcagagaaagtcataaatagtgatatataaaatggggaccttttaagagaagttaatgagttgtatcactgatttccctctcattattgctagttgagtagtagataattcagtatggtaatgttttgttttaaataagaggtgaggttgaagaagccataatatagtgaaggcagtcacattgctcttaaaagataggaaacctgagtaggttgagcctcatttgatagtaagcagtagtttgctcacagcagtaacataaataaggaaggtgttgtgtaaagctgtcctggtgggtcaggggagtagacacagcagacttggcagtaggcctggcttctaaaacaatatccaagtcatcaaatttgcccaggcatgccatatgaggttcaagtaacagtggaatttaagaggagtgagtttgttcagggaggcttgggagagtcacaagcaagagcaagcttttttaagagccatcatttaaactcaaacataatgtgggtctgcatatattttggcatgtctagtaatgtttacgtaattatattgtatgactttcacctgttggcaattggggctctaagatttaagtaacagcctatgaattgctagtttaccaacagctgaaatttaatctttgggacagttctagttaatattagttaatattcatgtgtgaggctgggcgcggtggctctcacctgtgtaatcccagcactttgggaggctgaggcgggtggatcacctgaggtcaggagttcgagactagcctggccaacatgatgaaaccctgtctttactaaaaatacaaaaaattagctggatgtggtggcgggcgctgtaatcccggctacttgggaggctgaggcagaattgcttgaacttgggaggtggaggttgcagtgagctcagatggtaccattgcactccagcctgggggacagagtaaaactctctctcaaaaaaaaaaaaaataaataaataaaaggctgggcacggtggcttacgcctgtaatcccagcactttgggttgctgaggcaggcggatcacgaggtcaggagttcgagaccagcctgaccaacatggagaaaccccgcctctactaaaaatacaaaattagtacatcgaagctgggtgcagtgccctgtgcctgtagtcccagctacttggaagtatctcttgagcctagggattctagaccagtctggataacataaggataccctgtttcttaaaaacaaaaacaaactgttagtgcatcgagttgttcttattattcaaaccatatttcccacgtctgtagttctttaatatgttaaacttcaaaaattgacttagcttattgctatccttttattgggttagttggctggtaaattttgccacttcctgaaaatgacttttgtttccccccttctctctgccctgtggccaaagtcttggtctccttccatttggatttgtgtattaatagttttctcttcgtattttctcctaattcagttctgaaagtcatagttgaggttatcttcaattcccactcctttttgtctgtaacctgcctttcctcacagtttttcattgtgctccaccattttatatctgttacttcagatatcaagctcatcacctttattcatctcttttcagtcccagtgtgaaacctttccttccatccattttcctgatctgctgtcaacgtgttcaccaaagactttttcttttgtgagacaacttaacagataattttgatgtagtactgagctaggaggtctggattctagattcatttctgttgctaattgtgtgatactgctaaaaagcatagagtttcaagctaattcagtccttccattttacaggagaggaaattgagactcaaattgacctgcccaaggtcatttaactggttaatatcaaaacagagacccaggacttctgactcctagtcctttggtcttctccagtaagttgcttaatttttgcttgaaaatcctacatttccttcttgtggattaaaaacaagaacaacaacaacaaaaatcctacagttctttttgcgcaacctataattttgatcattttgtaactttttgtttgtgatacattagataaatatttaatccagtgttattgagtacctattatgtgcaaggtatttttatgtgcattatctcatgataacctagagagaggtattatttctatttagcgcataaggaaacagaaatgcagatggatttgaccatctagaaagtggaattagctggtatttgaactttggttttctgacctcaaattttgggccctttctgctatgcctgcctcttgccttgctattctcagaaagagtttaagtacagaaagactcagtttttcctatggtgaaagcaagggtcatgttgggcatatggaatcaaacatatatgagtcatgtcttacaaattacatgtgttcctgtgactagattttctgctttgggctcaaaatagctacttgagggatgcttcttattcctgcctgctctaggaaattttaaagggtagcagtgatacagttagaccaatagagggtactgtatcgctatatcgctaactgtgctagacccaaatttagctcttttgggccttttctctttgctgctttgtggatctggaggtcaagaggtgatatcattttaggttttaaggcagtttactctaaggagaaattggcctttgtctttggcagcccccctctccgcccatgttgtcttgattagggtctgatttgtcatcttgcaggctgttttgcttttaaagtttaaagcgtttagatctgtcgtcaaaattgccctaaacctgaatgaggaaaaattcagaattttaaaaatgctcaatagtcagggtagtttcatttttcaaggttaacattttgctttcacatgttcaaaaaaaaaaaaatgagtactatttatttgattgaatttaggatgcaaggagaactaccttctatagccactaggactgatacacatttttttccttgatattttgaccaatttgccatctgccatttattcttctctctcaagatcagtactcttttggattttctctctctcttgtacatacccagttgtctctgagtttcaccagaactctccctttgagagcaaaggcaagaaagctcttttgtcatacatgttacctagtaaatgttggctgatcatggttttagcacttctgttgactttttaatcatccgattactatttgaaataaatagtaaaatactcttaatcttctagtttaaatatatgcaaaatagttacatttggattgatatttgctgaggggaaggaatgagacacggatgctggcttcacacagctcttttctttttaagagtgacgaaggacttttccagaagccttcagcaaacttaaccttgcgtttcattgaccaaaactgggttacattccctttcctaaattagttactggtaaagatgagtggaattattcttagccaaccagacctatgccttggcctgaggatatggttggcttccccaaaacacaaggctgcatgggagaggagtggatagaaggatagaaaatctgttagggaggaagaaagagaaaatggatgctgggagggggtcaaccaaaagaattgtctgtgcttactatccacagtattctagcaactgagggacttaaaaaaaattttttttttttgagagagaatctcactctatttcccaggctggagtgcaacctctgcctcctgggttcaggtgattgtgatgcctcagcctctcaagtagctgaagtagctgggattacaggtgtgcaccacatgcccagctaatttttttttttttttttttttttgagacagagtctcactctgtcacctaggctggagcacagtggcacaatctctgctcactgcaacttccacctcccaggttcaagtgattttcctgcctcatgcctcccaagtagctgggattacagatgtgtgtcaccgtgcctggctaatttttgtattcttagtagagacagggtttcaccatgttggacacgctggtcttgaactccctacctcaggtgatccgcctgcctcggcctcccaaagtgctgggattataggcatgagcccctgtgcccagccagttgagggactttataatgtaaacctgacttttgttatgcagttactttctctggcacttgctttttcttttgctttgtcagagtccttggggatgggcatgggagttgatagaggtgccaagaaagagaagtatggctattgatcctggattaataacagtggggttggtgtcttgatgggtgggagatctgggacacaaaattcatttttgttgtgtggttcaggtggaacctgatgattatgcagacatacagaagcataaagacagtgtcaaatctgatttgtcaaaattgagatagtaaagtgttttttaaatgcttattttattttatttcttaaaatttattttgagacagggtctcactttgttgcccaggctggagttcagtggctcaatcatagatcactgcagtcttaactcagcctcccaagtagctcaaaccacaggtgcttgccaccatgcccagctaatttttaaaaattgtttttgatagagacggagtctttctgtgttgcccaggccagtctcaaactcctgggcctgagcagtcctcccaccttggcctcccaatgtactgggattacaggtgtgagccaccatgcccacgctaaaaattctttttaaagtgctttgtttcattctttcgaaggctcatctgaaagaaactagctgttgttaaaggataaaatagaagaatatgtagaagaagagaaagtagtaaccagaggggaacattgtatgagatcttagagtaactgagctggaagggacctcaagaaagtcctcttccattaagtgggtaaatatactaaatcatttaatcttttaattaagttttgttaagtgtcagtattattatgtgccaaatactggtaatacaaattaaatataattcagtctattggagtagacatataaatgactacaacaatattaatataacagaggtacggagaagggcctctgagcatataatgacacagattaactctgagtagagaggtcagagaagagtacagttgagcagaatccagtgggatgagttcaccaggtggctaagggaggacataacatttcaggccagccgattatcacacccaaagacaggttaaagagcatggtcctttaatttggaaagtggaagatcaggattctgttgtgtccagatgtggctggagagggacagactattatactgtattgaggagtttggattttagtttgaagacagcagggagccattgaaggatttcaaattgggcagaaatgtcagatttgtagctccatcactctactatactgtgggtaatagattgaagaagacaggaatggaggtggggacacatgtatttgagaaatgataagggtagagcagtgaagacgacaaagtgggaatagtgctcagatagatttacaggaaagaaatcaataggacctggtatccattgagtaaggaaagggaaggaggcaggattatttctatttttctagtttgggtcagttgtggtaggagaattagctttggaggtggggagggagaaaggtgattcattttaataaaatgtgctattacaaaatgtctgtggaaatagtggtgaacaagacatggcccttgccttcatgaagtgcacagtctagtaattattaatgtaactagtgtcatgaaaatacaaagtgcaaagtataaagtgcaatgagagtatatagtaaaaaggagttcagttttgtgtatgtctagtttgaagcatctgtagatttattaggcaattggaaatataagtgtagagctcaaaagagaaacttgcacaaaagagatttgaaagttattggtctatagatattgatgatagttgaagtcatgggcatggatgaagtcactgcaacagagtgtggattataatgtgaaaaggaggctgagaacaggactctggaaacaacagtattgcaaggatggcaaggagagaagtctgagaagatactgtcacagagttaaattagacaatcaagagaatggtgtagggaaagccaaggcagaagagggttttatctatttcaacagctttattgaggtaaaattgacatttaataaacaacatatttaaagtgtacagtttaagttttgacacatgtagagacccatgaaacttttaccagatatagtgaacatatccgcgacccccaaaagaagtttgtttgtgtgcctctgtaatcactccctcccatacacctttctcccttttccagacaaccgctgaactcactagaacatttatataagtggaattgtaaagcatgtaccctttttttgcgggggttgggtgctgacttcttgtcattgctattttgagatatgtccatgttattgagtgtatcagtaggtcattaatttttattggggagtagttgccattatgtatgtatagtacaatttattttatccattcacctgttgatggacttttggattgtttccaggttttggctgttacaaataaagcagcgatgaatattcatgtattgtctttgtatggacacatctttccctttctcttgggtaaatacctaagaatgtaatggttgggtaatttggtagatgtacatttaactttttgtctattattattattattattattattattttttttttttttttttttttagatggagtctcactctgtcgccaggctggagtgctgtgatgcatatctcggctcactgcaacctcccaactccctcgttcaagttgttctcctgcctcagcctcccgagtagctgggattgcaggcacacgccaccatgcccggctaatttttgtatttttagtagagacagagtttcaccatgttgaccaggatggtcacaatctcctgagctcgtgatccacccgcctcagcgtcccaaagtgttgggattacaggtgtgaaccactgtgcccagcacatttaactttttaagaaactgccaaactgttttccaaagtggttatatcattttaaattcccactagcagtggaatattttgacatcctaaccaacatcaggtttagatagtctttttaattttagccattctaacaggtgtgtagtgttatcttctgtaggtttagtttatattttccaaataactaatgctcttgaacatctttttatgtgcttatttgctatcttttttggttaagtgtctttttaagctttttacccatttaaaaaagctttttattttgaaataattaatagatccacaggaagttgtaaataaaatgtaaagaggttctgggtaccctttactcagtttctcccaacgataacatcttgcataactatagtacaatattgagaccaggaaaatgacactggtagaatccactgaactaactcagatgtgaacaattttacatgcactgatttgtgtgtgtttatgtgtgtagttctctgcagttttatcatatgtagattagtgtaactactaccatgatcaagatacagaactgggccaggcgtggtggctcacgcctgtagtcccagcactttgggaggctgaggccggtggatcacctgaggtcaggagtttgagaccagcctggccaacctggtgaaaccctgtctctactaaaaatacaaaaaattagccggctgtggtgatgggcgcctgtagtcccagctactcgggaggctgaggcaggagaatggcgtgaacccaggaggcggagcttgcattgagtggagattgcgccactgcattccagcctgggcgacagagcgagaccccacctcaaaaaaaaaaaaatatattagccgggcatggtggtgggtgcctgtaatctcagctactgggaaggctgagacaggcgaatcgcttgaacctgggaggcgagggttgcagtgagctgagattgggccatttcactccagcccaggtgacagagtgagactctgtctcaaaataaaataataataataataataataataaaaaatatagaactgtttcatctcactaacttctttataagcacatccttttccctccctcttccccaacccagtctcaaattcctggcaaccactaatctattctacatctccaaagtattatttcaagaaaatgttagctacataaattaagtcatacactatgggacttttttgggggagggcagggcagggggacagggtctcactaggttgccaaggctggagtacagtggcatgattatgcctcactgcagccttgaactcttgggctcaagctctcctcccacctcagcctcccaaagtgctgggattacaggtgtgagccaccgtgccaggccctatgtgaccatttgaggttgactttttcttcactcattgcctggcgatccttccaagttgtcgagtatattaatagtttgttctgttttattgctgagtagtgttccatcatatggatgtactacagtttaattgtttacccattgaaggacattcgggttatttccagttattggctattatgaaaattgctatgaacatttgtgtacagatttgtatgtggatatgtgttgtttctttttttttctggtataaatacccagaagtacaaatgcctcctgacctccaatctgtgaatttagttttataagaaactgccagggtgtggtggctcacacctgtaatcccagcactttgggaggccgaggtaggcagatcacttgaggccaggggttcaagaccagcctgggcaacatggtgaaaccccatctctactaaaaatacaaaaattagtcaggcatgatgatgcatggctgtagtcccagctatttggaaggctgaggcatgagaaatcgcttgaaccctggaggcggaggttgcagtgtgccaagattgtgccgctgtactccagcctgagcaacagagcaaggctctgtttcaaaaacaaaacaaaacaaacaaaaaaaaaaaccaaacctgccaaatgttttcattcccaccagcaggtgtatgagttactcagtttctctgcatcttgggcagcatttggtattaacaccttttttttttaatcattctgatgggtgtgtagtgatacctcattgtggttttaattatattcttctcatgactaatactgttgaccattgttttatgtgatttttgccatccgtatattatttttggtctagtgtctaagtctttgcccctttttagattgggttgttttcttattgttgaattttgagagttctgtgtgtgtgtgtgtgtggggtgtgtgtgtgtgtgtgtgtgtgtgaaacaagtctatcaaatatatgctttgcagagagtttctctcaatctgtgatttgttttttaattctattaatagtatcttttgtagaagttttacattttgatgaagtttgccttaccaattttttctttcatggattgcacttttggtgttacagctaagaaatctttgcctaacccatgctcacaaagattttctcctcggttttcttttcttttcttttttttgagacacagtcttgctcgtgttgcccaggatggagtgcagtggcatgattatggctcgctgcagcatcaacctcctgggctcaagctattcctcctgcctgagcctctgtaatagctggaaccacaggtgtgcaccaccatgccccgccaatttttaaatttttcgtagagatatggtttcactgcattggccaggcttgtctcaaactgtagggctcaagtgatccttcctccttggcctcccaaagtgttgggattacaggagtgagctactgtgcctggctgctaggttttcttttggaagttttatagttttaggtttttttttttgtttttttttttgagacggagtctcgctctgttgcccaggctggagtgcagtggcgcgatctcggctcactgcaagctccgcctcccgggttcacgccattctcttgtctcagcctcccaagtagctgggactacaggcgcctgccaccacgcctggctaattttttgtatttttgatagagatggggtttcaccatattatccaggatggtcttgatcccctgacctcatgatccgcccgcctctgcctcccaaagtgctgggattacaggcatgacccaccgcacccggtcccaaagtatcttttaggtgcctgagtctcagcatttttgacacatcaattcgtctgtcaattttattttcttggagactttcctttctctcagagccttctaaactaatctggattagtggatacctagcatgttgtacatctgtcattgtgagacctcacttctctgtcatcttgagttctttgcatttctgttattgtgttgtcatttgtttctttgcaactcattttggtggagtacttccttcagtagcttactgatggtaataggaggtaaatttttgtgaccttatatatttaaaggtcttcaccaggcgcagtggctcacgcctgtaatcccagcactttgggaggctgaggcaggtgaatcacaagcttaggagttagagactagcctggccaacatggtgaaaccccgtctctactaaaaatacaaaaaaattagctgggtgtggtggtgcgtggctgtaatcccagctacttgggagactgtggcaggagaatcgcttgaacccaggaggcagaggttgcagtgagccgagattgcactactgcactccagccctggtgacagtgtgagactccatctcaggaaaaaaaaaaaaaaaaaaaaaaaaaaagtcttcattctcccctcacacttaattttggctggttgtagaattctaagttagatatcattttctctcataaatttgaaggcattgctctccattttctccattttattccattgttgttgaaaagtctgatgccattctgattcttgattcttcatgtgtaacctgttaccctcctctgagtcttttaggttcttctctttgtcctttgtgttctgattttttcagttccattgtaatctcaggagaccattttcacatacgtggtctgtcattgaccaaaacatcatcaagcagtacctgactacctacaaatgtaattgcttgtcatatggtaattctctatgtaaatttttgaggcaccatcaaactcttttctacagcaactcagctgtatcactttacattgccactagtaatatatgagggttcttatttatctgtatccacactaacacttgttttctctttttgtttattttttcaaattaaagccatcctgggagtgtgaaatggtatctctctgtggtttttatttgcattacctaatgaccagtgatgttgaacatcttttcatgtgcatgttggtcatttgtatatcttctttggagaaatgcctattcatgtgctttgtccattttttaattcagctgtttgactttttgctgttcagttataaaaactctatatattctggatactaaagccttatcagatctaagatttacagatattttttcccattctgtaggttgtcttttcacttttcttttttcttcttttttttttattttattattattattattattttcttctgagacaaggtctcactctgttgcccaggctggaatgccatggtgtgtgatgttggctcatggcaggcagccttgacctccttggctcaagttagcttcccacctcagccttccaagtagctgggactacaggtgcatgccaccatgcccagctaagttttgtattattttgtggagatgagatttcaccacgttgcccaggttggtctcaaattcctgggctcaagtcatctgcctgcctcagcctcccaaagggttgggattacaggcatgagccactgggcttggcctcactttcttgatggtgccctttggtgcacaaaagtttttaattttaccaagttgtattaattgagttcttttgttgcttgtgcttttactattaagaatccatcgccaaatctgaagtcttgacagtgtactcctatttttgcttctaagagttttatgcttttagctcttatatttaggttgttgatcctttttgagttaatttttgtatatggtatgaggaaggggttcaacttcattcttttgcatgtgataatccagttttcccagtaccatttgttgaaggaactattctttttccatttaaagtcttagcacccttgtaaaaaatcaattggccatagatattcgggtttatttctgaactctcatttccattccattgattaatacatctcttcttatgctagcaccacactgttttgattgctgtgcctttgtagtaagttttggagtgttaatcctactttgttttctttttcagtgttattttggctgttcagagaatattctgggccccttgcatttccgtataaatttgaggattggcttttccatttctctagaaaagcccgtgaaattttggtagggattgcattgtacatcactttggagagtattgcatgttaacattgtttttcaatccatgtacacaagaagtcttaccacttatttaggtcttctttaatttatttcagcaatgttttgtaatttttagtgtgtaagtttttcatgtccttggttaaatttattcctgagtattatttcttttggaggttactgtaaatagaattttcttaatttccttttcagattgtttattgcttgtatatagaaacaacagaattttatgtgttgatgttttaccctgcacctttaatgaattcatttattagctgtagttttttgtagaacttatgggttttactttatatagaatcatgtcttctgcaagtagaaatagttttacttcttcctttccaatttggatgtcttttaattccttgattgccctgggtaggactcccagtacaatgttgaatagtagtggtgaaagcatgcatccttatcttgcttcttatcttgggggaaggcttttgttttacaccactatgatgttagctgtgggcttttcacaaatggttttttttttttttttgaaatggagtctggctctgtcgcccaggctggagtgcagtggcgcgatctctgctcactgcaagctccgcctcctgggttcatcacgccattctcctgcctcagcctcccaagtagctgggattacaggtgcccaccaccacgctcagctaattttttgtatttttagtagagacagggcttcaccatgttagccaggatggtcttgatctcctgacctcatgatccgcccctcttggcctcccaaaatgctgggattacaggcgtgagccaccgcacctggcctcacaaatgctcttgatcatgttaaggaagtttacttctattcctagtttgctgaggtttttgtttgtttgtttcagtcttaaaaagatgttgaattctgtcaaatgctttttctgtcagttgaggtgactgtgtgggtttttttttttttttttgagatggagtctcactttgtcacccaggctggagtacactggtatgatcttggcttactgcagtcttcacctcccagggtcaaatgattctcctgcctcagcctcccaagtaggtgggattacaggcgcctgccaccatgcctggctaagttttgtatttttagtagagacagggtttcacaatgtttgccaggctggtctcgaactcctgacctcaagtgatccacgtgcctcagcctcccaaagtacaggcatgaaccagtacacccggcccctgattgtgtggattttttttcttcactctattaatatggtatattatatcagttgattttcacatgttgaaccacccttgcattcctgggataaatcacatttggtcttttttaatgtgctcttggattcagtttgctagtgtatattttgttgaggatttttgtgtttatattcatacgggatattggtctgtagtgtcttgctttggtatcaggaaaatactggcctcatagaatgtgttaggaagcattccctctattttttggaagaatgtgagaagtagtgctgttaattcttgtctaagtgttcattagaactgaccagtgaagccatctgttcctgggagaattttgactatgattcaatctctttacttgttagaggtctgagattttctttttcttctgagtcagttttggtaatctctgtatatctaggagtttgctcattccttctagattgtctaatttgttggtgtacgattgttcatagtattcttcttctttttttttgagacagagtctcactctgttgctcagactagagtgcagtggagcaatcttggctcactgcagcctccgcttcctgggttcaggcgattctcctgcctcagcctccctagtagctgggattaccaccacgccaggctaacttttgtatattttagtataaatggggtttcaccatgttggccaggctggtcttgaactcttgacctcaagtgatccacctgcttcggcctcccagagtgctgggattataggtgtgagccgccgcacccgatcctgttcatagtattcttattatcatagtattcttacatatatttttgcaaacaccagttgtaatacattctaacaaaatccacttacgttgtgctaaagtagtgttttcttttttcttttctttttcttttttttttttcgagatggagtttcactctagttgcccaggttagagtgcaatggtgtgatcttggctcactgcacctccacctcctgggctcaagtgattcacctgcctcagcctcccgactagctgagaatacaggtgtgcaccatcacgcctggctaatttttgtatgtttagtagagacggggtttctccctgttgtccaggctggtctcaaactcctgaccttgtgatctgcccgcctcggcctcccaaagtgcagggattacaggcatgagccaccacacccagcctcttttttgtatttttagtagagatggggtttcaccatgttggctgggctggtcttgaacttctgacctcaggtgatctgtccacctcagcctcccaaagagctgggattacagacgtgagccaccgtacccggacgccttttttttttgttgttttttttttaatttaatttaattttaagttcttggatacatgtgcaggatatggaagtttgttacatagcaaaatgtgtgccatggtagtttgccacacctgtcaagccattacctaagtgttaagcccagcatgcattaggtatttttcctgatgctctccctctctcgtgacccccacccccagacaggccccagtgtgtgttgttcccctccctgtgtccatgtgttctcattgttcacctactgtttataagtgagaacatgtggtgtttggttttctgttcctgcattagtttgctgaggataatggcttccagctccatccatgatctcattctttttatggctgcacagtattccatggtgtatgtgtactacattttctttatcttgtctgtcattggtgggcatttgggttgattctatgtctttgctattgtgaatagtgctgcagtaaacatacacatgcatgtatctttataatagaatgatttatattcctttgggtatatacccagtaatgggattgctaggtaaaatgatatttttggttctaggtctttgggagaataattgctacactgtcttccacaatgtttgaactaatttacatccctaccaagagtataaaagcctttctatctcagcctcgccaacatctgttgtttcttgactttttaatgactgccattctgggccgggtgtggtggcttacgcctgtaatcccagcactttgaggggccggggcgggcggatcagttgaggtcaggagttcaagaccagcctggccaacatgatgaaacgtcatctctactaaaaataataaaattagctgggcattgtggtgcatgcctgtagtcccagctacttgggaggctgagacaggagaatcacttgaacccaggaaacagaggttgcagtgagccgagatcatgccactgcactccagcctaggcgacagagtgagacactgtatcaaaaaaatataataataataataataataatttcctttctgactggtttgagatggtatctcattgtggttttgatttgcatttctctgatcatcagtgatgttgagctttttttatgtttgttgggctgcataaatgtcttcttttgagaaatgtctgttcatgtcctttgcctactttttaatggggtggtttattttttttttttttgtaaatttatttaagtttcttgtagactctggatattagaccttagtcagatggataaattgcaaaagttttctcccattctgtaggctgcctgttcactgtgatgatagtttcttttgctgtgcagaagctctttagtttaattagatcccatttgtcagtttttgcttttgttggcaattgcttttgccattttcatcaagaaatctttgcccatgcctatgtcctgaatggtatttattgcctaggttttcttctagggtttttatagtttggggttttacattgaagtctttaatccatctcgagttaatttttgtataaggtgtaaggaagggatccagtttcagttttctgcatatggctagccagttctcccaatactacttattaaatagagaatcctttccccattgcttgtttttgtcaggtttgtcaaagatcagatggttgtacatgtgtggtcttatttctgagttctctgttctgtttcattggtctttgtgtctgtttttgtaccagtaccatgctgttttggttactgtagccttgtagtatagtttgaagtcgggtaacgtgatgcctctagctgtgttctttttgcttaagattgttttagctatacgggctctcttttggttccatatgaattttaaaatagttttttctaattctgtgaagaatgtcaatagtattttaatgggagtagcattgaatctataatttgctttgggcagtgtggctgttttcacaatattgattcttcctatccatgagcatggaatgtttttccatgtttgtgtcctctccgatttccttgagcagtggtttgtagttctccttgaagaggtccttcacttcccttgttagctgtgttcctaggtattttattctctttgtagcaattgtgaatgggagttcattcttgatttggctctttgcttgtctcttgttggcgtaaaggaatgcttgtgacttttgcacattgattttgtatcctgagactttgctgaagttgcttatcagcttaagcttttgggctgagactagggggttttctagatagaggatcatgccatctgcaaacaaagacaatttgactccctctcttcctatgcgaataccctgtatttctttctcttgcctcattgccctggccagaatttccattactatgttgaataggagtggtgagataggggcatccttgtcttgtgtcaatattcaaggggaacactgtcagcttttgcgtatccagtatgacattggatgtgggtttgtcttaaatggctcttattattttgaggtttgttcctccgatacctagtttattgagagtttttaacatgaagtgatgttgaattttatcgaaggccttttctgcatctattgagataatcatgtgatttttgtctttagttctgtttatgtgatggattacatctattgatttgaatatgttgaaccagccttgcattctgggaatgaagctgacttgatcctggtcgataagctttttgatgtgctgctggattcggtttaccagtatttatttgaggattttgggatcaatgttcatcagtgatattggcctgtagttttctttttttgttatatctctttcaggttttggtatcaggataatgctggcctcataaaatgagttagggagtagtccttccttttcggttgtttggaatagtttcggaagaaatggtaccagcttctctttgtacctctggtagaattcagctgtaaatctttctggtcctgggcttattttggttggtaggctatgtattactgcctcaatttcataactcattattggtctgttcaggtattcagcttctttctggttcagtcttaggagggtgtatgtgtccaggaatttatcagtgtcttctaagttttctagtttatttgcataaaggtgtttatagtattctctgtggtggtttgtatttctgtggggtcagtggtgatatctgctttatcattttttattgtgttgatttgattcttgtctcttttcttcattagcctagccaagctcctggatgagttgtttttgtttgtttgtttgttttgagatggagtctcactctgttgctcaggctggagtgcagtgatacgatcttggctcactgcaacctccacctcctgggttcaagcaattctcctgcttcagcctcttgagtaggtgggattataggcacccaccaccacactgggctaatttttgtatttttagtagagacagggttttaccatgttagccaggctggtcttgagctcctgacctcaagtgatctgcctgccttggcctcccaaagtgctaggattacaggtgtgagccaccgtgcctggcctgaatttttttttttttttttcgagacgaagtctcgctctgttgcccaggctggagtacagtggcccaatctcggctcactgtaagctccgcctcccgggttcatgccattctcctgcctcagcctcctgagtagctgggactacaggtgcccaccaccacacccggctaattttttttgtatttttttttagtagagacggggtttcatcgtgttagccaggatggtctcgatctcctgaccttgtgatctgcccgcctcagcctcccaaagtgctgggattataggcgtgagccaccgcgcccagcctgatttttttttttaagggtttttttgtgtctctgtctccttcagttctgctctgatcttggttatgtcttgtcttctgctagatttggggtttgtttactcttggttctctagtcttttagttgtgatattaggatgtcgatttgagttttttctggctttttgatgtgggcatttagtgctataaatttccctcttaacactgctttagctatatcccagagattctggtacattgtctctttgttctcattggtttcaaataacttcttgatttctgccttaatttcattttttacccagaagtcattcaggggcaggttgttcaatttccatgtagttgtgtgggtttgagtgagtttcttaatgttgagttctaatttgattgcgctgtggtctgagagacagttatgatttcatttcttttgcatttgctgaggagtgttttacttccaagtatgtgatcgaatctagagtaagtgccatgtggcactgagaagaatgtatattctgtttttgggtaagtctacttgatcacagctgaactcaagtcctgaatatctttgttaattttttgtctcgatgatctgtctgatattgacagtggggtgttaagtctcccactattgttgtgtgggagtctaagtctctttgtaggtttctaaaaacttgttttatgaaactgagtgtgcctgtattgggtgcatatatatttaggatagttagctcttcttgttgaattgaaccctttaccatgctgtatgcccttctttgtctttttttgatcttgttggtttaaaatctgttttgtcagaaactaggattgcaacccctgcttttttcctgccttccatttgctttgtaaattttcctccatctctttattttgagcctgtgcatgtctttgcatgttagatgggtctcttgaatacagcacaccaatggttcttgtctttttagccagctaaccattttgtgtattttaattggggtatttagtccatttacttttaaggttaatattgttatgtgtgaatttggtcctgtcatcataatgctggctggttattttgcagacgtgttaatgtagttgcttcatagtgtcattcgtctgtgtacttgagtgtgtttttgtagtggctgataatggtttttgctttccatatttagtgcttccttcaggaattcttgtaaagcagacctggtggtgctgaattccctcattatttgcttgtctgaaaaggactttatttctctttcacttacgaagcttaatttgtccggatatgacatttgggttggaaattcttttctaagaatgttgaatattggcatccaatctcttctggcttgtagggtttctgctgagaggtccactgttagtttgatgggcttacctttgtggtgatctgtcctctctccctgcgcttaacattttttccttcatttcaaccttggagaatctgatgataatgtgttttgggattgatcttctcatggagtatcttactgggtttctctgaatttcctgaatttgaatggtggcctatcttgctaggttggggaagttctcatggatgataccgtgaagtatgttttccgacttggatgcgatctccccgtctctttcaggtaccccagttgtaggttcagtctttttttttttttttttttttttttttgagatggagtcttgctgtgttgcccaggctggagtgcagtggcgtgatcttggcttactgcaacctccacctcctgggttcaagcgatccttctgcctcagccgcccgagtagctgggactacaggcacacaccaccacgcctggctgatttttgtatttttagtagagatggggtttcaccatcttgaccaggctggtcttgaactcctggtctcgtgatccacccgcctcggcctcccaaagtgctgggattataggcgtgagccactgtgcccagccaggttcattcttttaaataatcccatagttcttggaggttttgttcatttcttttcattttttctttttcggttttttttttttttttttttttgagacggagtctcgctctgtcgcccaggccggactgcggactgcagtggcgcaatctcggctcactgcaagctccgcttcctgggttcacgccattctcctgcctcagcctcccgacattttttttttttctctaaccttgtttgcccgtcttattttagcaagatagtcttcaagctctgatatcctttcctctgcctggtctgttcagctgttgatacttgtggttgtattgtgaagctctcctgttgtgtttttcagctcaatcaggtcatttatgttcctctgtatactagccattctggttaacagctcctgtaatgttttatcatggtttttcgcttctttgccttgggttaaaacatactcctttagctcagcgaagtttgttattacctaccttttgaagcctacttctgtcaattcattcttctctgcctcagcccagttctctgcccttgatggagaagtgttgcaatcatttagagaagagacactctggctctttgagatttcagcgttcttgcattgattctttctcatctttgtggatttatctgcctttgatctttgaggctgctgacctttggatagggtttttgtgggatcttttgtgttgatgttgttgttgttgctttctgtttgtttttcttttaatagtaaggcccctcttccatagggtagggctgctgcagtttactaggggaccactcctgacctaattcatctaccccctcctgcacctggaggtataagcagtggaggctgcagaacagcaaagatggctgcctcctcctctgggagcttcatcccagaaggcacggagctgatgctggctggaacgctcctgtatcaggtgcctggtgaccccagttgggaggtctcacccagtcaggagggatgggatcaggaacctgcttaaagaagcagtctgactgccccttggctgagcaggttcggctgtgctggggagaattcccctcatctggactgccaacaggcaggaaagactaggtcagctgaaccatgagaccatgaccacccctacccgtagaggctccttcccagggatatcagagttctgtccataaactcctggctagagttactgcagttcctgcaaggaggttctgcctggtgaagagagaaggatctgggtcccacctaaggaaacaatctggccacgatctgccaccgccactgtgttgtgctgtggggaattcctcttcgtccaaaccgccaagtttccccaacaccagcaaaggaaaatggcagactggagccgcagtgatggcgactgcccctttccgtgggaacttggtagtcttaggcagtgtccagcctgctgctgctagccacaacctgagcaggttgcacagctctgtgcttgggtcccaaggccttggtggcgtgggctcatgaggggatttcctgatccatgggatgtacagatctgtggaaaaagtctggtttcccgcgcagggtagcacagttactcaccacctcccttggctgggtgtgggagttcgcctttgtggctaccaggtcaggttgtcgctctaccctgcttttcctagctctgtgtggatcacaccaaccacctagtcagtcccagtgagagaacctggatacctcagttgacggagcaggattcactggccgtttttgctcttcttagtgggagccgcagactggagtggcttctaatcagccatcttggctcctcctgcctaaactagtgttttcttaacttctttgcaaatgttttttcttgaagttgtttctttcacactattcatggaggctaattgtttagtcactttaaactctgcattgactcttcaataaataacaactgagcagatgttggtaacatctggcagcacatcaagggccaaggaaaagcactttttttttttttttttgagacggagtcttgctttgttgccaggctggagtgctgtggtgcaatcttggctcactgcaacctccgactccctggttcaaatgattctcctacctcagcctcccaagtagctgggattacaggcaagtgccaccacgcccagataatttttgtatgtttagtagagacggggtttcaccatgttggccaggatagtctcgaactcctgatctcgtgatccgcctgcctctgcctcccaaagtgctgagattacaggcgtcagccaccgcacctggccggaaaaccactttttaaggaaatcgtttgttttattttgtaattaacctattaatgttgctaccaatgtcctcagtttttctaccagttgttcttgctgaaaggctaatagtcttgtaagtttttctctgaacatatttccgtggtttctccggtgaaacacaatttaaataactcaccatcagtaaatgactttctttttttttttttgagaccaagtctcactctgtcaccgaggctggaatgcagtggtgcaatctcagctcactgcaacctccgcctcccggcttcaagtgattcgccttgcctcagcctcccaagtagctgggattacaagcgcctgccactatgcctggctaaattttgtattttagtagagatgaggttttgccatgttgtccaggctggtctcgaactcctgaccttgtgatccacctgcctcagcttcccaaattgctgggattataggcatgagccgctgcacccggccccagtaaatgactttctttactttgctagcaaatgagccattttattttctttgttttttgtttttgttttttttgagagacggagtcttgctcttgtcacacaggctagagtgcagtagtagcgcaatctcggcttactgcgacctccgcctcccgggttcaactgattcccctgccccagcctcccaagtagctgggattacaggcacgcggcaccatgcccagctaatttttgtatttttagtagagacagggtttcaccatgttggccaggctggtcttggactcctgatctcaagtgatctgccccctttggcctcccaaagtgctggaattacaggcgtgagccaccatacctggccgattgtttttttttgttgttgttgtttgttttaaattttttttcttttcctgtgagttgggagtattatgatgaatgcattactgtggtaatgcatatatatggccataatgttattgcacatctaatttgataacagtataaccacactccactgtgctttaaaagggcaacattcaaagtctacttttctttttgtgttatgcactagtaaaaatttttttaaagtcacagtatatacgtatgcattgcactcattagaactttgtcactgcaatttgtgtccatcaagcagcaatgtgaaggaataggggtagtacatgtggtccctttgacagttactcagttctacccttgtgtgaaaataaccatagatagtatataaatgaatgagcatggttgtgtttcagtaaaacgttatttatggataccagaatttgaatcataacttttttttgtcatgacacagttaaaaacaattttttgaaaccatttaaaaccattagtttgtaggctatagaaagacaaactattatctgtaggctttctatagcctacaaactaatgattttaaatgtggcctaccacttgttggtgggccagacttggcacatggactgtattttgccaacctctgcttcatactatacataaaaacattcataagacaacttgggttgtccagattactgtatgcttgcatgagtccctctggtggttgaaggaacatggaacaagtaattcttgagatggtgaaatttctgaagcaccttgaatttgagaattctagacttggaaatctggacttaggactgttcgtcatagttagattgtagtagctgcttatatcatttccagaggttggacacttgggaaaaagataaagcagcattcccacaaattttgtgtgcaggtctctgcagcactttaagacatcattctgacgtagaagatgtttgcttcatctacagtttatttgggagaagggtgtggttttcagcattagtcaacaactgaaatgggctggtacaataatttcatttgaataaactgtaaaatcttctatgggtgactttctgtccttttttttttttctcaaagggttgggatttaattaatttttcctatttaatcaagtacattcttaagtaaaggaaaaaggcagtttgaaaataagcagtacgattagatgaaattagtaaagaacaagttgttctggatgacttcaaggtgctatatataccctttgaactgtttgcttgtttttcctgtctctccttttctttgcagccatcttctctcattttagatttcctgcttctaatctgtggactagataagcatataatattatgggatctaaaattgagtagagaggatctgaacaaggggccaaggaaaatttctgtgagttaaacacatgagcttttatgctgtatattttgagtgttcagaggcttgttttacttctgtccacttgagtaccatttagataggtgacattgtgagctaagttttagaaagttttagctaccatcataattcaacaggctgatagcattgccaagaaacatggttcaaaaattcctaattgaggattttgctcctaaatttatatcagatcatatatatcaaatggtgatacttttctgtttagaatgctccattggtttcccatctcgcaaggccttacttgactagcctctccctgagcacccctagctctcattattctgcctccttactcaggagtaacatagattctctaagggaagcaattccaacaaccttatttatttatttagacagggtcttgctctgtcaccgaggatggagtgcaatggcgctatcttggcttacagcaacctccgaatctcaggctcaaacgaccctcctgcctcagcctctcaggtagctgggactacagtacaggcatgtgccaccatgcctggctactttttgtatttttatttttgtagaaatgggtttttgccacatcgtccaggctggtctcgaactcctgaactcaagccatttgcctgcctcggcctcccaaagttctgggattacaggtgtgagccaccatgtccggccccaacaacttgaacaaatgatttattatagacctaataaatgtcagggacttacttggtaggtactggagatacagcagttgaagttgttctcatatataatagaaatcatgtcattcccctttttaaaactcttacatggtttccattattctttgaataaaatccaaagcccttactacagttcttctatgtcttggcttcttctagctctaccctttcagttgttaactctagccatcttgggcgtttcttaaagaaaccaaggcgttatttgactcagactgtttatgcctattctcctgtgttgcaactatcaccttctctccccagccccgctgactctctttctttgcttgctggttcctatttatctttcaggttttagcttacatgctaccctctcaaaaaggccatctctgtaatctctgtaaaacaagttccttgtctgattctctcttctaccacttagtagcacttaccatttttaatttgtgtttttgtcagtctctcctgagactgactgcttaatgagggcgggggaccatatgtgtgttatttactttttatgtacctaccatctataacagtttctataaaatattaatcacatcattaatagttggtgaatgaatgagcaccttcttcacttggcttctgggatgctgcattcttttggttattgttccatttcactgatgtctcttctaacctcttaactcattcttctttttctccctaatcctaaactttggagttccttgtgcctcagttgcctactttcttctctatttgtactaatttcttagtgatcttttggtcttatggctttaaatttcatatatacgttaatgattcccacatttacatagctagcttgtgttcttatgcacaaatatctatttgacatttccacttggaaagcttactggactctcatatttaatatgtacaaagtagaagttttggtttcttatctcaagtctgtctcactttctttatttcagtaattgctgttctttcagaaattcagaaaatttcagaaatactgtattgttgttgttgttttttgagacagcctcgctctgttgcccaggctggagtgcaatggcgcgatcttggctcactgcaagctctgcctcctgggttcacgccattctcccacctcagcctcccgagcagctgggaccacaggcgcctgccaccacgcccggctaattttttgtattttcagtagagatggggtttcaccgtgttagccagcatggtcgtgatctcctgatctcgtgatccacccgcctcggcctctcaaagtgctgggattaaaggtgtgagccactgcgcccgaccaatactgtgtttttaataatagttcaaggctttaaaccttggtgtcacccttgactgttctttcacatccagtcaacaagttccgtcagcactactttaatccaaaatctgacttcttaatgctgcttctgcttttacagctcactaccacttaggtcctgtattccatcttttctcacctggatgattacagtagcctcctaaatttatatcagttcatatatatcaaatgatgatacttttctgtttagaatgctccagtggtttcccatctcgtaaggccttacttgactagcctctccctgaccacccgtagctctcattattctgcctccttactcagttcaagtcccactggccttgttttttctcatacagtacacttcaacaatgctgtacctcaggtctttgcacttactattatcctctgcctgcattatgcccctaaatttctgtatagctcagttacattaatattcttctgctatttcctcaagtattagagaaggctttccagactttcctattaaattaacatctttgcctcctctatattttttcccgttttattttctcttacagcaaatatcactacctgacatattttactagaatgtaagctccatgaggaggggattttgttttgtttaccatggtgtttttagtattcagaacatgcctgcttacatagtagttgctaaaaaatttttttgttaaatgaataagttgaatcatgttgtttccagtgtagacagaataggtatatgtggttgaaaaatgaacagcacaaagttagctccccaaaaatggcaaagtgaaataaagaaacatttctgaagaacattgttgaactgtaatcccagcactttgggaggctggggcagttggattgcctgagcccaggagttcaagattaggctgggcaacaaaacgagaccctgtctctacaaaaaaaaaaaaaaaaaattgctgggagtggtggcatgcacctgtggtctcggctacttgaaaggttgaggtgggaggatcacttgacccagaagtttgaggcagcagtgagctatgagtgcaccactgcactccagcctgggtgacagagcgagacctagtctcaaaaaaaaaaaaaaaagtccgggtgtggtggctcatgcttgtaatcctggcactttgggaggccaaggagggtagattgcttggggtcaggagtttgagaccagcctggacaacatggcaaaaccctgtctctactaaaaataacaaaaattagccgagtgtcatggcaggcacctgtaattccagctacttgggaggctgaggcttgagaatcgcctgaacttcggaggcagaggttgcagtgagccaagatcgcaccactgcattcaagccagagagagactctgtctcagaaaaaaaaaaaaaaaaaaaaattagctaggcatggtggcgagtgcctgtagtcccagctactcaggagactgagacaggaggcaggagaattgcttgaatccaggaggcaagattgcgccacagcactccagcctgggcgacagagcaagactccatctcaaacaaacaaacaaacaaacaaaagaaaaacccacttttggaactctcctacctttgactacttgttatgttggataatatatacaggttgataatgcaggttgttatgttggataatatatacaggtcatattcaaaatctggaatgttccaatatcctatactttttagctctgacatgatgccacaagtggagaattcttaacacagactttttttcattcaccgaattattaaaaaatattgtccaaaattacctttcaggctatgtgaataaggtatatatgaaacataagtgtatttcatgtttagacttgggtcccatatcaagatatctcattgtgtatttgtaaatgggccaaaaaaaaaaaatccaaaatcccaagcacttctggcctcaagcattttggataagggatattcagcctgtgtcccctccccctttttcagctacattgagttggattttctgttctttgcagcctaggaatatctcatttcttttcttttcttttttttttttttttttttttgagacggagtcttgctgtgtcacccaggctggagtacagtggcgtgatctgagctcactgcagcctgtatgctatgagtattttttagaattatggatgtgtttttttttttttaataaacacatttattgagctgggcacagacgctccctcacacctgtaatcccagcactttgggaggctaaggtgggaggatagcttgagcccagccttggcaacaaagcaaggccctgtgtctaccaaaaatgacaataaaaagtaaccaggagtgtggcatgtacctgtgtcccagctactccagaggctgaggaaaggatcacttgagcctaggatgggaggttgaggctttagtgagctatgatcacaccattgcactccagtctaggtgagagagtgagaccctgtctcaaaaaaaaaaaaaaaaaatctttttcagggcataatgtttcctgattatctttttagaaaatgtggacataaaaaggaaaaattacatatgtaattgtatatgtaataatcacacatatctgcagaaataaccagatgcattgaaaaaacacacacatgccacttctttagtggagctaatgacatacattttatatcccacttttttctctcgagattgttattatttactttctcatctagtaatttatacatctgagttttctaatttcttgttttgttgggtttttttttttttgccttcctccccgtagatcttgagccagatgattgtgcatccatttacatctttaatgtagatccacctccatctactttaaccacaccactttgcttaccacatcatggattaccgtctcactcttctgttttgtcaccatcgtttcagctccaaagtcacaaaaactatgaaggaacttgtgagattcctgaatctaaatatagcccattaggtggtcccaaaccctttgagtgcccaagtattcaaattacatctatctctcctaactgtcatcaagaattagatgcacatgaagatgacctacagataaatgacccagaacgggaatttttggaaaggccttctagagatcatctctatcttcctcttgagccatcctaccgggagtcttctcttagtcctagtcctgccagcagcatctcttctaggagttggttctctgatgcatcttcttgtgaatcgctttcacatatttatgatgatgtggactcagagttgaatgaagctgcagcccgatttacccttggatcccctctgacttctcctggtggctctccagggggctgccctggagaagaaacttggcatcaacagtatggacttggacactcattatcacccaggcaatctccttgccactctcctagatccagtgtcactgatgagaattggctgagccccaggccagcctcaggaccctcatcaaggcccacatccccctgtgggaaacggaggcactccagtgctgaagtttgttatgctgggtccctttcaccccatcactcacctgttccttcacctggtcactcccccaggggaagtgtgacagaagatacgtggctcaatgcttctgtccatggtgggtcaggccttggccctgcagtttttccatttcagtactgtgtagagactgacatccctctcaaaacaaggaaaacttctgaagatcaagctgccatactaccaggaaaattagagctgtgttcagatgaccaagggagtttatcaccagcccgggagacttcaatagatgatggccttggatctcagtatcctttaaagaaagattcatgtggtgatcagtttctttcagttccttcaccctttacctggagcaaaccaaagcctggccacacccctatatttcggtgagttgatggaaatggctgctggtcatttttcatgtttatgggtcattggtggcatataactacattatcagtatataatggttatataatggtttgaccatttctcctcttcctatttttaaaaaaaattttaccaaataacttaatgtttattttcatttgcatcttaaaagtatttttagataggttaaatataattttaaaatatatagctaatgaattgttgataataataaattacatttaaaaatccttgctaggtttggaggcttatgctttgtattcccaacacttgggaggctgaggcaggaggattgcttgagcccaggagtttgagactagcctgggcaacatagcaagatcctgtctctacaaaaaaaaaaaaaaaaaaattaaccaggcatagtgatgtctgcctgtagtcctagctgcttgggaggctgaggtggaaggattgcttgagcccagaacttcaaggctgcagtgaaacatgattatgccattgtactccatcctgtttctaccaaaaaaaaaaagtttattgtacaacttggattataatatgaatttaattactaagaaaactatttgggggccaggcgtggtgtctcatgcctgtaatcccaacactttgggaggccgttgagccctgagccccagagttcaagaccagcctgggtgacatggcaaaaccgtgtctctacaaaaaatacaaaaattagccaggtgtggtggcacacacctatagtcccaggtactagggaggctgaggcgggagcattgcctgagatgggagatggaggctgcagtgagctgagattatgccactgcactgcagcctgggtgaaagcaagaccctgtctgcaccacccccctacaaaaaaaaaaagaacctattaattacatttacagaatcaatctagtctataactgattagaaaagacaacttttatgtattaaattcccacatggagttgtgcctgttaggatttttgttttgttttttgagacagcatcttgttgcccagactggagtgcagtggggtaatcatagctcactgcaggttcgacctcccaagctcaagcaatccttatacctcaggctcctgagtggctgggactataggcgtataccaccacactcaattatttaaaaaaattttttttgttttttttggtagagatggggtcttgctttgttgcttaggctgatctcactcctggcctcaagtgatcctcctgcctcagtttgcaaagtgccaggattacaggcaggagccactgtgcccggccaggggtttttcttttctttcttttttttttttttttaagagatggagtctcgctctgttgcccaggctggagtgcaatggcgcgatctcggcttactgcaagctccgcctcctgggttcacctaccattctcctgcctcagccttctgagtagctgggactacaggcgtccggcaccacgcccggctaatttttgtatttttagtagagacggggtttcaccgtgttagccaggatggtctccatctcctgacctcgtgatcctcccacctcggcctcccaaagtgctgggattacaggcgtgagccaccgcacccacccggccttctcttttttttgagacggaatctcactgtcgcccaggctcaagtgcagtggcatgatctcagctcactgccatctccgccttccaggttaagcaattctcctgcctcagcctcccgagtagctgggattccaggcacctgccaccacgcctggctaatttttttgtatttttagtagagaatgggtttcaccatgttggccaggctggtcttgaactcctgacctcaggtgatctgcccgcctcggcctcccaaagtgctgggattacaggcgtgagccactgcgcccggccaatgcttttttcattagtgtgaatctttatttctcaatcctgatctttagaaaaatagaattatggtaatgaagacacctttgaacccatccctttgcttctgaaatttatcttaatttttctagtggtttgcttaaggctgcaaaacaaatacagaagtaactgagagttgaagttggattttttcaaactaataaaaattaatatccttgaattcacaggagtaggacttaaagctaggctgaggacatggaaggaaacaatgaaataatttagaaattgtacttgacctgtagacatacgaagtttttcttttataatccatgttttaatatatcaaaatgatcctttgggcctttaagcaatttaaattgtcttactgataaagtaaaaaagtaacatttagagttgctggagtgacgggttgttttccaaccaagcatgtaccaaaattaaatttttacttcaaattgcagtatattgctgaatggaagcagtttttcagagagacagggaaaggcgcagtaggaaggaagtagggaaaggagcaatagggaggaagtgcgggaagtgataacttcagtaggctgacatccagagatatgtaccagggagggagatagacatcctgacacagagagagatgtttggatatgtggagagatacagatatacataaacagaaatgtgcctctttgttttaaaaaaatcaaattattattttttggttatttttgttaagttcatacacatagttgagaaaaatttacagttttataaattataagaatttgtctttttcaaaaaaatatgggaaaccaaaatgaagataagatagatttttaaattttattttattttattattattattattttttgagacagagtctcgctcttttggccaggctggagtgcagtggcgcaatcttggctcattgcagcctccgtctcctgggctcaagcatttctgcctccttagcctccctagtagctgggattacaggtgagtgccaccatgcccagctaattttagtagagatggggtttcaccatgctagcaaggctggtctcgaactcctgacctcaggtaatctgcccacctcggcctcccaaagtgctaggattacaggcatgagccaccgcacctggcctttatttttattttctaaaatttatttatctttaagcatgtaccacctttgggaaataaaatagattttattctaaagatgaaataattatttattaagcactcaccataaccagaattgtaacttactaaatgaagttttattttgtaatacattgtttcaaagatcaaaggaagaaatgttggtgctggcaaagaagccatttgaatcattgcttggcaataatagcatggtgacatgcatctttgtgtgttttgtttgtagcacatcttcattacctccactagactggcctttaccagctcattttggacaatgtgaactgaaaatagaagtgcaacctaaaactcatcatcgagcccattatgaaactgaaggtagccgaggggcagtaaaagcatctactgggggacatcctgttgtgaaggtatgagacttttggggcttgttttgcagataccatacacctagtgatgattagacaagtctattcagttaggtactagagagtgcaaagagcataaactcaaaactagagagcctctgttgttttgggggcttgttgatgtgactacacttgtgcattgagttatatttgctaggctaaaagatgttctttctggactgactttccttctggggagactctggagaaagattacagtggccaaatagccgtttttctgacaaacaaatatggccgtattatatttatgaataaaatatatgctcatttaaaatttaatacaggccgggcacggtggctcacgcttgtaatcccagcacttggggaggccgaggcaggtggatcactagctcaggagttcgagaccagcctggccaacacagtgaaatcccgtctctactaaaaatacaaaaatgagcagggcgtggtggcgggcacctgtaatcccagctctgcggcaggctgaggcaggagaattgcttgaacccgggaggcagaggttgcagtgagccaagatcgtgtcgctgcactccagcctgggtgacagaactagactctgtctctaaataaataaataagtaaaatttaatcagaaaaataggaaggataagcaacaaattacccaaaatctaaccctctcagaaataagcagtgttaacatttgattaacattccagataactctctgtgtgtatatttagtggaagactgaatggatagctagaaaaatgaatggatttttttaaggaaagaattttttaaggaaagagattacatctgtaatcccagcactttgtgatgctgaggcaagtggatcacttgagcccaggaatttgaagccagcctggacaatatagtgagaccaagcctctacaaaaaaatacaaaaattaactgggcatggtggtgtgtgcctatagtcccagccattccagaggctaagatgggaagatcaattgaacctgggaggttgaggctgtagtgagctatgatcatgccactgcagtccagcctggggaacagaatgagaccctgtctcaaaaaaaaaaaaaaaggaattcctaaaatatctttctaaggtcaaaaaaagagattaaatacattattgagagatgaagttattgtttcagatttagatggcatagattgacttctactctgaaaagtaaagtaattgtctgtcttaaacttccttccccttttctactctttacctcctgaattttcttgcttatgctatttttcctttcaaatttacatcctccctaacttctcccccaattatttagccttagttctatttctagttagattcaatgctcactactactacttttttatttcattaagtttttttttgtttttatgtaaggagggctttggattctatgttccatgggttctttcatgtttgaaaatgtgtttgttgcctttatatactaaaatatagaaatggctgtagatgataatctcttagaactgtgtagatatttttctctcgtcttaatggtatttattgaatactgtagtggaaaaactaattacactgaagtgattttcaacaaataaaatctacaaattatcatctcttttatgagctatgctttatgattattatctgatcatgttttatagttctttacgtataaagatttacattttagatgggtttttttaatgatttgttattaagaaacgccaggaaaacaaaacataagaattttgtcattttgtttgtaagagtcatatttttttgttaaatgaatttatttcattttgataaagtaagcagatttattgcttagttttctatatcttttagttttcatagcaatcaacaaattatttacaagtgtataaatgaacaagtcttttgggagggtacatgatttgtttccacagttttcctttaatgaaaaaaccgatgcatgtgctgtggtcaaaagaaaaaaacaacgttaaaaaacataattaaaaaaaataattttaaaagattaaaaaaacaaaaacaaaaactgagccaggaacaatggtgtgtgcttgtagtcccagctactggggaggctgaggcttaaggatcgcttgaggccaggaattcagggctgtggtgtatgatgattgtggctgtaaatagccactgcactctagcctgggcaacatgtctctttaaaaaacaaaagcagaactggtgctgtagctcatgcctgtaatccaggtgacatggtgggctgggatgctaggtgagaggattgcttgaggccaggagtttgagactgggcaacaaataaataaataaaattagctggacattgtggcacacccttgtagtcccagctactccagaggctgaggcagtaggattgctggagccgggagtttgaggctgctgtgagctacgattgtgccactgcactccagcctgggcaacagagaccaacccagtttctacaaaaaatttgaaaaatagccaagtacaataagtagcatgcgcctgtagtcccagctctttcagaagctgaagtggaaggatcatttgagcccaggaatttgaggctgcagtgagctatgatcacaccactgcactccagcttgggtgacagagcaaggcacttctcaaaaacaaagacaaaacagctgagtctctcgttaaggggagactacaacttctggtaccagcagtttttattttcttcttgtaaatgactttttgttttctaacttactgattgaagaattatttcattatacttgaaatagttgacttaaccagagtatgtctgaatgttaacagttctttatcagtctttcccagtacttttgatgctccctttcaatctgagattctttcttgcttcatgccagaaaaatgtatatatttcctttcccatatattttgttgtttacttaagtgactctaattattactcaaatgttggcttatcttaggtcttgttatgttgcccaggctgttcttgaacccttggcctcaaatgatcctcccaccttgcccgctgctccccgccttttttttttttttttttttttaagagctaggctcttgctctgtcacctaggctggaattcagtggcatgatcatacctaactgcagtctcaaactcctaggatcagggcattctcctgcctcagcctcccgagtagctgggactgcagatgcatgccactgcatctggctaattttttaatgtatttgtggagacagtcttgatttgttgcccgggctggtctcaaaactcctggcttcaagtgatcctcctgccttggcctcccaaagtactgggattataggtgtgagctgccaggcctggctgatttctctcttttcttgtggtgggatagtattcaattgtgtatatataccacattttagaaatccattcatccactgacgaacacttattttggttccatatcttggccgttatgaataatgctgaaagaaacataggagcacaaatatctttttaatctactgatttcatttcttttggatatataccctgtagtggaattgctggatcatatggtagttctgtttttaattttttgagtaacctccatactgttttctgtaatggctatactcactcacatttccataacagtgtgccagtgttcccttttctccttatcccagccagaattttcctttttttgcattttgataagtagccatgctaaccggagtgatattatatctcattgtggttttgatttgcatttccctgatgattagtgatgttgagcatttttttatatacctgtttgccatttgtatgtctccttttgagaaatgtcattttagatcctttgcccactttttagattatttggggtttttttggctgttgagttgtttgagtaccttgtacattcttagtattaatcctttgttggatgaatagtttgaagatattttctcccattctacgggttgtctcctcattctgttatttcctttgctgtacagaagctatttagttgatagagttctatttctctgtttttattggctgtgattttgtagaattactcataaaatctttgcttagatcagcgttatggagctttccccctgtgttttcttctagtagttttttagttttggatcttaaatttaagtctttaatccattttgagttgatttttttgtatatgatgaaagatgggtttctaatttcattcttctgcgtgtggatatccagtgttcccagcatagttattgaagaggatatcctttccccaatgtatgttcttattagcacctttgtcgaaaatgagttagctgtaaatacaggaatttatttctgtgccctctattctgtcacatgagtctgtgtgtctgtttttatatcaatactgtgctgttcttgttactgtcattttgtaatgtattttgaagtcaagtagtgtaatgcctcgggttttgttctttttgttcagttaagctttggctctttggggtctttggtggttcaatttaaattttaagattgttttttctatttctatgaagaatgtccttggtattttgacagagattgcattgaatctgtagaatgtgtttggtagtgcttattgatacattcttatacaacaacaactttttttgtttgtttttgttttttgagacagagtctcactctgttacaccagctggagtacagcggtgtgatattggctcactgcagcctctgccttccgggttcaggtgattcttctgcctcagcctcctgagtagctgggattacaggcacgcactaccatgcctggctaattttttgtattatagtagagacagggttttaccatgttgtccaggctggtctcgaactcctgacctcaagtgatccacccacctcggcctcccagagtgctgggattagaggcgtgagccactgtgcctggccaacaaaacttttaaaagacaaaacaaaattttaaaagaaacaagccagcagataccaagcacaatcaaggtacttttttttttttttttaagtagaaacagggtctcgctatattgcccagtttggtcttgaactcctggagtcaagcattcgtcttgcctcagtcttccaaagtgctgggattacaggtctgagccactgcacctggcctaaacataccacatttatatgtgaggctcagaccagtctggaataactgatgcctttctctctctctctgagaatttaaaatcctcagaatagtggagaaatctaccaactcttctcaattgctggagaagaaccacctctgttaatgggaaaaaatgtcgtctcagaagtgggcatatactggtatagtgttccatacattgcacaactctgcaaatatgttggaatatagagaatcaggtatcacttccactttcccttttaaatgacgtgctctcatgtgtactgcttatttttctctcaatattagaaaaatagcttttagatagagagtaaaatgaagtagtatcacaatcttcccccaataattaacaaaataaacaaaatgtatgtgtgtgtaggatgtgaggaaacagccaaaaatctatgggtaacacccaaacaagcaaaaaagaacacaaactttgatctataaacttcaaagagtggtgatagaggatggagggtggggtagggtgaggactgtgtaatagaagagattctggtatagtatatagcagagctgctaacccacacatactttcatccatcaggaagagtaataagtcaaggaaaaaccctcaagaataaaagaataaaagatcctttacactgctagtgggaatgtaaattagtatagccatgatggaaaacagtctaaaggttgctcaaaaaatttaaaaatagaactaccatgtgatccagcagttccactgttgggaattcatccatagaagaggaaatcagtatactgaagagatcacagtagccaagatatggaatcaacctaaatgtccatcagctgatgaatgaataaagaaaatgtgacatatatgcacaatacaatactattcaggcataaaaaagaatgaaatcctgccatttgtggcaacatggatgaacctggaggacattatattaaatgaaataagtcaggcacagaaagataaatactgcatgttttcacttatatgaaggggctaaaaaatttgagctcatagaaatagaattttcgttatcagaggctgagaaaggattgagggaagtaaggatggggagaagttggtcaatggatacaaaattacagctagaggggaagaataagacttgtattatgtagcactgtagggtgaatatagttaataaaaatttattgtggcggggcgcagtggctcacacctgtaatcccagcactttgggaggctgaggcaggtagatcacttgaggtcaggagttcgagaacagcctggccaacatggtgaaaccctgtgtctattaaaaatacaaaaattaactgggcgtggtggcacatgcctgtaatctcagctactcaggaggctgaggcaggagaatcacatgaacccgtgggtggaggttgcagtgagctgagattgcgccactgcactccagcctgggcagcagagtgagactctgtctaaaaataaaattatgtgtatgttcacaaagctagaaaggattttgaatgttaacataaatgataaatgtttgaggtgatatcttaacctgatttgattattatacattatatacatgtatcaaaatatcactatttactccgcaaatatgtataattattacatgtcaactaaaaagaggaacaaatatatcaataaagtatacaaaccttaagttgtacaacgcaatgaatatttaacacgcaagtataaatactcataaaaataccacacaggttaacatgtagaatattttaagcacttcatgagtctcccttgtaccccttcccagtttatacccccaaccgaagataatcatgcttctcaattctcatcatcatatattagttttcttatttctgcattttatataaatggatgtcctgctttgtatctaacatcatgtattcaacattatgattgtgggattcatcaaatttttgttgtttatttttttcattgctttgtgttattctagtgtatgaatttgcaagtgtttctttatctgttatcttttcatggacatttgatttgtgtccagtgttggacaatatgtataaagctgctttgtgcccttttttttaaaaaaaaaaaaaatgactttcgatggacaaagcattcacttacttgggtatatgtctgggagtgtagttactgattttccaaagtggctgtgccaatttatactcccaatcagccatatataaaagttcttattcctccacattgtcaccaagtgttacacttgttagtcttttaattttaactattattgtaaagatataatggtatctggctgtggttttaatttgtgatttcttgattaccaatgatattgaacatcttaacatatttattggacatttggatatctttcatgaagtgtttgttcacatcttttgaactttttgtgatagtggcacaatcacgacccattgcaacctcaaactcatgggctcaagcgatcttcccaccttggcctcccaagtatctggcactacaggcatgtaccaccacgcttggctaattttttaaatctttcttttagacagggcctcgctatgttacccaggcccagtgtctgccacttgcttgttttcttgtctgaaactcttggcttcaagtgattgatcctcccacctcagcctcccaaaatgctggaattacagacgtgagccactgtgcccagccagctcatcttcgaataataacagttttacttcttccttcttaatttttatactttttcccccctttttcttgcttcattgtattgactaggatttctgatacattgttgattagaggtggtgatggaggacatccttgtctttttcccaaactcagggcaaaaaaggattcatagttgtgccattaagtaatttgctagggtttgttttggggtttttttggggggatgggggataccttttatcagactaaggatattcttttattctaatttgttgggaggtttctatttttgttttttgaattcatgaataggtgttgagtgttgtcaactgcttttcttgcagacttgttttctattttaagaatacaagaagcaaaccatgcagccagtgtctgccacttgcatgttttctgtaatgtggtaacttaatattaaagtaaaatagagataatgttcttttattattaaattggactgatacagtctcttttttttttatcgtttatggttaggaagtgtagaattatgtaacactgttaagaatctccctccaggttctcattttttggggttttacacatccacgatatctttgtgttggtggcgggggacttcatagtgccttcagagtgcacaagtgagaaatagatgcaatttaatctcaaatgaaactgaactgtggccgggcgcggtggctcacgcatgtaatcccagcaatatgggaggccgagatggacggatcataaggtcaggagattgagaccatcttggctaacacggtgaaaccccgtttctactaaaaatacaaaaaattagccgagcgtgttggtgggcacctgtagtcccagctactcgggaggctgaggcaggagaatggtgtgaacccgggaggcagagcttgcagtgagctgagattgcgccgctgcactccaacctgggggacacagcgagactccgtctcaaaaaaaaaaaaaaaaaaaaaaaaaagaaactgaattgtgtacttgttgctgagaaactaatctttaataaatttaaaatagtctttaatgaatatttaatcagattattttactttttagttcttatctaaatatggaagaactgtctgtttaattaaagccgataccttttattgaaattacctggtgaaaatgctcattttcagttactagaattggaagagacttttgtaggtcttaattttctgaatttttttagatgatttaatatagattatctgtatattttaaaataatgtttgggttttagaaaaatagtttaggctgggtgcggtggctcacgcctgtaatcccagcactttgggaggccgaggcaggtggatcacccaaggtcaggagttcgagaccagcctgggcaacaccgtgaaacccccactctactaaaaatacaaaaattagctgggcatggtggtgcatgcctgtaatcccagctactcaggaggctaaggcgagagtatcacttgaactcgggaggcagaggttgcagtgagccgagatcgcgtcattgcactccagcctgggcaacaagagtgaaacattccatctcaaaaaaaaagaagaaagaaagaaaaatagtttgaaagaatttgctttactgtgaacatttgtctaaaaagtgcttgaagacaaaatgctacttaaattactaatttcagtggcattttgtaggttcgtgctgctattaattgtaataatttactttttgtagtgttttgtagtttacaaaatgttttcccagagtttactttttttttcttttttcttttatgagactgtctcactctgttgccgatgctggagtgcagtagtgcaatgtcagctcgctgcaacctacactttctgggctcaagcgatcctctccacctcaacttctcccgtggctgggactacaggggcaaaccaccacacctggctactttttgtattttttgtagagataaggttttgccatgttgggcaggctggtttcgaacccctaggctcaagtgatccacctgccttggcttctcaaagtgctaggattataggtgtgagccaccacgcctggcctcagagtttacatttaatctttacaaaagttctttaaaaagggcaaagcaagtacagtcatatgtcacttaacaccagggatatgttccgagaaatgcatcactgggcgatttccttgttgtatgaacaccatagagtatagttatacaaacctagatggtataccctaatatgtggtataaccagtcacagtggcaccatgcttgcagtcccagctacttaggagggtgaggcaggaggattgcttgagtccaggatttagaattagcctgggcaacatgttgagagcttgtctcttaaaaaacaacaacaacaaagatttacttaagaaaatatggtataaaatattaaaaatagtatacctgaatagagcccttaccattaatggagcttgtaggactggaagttgctctgggtgaatcagtgagtgaatagtgaatgaatatgaaggcctaggacattactgtacactgctgtagactttctaagcacagtactcttaggctgtactatgtttataaaaaatttttttctttaataattaactttttcgctttataagttgtgaattttaaaaaaatcttttgtcttttgtagtaacagtttaaaacacagacacgttgtgcagctgtacaaagatattttatttctttatatccttattccataaacatttttctatgttcaaattttttattttttatttttatttacttttaaaacttttttgtttaaaatgctgacacaaacacacacattagcccaggccttcacagagtcaggaacatcaagatgtcactaggcaataggactttttcagctctgttgttacctgtgggaccaccattatatacggtctgtcatttaccgaaccactgttatgtagctcatgactgtacattttacaggtgatctgaggttatgtatgttgtaattggcagagaggtcttaagcccaggtcttttgactgtcgtttctctttctgttttaccatattacttcttacactgtaattatctcataatttcttagtatatttcattttccttctttttttttttttttgaaacagtcttgctcagtcacccaggccggagtgcagtggctcgatctccgctcactgcaagctccgcctcctgggttcacgccattctcctgcctcagcctcccgagtagctgggactacaggtgcccgccaccacgcccagctaatttttttgtatttttttagtagagatggggtttcaccgtgttagccaggatggtcacgatcttctgacctcgtgatccgccctcctcggtcggcctcccaaagtgctgggattacaggcgtgagccaccgtgcccggccgtatgtttcattttctaaaacactttcacgttatctcatttaattctccaaataaactcttttagaaagcctagtctttgacttaaagtcagatactctttctcttactttaaaaaaaaatttttttttctttgagacagagtctcgtgctgttgcccgggctagagtgcagtggcccacatctcagttcactgcaacccctgcctgctgggatctagtgattctcctgcctcaacctcccaagtagctaggattacaggcacccaccaacacacccacccagttaatttttgtatttttagtagagatggggtttcgtcatgttggccaggctagtctcgaactcctgacctcaagtaatgcaccacctcagcctcccaaagtgctgggattacaggtgtaagccaccgtgcctggcccctgataaaaatcttaatgcttgtttactattattatagttcaagctctccttccttggattaatcatggtagcctaactactgtaactaataatccccaattctcagtggtttaagaccaaaaaaattttttaaaagtttattttgcattttctttcaaattgttgctcaggaatccaagatacgttcatcttttgatgtcgtctttgatgcacagcttctactgtccatgggaaagaagaaggtgtatggaaagcactcaagatacttaactacattaacctggaaattactatcaatcatcaccacttacaattttttggctacaagtagtcacatggccctacttacatgcagaagtactgggaaaagtagtccctggctgggcagcctttcctcatcaaaactctgtattctgtagtataatatagaactctatacttaaatctttggtggttagtgtgccttctatgccacatgctccacacaggaataaatcatggctaagtcactaatacgggctctagagccagactgttttggttgaatcctggattttactgtatccttgaccaagtaacttaacctttctttctagaccttttatttaatcattcattgcttaatttattcacctatctatccatttacttattcgatatgtattttttgattgctcactacgttatagacagtattgtaggtgctagggatgcagagatgaacaagagagacaaaactccagtcctcaagggcctttctcactttatactgagagagacaatgagtaaataaacaaaacattagaatatagtaagtgctatattggaaattagtattgatgcgatagaggttaattatgaagagaactttaccttgggattttttctttataaaatgagaataatatataatatcatctacctaagagctgttgtgaggagtaaatgaaacattgtgaggaacatggcatggtaccttgcacattgtaaatgctcagtaaaagttagctagtatcattacttaggtttctttgaacagtttgaccaacacttcaacactgatgaagagtatgtagcagaataagatatctacattggcatcctagaattaagctaggtttgttactgacattttaaggagttgtgaattaatgggctagtgatatgtgaaaatggaaagtagaagggtacttaaacatcagttataatgatcttcctgttattctgcaaaggagaatttcaaaagagctaagaaatttctgaaatacatattttttgaaatgatgagggaatgcaagctgtgctgctgttggaaaataccacctaccttgtagccaactgacaaattaactttttcttttcttcaaaataagttatctgattcattaatgtggtcaccaaataatacattcaaagcagtttgctaatgtagctgggggttcactgagggaaatcagacatgttgactactcccatgaactttattgtccattgagacttgcaaataaggtagtaccaataaagtatgataaatgtttaatggaggaaattcagatctttgtgagagcaaatacagacctgaaatttgatggagttgaatcaggtacttattttttatttccacaagaaagaagagggatttttatttttaaatttttattattattattttttgagacagagtctcattctgtcacccaggctggagtacagtcgtgcaatcttggctcactgcaacctctgcctcccaggtttaagcaattctcatgcctcagcctcccaagtagttgggactacaaggctcatgccaccacgcctggctagtttttttgtatttttagtagagacagggtttcaccatggtggtccggctggtctcggaactcctggcctcaggtgacccgcccacgttgggattactggcatgagccactgcgcctggccagaaaggggacttcttatttgaagatagtgtctagctaattaataagcagacatctagggaaaaggtagatactaaggagggaaaagtattaagtagagggaagggtttagagctgcactgtccaaaagtggaatccagaagccactagctacacgtggatatttcaatttaaattaaactgaaattaaaaattcagttattcagttgcattgacaacattccaaggtttagtagccacatgtggatactgactatattttcttttcaacagatgatgtcagagcaactggatatccgtaggcaagaaaataagccttgacataaaccttatatcttataaaattaatacaaaatgatcatggatttttttttttaaattggagatattttacccaaaagtctgttgaaataaaaaaaaggagtattttagtgactgcagaaagttatcttggacagtgctggtttagaagcccataagacagagagactatagtatgttaatgaattatttatatattttatttcagtagcttttggggtacaagtggttttttgttaaatggatgaattgtgtagtggtgaagtctgagatttcagtgcacctctcacccaagtagtgtacattgtacctaatatgtagttttctgtccttcaccccctcctatcctaccctcttctgagtctacaatatccattataccactctttatgcctttgtgtacccatagctttgctcccacttataagtgaaaacatactgactttccagtggtatttggttttccattcctgagttacttcactttgaataatggccttcagtaccatccaagttgctgcaaaagacattatctcattttttttatggctgagtagcattccgtggtgtagatataccacattttcttcatctactcatggctgatgggcatttaggttggttccatgtctttgcagttgttaattgtgctgtgaataatgtatgtatgcaggtgtctttttgacataatgacttcttttcctttgtatagatacctggtagtgggatggtcggattgaatggtagatctacttttagttttttgagaaatctccatactgttttccataattgttttaatttataatttacattcccatcagcagtggacaagtgttcccttttcatcacatcgatgccaacatctattgttttcttggctttttaataacggccattctggctggaggaaggcggtatctcattgtggttttaatttgcatttacctgatggttagtgatgttgagcatttttttcatacgtttgtgggccatttgtatttcttcttttgagaagtgtctgttcatgtcatttgcctactttttgatgggattatttgtttttttcttgctgatttgagttccttgtagattctgggtattagtcctttattggatgtatagtttgctaatattttctcccattctgtgggttgtctgtttattgcgatgattatttcttccacagtgcagaatctttttagtttaattaggccccatttatttatttttggttttgttacatttgtttttggggtcttaatcataaattctttgcctagggtgatgtccagaagtttttcctaggttttcctgtaggatttttatggtttcaggtcttttaagtctttaatccatcttgagttgatttttatatgtggtgagagacagggatccagtttcattcttctacgtgtggctgtcctgttttcccagaaccatttattgaatagggtatccttttttcaatttatgtttttgtatgctttgtcaaagatcagctggttgtaagtagttggcttttttcctaggttgtctactctgttctattaatctttgggtagtgtggtcattttcacgatactgagtcgtccagtctgtgagcatgggatgtttccatttgtttgtgtcatctatgatttttttcagcagtgttttgtagttcttcttgtaaagatcttttacctccttgtgtaagtacacttctaggtattttattacttttgttgtagctattgtaaaagggattgagttcttgatttgattcttagcttggttgttgttggtggcggtgtgtagcagtgctaccaatttgtgtacattgcttttgtaacctgaggctgctgattcatttatcaaatctaggagtcggcctggcatggtgactcacgcctgtaatcccaacactgggaggcgaggtgggtggatcacttgaggtcgggaggagttagagaccagcctggccaacatggtgaaaccctgtctctactaaaaatacaaaaattagctgggcgtggtggtgggtgcctgtaatctcagctacttgggaggctgaggcatgagactcatttgaacctggaagccagaggttgcagtgagctgagatcatgccattgcacttcagcctgggtgacagagtgagactgtctccagaaaagaaaaaaaaaaatctaggagtcttttgggtaagtctttagggtttcctaggtatatgatcgtatctttggcaaatagagatagtttgacttcttcttttccaacttaaatgccctttacttctttctcttgtctgattgttctggctaggatttcctgtattaataaattacaagaaatatgtagtagccgcatgaagtggctcacacctgcaatcccagtaccttgtgggggctgaggagggaggatcacttgaggccaggagttggagaccagcgtgagcaatagtgcgagaacctgtctctaccaaaaaataaaaataaaaaatttaaccaggcatggtggtacccaccttgagtctcagctacttgggaggattgcttgagcccaggaggttgaggctgcagtgagttatgcactgtagcctgggaaacagcaagaccatgctaaaaaaaaaaaaaaaaaaaaaggaaagaaagaaaggctatatagttataaaattgggttttatttatctaaaaatattagcattgtaggaattacttgagatacgttacttttttcaaaatgtgaaaatcagctggaattgtcaatttttaatttaaaataggtaatagtaactctatgtaacatactgtttatagacaaagatgagtattctttaagaggttttatattgtctttttagtaaatagtgctggagcaattggacacccataaggcaaaagaataaaccttaacccaaacctcacatctttctcaaaaattaattcaaaatgggttgtggatttaattataaaacacaggtcaggagcggtggctcacacctgtgaccccagcattctgggagactgaggcgggcagatgacctgaggtcaggagttaaaggccaacctggccaatataatgaagccccatctctactaaaaaataacaaaaattagctgggcatggtggtgctcacctctagacccagctaagtctggaggctgaggcaggagaattgcttgaacccaggaggtggaggctgcagtaagctgctatcacaccactgcactccatcctgggcaacagagcgagactccatctcaaaaaataaaataacctaaaaaataaagcataaaagtataaaacttttagaagaaaacaggagaaaatctttaagatctcaggctaagcaaagatctctagaacataataccaaaagcaccatacctaaaagaaaaaaattgataaattggatttcatcaaaattaaaaactttagctccgtgaaagatgctattaaaaggatgaaaagacaagctacagacagggagaaaacatgtgcaaagcatatatctgtcaaagatcatagaatgtataaagaactctcaaaactcaacaataaaaacagttcagttagaaaagatgccaaagacatgaacagacatcaccagccattagggaaatgcaaattaaaaccacattgagttatcattacatacctattagaacagctaaaataaaaaatataatactaactgttgtcaaggatgcacagaaactggatgcttcataaactgctagtgagagttaaaatgatacagccactctggaatatagtttgttaggttcttaaaaaactaagcttcccttatgccccaccaatctcactctggggcatttataacagaaaaaaaaaaacttatgtttacacaataggtatactaataatattcgtaacaactatgtattatcattatcatcatcattatttttttttgtagacacagtggttcaccatgttatccagactggtcttgaactcctgagctcaagcgatccatccaccttgccctcctaaagtgctgagattacaggcgtgagccactgcgcctagcctcaacttcatttttttattttttttattttttagatggagtcttgctctgtcacctagcctggagtgcagagactccatctcagctcactgccacctccgcctcccaggttcaagagattctcctgcctcagtcttacgagtagctgggattacaggtgcctgccaccacgcccagctgatttttacatttttagtagaaacagagtttcaacatgttggccaggctggtccggaactcttgacctcaggtgatccactggcctcagcctcccaaagtgctgggattacaggtatgagccaccgcacatggctgcctcaacctgatttttaaaaatttttttcgtagagatggcaatctcactatgttgcccaggctggtctacaactcctagcctcaagtgatcctcccaccttggcctccctgccgtgggatcacaagcttgacccactatgcctggcctaacaaccaacttttctttctctctctctttttttttttttttttgtgatagggtctggctctgcagattgcacatcacccaggctggagtgcagtgatgcgatctcagctcactgcaacctcagactcacaggcccaagccgtcctccaatctcagtcttcctagtatatgggactacaggtgtgcgccaccatgcccagctatttttatgttttttgtagagatggggtttcaccatcttgtccaggcaggctggttttgaactcctgagctcaagcgattcatccacttcagccttccaaagtgctaggattacaggcatgagcctccacgccctgctgcactttatttttaatagcccaaggttataaacaaaccaaatacacgaataaactctggtgtatccatacaatgtactaccactcagcaatataaaagaataaactgttgatacatgcaacaacttggacagttctccatagacttatgctgagtggaaaaaagtcaatatactatatgattctatttatgtaatattttcaaaatgacagaactgtagagatggacaatagattggtgccaggaaacagggtcaggttgaggggtgcaaatatgaaggggtggcccaagagaatttcttcatatcttgactggggtagtagttatttgaatctatatatgggataaaattgcataaaactatatacacacatacaaatgaatgcatgtagaacaatgacaactgaataagacctgtagtctagttagcagtattgtatcagtgtcaatgtcctggttttgatactgtgctaactacagttcaatattgtgggtatatgtactgtattatagttgggggaaactaggtgcagggtacatggggctatagtatcccttgtctgcttgggatcagaagtcagaagtgtcttagattttggattttttcaaattttggaatatttccagaatacatactggttgagcatccctgattcaaaaatttgaattccaaaatgttccagtgagcatttactttgggtgtcatatcagtgctcagaaagtttcagattttggagcattctggattttcagattagggatattcaacctgtagtacatatacatactatttttgcaacttcctatgagtctaattatttaagaagaataaaagttttagccaggtgtagtgatgtgattctgtaatcccagttacttgggagactgaggcaagaggatcactgcttgagcccaggagtttaaggccagcctgggcaacatagcaagaccttgtctcccaaaagaaaaaaaaaaaggattttttttaaaaagcttatatattatacagtggtaagttttattaaggtatacatattttgaatcttatcccaaaagttactgaaatttgaaaaatgaagtttgtattattttttcatttttatgcatactttcattttaagcaatttatattatagaaatttaattttgtatttttagtatttctacaatgtgttgtcatgggtctaatatatttagagcccattcccccaactaatcagcagaactgataatggaactgctcttattgaagttgctgtagtctgtcctgtagtgaccttcaggctttaaccctccagctttagttaaattaagcaggcacagacctttgctatggaaacgatacagaaacataacaaacaacttggcttactttcttctgcgaagcagagggtggactgaagagattactgatactggtgaaagtttttagagactagtgttaacagtagtagtaatttatttattgcctacaacataaatgcttctctggaaatcagatgggataatagtctaattagtttatttgatcttcctttaaaagtctctcagatagaaaggcatagccctatttttcttatggtattatacatctggaacagatgttggtcaaaatatgtgttatgaaatatattccctttgaaatcttatatgagtgattaccttcccccaacatcagtttattttatcaaagtataaaaagcaagtggcttatgactttgtgaagctcttatacatgtcagccatctaatatgactaggattctttggtatagagtacttgccagtatgttatttgatatctggataacttaataggtaatagcaaacttttttatttatattctctattttagatttaactacctcattttgacgagctactttaatgcctataatttttttgttggttttttctttttctatataagagcaaattgcctacagttcttttagaaataatgtattgactaacttcatgagttattttgcttcaccaaattgtactctgttattctaaaatttattctttcaacaatgattgaatgcctgtaatgtgctaggcgctctgctaggctctggagataacaagatggatactgtcctcttcacagtgctcacaggcaagtggtaaagttgttgctgtttatttctccacttgatgaacagttggtcatgtagaataatttgttaaatttatgattaaacatgaaagagcaacaggtataccaaaaaggaatgactaatcactgaatagatgaatgtgaggaagttgcctaatcattgttagcttcagattatctgtgaactgaaaaaaaaaaaaaaaaaaagacatatagtccacaggagtttttggatgcagtgaactataaccactctctaccttcatttttttttacctctgggtataaatctggatgaatctcacgtggcattattacttaccccatctgccgccagataaaccaaaagagtaatggctgaaatttgtttttgcacagatacacataaaatatatgcccaaacttttccagtttccttttagctattgatttatttaggatttatttatttatttatttagagatggagttttgctcttgttttgcactccaggctggagtgcaatggcgcgatctcggctcactgcaacctccgcctcctgggttcaagcgattctcctgcctcagtcttcctgagtagctgggattagaggcattcgccaccatgcccggctaattttgtatttttagtagagatggggtttctccatgttggtcaggctggtctcgaactcccgacctcgggtgatccacctgcctaggcctcccaaagtgctgggattacaggtgtgagccaccgtgcctgacctaggctttatttttgttattgtgatgatattgacattttatagttttatggaatagtttccataattaaagctttgaaatttattaattttacactaaaatgtgtaaaaaaattacaaatgagaatactgatagatttcttgactacataaaaattaaaatatttacagaaaatggaaacataaatgtaataaattgaacaggtttactttcactaaacataagacagctgtagcttaagcctgctggcaggtgagaaagaaccaataagcaagcagcacaagtcattttgcatctgagaactctggaaaggttcaggaatttgacgtactggatatctctgaaagtgggatgtgaggtgagactgaaaacaagaagattggataaaaagtctataaaagaaggagttaagaccgggcacggtggttcacacctgtaatcctagcaccttaggaggttgaggcgggtggatcatttgaggacaggagtttgggaccacctggccaacatggtgaaaccctgtctctactaaaaatacaaaaaaattagccgggcatggtggctcatgcctgtagttccagctactcaggaggctgaggcagaagaattgcttgaacctgggaggtggaggttgcagcaccactgcactccagcctgggcaacacagcgagactccatcttaaaagaaaaaaaaattaaattgaatttaaaaaggacttaaatttcccagatgtttctttcctgtgtggtacagcctagtgataatgcctgtcttaccctgagagaatctggtgattctatagagagaatgaagtggaggttctagattctaggagagctaaaggctaggcttaatgatctgttcttaaaatggggtgggggcggaagggaaggcataatggaagtctgcatactgaagagtgagacctctgaccattttattagttcccacaatgcttgcaataggtttactatgctccctaggcagaagactgcaggatgtgttttaggcaaactcactggtccagtagaagagacctgtagattctaagaaataaactttacttttaacatgtttaaattactgttactttggatttttgtttatgcagccaaacttaatcctaatataaaaggcaattattaactgtaaccaaataagttgtatgaaaaaggaaatataattaaaatacactacaaggctgagctgcaagtaacatgtatccagttataatgcaaacactgaaagttcaaaagataatatatctaaccttgaaaaacattaggaaatagcagtattaacatgttccttagaaatatggaagtaagttccaaaagaaacagtgaaaagggttacaaatggttcccttctgaggagcagaaattgatccagaattggtgataaatggaaaacaaaaccatatttataacttgtaaggcagacaaagggttaatatgcttagtatatctaaagggcttgtaaaattaataatactaaaatagaaacagaaaatgagcaaatcatataaacagccacaaaggggaaaagttgtctgtgtagactattaccacttctctgttctttgcttttttgataggttagaagtagttttcttatttatttgatatttaataagattgagcatttttccatttatttattagctgtttttccctgctttatatgctctacttatatcctttgagaagggtagttggaattacgatttgtcatcttccttgaatctggaattgtttctgcagtatgaattataataaagaatcttgcccgttgcaaaacattattataaacctttggtggttatatcctgaggtctttgtgcctctttggttacaagtcttctagatcagtgtctctcagctctatcagacccagccccactctcaaaaaaagccccacatccattttgtaatgctactttattaacttgaaatggagatttaaagataatacaattaggccaggcacagtggctcatgcccgtaataccagcattttggaaggccaaggcaggaggatcacttgaaaccaagagtttaagaccagccagggcaacctagtgggacttctatatctaaaaaaaaaaaaaaaaaaaaaaagctaggtttggtggcacactcctgatgtcctagctactctagagactgaagtggaaggatcctttgagcccagaaactcagggttgtgttgagctatgattgtgccattgcactgtagcttaggtgacataacgagaccctgaatcaaaaaaaaaaagtgatataattgactacacgtataattttaagaatatcagttataatgcagtactattaagagaaaaataaatatataaactaaattatagttgatgtggtttggctatgtctccacccaaaatctcatcttgaattgtaatccccataattcccacgtgtgaagggagaggccagatgggggtaattgaatcactggggtggcttccccatgctgttctcttgatagtgagttctcatgagatctgatggctttgtaagtgtttggtagtttttcctgtattcattctccctcctgccaccttgtgaagaaggtgccttggttcccctttaccttcaaccatgactgtaaatttcctgaggcccccccagccatgggggactgtgagtcaattaaacctctttcctttataaattacccagtctcgggcagtttcttatagcagtatgagaatggactaatacagtagtttaaaagtatggctgggcattgtagctcacacctgtaatcacagctacttgggtggctgaggcaggaggacgtttgagtcaaggagttcaagaccagcttaagcaaaacagtgggaccccatcttaaaaaaaaaaaagtttcaaagtgaaaagccttgataatgactatagaagacacagtgaagtagttggacgcttacacatgcttgataatgactatagaagacacagtgaagtagttggacacttaacacctgcactatcagtgtgagtgttgccaggtacaaaggcaggcgtgttgatcatcaccctaaattccctgagtggcattactgacaatgacatgattttttgaaatgatgaactctttacatggtaagttgtactcatgaaaaattcatgtatcttaaaattgcatcttttgggggtattaatatatactaaggagttctaagtttataaacattttccttatacatgaatgtctgatgggatattctcaaattctgtgagatgtagactattcactttgaagaactatagttatcccatgtattgagataaagttgaatctctggccctttctccttaagtatctgtagtgcaccccacttatcatgttgacaactaaacgcatcttcacaacatttaaaaaatgcctctgctccaccaccaccctcccctgcagagggtgatactgtccaagttaagaaataccattctaagtcgggcacagtggctcacgcctgtaatcccagcactttgggaggccgaggcaggtggatcaccggaggccagaagttcgagacgagcctggctgacatggtgaaaccccgtctctactaaaaatacaaaagttagctgggcgtggtggcaggcacctgtaatcccagttacttggaaggctgaggcaggagaatcacttgaacccgggaggcagaggttccagtgagcctggatggcgccactgcactctaacctaagtaagtgaggctccgtttcaaaaaaaaaaaaaaaaggctgggtgcagtggctcacgcctataatcccagcactttgagaggccaaggtggacggatcacttgaggtcaggagttcaagaccagcctggccaacatggtgaaacgccatctctactaaagataccaaaaaaaaaaaaaaaaaaaattagctgggcatggtagtatgtgcctgcagtcccagctactagggaggctgagacaggagaatcgcttgaactggggaagcaaatgttgcagtgagccaagatcacgccacagcactgcagcctgggcaacagagcgagactctgtctcaaaaaaaaaaaaaaaaaaaaaaagtaccattctactgggtattaaagcatttgctcggaagagaaggaaataccattctagaccaggggttatcaaactatggcttttataggccaaaatgggccctacacctggtgttttgtttttaaagagaaagagccttgctctgtcacccaggctggagtgtagtcgtgcaatcatagctcactgcagccttgaactggcctcagaggcaggaatgatcctcctgcctcagtctttcaggtagctgggactacaggtgcatgccttcacgtctggctctacctgtttttgtacagcttgtgaactaggagtggtttttatacatttttacatgggtggagaaaaaatcaaaagaatactattttctgatgtgaaacttatgtggaattccaaagtaaccatccataatgattgtttttcatttatgtattgactggttacttttgtgttacagtgacagagttgagtaagacaagagaacataagtggcactctcatcacttcacactaccgctcagggcagtataaatcacagtgatgcagttaaaactcaatagtgtttcaagtgccacaagtattgctgcattgggactttaaaaaaataataatcagtacatactcatcatgtcaaaacaagaaaaagcagatatcgaatgtcattcttttgaggcacagtggactgtgtgttatcttgttatcaaattagatagcaaactgggtaccgtggctcacgcctgtaatctcagcactttgggaagccaaggcaggtggatcacctgaggccagggcaggtggatcacctgaggccagaagttcaagaccagcatggccaacatggtgaaaccccgtctctactaaaaatgcaaaaatttagccggggatgatggtgcacacctgtagtcccagctacttggaaggctgagtcaggagaatcgcttgaacccaggaggcagaggttgcagtgagccaggattgcgccattgcactccagcctgggtgacagagtgagactccatcccccaaaaaagaaaaagttagatagcaaagcattgtgtttattgtgctacagcattatggctaggctaaaagcatatacatcttatgtagcctcacatttccatatagatgtctcactgttacctcgactacagtgtgaccagcattgacaacattaatctttttccaaaatcagtgacttcttcacattattattattatttttattttttgagacagagtctcgctctgtcgcccaagctggagtacagtggcccgatctcagctcactgcaagctccacctcctgggttcactccattctcctgcctcagcctcccaagtagctgggactacaggcacctgccaccatgcccggctaattttttgtgtttttagtagagatggagtttcaccgtgttagccaggatggtctcgatctcctgacctcgtgatctgcctgccttggcctcccaaagtgcttgggattacaggtgtgagccaccgtgcccggcccacattattatttttttaagagacaaggtctcacactctgtcacccaggctggagtttagtggcataatcatagctcactgtaaccttgaactcctgggatcaggcagccctcccacctcagccttctaagtagctaggactacaggagcacaccaccatgctcagctagtgtgtgcgtgtgtgtgtgtaatgtggagatgggggtctcattgtgttgctggtcttgaactcctggcctcaagcagtcctcccgcctcagcctcccaaagtgttgagattactggtgtgagccatgatggccagccttatactttgtttcctagtgataccatcattctcctgggtactgaagctcagatctgacttattggatccctctatcattctgtgtatagttagttacgaaaatctctttagggccttctaggaaagatttattgcattcatccctttccatttctattttctatttatgatcctgcctccaccctagtttaaactttcagcacccatgatttaagtgcctcagccctcttaacttgtttccatgatttcatccgttctctttcatagaggcttaattgatttttatcatatgcttacctgaagctcctgaaagggcaggaatttattcttagtataggatgtagacaagcacaagataaggagactcagatattatattttaaatattgcagtctcctctcagggaactgacctttacgtatctgaatcaagtcaagtaacatgaagatcagagggaatgatatttcagagggataaaatattaagtgtgaaagccctgacattaggagtgagcttgagtggttcatgcaataaggccagcaaggctagagcagactgtggaaagggtaaggccaacagttcagccagggccctaatcaccttatgctgtgtaaaccatcatagggaatttgaattagttctaaatgtggagggaagccattagagagttctgagcaggggagccaaagttatccaattcatgttaacaagtttattctgactcttggatagagaatggactatagggcaacaagagggaagacagagagcagttataaggctattgcaatagtccaggctttaattgcttctttataaatgttacaggactgaaaactatcctgggtaaaattgtattacctaataataggcaaaagtcttaatgtcttcttctgggtacagggaggataaccaataaattatgaagttcgctggttacaagttccactgtaaagccaaggctggacaagtaggcgggaataaaactcacctgtaagactccaccaaatacaaggaggctactataccaaggaagaggaggcatggcaggagaactgagacccccctcacttcatagttttacctactgaaggcagaaacccttaggcacttaggctgtcatttacaaagactgaagtattatcaggagagctgaaagaagtctctccaagccaatctcaaaagacccaagatctagtaacatagctgaagagatgccctgaggctcagaaataaagagcaagactgaagagcatagagaactcctcatagattaaaaaattatcagccaggtggtaaatcagaggaaggtcttccaacagtttcaaggaccggagacttggttatgaagcataggtagatctctggaatctggccagctctcagattccctcgccaggcagaagagagagacattccacccgccaggcctttaaagccagtgctatactgaatcagactatagcttcagacacagtttaagagctgtgaccttacaaaagaaatagcatgcccctttctgtaggtaaatattttctgcttgagtctctagactttttttatactaaatgtccattaaaacaataaacaaccatacacacacacacaagaaaatgtggcccacattaaagagagaaaacactcaatggtagcagactgagagaaggcttagattagatattggaaagatactttagaattactataataaaaatcctgaattaccttgaggaaaaggtggattccgtatacatgaagagatggaggactttcattagggcagagacagttttttattttaagtcaaatggattggctgggtgcattgactcatgcctgtaatcccagcactttgggagaggggtggatcgcctgaggtcaggagtttgagaccagcctggccaacatggtgaaatctcgtctctactaaaaatacaaaaattagccgagtgtggtggcaggagtctgtaatcaatcccagcttctcgggaggctgaggcaggagaatcgcttgaccctggggggcagaggttgcagtgggctgagatcgtgtcactgcactccagcctgggggacaagagcgagacttcgtctcaaaaacaacaacaacaacaaaaacaaaaacaaatggataatgatggggacaaagatacaagagaagaaaactgcaaaccgatatccttcatgaatatacatgcaacaatcttcaacaaaatgcttagcaaccaaatccatcagcacactacaaaagtttatacaccatgatcaagtgggatctatcccaggaaagcaagagtggttcaacatatgaaaattaatctgtgtaatttactacattagtagaatgaagagaaaaaccatgtggtcatctcagttgatagagaaaaaaacctttgacaaaattcagcagcctttcatgatttaaaaaaagcaaaacagccgggcacagtcactcacacctgtaatctcagcactttgggaggtcgaggcgggcagatcacctgaggtcaggagttcagatcgccctggccagcatggtgaaaccccatctgtactaaaaatacaaaaattagccgggcatgttggtgggtgcctgtaatcccagctactcgggaggctgaggcaggaaaatcgcttgaacccaggaggcagaggttgcactgagcagagatcgtaccactatactccagcctgggtgacagagcgagacactgtctcaaaaaaaggcaaaacaaagcaaactgaaaatagagggaaacttagtgtgattaagaggattcttgaaaaactcacacctaatatcatacttaatggttaaagactgaaaggtttccctctaacatcaggaacaagacaaggatgcctgctttcactactgcgattcagccttatgctagaagtcctagccagagcaattaggcaatataaaagaaaaaaaaaaaggcatagaaaacaaaggcacaaacacattctctctctctgtctctgtctctctctccttctccttctctccctctctccctctttctctttcccgaagattgttgaaattgtttgcttaaataggcatttaacttggttggagtcagcctggaaaacttgtctccctgtggttggtggcagctcaaaatctcatttcagttttagccttagctaggctgcttggggtctgtaagtttatacttataaaattgtaagtttataatatatggaataggggttttcagactctttctactaaaagtgtctccgatttaacagtctgttagaggaccttcctatatacccaaatctttaggtctggtctgaatggttaatgttgcccagagtacagaatcagtatttcttttgtgttttctacagcagagtcagaaagctttgtacagttttggtcgatctagatatttatcttaaaaaaacaaaaccaaacccacattcctttatgtaacgtattccagtgttttatttcttaaactaatttggaaatttggagggctgctcactggttacttttggttgtattttttgaaataacattttgtgtgtcaatagtatatgatagagatataatagacttactattgttggcatattgtaaaatgcatggataatgaattgtgcttttctgtgtttctttttcctgattagctcctgggctataacgaaaagccaataaatctacaaatgtttattgggacagcagatgatcgatatttacgacctcatgcattttaccaggtgcatcgaatcactgggaagacagtcgctactgcaagccaagagataataattgccagtacaaaagttctggaaattccacttcttcctgaaaataatatgtcagccaggtattttgaaatatacctaaaatgtgcagttctttttttctctatactttcagaaaaaaagtaaatatatttttgaatataaatataaaatattgttctaaatggcattatgtaaataatgtacatttagtacattttctaagagtggtagcatatttccagaaggaaaattcaattcagtaagtgtttttatactatatattaccagccaagccattatcctaggtgatagggatataaatactgtatctggactttcatcaaatggctcacagtctatctaatagggtagacaataaataaacaattatgatacaattatgattgttctatttccttaaggaaaacttttgactttacctccaggcatcccacttgacccatttccaaataagatgaggtggccaacttctgaatgagaatgcaatagagttttgtacaaaaggattatatatagttgcctgtaatagaaacctgatatgcagtggcttgaacagttaggggtttagtgttttatcacataaacgaaatatacagatagatattttagggctagcacagtagctgcataagtcattagggccccaagcaagttttttcttctttgccgtctttagcatgtggtttccatcctaaagattgtcttatgatctaaaatggctgctggagctctagccatgacatccttattaccagaggggtaataaggagaaaggtgtggaggaagggtaaaagggaacttccattggagtcaaatcctcttttaagaaccttttcctaaaacctacttaacaactctacatctcattgatcatgcttatatgtaaggaacacatggttatgtttaccagaacacattgtcacctcaaataatttagggaggccgagcaccatggctcatgcctgtaatcccagtattttgggaggccaaggcaggcggatcacctgagctcaggaatttcagaccagcctgagcaacatggcgaaaccttgtctctactaaaattacagaaattagccgagtgcggttgcgcctgtctgtagtcccagctacttgggagactgaggtaggaggatcacttgcccgggaggcagaggtggcagttagtcgagatagtgccactgccactacactccagcctgggcaagagtgagatcctatctttaaaaacaaaaaacaaacaaagcaatgtaggggcctgttactgaggaagaagaaaagaaaggatattgagtaggcaggcacctatcagtgggtagtaggcacaaccagacatgggaaacttagatttttattacagaaattgtttcaaactacactatagacctttctttcttttttttttttttttatatttttatttatttttttcaagatggagtctcgctctgtggcccaggttggagtgcagtggtgcaatctcggctcacgcaagctccgcctcctgggttgatgccattctcctgccccagcctcctgagtagctgggactagaggcacctgccaccacgcccggctaatttttttgtatttttagtagagatggggtttcaccgtgttagccaggatggtcttgatctcctgacctcgtgatccacccacctcggcctcctgaagtgctgggattacaggcgtgagccactgagcctggcccacagacctttcttaaggcaggaataacatccatcccaggctattgcaagaacagtcctataaaacagatttcagctgggcgcagtggctcacacctattatcccagcactttgggaggccgaggtgggcggattacctgagaccaggagtttgagaccagcctggccaacatggtgaaacccgtctctgctaaaaatacaaaaaattacctgggtgtggtggcgggtgtctgtaatcccagctactcaggaggctgaggcaggagaattgcttgaaccccagaggtggaggctgcagtgggctgagatcactccattgcatcaagagcgaaactccgactcaaaaagaaaaagaaaccccaaaaaatcagatttcagtcttgagctctcttcatttaaatttatatttaaataaactttttagatgagctgagtgtactccctgaggacatagaaactgatatgtttctattaggtaaaataagagttgcctcaatacataacttattttgggcagatcacttgagggtcaggagttcgagaccagcgtggccaatatggtgaaacccccaactctactaaaaaatagaaaaattagctgggcatagttgtcctgtctgtagtcccagctgctcaggaggctgaggcttgagaatcgcttgaatccaggaggcagaggttgtagtgaccccagattgcgccattgcactccagcctgggcgacagagtgagacttagtctcaaaacaaaaaacaaaaaaccttattctgttaattactaccagaaaagaaaagttaatataaatttaaataaaatctttaaataaatataaatttaaataaaatttttgcctgctttggttcagatggacagtactcaagaacctaacccagcaaatcattgcataggggctatgacagagttttttcacagcaaaggcagacagctagctgataatctctactcttaaattttttttttttagactgtctaaatttgttgcccaggctggagtgcagtgtcaccatcttagctcactacaacctctgcctcccaggctcaagtgattctcgtgcttcagccacccaagtagctgagattgcacacgtgcaccaccactcctggctaatttttgtatttttagtagagacagggttttgccatgttgaccaggctggtctcgacctcctggcctcaagcagtccacccgctttagcctcccaaagtgctgggattacatctagatgtgagccactgcaacggccttaaacatttgtgttctataatgtagaaagaactttggaatctcagcctgtatttattcagatactcgagcaaaactttcttgaggaaaaatattgacaccaggcatcctattggacacattttcaaataaggttaacatgcccaacctctgaatgagaatacaagtaggcttcttcccttttgttctgggatcttacttttttatatagcatcagaagcatgtgatatgtgattagtcagctgtagagggaaatttaaaaatcacctttgaactgtctttttccaaaaactcaggaaattgatccctagacgatagtttgcaggccatgtttgcattcattcctctggatattcaaagcacaatattcgaatcaagttaaatagaaaaatcacaagtttattctgttacttaacttggcttgagggacagtatgagaaatagccatgaacatacttcataatctgaaaaaccactattaaagacagtttctcttaggttgatcactattgcatgcgtgtgtgcatgcacacacaaacacagtcctttcaacttaaaggaaaaaagttagtgtttcccgatggcatggtagattttgctttaccgtacaacacgtggcctataacaactttatcacatttactttttgccttggcttccagaacttcatagtcaagcccgtttacagtaattatagtaatttgtacaactctagacttggagtttacttcctagtgttttaaaattttttctatttattttttcttggctttatttgtatctatattgtaaaatgcctcatatcctttctgaaaataatatataaaccaataaatagaaaagagtatattaatttctatgaaaaattatcaagaaattgggaaaggctcatatcccaaataatatgaaagcattggagcagtaggatctaaatttacctgtctcctccatcatcttccatttactagcacatggaacaagggtaatagtcataatttatgtcccttcctcaaccagatctagcatgtactgtgtattttagaccagaaaggaccaggctgcagaaataccactatgactagtaacatacaggtagtcctcctcctgcaaccctaccacacacatacctaaaacttcttgaccattctatctgctctgtactggtagattgtggaacaggagttctgtaggacccaagcgttatgtatattggagaaaggattaaataaggggcaactaggatgttactaaacctaagaaactttttttaggtactgtagataccagggtagctaatgatgaatgagcctgtttactcagtagctaattgctaggataaactagtatcctagtagcttgttgaatgtaactatattattcagtacagtggttgaatataatatagttccagataatggtaggtttaaaattcccaggtgatagataagaccatggttcaaaataatttatgcataagtgaaccttaagtatgtattaagtgtctttactgttctcttaaggcaataaggtgtggaaaaattcatagatactcccttggttttgcctactaagccatgggcttggttatttcaagcctaaactcttttttttttttttttaaacatctcaattggctttattggtgattctggaattgggcaacacttcattccataaaatacataagtgttccgacaaggttgactttatagacagagaagggctgaagaaagacaagcaaagatcaaagaacatgttgatcatttttttttttttaattgatcattcttgggtgtttctcgcagagggggatttggcagggtcataggacaatagtggagggaaggtcagcagataaacaagtgaacaaaggtctctggttttcctaggcagaggaccctgccgccttccgcagtgtttgtgtccctgggtacttgcgattagggagtggtgatgactcttaacaacgagcacgctgccttcaagcatctgtttaacaaagcacatcttgcaccgcccttaatccatttaaccctgagtggacacagcacatgtttcagagagcacagggttgggggtaaggtcacagatcaacagaatgagaatttttcttagtacagaacaaaatgaaaagtctcccatgtctacctctttctacacagacatggcaaccatccgatttctcaatcttttccccacctttcccccctttctattccacaaaaccgccattgtcatcatggcccgttctcaatgagctgttgggtacacctcccagacggggtggtggccgggcagaggggctcctcacttcccagtaggggcggccgggcagaggcgcccctcacctcccgggcggggcggctggctgggctgggggctgaccccaccacctccctcccggacggggcggctggccgggcagaggggcttctcacttcccagtaggggcggccgggcagaggcgcccctcacctcccgggcggggctgctggctgggcggggggctgacccccccacttccctcccggacggggcggctggcctggtgggggctgacccccacctccctcctggacgggtggctgccgggcggagacgctcctcacttcccagacggggcggctgccgggcggatgggctcctcacttctcagacggggcagctgccgggcggagggtctcctcacttctctgacggggcggccgggcagagacgctcctcacctcccagacggggtcgcggctgggcagaggcgctcctcacatcccagacggggcggtggggcagaggcgctccccacatctcagacgatgggcggccgggcagagacgctcctcacttcctagatgggatggcggccgggaagaggcgctcctcacttcctagatgggatggcggccgggcgaagacgctcctcactttccagactgggcagccaggcagaggggctcttcacgtcccagacgatgggcggccaggcagagacgctcctcacttcccagacggggtggcggccgggcagaggctgcaatctcggcactttgggaggccaaggcaggcggctgggaggtggaggttgtagcgagccgagatcacgccactgcactccagcctaggcaccattgagcactgagtgaaccagactccgtctgcaatcccagcacctcgggaggccgaggctggcggatcactcgtggttaggagctggagaccagcccggccaacacagcgaaaccccgtctccaccaaaaaaatacgaaaaccagtcaggtgtggcggcgtgcgcctgcaatcgcaggctgaggcaggagaatcaggcagggaggttgcagtgagccgagatggcagcagtacagtccagcttcggctcggtatcagagggagaccgtggaaagagagggagagggagaccgtggggagagggagagggagagggagagcgcctaatctcttttctaagaccattacactaacgcataagtcacagagctaccctacaagatgctttaaatataggatgccagtatttattgccttagctctttgcagctcctctgtttttttaacattggattaatattgatgtagcagtgctacaccttgatttaaaatggcatggtggctcatgcctgtaatcccagctctttgggaggctgaggtgggcggatcacgagatcaggagatcgagaccatcctggccagcatggtgaaaccccgtctctactgaaaatacaaaaaaattagccgggcgtggtggtgcacgcctgtaatcccagctacttgggaggctgaggcaggagaatcccttgaacccgggaggcagaggttgcagtgagccaagatggcgccactgcactccaccctggtgacagagcaagactcagtctcaaaaaaatttaaaaaacaatttaaaaaaataaataaatgtagttttaaagataatttaatacttattttcaccgctacataagagtttttttcttgttttattttgcttgcttttttgttttttgcatttaagagttttcagatgtactttctggtactgttatttcacatctattaggaacttagtttgctgctagtatgcctttgctcagtacttaataacacagatgatctctgctatttcccctgaagacccatgttggcatgttaacatgaataatcactaatttgatataacttgataatactgctttgagctaaagtgcagttgttcagtatcagttatataatttgttatctataaatggcaaatgcttttttagttttcaaaattgttgcatttaaaaaaaattcttctcctgtgtctttcttaagatgaaaaattttgagtggcttaattccttttgggattctgccttctgttttattggttgtctttttttttttctttttcttttttttttttttttttggtggagatggagtcttgctctgttgcccaggctggagtgcagtggcgtgatctcagctcattgcaacctctgcctcctgggctcaagcagttttcctgcctcagcctcccaagtagctgagactacaggcacacgccaccatgcctggctaatttttgtattttagcagagacagggtttcactgtgttggctaggctggtctcgaaatactgacctcaggtgatccactcaccttggcctcccaaagtgctgggattacaggcatgagctactgcacccggccggttcttgtcttgctatcctagttctgtaatatattgtccttcaaagtgacttctgcagcctctgtgcaataagcattagggttggaactgttgatagatccagtaagaggacagataacaacgaatgccttgttagcaaggttaactagtatatttgatcataattagttatccatttgctttattcttccaatatgtgaataacaaaggtattttgtagcttctgttgtttcctgccacaatagtgtgttaaacagtcatacttaataataaagttagcagatgatgaaatgttataccttaaatgcagaaccttcatcttacatgtgcattccttagaaattcaagaattttagcctgatagattgtttttattaataaatacatcactataaaagtctaaatatgctgttgataaattatttcttgttctgacgtagttacatgtgtagaattaaagagtctttactttatttcagctgtctggttctaacactccaaaaatttaatggcttatagttatcactctattattttgcatgattctttgggttgactgagctcaactggtccattcacatggtgtcagctggggtcacttaagtacctggattaagtgggagctcagctagggttgaacatccaaaacggctagggtggctgggtggctggagtggttagggattgtctgggcctttctctgcaccatgctagttggacttcttactcaggactccaaaatagcaaaagtggaagttaccagccttcttcagtgctaggctcataacttgcatattgtcacttggccacactccatttgtcaaagcaagtcataggccagttctcaaggagagcaggcatagatactctacgtcttaatggcaggaggaaaggcatgcaagtactggaatgaagaggaattattaactttgcagacaatctgctaagttttgcacttttatcgtacaaaaatatttttaatgcctaaacttcagtttagcagtgaatagcaatcatacatatctttcttttttgacctaattttgggtagtttttttctgacaaattaacaatttctatgtagttgagttgtttataaccatgattatcaataaacaaattaaatttttgtatttttctctttagtattgattgtgcaggtattttgaaactccgcaattcagatatagaacttcgaaaaggagaaactgatattggcagaaagaatactagagtacgacttgtgtttcgtgtacacatcccacagcccagtggaaaagtcctttctctgcagatagcctctatacccgttgagtgctgtaagtgagcttgtgatgatgttttaagatcttgtgtataatagcttattttctgttttacttataatgtaatgtatgcgtctgaagtgcaaactgaggcatacaatctgggttgctggtttgattttctcatgtggaaatgagctaacatgtttgggtggaagagtactgatcttggaattagaaaatggtttctcatgatagtttgactaggtagctctgtgaactacagacaacctctcttgaccacagttttcttgtctgtaaatgagaatggggggcctgatgccatctgaggaccaaatcatgaagctatgattcagatgcttttaagtatcacttggtctttatttcattaaaatgtcagccttcatgctaggaggtacttacttctgtaagctgatactttagctaaataagacttaacagagcttttgttcaaattatttacaacatctgattgagatagtgaatgttttttcctaacatacaaaaccaagatacaagaaaagaccctgcagcctgacatgtactcaatcctggggaactgtggatcttgggcaggttagctggtatgacttgaaatattgagactaatacttgatctttaggacataatttagaatattctgattccatgttttatttgcataggagaaaacagaggcacaagtatctctagtactcattcaaggttatttgctttttagtgatagagctgtgctgcctagaaaacaggttttcttatactctgttgattatataatgttttatatctgttaaccgtatgtgttctttttttttttttttttttttttttttttttttttttttgagacggagatttactcttcttgcccaggttggagtgcagtgttgtgatcttggctcactgcaacctccacctcctaggttcaaacgattctcctgcctcagcctcccaagtagctgggattacaggcacccgccaccatatctggctaagtttttgtatttttagtagagacagggtttcatcatgttggccaggctgccctcgaaatcctgacctcaggtgatccacccgcgttggcctcccaagtgcagggattacaggtgtgagccactgcgcccggccaaacacatgtattctttttttcaggtgagggggttgggtgttttttgagacggagtctcactctcttgcccaggctggaatgtggtggcgcaatctcaactcactgcatcctccacctccagagtttaagcgattttctcctgcctcagcctcctgagtagccggggctacaggggcatgccaccatacctggctaatttttgtatttttagtagagacgaggtttcaccatgttggccatgctggtctcgaaattctgacttgaagtgatctgcccacctcagcctcccaaagtgctgggattacaggtgtgagccactgcacccagcttgtattcttttattattattattattattattattattttttagacggagcctccctctttcatccaggctcgagtgcaatggcacgatcttggctcactgcaacctccacctcccatgttcaagtgattctcctgcctcagtctcctgagtagctgagattataggcgtgtgccaccacacccagctaatttttgtatttttagtagagacggggtttcaccatattcaccaggctagtctcgaactcctgacctcgtgatctgcccaccttgccctcccaaagtgctgagattacaggcgtgagccaccgcacccagccctgtattcttaatttggggccacatctgctataaaatctttcatgccttcttttgctgttcgctgaattggagtgatactttatcatttgccagttgactctgggaatcactgagtaaatctgtggtgaattagctgtagaactaatttttgtatttttaaaatttaaaaaatatattctttgtatagatagggtctcactgtgtttctcaagctggtctcgaactcctgggcacaagtgatcctcccatctcagcctcccaaagttctgggattataggcatgagctaccacattcagcctatattaactttttaatgggtaatataggtatatgctacaaaattcagaaatatagagtacaagataaatttccaagtcaaccagttctcttgcttagaaacagctaccattgccagcttcttaattatcctgccagagggttctatgcccaggtaagcatagatcactctattttaaagtaaagttattaattcatttatttgagcagggtctcactcttttgcccaggctggagtgcaatggcatgatcttggttcactgcagcctccgcctcccaggcttaagcaatcctcccacctcagcctcccaagtagctgggactacaggcacaagccaccacaactgactgatttttgcatttttccccatgttgcccaggttgatcttgaactcctggacttaagtgatctgcccaccttggcctctcaaagtgctgggattacaggcttgagccaccatgctcggctggcaaagtaatttaaataatttaagttcatagagtagtttgagtgtttgagatgaagttacgctaaaatgattcttaattttttttctttttttaaaaataaaattggccaggcgccgtggctcataactgtaatcccagcactttgggaggccaaggcaggtggatcacctgaggtcaggagtttgagaccagcctggccaacatggtgaaaccctgtctctgcgaaaaatacaaaaattagctgggcatggtggcacgtgcctgtaatcccagctactccagaggctgaggcaggagaaccgcttgaacccaggaggcggaggttgcagtgagctgagatcacgccattgcactccagactgggcaacgaacgaaactccatctcaaaagaaagaaaggaaatggatggagtggggagaaaggtgggatgtagagaaattctaggagcaccactgcactccagcctgggcgacagagtgagactccatctcaaaaataaataaaaaataaaaataaaattaacgtgattattgagaatatagaaaatgcaaaatggggctgggcatggtggctcacgcctgtaatcccagcactttgagaggccgaggtgggcagatcacgacgtcaagagatcgacaccatcctggccaacacgatgaaaccccatctctactaaaaatacaaaaattagatgggcgtggtggcgtgtgcctgtagtcccagctacttgggaggttgaggcaaaggaatcacttgaacctgggaggctgggttgcagtgagccgagatcatgccgttgtacttcatcctggcaacaacgagattctgtctcaaaaaaaaaaaaaaaaagcacaaaatggtacaaagaatagtataatattaaattattttgtaatattactatttatatatagtcagtattaaccttttctggctgttcttttttttttttttttgagacggagtctccctgtgtggtccaggctggagtgcagtggcgcaatctcggctgactgcaacccctgcctcccaggttcaagtaattattgtgcctcagcctcccaagtagctgggattacaggtgcccaccaccacacacagctgatttttgtatttttagtagagatggggttttaccatgttggtcacagtggtcttgaactcctgacttcaagtaatctgcccacctcagcctcccaaagtgctgggattacaggcgtaagccactgcgcccggcctcgattttcttttattgtatttgtatgtctttttgtaaacacacatacacacacaatgttttttaattgggcttatctgatacagttttatatcgttttgcagttttcacttatactatcatagatgttttcttctgttattaaatattcttcaaaaatattattttcatcacgcaagtagttttttggcatgtttatgccatctgttgaacacatttttattttatttttttgagatggagtcttgctctgtcgcccaggctggagtacagtggcacgatctcagctcactgcaacctctgcctcctgggttcaaacaattcccccggctcagcctcccgaatagctgtgattacaggtgcctaccaccacgcctggctaatttttgtatttttcaatagagatggggtttcaccatgttggccaggttgatcttgaactcctgacctcagatgatctgccggccttggtctcctaaagtgctgggattataggtgtgagccaacgcacccagcctgtgcacactttgctgttacttagaatgtacctgtaatcagtgtttgttttccggacccttctctatgtcctatttagaacagtagagacatgagtattttctgagatctaggttggtgcttggtacatcccaagtaataactgatcctaaatcccatacctatctttttttttttttttcttgagacagagtctcactctgttgcccaggctggagtgcaatggcatgatcttggctagctgcaatcttcgcctcccaggttcaagagattctcctgcttcagcctcccaaatagctgagattacaggcatgcaccactgtgcccgactaatttttttatttttaaataaagatggggtttcaccatgttggccaggctagtctcaaattcctgacctcaggtgatccacctgcctctgccttccaaagtgctgggattacagacgtgagccaccacgcctggctgcatacacatcttttttcttttcttttttttatgatggagtctcgctgtttcgcccaggggtggagtgcagtggcgcgatctcggcttactgcaacctccgcctcctgggttcaagtgattcttctacctcaacctccagagtagccaggattacaggcgtgcaccaccacacctggctaatttttgtatttttagtagagacgggttttcaccatgttggtgactacaggtacgttctaagtaacagcaaaagtgtgttcaggttgggctcattggctcgaactcctgacctcgttatccgcccacctcagcctcccaaagtgctgggattacaggcgtgagccaccgcgcctggcccacgtaggcatcttctatgaaagaattgattataatactctctttgaatcgggctggcgtcccaatttatgtacttttgtggctaggtattaagtacttgagagctgttgtgagctgggaatggatgctttcctaatggcattgcattttaaatttccttaaaatactctgctagccaaagaaaacacagctgatcttcaaacccaccagttttcccacccacatactagaagtaaaagtggacctgttttccaaatgtgaagagatataatcaacacttttaaaatttgttttaattcagagagaaacctaggtatctaggtatttggcaagaaaaaaccattagaggtcaggtatgccgactcacacctgtaatcccaactctttgggaggcctaggcaggagtactgcttatgtccagaaggactgcttgagcccaggagttggagaccagcgtgggtaacataataagaccctgtctctacaaaaaaaatttttttttagttgtgtatggtaatgcattcctatagtcccagctcctagggagggtgagatctgaagatcacttgagcacagaaggttgaggctgcagagctgtgatcatgccattgcacttcatccttggtgacagtgcatgaccgtttctgaaatccaacaaacaaaaacaaccgttagagaacctacacaatgaaaagaagtataatctacagtttgaaactcaagcaattaaaagaaagaaatgccagaaatagaatctccagaaaatgtagcaacttggaaccagtcattatcagagaaaggtggcaccgtaagcactgtttatagaagttgataatgtaaatatctgggcccagtggctcacacctgtaatcccagcactttgggaggccaatgtgggaggatcacttgagcccaggagttcgagaacagcctgggcaacaaagtgagaccctatctctacaaaaataaaatattaaaaatcagccaggcacggtggcacatgcttgtagtcccagctacttgggaggctgaggtgggagtattgcttgagcccaggagtttgatgctgcagtgagctgatcatgccacactgggcaataaataacctgggcaacagagcaagtctctgtctttaaaaaaaataaaaatataggccgggcgcggtggctcacacctgtaatcccagcactttgggaggctgaggcgggcagatcacctgaagtctggagtttgagaacagcctgaccaacatggtgaaaccccgtctctaccagaaataaaaaaattagccgggtatggtggcacatgcctgtaatcccagctactcaggagactgaggcaggagaatcacttgaacctgggaggcagaggttgcggtgagccgagatcacaccactgcactccagcctgggcgacacagcaagactctgtctcaaaaaaaataaataaataaaatgaatttaaaaagaaaggcttacttggtgtttgtctagtagtagtttcctagaacttgtcttctcttcattgcacgcaatataattatacatctttggacttacatgctttttgtaattagatttatagattttaacggatagttgcatagaagaaacatattaaacatttaagcaaaaagaaaagcagatgaggtaaatgtgttggagtcagtatgaagttgaagatattaatgaagttttattagtttctttatagttgtagtctaagaaaataattggctgggtgtggtggctcaagcctataatgccagcactttgggaggccaaggcaggaggattgtttgaagccaggagtttgagaccaggctggacgacaaagtgagaccatgttgctattaaaaaaaaaaattagctgagcatggtgtcatgcatctgtaaccccagctacttgggagactgagatgggagcatcacttgagcccaggaactggaggctgcagggagctaggatcacatcactgtgctccaatttgggcaacagagtgagaccctttcttaaataaatatacttagaaatcacattaatatatctattttgttttataaacagcttagttcttttagtgtgttttgttgccattgtcttgaattttaaaagcctaaatgaatcccaaaatttgcttctctttattttctttttgtagcttgagtttgtcatttatgtatcaaagatttttaactaatattttgttttttctcaactctttaaaaaaatttaaaacagcccagcggtctgctcaagaacttcctcatattgagaagtacagtatcaacagttgttctgtaaatggaggtcatgaaatggttgtgactggatctaattttcttccagaatccaaaatcatttttcttgaaaaaggacaaggtaagtaatatatgagttgattgacttcaaactaaggggcaaagggtaaaataaattatttagatgtttctgtaacaaaaattacaaagtagttttcataaagctatgggtgtcattttgcacttgattttattttaaaccaaacatttattaaattttcatataaatgttaaattatctttaaggagctgggcatggtggcatgtgcctgtagttccagctactcagaaggctgaggcaggaggatcacttaggcccagaagttctaggttacagtgagctctgattgtggcacttcactcctcagcctgggcaacagagtgaaaccttgtttctaaataataatgtaataataataatttaagatgtctgaaaagtagaattcccccagcaactctactcctaagtgtttacttgaaagggttagaaatacgtgtccgtacatgaacttagagacaaatatttatagcaactttatttataattgccaaaaaatggaaacaacctaaatgctcaccaactgatgaatggataaacaaaatgtgatatatccatacaatggaatattacttggttataaaaattaatgaagtactcatacatgctacagcatggataaaccctgaaaataggctaagtgaaggaagccagcataaaaggacacatagtatatgactccatttgtataaaatgtccagtataggcaatccagaaaccaaaagtagattagtgcttaccagtggttggaggaagttgtcagtagtgagtgactgctgatgggaactgggtttccttttggagtgatggaaatcttctggaattagatagtggtgatggttgtactgctctgtgaatatcccccaaccctctgagtagtatactttaaaaggatggattttatagtatgtgaattatacctcaattatttttaaagtagaagaattcagtgtttatcagggtgtttgattttattccttcttgtgcatatttaaaacacttttacatcagttgtttcctctcagttttaaaaatgtttaaaacttatgaaagactttttttttttgagacagtgacttgttctgttggctaggctggagtgcaatggcacaatcttggctcactgcaacctccgcctcctaggttaaagcgattctcctgcctcagcctcccgagtagctgggattaccggcacacgccaccacacctggctaatttttgtatttttggtagacacgggattttgccaccttggctaggctggttcttaaactcttgacctcaagtgatctgcccacctcagcctcccaaagtgctaggatctacgcgccagtcatgaaagactgtttttataagaataatataatataacaaatacttaaacctactaccaagtttaagaaatacatttacctttgaaagcccctgggtcccccttctcaaatggaaccatcatctgaattgacccttgcttttcttttttttgagacggagcctcgctctgttaccccggctggagtgcggtggcactatctcagctcactgcaacctccacctccgtgttcaagcaattctcctgcctcagcctcccgagtagctgggattacaggcgcccaccaccatgcccagctaagttttggatttttagtagaaatggggtttcaccatattggccaggctggtctctaactcctgacctcacgatccacccgtctcggcctcccaaagtgctggaattagaggcgtgagctaccgcacccggctgtaacccttgcttttcaaccatataaaactatttataattgccaaaaaatggaaacaacctaaatgctcaacatcttttttttttttttctgtttttggactttgtacgatattgcctctattctttgaaaaattgtattttcagaggtcttaatgttttaagactgatccatgtaactgaagacctttcactactataaagtttttcgttgtatgaatgtaccacaatttattatcctttctcttactggatatttcgatattgtccagtttttggcactgctgtacctggtaggcataggcaagaatattaaaattcttaaatttttttaatccactagaggtgaaatggtattttgaaatttgggtttgaatttccctgatagctgttgaggttgttatggaccattaatatttcatttactatgcaataactgtgtctttgcctgttttctccattggatcatttttcattttcttagtgacttaaggaattctttatatattccggatatcagagtgatttgggggaagtgcttcttctttttccattcattaacagtatctgttgagtactctcatgttcccttgcacatgtgacagagctcacctccaaaaccttctggacaggggactgtctttgtggggagccattaacttgtgatatatttctatttgtggttgtaggactagtcagatttgtttcttcttgagtttgttctggtcatatatatttttctttctttcttttcttttcttttttttttttttgtttttttaattttgggatggagtttcgctcttgtttcccaggctgcatgcaatgccgtggtgtggtcttggctcactgcagcctctgcctcccgggttcaagtgattctcctgcctcagtctcccaaatagctgggattacaggcacctgcctccacgcctggctaatttttgtatttttttaaatagagatggggtttcaccatgttggccaggctggtcttgaactcctgatctcaggtgatccgcccgtcttggcctcccaaagtccttggattacaggcgtgagcctatgtgcccgcctggtcatatatatttttctaggactttattcctttcccctacattttcaaatctattgacattaattaactcacagtattctctttttgcatctggagttatatccccccactcttttattcctgttatttatttatgccatttctggattttttaccagtctttccatagttcttggctttatcaaacctttcagtgtgcctttctgtttcactgatttctatatttaacttctttttactttttttattatgttttttcttaattaaaattttaatgttttcattcttttgtctttttaaaacttaagtattaaaggctatacggtgcccccatcacctctcttttataatttctctatctttttctactggatccttcttcttggagtttaattatgtttatgtcttctcatcctaaatattccctttctcttaaatctgtcatcctcttaagcttttgtttcatttctctatcgcttagcatccaccctctcaaaaaagtagtatcatatgctttcatttccttacctgctactctttaatcttttgtctttcacttcattgaaatcataatcacctaaaaatttgacagccagctacttactctccttcttaacacttttcccccttggctttgttgttatctggttctcacacatctttattcttgtttgtttttttatacgaatttttctggctcttaaatatagatgttttctaaggttttctacttatttttcttctcattgttttccttctttttgagaaattttattagctcccaaatctctctctgtagcaacatgtttctcttaaactttaacctgaaatttaaaatacccactggatattgcttcataaatgtctcactgatacttaaaatatgaaaacatatctgactttacaaactagtttttctctctgggtttcttaacttgattaataatatcagcatcttctctttgagctggaagtatgtggctgtcttattctcctttaaaattaacttcccttcaaccctgacccataccctgcctgtcttcaaaaaacatcagttctgtttcataatttattaattcatcaattatttatgtagcagtgctatgtgatatagacactagtctaggcattggggacataatgttgaatacaaccttcaggttgtgtgctctgatagagcttacattgtagtgggggaagcacctataaacaaataaatgaacaagattattccagataaaattgtatgaagagggtatagtgatagagactgaattgtgaactgtttgtatcaagtcatcaagaaaggtctttctgtaggtgtcacattttaggtgaataaggagcaggaggaagagacggtgtctcagagctgtcccttcctttccactgtaaaaattcatctgtgcatgaatacaattaataggtattattgaattcatttatttggcccagagcttcacatttaagagcttttgactgaagttgaatcatgttaaatggtggcagttactggttttagaggagattgcagttgtaaacatgtaactcccattttaaaagcaccttcagtgatccccttcattttctaggctccttattatggcattcaggccataatctgctgccagtctttccaaccctctttcttactgctccttgcctcatactttatacagcatcacagctgcttgttaagtctctatatcttaggggttcatgtcatcttgcctgtgctcatgctgtctcttctgtctataattaccctttcctcatattatgagttctgtctcatgttaagtctcagttcaacgagctcttccaggaagccttccttctctcactacccctccccaagattaggttgaagaccctgatccctgtgttcttggtttattcagagtgtacctttattaattattgtacccaacacattttattataatcaactgtttgcgtttgcctttcatccacaggctgaaggcagggcatcctgtctcagttatctcagtaacatgaagtgtctggcacataaggatccagcaaatggttgctgaactgagctgtaattttaagtaggtgtagcacttgcctgtagtatctcttgtgcagcagaagtaaccattgtctagttactggactggaaaatgatagttacaacctggaaagcatttgatgaaatatttcatgataacttcacagaccagatgaagaagtgatgcaagctgtgtgtggcttagtcactgggtgaatgcccatgacacaaaaagaatgctttggaataattgtacatcagtcggagagctttagtagcagataaggctgtctccaaatgagtagttcacttaggatgaagagacagaaaatgtgttggccaaatcttcaggtgacagaaatctggaaagcctaggaaacattttttaggaccatcagtatctaaaaaatattttgacaagtcaagggatccaacaaaatgaagtctccctgctgggagtaagtaatgttccaaagggctgggagaaaaataccaactcagctgcattaagtgcacagtatgggaacatggcagtaggaaatgtatagacccttggtcacatacttattgtgagagtcagcatatggtgctcccaagaaagcttccccgcctgcaccccaagaaagctttcattaacaaagacacagcatttccgtgtacggtggttagagcctcagtcattctgtaccatgcttggtcatttctcacctaggttattcagtcctgggccttgtgaatttggaggagcacgtttaagcagagaccatgaagtctaaaatattatgtaaggaataggcacagaactggggatgctagccagtaggagaggagacacaagcagatataacagcttttcaacatctgaaatataatctcacagagaagcaatcaagattttattttgtgacggcaaggaataatgtttagcctagttgttggataccataaagagacatttcatttatcacgaggagctttctagcagcatttattatccaagatggaatgagttacctggtgaggaagtgagtttcctgtcattttagttgtacaagcaaaagttggccaccacttgatggcggtgttctcagagggcttttatttgttttttatttttattttttttaaattatactttaagttctagggtacatatgcacaacttgcaggttgttacataggtgtagatgtgccatgttggtgtgctgcacccattaacttgtcgtttacattagatatatctcctaatgctatcccttccactttcccccaccccacgacaggccccagtgtgtgatattccccattcctgtgtctcaagtgtgttctcattgttcaattcccacctatgagtgagaacatgcggtgtttggttttttgtccttgtgatagtttgctgagaatgatggtttccagcttcatccatgtccctacaaaggacattaactcatcattttttatggctgcatagtattccatggggtatatgtgccacattttcttaatccagtctatcattcatggacatttgggttggttccaagtctttgctgttgtgaatagtgccacaataaacatatgtgtgcatgtgtctttatagcagcatgatttataatcctttgggtatatacccagcaatgggatggttgggtcaaatggtatttctagttctagatctttgaggaatcgccacactgtcttccacaatggttgaagtagtttacagtcccaccaacagtgtaaaagtgttcctatttctccacatcctctccagcacctgttgtttcctgactttttaatgatcgccattctaaccggtgtgagatggtatctctcagagggcttttaaacatcacttgggtagatggttagaatgaactcagtgggatctgctaacctgggcagcccaagatctttctccttgtattttccccatttgtacatatttatattttattttcataatggaagtcagtggaaaaaagatcccctttgttaataaatttgtgatactatccatgcattagattttgtctgtatgctttctgatatgaattgcttttaactataaactctttctttcaatagatggacgacctcagtgggaggtagaagggaagataatcagggaaaaatgtcaaggggtaagaaatttaccttaattcttaagaaatatttaagacactgaatagaaaattgaataatgctgctttatggtatggatgactcttttgtatattgattaataaaaaagtaaaattaggctgggcatggtggctcatgcctgtaatcccagcactttgggagtctgaagcaggaggattgtttgagcccaggagttgagacaagcccgagcaacatggtaaaaccctgtctctaaaatacaaaaaattagccatgcgtggtgaggtgcgcctgtagtgccagccacttgggaggctgaggtgggaggatcacctgagcctgggaggtcaaggctgcagtgagccatgatcatgccactgcactgcagcctgagtgacagagtgagaccctgtctaaaaaagtaaaatttctagcggtttggaagtaaaatatttacctagtattaaagtaaattaaattaaagtttagaaaagataaccagttagtgtcttcttttctccttattgtatatagggaaggagaaactagaaatgaaagatcatcagaaggttcttattgaaattatcattaatttctctgaactcatttaggaataaaaacaaattcaataaagaacatatgtataggccttcatggaaaaatgagaaagaacatatgtagtgggtaaaagttaggagcaagacaagtccttaggaattgtgtacttaacacatatttctaactcttcagctatttagttaagctttctaggattctacattgaaagttttggtcttgttatggtggttggaatggagacagagcattttctgggctagggaataccacttcccacagtgctttccaaagatttggagcagttaggttgaggattgtatttggtttggggctaaagattttcaccttggttttgtaaaattatttttgatatagataacacattttgtttaatgccagtttagaacatttggattattttatttttttaatttttatttatttatttttagatggagtctagctctgtcgtgcaggctggagtgcagtggtgtagtctcggctcactgcagcctctgcctcccgggttcaagcgattctcctgcctcagactcctgagtagctgggactacaggcgtgcaatatcatgcctggctaatttgtatttttagtagagatagggttttaacatgttggccaggctggtctcaaactcctgacctcaagtgatccgcccacctcagcctcccaaagtgctgggattacaagtatgagctatcacacctggctccagtttagaacattttgaatataaaatttaaaataagaaatctaaactataatgctacttgggaaccattaaacctaattaaaaatcagaatgaatttactgttaagatacatagtaacatgtaatattcagtagagtaaaacatctcactacatagtatgtaagactttttacttctgctacaaccagaaacccaattgggtgagtaaaaagcaatttctcttttattgattaaaagacttactctttcaagactgaagtatccctttagtaaatctccagatgatgtatatgactagctgatgtgcataattatctatgctggagccttgtagttaagactcatgagttgtgatgtgtttaacaggtgcatttcatttttagttctgagtgtaacacaatcttgctttccatccttaggctcacattgtccttgaagttcctccatatcataacccagcagttacagctgcagtgcaggtgcacttttatctttgcaatggcaagaggaaaaaaagccagtctcaacgttttacttatacaccaggtacgaggagtcatgatggtttactatagagctttctttcctaatgaataaaaagttatttaacgaatcctatattacagtgtttaaggtagagtgcttataaacaatgaaaacaccaacagatgcccactctaaagtttttgttgactttaaatattagatgtggtctcagttgttattttgtaatgatttattataaggaaattagaagatggacggtaggtttaaggtcttttttcagaagggttttaatcaaaaattcccagcattacagaggggcaggtgttcgtgagtatgtgtgtggttctgggtcatgaactctccttgtacccttagcaccataaaaaggcagtgtggccaggcgcagtggctcatgcctgtaatcccagcacttagggaggccgaggcgggaggatcacctgaggttgggagtttgagaccagcctgaccaacatggatggaaaaacttcatctttactaaaaatacagaattagccgggtgtggtggtgcattcctgtcgtcccagctactcaggaggctgaggcaggagaattgcttgaacccaggagtggaggttgcggtgagccgagatcgcaccattgcactccagcctgggaaacgagcgaaactccgtcacaaaaaaaaaaaaaaaaaaaaagaaatgagctttaacagaaaggtaacatgatcagacttgtgtttcaaaatcattttcctcatatttcttttctttataaagtgtcaagaaccagtttaatcttttctgaaattagtgactctgaggagtgagatttacatgagataagtccaagaaggtgattcaaacaccaagagtgttttgaatatacagacagaacatcagtgatgataaagaatatcaggttttggggacagatgagaggggataggatttaaaatgggccttagaggggagaaggaacagaagggaaagaagataaagaagatggattaagatggatgtagatgaaaaaagtttgtagatttagtaatggagagtttaaggagcttccatatgatagctttaggttttttccgcaaaaaatggcatgaagtgtcctgttgtggagcagagggaagtttgggtgatttcacagttggacaatcatggagaatgtttgaaatagtttctgtaggccgggcgctgtggctcacactttgtaatcccagcactttgggaggttgaggtgggtggatcacgaggtcaggagatcgagaccatcctggctaacatggtgaaaccccgtctctactaaaaaatacaaaaaattagccgggcgtggtggcgggcgcctgtagtcccagctactcaggaggctgaggcaggagaatggcgtgaacccaggaggcagagcttgcagtgagccaagatcgcgccactgcactccagcctgggcaacagagcgagactctgtctcaaaaaacaaacaaacaaacaaacaaacaaacaaaaaacacacaaatagtttttgtaaagagagagaaagttctctacagaaacctagtagcattgtagacttgattgaagggcaccattgatgttgatcatcaatttacagatactattataattaattctataattaggggtttatttatttattttttttttttgagagagagtcttaccctgttgctcaggcttgagtacagtggtgtgatcttggctcactgcaacctccgcctccagggttcaagttcatatgattttcctgcctcagcctcccaagtagctgggattacaggtaccctggctaatttttgtatttttagtggagacggggtttcaccacgttggccaggctggtctcgaactcctgacctcaggcaatccgcttgccttggccttccaaagcgctgggattgcaggtgtgagccaccgcgcctggcccaggggtttaattttctttttcctccctttttgtttttcataccccttggtaacaagttgacctgctgttaaactttcttaagtagcactcaaattcttcaaggcgggtggtaaggtatgcatctcctccagaatggggtatgtcctgtccaaagaggttatcaaatactgttgagatgagggattgtagactctaacctgaatgagaaagaagagggctttccagattgcaataaggaaaagcaaaatcagtcaacagattagggggtttgattacttactaccttataatggtagtaattgaaaggcaaaccaggggccgggcgcggtggctcacacctgtggccccgctactttgggaggccgaggtgggcggatcatgaggtcaggagattgagaccacggtgaaaccccgtctctactaaaaatacaaaaaatcagccgggcattgtggcaggtgcctgtagtcctagctactcgggaggctgaggcaggagaatggcatgaacccgggaggtggagctttcagtgagccgagatcgcaccaccgcactccagcctgggcgacagagcgagactccgtctcaaaaaaaaaaaaaaaaaaaaaaggcaaaccaggagaatttgccgcctttcagcccatgaattgggaggacaataaaaaggcagaatcctagaggatattacatttgggaatggaaatcagtagagctctggaatggaaagaaaacattgggttgcactgtaactcatcactggccttatggttgatagatgacaaatcaggtgacatacactaacagaagaatagacacacaggaatgcttgtgtagtacttgttctggttggttactatctctgtagcatttagcttttttcatttttttctaaaatgacattttgaataaaatttttacaaaagtcagtacattactgtaattaaaaaaaaaaaaagacaggtggaaagactatattaaaacattcaaattcttggccaggcgctgtagctcacgcctgtaatcccagcactttgggtggatcacgaggtcaggagatcaagatcatcctggctaacatggggtgaaaccctgtctctactaaaaatacaaaaaaatgagccgggcgtggtgtcgtgagcctgtagtcccagctgctggggaggctgaggcaggagaatggcgtgaacccaggaggcggagcttgcagtgagctgagatcacaccactgcactccagcctgggtgacagaacaagactccatctcaaaacaaaaacaaaaacaaaacaacaacaaaaaaaacattcaaattctcttctattctgagactatcattctgttcttccagattcctttgatccacatataaacaaaatttttaaaaaatggaaatgggactagcccatatatagttttgtaactgaacactttaatttttcatcatcaacagagaattttacagaattgtaataacttcttagtattttgttgtatgacctgatctctgttatgttagtgttattttgtttgtctcattaatttgtatgaatactttatttagagattttattttgtttatggcgaataactccttttaaaattttacttatacaatttttagatagtcatattgttatgggatccttgaggtgtcactttgccagccgaaaacccctgtggctagtggcacctttgcccacagccctctggggccacttggcctggcaagctgcattcggctcgtgcaactggcctggatcccatgcctgcaaagggtgagcagagtgggaaggggtgtgtgagtgagtgagcgtggggtccagccactgctcacagccaggcacgctggctatggagggtctggcagctctaggcaccagcatgggtggtggcgccctgtgaggctgcagctggaccagggataccgcaggcagcttccatggctggcactggggaacatggtggctcctagaaacttgagatgccaggaacctcagagccccaaagagggtgtcacagccctggctcagagagctcctaggtctgggcttcctgaaggccgcagctcttctctccttgttgctgccaacatagcgagcagggggcctgtttcaaccctgtttgtattacaactctttcagccccactgagttcttgtcctgtgcccaggaagaatgaggtacacggacaaatggagggtgagcgggatgaagaggagcttttttgagcaatagaagagctcagagaagacccacagagggtagctcctctctgcagccagggtgtcccaagtgttcagccctcagcagagaggaaactctagaatgggtagctcctctccacaggcaggttgtcctgttgtcttctcagccctcagcagagaggagaccctggggtgggtagctcctctccacagctggtcatcctgttttctctttttgagtatggatgagtccaggttttatatgggcttcagaggagagaaagtgcatgctgactggtccatgggggggccatgggtgggcccagaaaaagcaccgtaagttcgcactctggtctgtgggactggcagcccagcccccagacttcaggccttctccaccctgaaggtggggcttcactggcaacccacctctttccgcccaggaacctgtctgcctcctgttgctgttcatggtgcccaggttgtttctgtcaaggggcgcctgcaaaccagggctgagctgccctcagccctacctcgacctccctcccatgctcatcagtgcccaaagtctggagggggctgaggcggcaggggtctggtgtgtcagcactgccccaagcatatacacacccggctgggttgcaacatcacccagactcagcctcaacctcgctccaagattgaaatgggcaccaggagcagggaggggccagacactgggagcaagcatctctgagctgttgcgggaggggggcttcctgggtctctcttcctaggcagagatgcctaggtcagcagccatcgtttgagtggctgtagctgcacccaggatggtggggcttcttcctgctaccgcccctctccccccgccaagagcgcagggatgcccgggtcagcagctgcagctgggtggccacaactgcacccaggaagtgcaaggctcccgccctgccaattcagaaggtggcggggcttccacctgttcccagctcccaccagctctgtggagcacgcagtcttggctgcacctcgcccactgcagccagggtcatggcagtggccactctagatgggcaaccactgccatcaatagttgcttgttttttattaaggtatttctgaatttattacctttttggcaatccccttgcaatagggatccaaccaatatcaatatccagtgaagggatgatcattaattgcaaatggctggttcttttagggtttttaaattttatttttgtttgagacagaatttcactcttgttgcccaggctggaatgcaatggtactatctcgtttcactgcaacctctgcctcccgggttcaagtgattctcctgcctcagcctcccaagtagctgggattacaggtgtgcaccaccacgcctggctaattttgtgtttttagtagagacagggtttcatcatgttggccaggctggtctcgaattcctgacctcaagtgatcctcccacctcagcctcccaaagtgctgggattacaggtgtgagccactgcgcccagccccaacttcattcttttacatgttgatatctagttttctcagcaccatttgttgaaaagactgttctttcccccattgaatggttttggcacccttgtttttgaaaattagttgacaaatgtgtgagattttatttctggactctattccatcacattgattatgtctatccttatgttaatatcacactgttttaattattgtagctttgtgtagtaagtttttaaatcaggaagtcctgatttcctccaactctgttctttttcaagatgatattggttgtccttgacttgggtagagtgatgtctggttggtgctgcctatctcatataagccagggacaaatcaatgccttatttattccagcttggcttttggtctgtgcccatacctggtttatgccttggacacatgggaaaaaagattgtgttggctatttgagatctcttgagattccatgtgtattttagaatgagtttttctatttctgcaaaaactgtcactgagactttgatagggattacattgaatctgaagatcactttatatgactcaaggacattttttttaaaaaaagatcactttggagagtgttgtcgtcttagcaatattaagtcttcaatccatgaacctggaaagtctttccatttatttagagcttctttaatttctttcagcagtgttttgtagttttcagttataagtcctgccttccatggttaaatcatttctgagtattttattattttttgatgttattataaatgaaattgttggctatgcacagtggcttatgcctataatcccagcactttgggaggttgaggtgggaggattgcttgagtgtggaagtccgagaccagcctgggcaacacagtaagactttgtctccacaaaaaataaacatgagcatggtggcgcacgcctgtattccagctactcaggaggctgaggtgggaggatcccttgttgcagtacgccgagattgcacgatggcactccagcctggccgacagagtgagaccctgtttcccaaaaacaaaaaaaagaaattgttttctgaatttttattcagatgtttattgctagtttatagaaatataacttactatttttgtatgttgattttgtatcctgcaactttgcagaatgtatttgttagtttttttgtggattttagtacttgttttgatccccacatgatggcagaggatcaagtgagatgcatgtgagaaccattgtaaagcagaagttctatgaatgtcagagtcatgatttctggtatatgatgcaacatgtaaaaccagatgacttggtaggcttcggatcagggatccccaagtcaatacttaattaggccctagggctttgttttttgttttagttacttaattttgaataggtaataaatacacagtgaaaaacattcaaaagacataaaaaagtatatagtaaaaagtaaacttcctaattctgtcgcttagtcacctaattttccttcccagcagtgactctaacatagtttcttgtgcctcttcccaaagatattcatattatacagaagcaaaacgtgtatgtgtatacatatatatatgtctacacgtacacacagacatacacgatattttatatgaactgccttccttggcatttgagtttgcccctcagcttacgctgtagttgtgtaacctagcatgaaggcctgtcatgataattttatgtattgtataataatatttgctttaatcattttcttttcagttttgatgaagcaagaacacagagaagagattgatttgtcttcagttccatctttgcctgtgcctcatcctgctcagacccagaggccttcctctgattcagggtgttcacatgacagtgtactgtcaggacagagaagtttgatttgctccatcccacaaacatatgcatccatggtgacctcatcccatctgccacagttgcagtgtagagatgagagtgttagtaaagaacagcatatgattccttctccaattgtacaccagccttttcaagtcacaccaacacctcctgtggggtcttcctatcagcctatgcaaactaatgttgtgtacaatggaccaacttgtcttcctattaatgctgcctctagtcaagaatttgattcagttttgtttcagcaggatgcaactctttctggtttagtgaatcttggctgtcaaccactgtcatccataccatttcattcttcaaattcaggctcaacaggacatctcttagcccatacacctcattctgtgcataccctgcctcatctgcaatcaatgggatatcattgttcaaatacaggacaaagatctctttcttctccagtggctgaccagattacaggtcagccttcgtctcagttacaacctattacatatggtccttcacattcagggtctgctacaacagcttccccagcagcttctcatcccttggctagttcaccgctttctgggccaccatctcctcagcttcagcctatgccttaccaatctcctagctcaggaactgcctcatcaccgtctccagccaccagaatgcattctggacagcactcaactcaagcacaaagtacgggccaggggggtctttctgcaccttcatccttaatatgtcacagtttgtgtgatccagcgtcatttccacctgatggggcaactgtgagcattaaacctgaaccagaagatcgagagcctaactttgcaaccattggtctgcaggacatcactttagatgatggtaagttcatctctgatatgttcttgaagtagtgaagattcagggactttattctcccaagtgtcatgaaaaagtttctatggattgcttattggcatatggttgggcttttaaataagttgttattagaaatatatgttaatatataactttgccaggtaccacggctcacgcctgtatcccagcactttggaaggctgaggcgggtggatcacaaggtcaggagttcaagaccagcctggccaacatggtgtaacgctgtctctactaaaaatacaaaaaattagccaggcatggtggtgtgtgactataatcccagctactcgggaggctgagacaggagaatcacttgaacccgggaggtggcagttgcagggagctaagatcgcgccattgcactccagcctgggcggcagagcaagactccgtctcgggaaaaaaaaaaaaaaaaaaaaatatatatatatatatatatatatgtatgtgtatatatatatatgtatgtgtatatatatatgtatgtgtgtatatatatatatgtatgtgtatatatatatatagagagagagagagagagagagaactttgagggtagatatgaaaatccatgccttagcatctgttttaccactaatatctgttgctgaatacgagatcttttcttccagaatatatagtgagatcacagtgtctagagaatggaattacaaggccattagttccataaatattgctgaatgctgtccttttgcaagatgaagctagatgctgggaatgcgaaggatgtattaagatagaattctcggccaggctcagtggctcacacctataatcccagcactttggaaggctgaggcgggtagatctcttgagcccagaacttcaagaccagcctgagcaacatggcagaaccccatgtctacaaaacaaaatacaaaaaattagccaggcatagtgatgtggccctgtagtcctagctagccaggaggctgaggtgggaggatcacctgagctggagaggttgaggctgcagtgagctgtgatcatgccattgcactccagcttgggtgacagagtgagaccctgcctcaaatttaaaaaaaagatcagcagagatatgtaacagatttcacaggaaggattcagcaagtcttctgtgagtaggtgacatttgagccaagttttggaggatgagtacagttggctttctgtatgcatgggttccacaccttggattcaaccatctgtggattgaaaatatctagggggaagaaaatggatggttgcatctgtattgaacgtgtacaaacagacttttttttttcttgtcttattccctaaacaatataatattacaactgttcccattagcatttacattgtatttggtattataaataatgtagatatgatttaaagggggtatgtggatagattatgtgcaaatagtacactgttttatataagggacttgcgcattcatggattttggtatgggggggttgtatggtatggacataatcatttctcagtgtactcaggggattgattttaggaccgcctgtgtacaaccaaatcatgcatgctcaagtttcacagtcaccctgtggaacccacatgtaagaaaagcagctgtggtctcagtgctttgggaggccaaggtaggaggattacttgagactaggagtttgagaccagcctgggcaacataatgagacctcatttctaccaaaaaaccctacaaaaattagctgggtgtggtggtgtgtgcctgtagtcctagctactaggaagactgaagtgggaggatcgcttgagtccaggagttctaggctgcagtgagctgatcgcatactattgcactccagcctgggtagcaggaaagtgagaccctgtctctaaaaaaaattaaaaagccctccacatatgcagatttcacattcgagaatattcttttttagatccatgtttggttgaaaaaagctgtgtataagtggacccagacagctcaaagctgtgttgttcaagggccacctgagtatgttttcagtaaatgaacatcagaggcaagtcagataacacagcagaaatagagaagaagggtatgtttgtcagggaaggatatgtctgtggtggggtgaggtatggggtccggggtgggggatgggggtgattggtatggtacaggatggttttaaagccatgaggggacatgccaggtcatttgtgtgtaaacagaaggtatatgtgtaaactagagcaacacctaaaattgcatagcatttttctatttattatctaatctaatcgttaccattcctcaaactctgaggtagatagtgacatttatagagttggacttttgaaaaatcacacaactagtaagcagcagaactgagactggttcaatccagtctttttcttgtggcactacagctgcctctcagaaacagcaggccatggtggttagaacagaactctctactaaacggaatccctcaaggtttttctaattcctggagaatattctccagaaatgcatgtgcacaatttcactgcgttaacccatgttcacaactgcatctgatctgttacactgtttggtgtacttgagcactctggtatttaagcattttgctgctgttctctgtgcacagctggcataagtgtcactccctactaaatgatgaaaccaaaaggtagagagcaggctgctacttttatgcaaaacagatttgaaataaaggcttacgcaaatattggctttaaaaatgttgcctgtttcttttagcagttttagactaactcttcacattgctttttaccctgaaacaaggactgagaccttgagtcactcatttgtgatataactgaagataggagatttattgagactttaagagcacttcagctcattttttttaaccaatgaagatattttttccttctaaaaagagcccaaagctagaacctgctctttctaatttaccacaggttgagagatttgggggtagagggtcggataggcaacaaatcagatctctagaaagattttgggaaaatgtatttcattatttgaatatattaagatttgttgcaaaaacagaagatctggaaaggtgaggtctgtgagggcaactgtaaaagcaattttatttttgctccctttattatagtagggcatacaagcaagaaaggagccaggtgccgtggctcatgcctataaactcagcactttgggaggctgaggtgggtggatcacctaaggtcaggagttggagaccagtctggtcaacatggtgaaaccctgtctctactacaaatacaaaaaaaaaaagccagcgtggtggtgggtgcctgtaatcccagctacttgggaggctgagacaagagaattgcttgaacctaggaggcggaggttgcagtgagctgagatcgcgccattgtactccagcttgggcgacaagaacgatactctgtctcaaaaaagaagcaagaaagaatgttcctagattgtagccccccagagactagctatcacatttgctcattgccacccctcaggggacttaatagaagctcagtgctgccaagcagtaattacagagggggaagagcagtacacaatggtgtgcacctgtagtcctggccacttgggaatgtgagatggaaggatcacctggactcaggagttcgagtccagtcttgccaatatagtgagaccctgtctctaaaattgaaaaaaaaatggacaggctgggcgcagtggctcatgcctgtaatcccagcactttgggaggctgaggtgggcggatcacgaggtcaggagatagagatcatcctggctaacacggtgaaaccccgtctctactaaaagtacaaaaaactagccgggcgtggtggtggtcgcctgtagtcccagctacttgggaggctgaggcaggagaatggcgtgaacccaagaggcggagcttgcagtgagccgagattgggccactacactccagcctgggcaacagtgcaagactccgtctcaaaaaataaaataaaataaataaaaggacagaaaaaactgaaacgcactctttttatttttttgtgatggtagtctcaccctgtcatccggtctgaagtgcagtagtgcaatcttggctcactgcagcctcgatttccttggctaaagggatcaatcctcccacttcagcctcctgagtagctgggactacaggcatgtgccaccacacctgaccaatttttgttaaaacgcacttctgaaaaccttagattattggctgtataatttttgcaaattgaatttttgatgcttaatttaagctccaaaatgaatttatttttatttttatttattgatatggagtctctatcacccaggctggagtgcagtggcgcaatcacagctcactgcaacctctacctaccaggttcaagaggttctccttcctcagccccccgagtagctgggactacaggcgtgtaccaccacgcccagctaatttttgtattttttagtagagacggggtttcgccatgttggccaggctggtctcgaactcctgacctcaggtgatctgcctgcctcagcctcccaaagtgctgggattacaggcatgagccaccatgcccagcctaaaatgaatttttgatatttttaatttgactcatttattatgatatttggatttgcctttgaaggtagaatttttagatgcctagaaaaaaaagttctgcaaacttttaatgtaaattcaaattagctgggcgtggtggtgggagcttgtaatcccagctattctggaggctgaggcagggagaattgcttgaacccgggaggtggaggttgcagtgagctgagatcgcaccactgcgctccagcctgggtgacagagtgagagactccatctcaaaaaagaaaaaaaaacaacttttaatgtaaatccataaaatgaaaattaaaatggctgggcgcagtggctcactcctgtatctcagcactttgggaggccgaggtgggcagatcacctgaggtcaggagttctccaccagcctgaccaacatggagaaaccccgtctctaccaaaaatacaaaattagcctggtgtggtggcgcatccctgtaatcccagctacttgggaggctgaggcaggagagtcgcttgaacctgggaggctgaggttgcggtgagccgagattgcgccattgcaatccagcctgggcaacaagagtgaaagtccatctcaagaaaataaataaataaataaataaataaaaacccatagaccttgaactccatagcactggaatatctcgtttttaatttttttttattttttgtagagatgaaatcttgctaaactgcccaggctggtctagaactcatggcctcaagcaattctcccaccttggcctctcaaagttctgggagccatcatatctggccaaatgtcccctttctggttagctttattatattttattttattttactttatttcattttattattcttgaagatggcatctcactctgtcacccaggctggagtgcagtgctgtgaacacagctcactgcatcctcaacttcctgggctgaagcattcctcctgcttcagcctgctgagtaactgggaccacaggcacatgccatcatgccctgctaatagttaactttaaaagtcatagagccaggcgtggtggtgtgtgcctgtaatcccagttactgaggaaggctaaggcaggaagatcacttgagcctagtttgaggctagcgtggacaacatagcaagaccctgtctctgagtattttaagtgagtcatagaacataccagaaaggattgaaagtgactaaaatgaactttgtagttagccgaagctcaatttgttttaactttttcatattatgttaactgttaagtccaaagtaatttccactctacaaccacaggacacggtaatttaaaaaaatttttgctatactacttaaagatacttatcctaataacttttgttaattctgttttatattcaaatttatatatcctcttttaaccaaatcaaagatcaaaacacattttctttaatttttgaagtttttaagtaacatggaatctcttaggcatcattcatgtattagttgactgttacttttagaaatgtggacattaacatcaattttttattataaattcaatgacatttactggagaagatagtaatgtaactcagctcagaatttcgggagttatagactgagcatggtggctcacgcttgtagtcccaccactttgggaggcccaggcaggcagatcacttgagcccaggagtttgagaatagcctggacaacatggcaaaaccctgtctggaaaaattacaaaagttacctgggcagggtagcacgtgcctgtaataccagctacttgggaggctgaagtgggaagattgcttgagcccaggaggtcgaggcttcagtgagtggtgatcatgctactacactccagcccaggtgacagaatgagacccttgtctcaaaaataaagtagttatagagctggaaaatattctaatatagctctcattttatggataaaacatctgaattttacacagagcctaaggtgttcatccaggataagacacttgaattatggcagaataaagactaaaacctgttttctgactctaggagtttttctagaatctgtaatcaagtttctagtcagtgtgttgaggttttagaactggtgtcaaacaaagaatacatgaaagaaaatgccattttctccatagagccttgattgtgagaggaaccagggtaatcttaagattatagattctggccaggtgcagtggttcatgccttgtaatcccagcacttcgtgaggccaagatgggaggatcgcttgagcccaggagttctagaccagcctgggcaatataccctgtctctaccaaaaatttaaaaattagctgagcatagctgggcgtgttggctcacgcctgtaatcccagcactatgggaggccaaggcgggcagatcatgaggtcaggaggtcgagaccatcctggccaacatggtgaaaccccgtctctactaaaatacaaaaaaactagccagacatggtggtgcgtgcctgtagtcccagctactcaggagtctgaggcaggggaatcgcttgaacccaggaggcggggattgcagtgagccaagatcacgctgctgcactccagcctggcaacagagcgagactccatctcaaaaagaaaaagaaaaaaaattagctgatcatggtgatgtgtgcctatagtcccaactactcaggaggctgaagtgggaggattgcttgaacccaggaggcggaggttacagtgagctgagattgcgccactgcactgcagcgtgggcaacagaccaagaccctgtttattttttttttattttttattttttttgagacagagtctcgctctgtcgcccaggctggagtgcagtggcgcgatcttggctcactgcaagctccgcctcccgggttcacgccattctcctgcctcagcctcctgagtagctgggactacaggcgcccgccaccacgcccggctaattttttgtattttttagtagaggcggggtttcactgtgttagccaggatggtctcgatctcctgacctcatgatccgcccacctctgcctcccaaagtgctgggattacaggcgtgagccaccgcgcccggccccaagaccctgtttaaaaaaaaaaaaaaaagtattattctcagtattagatgaagtgttttttggtttgttttgtttgtttttgagacggagtctcactctgtcgcccaggctggagtgcagtggcgatctcagctcactgcaagctctgcctcccgggttcatgccattctcctgcctcagcctcctgagtagctggaactacaggcacccgccaccatgcccggctaattttttgtatttttagtagagacagggtctcaccgtgttagccaggatggtcttgatctcctgaccttgtgatccgcctgcctcagcctcccaaagtgctgggattacaggtgtgagccactgcgcccggcctagatgaagttttaaaggctctccattctctttctcgctggagttcacactttggtattcttaatgataattatattcgtctgtgtctcttccctagcttctttggaacatctcagggccttttgagttctaactactcttcttgttttatgtgggctctatctaatacctctagattaattcagaacatatttaatccttcttgtataatagccttcacatgtgtgaaagcttgatctctttcccagtcttaaaaactctccagcaacttcatccttccctcaccaaaatgcaaatttccttctgcttgaaccgtgatgtttaagttccctttcatagtggagtatccagaagggaacacattgtagctagcttgttgtgggttaagactgtcactttccctgttgaaaagactttatcagtatggcctgaggtcaggggattttcttagctgtgatatactgttgatttagtgagtcataattatgcaaagttgtgtcctttccctacataggtttatatatatatatatatggggtttttttggaccaaagactaaactttataattatccttgttcagtttcattgagatgatttcggtgcctcataccaattttccaagctcagaagaatcccagaagcatttctcagtctcaggcttcctggggcaaggcagatattcctttgggggttacaacagcagcacagtactgacgtttcaccaagttctctttcaagtagtccccctggaaggctgtaatataaacttactcaaacaattaaggcatagttcatgactattttgcttcttgtctttatattttcttcactacctccatatatcattgcacctccttgaaaagcatgttctgtggctgtccaattatcactgaattttactcatatttacaattcgtatgcctggaaatgtaattttccgtaaacatttatgttcgttatggtttttatgccgcaggttttggaccagacagtaaacattaaaacagttgattttataacagatatggaaactgtcaagctgtttttcatttgtttattttttgagatggagtttcccttgtcacccaggctggagtgcagtggcacaatatcagctcattgcaacctctgcctactgggttcaaacgattctcatgcctcagcctcccgagtagctgggattacaggtgcccactgccgtgcccagctaatttttgtatttttagtagagacagggtttagtcatgttggccaggctggtattgaactcctgacctcaagcgatctgcctgcctcagcctcctaaagtgctgggattacaggcatgagccactgcacttggccttgtttaaaatttattttgagacagggtctcactctgttgcacaggctggagtgcaggggcgtgatcatggcttactgcagccttgacctcctgggactcaggtgatccttccactttagccccccaagtatgcagtgtacttacatgtcacacttcctcatgttgcctagctgaattttttgtggtgttttctgttttgtttttgttttttttacttgttttttgtttttggtagagatggagtttcgccatgtttgcccaggctggtctcaaactcctgggctcaagtgatctgccctccttggcctcccaaagtgctggtattacaggcgtgagccactgtgcccgtttgtcaagctgttttaaacattttaattaagatttgattcagtgtggtaattgatactgtttttttgtttgtttcttttaaaaaaaagaaagattatagcggccagacacagtggctcatgcctgtaatcccagcactttgggaggcttaggtgggtggatcacctgaggtcaggagttcgagtccagcctggccaacatggcaaaaccccatctctaccaaaaaggaaaaaaagaaaaatcagctgggcacgatggtgcatgcctgtagtcccagctacttgggaggctggcataggagaatcacttgaatccgggaggtggaggttgcagtgagctgagatggcaccactgcactccagcctgggcaacagagtgagactccatctcaaaaaaaaaaaaaaaaaaaaaaaaaaagattatagtattgtgaaactagactatcttagacctttaaatacaggcccatttaatttatgattgagttaaccgaatcctgttacaactttccattaaagtccctcagttcccacttgtcctccttgttcacagactaacagagccacagctgcagctcttcagcagagaagaggatgcatgttaaatatagcctgacctgatgctgtgctgaaaactgacactgccacttgcaggctctgtgcagtaacatgctgatcctgaatgtagggcatttggtaattcagcagtagtaaacagggactctagtcatgacctcagctgcttcagttctgtatgtaaaagacaagcagaagagcctgctttcaaaaagcaggtgctttttaaaatcaagggaatgataaacacaacattcaggtggttacttggatgtgggaagcaggagactggtatggaggaggaacagagaggttagtattgtcagtgttctcttgcacctgttggttagtggtttcactggtgtctattttattaaaataaaacaaggcaaggcgcggtggctgacgcctgtaatcccagcactttgggaggccgaggcaggtagatcgcctgaggtcaagagtttgagaccagcctggccaatatagtgaaaccccgtctctactaaaaatacaaaaattagctgggcgtggtggtggacacctataatcccagctactcgggaggctgaggcaggagaatcgcttgaacctaggaggcggaggttgcagtgagccgagatcgtgccattgcactccagcctgggcaacaggagcaaaactccatctcaaaataaataaataaataataaaaaaaaataaataaataaaattaaataaaagccatacacagccagtggtgagaatgtgtcatctatgaggtataatcactatgggcactggagtggagggaggtagataatgctgaaatttctcttttaacttggacactggataactcacgaatcctcttttgggaagcatacatgtactatacagcctcaaacgtgtttaggatgaatgattccagaagctgaaaggtcttgtaaataatgcctatgtaggctttaaatcatggcttatgcgagatggaccatgatggggattcaagaccttagacacaaccaccctgggacatacaataagaaaaattgagttttaggcctaatgaagaaagaacaacaaacatttgagaagattttttattttttatatcgaatgcgtctgtgtatttccatggacataaataagttgtacctttttttaaatgaatgtattatttctgaacaaaaaatttattttaatcaacctacattaagatttatacatgaccaggtgctgtggctcgtgtgtaatcccagcactttgggaggccagagccggtggatcgcttgagctcgggagtttgagaccagcttgggcaacatggtgaaaccctgtctctataaaaaataccagaattaggccgggtgtggtggcgtgtgcctatagtcccagctactcgagaggctgaggtgggaggatcgctggagcctggaaggcagaggttgaaattagcagagatcatgccactgcacttcaacttgggcgacagagtgagaccctgtctcaaaataaataaaatgcaattaaaaatataatttatacataagctaggaaaagtccaagagaggctaccactaaagcagcatatcagaagtcttcaaactaagttcccctcaaaatgtgtatttaaaaatagttaatggctgggcgcggtggctcgtgcctgtaatcccagcactttgaaagaccgagatgggaggatcatttgacatcaggagttcaagaccagcttaaccaacatggtgaaacttcgtctctactaaaaacagtaaaaattgggccaggcacagtggctcatgattgcaatcccagcactttgggaggtcgaggcaggcggatcactggaggccaggagtttgacaccaggctagccaacatggtgaaaccccgtctctactgaaaatacaaaaataagccgggtgtggtggcacacatctgtaatctcagctacttgggaggctaaggcaggagaatcgtttgaacctgggaggcagaggttgcagtgagctgagatggtgccactgcactccagcctgggcgacagagcaagactccatctccaaaaaaaaaagaaaatagtgaaaattagccacgcatggtggtgaacgcctgtaatttcagctactcatgaggctgaggcaggagaatcacttgaacctgggagacagaggttgcagtgagctgagatcaggccactgcactccagcctgggcagcagagtgatactctgtctcaaaaatacaaaaaatggtaatgaattatggttactgtttcttgataaactcatattttttttgaacactgtgctaggcactttgctagtggctcattaattctttgcaatcatgtgtgaaatgtgaattattagtcttaattttgtatagatgtggctcagagaccttaagcacatcccagcgttatatggccacaaataattggggcagacatttgaatccagatttgtctgaaatgtagattttctcacatgtgtttttagtggcttctaaaatagctataattgattacttatataatctcgctttcgtaaagacaatagcattgtaactttctaatgtgctgccatgtgtaagatagcaaaacctgtcttaaagatgtattctattttaaaattgatatcctttttttgagttccttcgaagacagattattcacaggaacaaaaagattttttaatgagagataaattgtttaattttaggttcagcagttgaacaagctttttgtggtttggtggcagttttctgccttggcattacaaggttacctcttgctaacaatcatagcttttgatagacttagataaatgtgttcaaacagcttttctctgtttgaagatgcctggctcttttttttttttttttttaaagacatttccaaagcctacagttagtgtctccatctgggcaagagacaacatgtgaaagtctcatttatgctggaagatagggtagggttgagagtgatggttacaagcattttaactttacatctacaagagtgtggtacagattaagtccttgataatcatgttgtatatttaaaaacatctatagatgattttatgtagaatgggaattttaacattttaaatgtgtttatttctttggtgggggaacggagacaggagtttgctctgttgatcaggctggagtgcagtgggaccatcatggctcactgcagcctcgacctcccaggctccagcatttctctcccacctcagcctcccgagtagctggggctacaggtgcctgccaccacatccggctaatttttaaatttttttgtagaggcaggcttttactacgttgctcaggttggtctcggcctcccaaagtgctaggattacaggcgtgagccaccatgcctggcctgtgtttcttaatataatcattttttgaacaagtaatatgttcatgtggtttaaaatgctaaagttacaacattatacatagttaaaaaaaatctgtcttctaagtagatactccattgtcctctgtagggagaattggagttactagtttcttggctgtcattctatgcatttataaacagttgcatttttttccccttatttttactagcatattatgtatactagtttatactttgcatttcccatgtaatatagaatcttgagagattattctatactgtaacataaaagagcttccttgaaaagatattcttaaaatagaatattccataaaatattctataaaatactgctttgaatatttgcaccactatctttttttctttttttttttgagatggattctcgctctactgcccaggctggagtacagtggcaccatctcggctcactgcaacccccacctcccaaatctatgatctctttcatatttgcttacttttctattagattgttgatccttcctcttactgatttatagaagccctttgttaggtgcattagctcattgaggtatgagttgaatgtatccagatttataaattttaaaagagggatttacaaaagtcctctaagtcttgctttaagttaatggttagagctgtgaaaacctaattaagtcatttcacacaatgttctcccatgagaaaatccaaagtttgtttaaaattcaaaatttaccattttaatcattttaagtgtatagctaagtggcattaaatacattcacaatattgtataaccaccaccactttctatttccagaagtttttcatcacccaaactacaactctattaaagtaataactactcatttccttcccgtcctcccagcccctggtaacctgtactctgctttctgtctctatgaatttccctactctagatacttcatataagtgggattacacaatgtttttccttttttgtctggcttatttcacttagcataatgttttcaaggctcatccatattgtaagcatacggaggaataatctattggaatatttttatatagcatattatttacatataatattccatatggaggaataatattcaattttttgtgtacaccacatcttgtttatccattcatctggtgaaaaataatttgggcctaggcacagtagctcacgtctctaatcccagcacattgggaagctgaggtgggtggattgcctgagcccagaagatcaggaccagcctgggcaacatggcgagaccccatgtctataaaaaatttaaaaattagttgggcgtggtggtgtgcgcctgtagttctagctactcaggaggctgagatgagaggatcacctgagcttaggagatggaggttgcagtgagctgagattgcaccatgcactccaacccgggcaacagagaccctgtctcaaaaaaagttgatgaacgcatacatattaaaaaaaaaaaaaaaaaaagatggacagggctcggtggctcacgcctgtaatcccagcacctgggaggctgaggcaggtggatcacctcaggtcaggagttcgagaccagcctgaccaacacggtgaaaccccatctctactaaaaatacaaaaattagttgggcatggtggtgggcgcctgtaatctcagctactcggaagactgagacaggagaatcgcttgagcctgggaggcaaaggttgcagtgagccgagaccatgccattgcactccagcctaggcaacaagagcaaaactccatctcaaaaaaaaaaaaaagataatttgtattgtttccctctcggctgttgggaataatgctgctgtgaacactggcatacatactgtttgagtccctcttttcagtacttttgtgtgtttacgtaagagtggaattgctgggtcctatggtaattctgtgttcaactttctttttgagatggagtcccactctgtcacccaggctggagtgcagtggtgcgatctgggctcactgaagtctctgcctcctgggttgaagcgattctcatgcctcagcctcctgagtagctgggattacaggcatgtgccatcacgcccagctaatttttgtatttttagtaaaaacggggtttcaccatgttggccacactgatctgtcttctgacctcaggtcacccaccctcctcagcctcccaaagtgctgggattgcaggcgtgagccaccaagcccagcctccatgttcaactttttgaggaaccactattttttttaatcctacagcagccacaccattttacatttacaatgtataaggctttcagtttctttatacccttgccaacacatgttattttccatttttaaaataatagccatcctactgggtattaagttatattcattataattttgatttgcatttccctattgactaatggtgttgagcatcttttcatgtgcctgttgtccatttgtatattttcttgtctatccaaatcctttattttatttatttatttatttttgagacggaatctggctgtgtcacccaagctggagtgtagtggcatgaccttggctcactgcagcctccacctcccaagttcaagcgattctcctgcctcagcctcctgagtagctgggtttacaggctcacaccaccacgcctggctaattttttgtatttttattagagatggggtttctccatattagtcaggctggtctcaaactcctgacctcaggtgagccacccgccttagcctcccaaagtgcagggttataggcatgagccaccatgcccggtctagttttcaatgtagaaatcttatgcctctttggttaattcctaagtattttattctttttgatgccactgtaaatagaattgtttttcttaagattgggcacagcggctcacacttgtaatcccagcactttgggaggctgaggcaggctgatcacctgagttcaggagttcaagaccaacctggctaacgtgggcccacctggccaacatggggaaactctgtctctactaaaaatacaaaaattagctgggtgtggtggcatatgcctgtaatcccagctatttgtgggactgaggcaggagaatcgcttgaacctgggagacagaagttggagtgaaccaagattatgccactgcactccagcctgagactccgtctcaaaaacaaaccaaaaaaaaaaaccccaaaacaagaattgttttcttaattttttttggacctttcattccaagtatatagaagtacaactgaatattgtgtgttgattctatattctgccactttggtgactttatttgttagtgctaacatttttttgtctgtgtggattctttagagttttatgtttatactatcatgccattcgtgaatagagataattttctctcttcctttttaatttggatgggctttatgtatttatttatttttctaacctaattgctctggctagaacttctagtggtaggctagtagaagtggtgaaagagtgggcatctttgctttgtttgtgatcttagggggaaagcttttgttctttgttgataatgataggaactaacagtttttcatatatggcctttttcatattgaggaaattccttctattctttgtttattgaatgttttcatcttgaaagagcattgaattttgataaatgagttgggcacggtggctcacgcctgtgataccagcactttgggaggctgaggcgggcagatagctagaacccaggaggtggaggctgcagtgagccgtgattgggatgctactgcactccagcctgggcaacagagtgagaccgtctcaaagaaaaagagttctttccctgccactgctgagttgagtggaggcagaggcttgggtgcattcaagattcagcttcacccgtagaccaccaccatggccacggaaggtgttgctgctggaggtgtggtggctgttaatactgctttacaagaggtgttgaagactgtcctcacccatgatggcctagcacgtggaatttgcaaagctgctgaagggtcaggcccatcttttgtgtgtttgcatccaactgtgatgagcctatgtcaagttcatagaggttctttgtgctgaacaccaaatcaacctacttaaggttgatgacaagaagctagggggaatggttaggtctctgtaaaattgacagagaggggaaaccccgtaaagtggttcgttgcagttgtgtagtagttgaagtacttcaaatgcaagaaatgaacgaataaaactctggctaacccccctgccccccaacacacacacagacacacacacacacacactcacagtcacactcactctgggcatgttggctcaatcctgtagtcctagcactttgggaggccgaggtgggcagattgctcgagcccaagagttcaagaccagcctgggcaacatgaaatcccatctctgctaaaaatacaaaaaatggccaggtgcagtggctcgcgcctgtaatcccagcactttgggaggccgaggtgggcggatcacgaggtcgggacattgagaccatcctggctaacacagtgaaactccatctctactgaaaatacaaaaaaattagctgggcatggtggcgggcacctgtagtcccagctactcgggaggctgaggcaggagaatggcgtgaacccggaaggcggagcttgcagtgagccaagatcatgccactgcgctccagcctgggcgacagagtgagattccttctcaaaaaaaaaaaaagaaaaaaaaaaagaatacaaaaaattagccaggtgctgtggtcccaaatacttgggaagctgaagtgggaggattgcttgagcctgggaggtagaggctgcagtgagccattattgtgccactgcacaccagccttggtgacagagtgacaccttgtctcaaaaaaaataaaagaatttttacaaacacttttctgcatctatcgagatgatcatgtggtttttaaattaatttttgtagaggtagggtcttgccatgttgcccatgccagtcaggagtatgtttttttttcttttgttcaactaatttggcatattactttaattgattttcatttgttgaatcatccttgcattctgggaataaaactcacttggtcttaatgtatcatccttttaatatgctgctgaattgtgttagtgttttgttgatttttgcatctatattcataaagaatattctgtagtttttttgtttttttgtttgtttgagatggagtcttgctctgtcgctcaggcaggaatgcagtggtgtgacctcggctcactgcaacctctgcctccccagttcaagcgattcttctgcttcagcctcccgagtagctgggactacaagtgcgcaccaccatgcccggctaatttttttgtatttttagtagagatggggtttcaccatattggccaggctggtctcgaactcctgacctcgtgatccacccaccttagcctcccaggtgtaagccactgtgcctagccttttcttttcttatagtatctttttctggctttgtgtcagagtaaattctggcctcataatgagttaggaagtgtttccttttctttaatctttttaagagtttcaaaagaatcgaaactcttttttctttgttttgttttgagatggagtctcgctctgtcgccaggctggagtgcagtggcgcgatctcagctcactgcaacctccacctcccgggttcacgccattctcctgcctcagcctctcgagtagctgggattacaggcactcaccactatgcccagctaatttttgtatttttagtagagacggggtttcaccatgttggccaggatggtttctatctcctgaccttgtgatcctcccgcctcggcctcccaaagtgctgggattacaggcgtgagccactgtgcccggctgaaactcttcttctgtaaatgttttttgttgttgttgttgttgttgttgttgtttgagtcggagtctcaccctgttgcccagtctggagtgcaatggcatgatctcagctcactgcaacttccgcctcccaggttcaagcaattctcctgcctcagcttcctgagtagctgggattacaggcatctaccacacgcccagctaatttttgtgtttttagtagagacggggtttcaccatgctggccaggctggtctcgaactcctgacctcaggtgatctacccgccttggcctcccaaagtgctgggattacaggcatgaggcaccgtgcccggcacacttttgtaaatgtttggtcaaagttcttgtgatcaggagagatgaatgaggtatattttggagctcacgaaagtgcttcaaggaactagaaggatttctggagcactgcaagtttctgtaaagcacaatctgaaagtaccactgaattcatccactcacaaaagctcccatagtgtgtgttggcctcttgctttgttcctgggatgctttcttatgatttttatgctgctgtacctgtaatcacatgttctataccttcaagtctgttttggaggattcagttgtggagattgggaacccccagaaagagtattttgatattttcagtatttaaaatactttgcacacactgtaatctttaaatcacctctgaaaactaggtgagtgatctcaaataataaacaagcttaagtcagaaaaattttgcttaaccaaaggatttctggattttgttttgttttgacccctatagtgagggtgcattttgtacagattgactcttcctttgtttttctttttttatctgcttaaaaggaaggtattagttagtgttcatagagactacatgcagatttttcccttctaagtaggttaggtccttttacttgaagttgtacaacagaggccaagaataattccttataggcaaaaagatgagagttgttgttgttgttgttgtttgagtcggagtctcactatttcgttattgtgtttttgactcttggggcatctgaatgctttagccagtactgcaaaactgaccagtggtgactcttcttttgtgcagtgactttcaaacatttttgacagcttcctacaataaaatacaaggattatgttgtgacccagtacacaaaaaatacatacatatacaactaatgttaaagtctcacaaaccaattcttaacctttattagagggaatgcagcctgctatcttctattttgttctatttctttctcttttttttttttttttttttttgagatggagtctcactctgttgcccaggctgaagtgcagtggcgtgatcttggctcactgcaagctctacctcccaggttcacgccattcttctgcctcagcctcccaagtagctgggactacaggcgcccgacaacaagccataggagtgatattataatatattttaagtgattattatagctagcagaccagggatatcacacagagattaagaacacaacaaagagcacatacgaatgatcataaaacagtcagatgaataaaaacacgaaccacagaaaacaacaaaaagacagagagaataacaaggaaataaaagagacaaaagaaacagagaaaaaaacaaaacagcatacacggaacaacgaaccacacaggcaaacaagaagagacgagaccagacagaaagagcaacaaagagaacatcaagaaaaaaaaacaaaaaaacagaaaagaaaaacgaggaagaagacaaaaaagaaacaagaaaccaacaacgaaagaagaaaggaaagaaaaaacaaaggaagaaaacaaaaaaaaaatagaggaaataaaacacagaaaaaaaaaaaacaaaagaacacaaaacaaagaaaaaagaagaaaagaagagaaaaaacaatacaaaaaagaagaggagagcagagaacgcaagcgaacaaaacgaaacggagaagcgagaagagagcacagcaaagagagggagatactaagccaagagagaagaagagaaaaaccaagaccaannnnnnnnnnnnnnnnnnnngtcccaggtactcaggaggctgaggcaggagaatggcgtgaactcaggaggtggagcttgcagcgagccaagatggtgccactgcactccagcctgggcgacagagcaagactctgtctcaaaaaataaataaataaataaataaaaattaaaaaaaataaaaattaaaaaaaaaatactagtttcaacttgctgaattgatttcataaatttctaatggatgtgaactttagtttaaaaaatactcctccaggcgggcatggtggcttacgcctgtaatcctagcactttgggaggcctaggcgggcggataacctgaggccaggagtttgagacccacctggccaacatggttgaaaccccatctctactaaaaatacaaaaagtagccaggcatggtggtgagtgcctgtagtcccagctactagggaggctgaggcaggagaatcacttgaacctgggaggcagaggttgcagtgggcagagattgtgccactgcactccagcctgggtgacagagtgagactccatctcaaaaaaaatactcttccatgactcccagatttggctgtacatatagttttctgggctgctacccttgaagattttgattttgtggtttgagtttgtatttttataaaacattcaggagtttatatttttatcagttgcccagataattttgatgtagccttagccaagtatttgggaactactaatagatataatgtaataaaaactagtttatttaaagctgaatttatcccttaaaaccactgaaaaccataattgtaactcttaaagttattgcccttcaaatttttaaaagaatcatcttagtacctgagctatctgaactccagtatttattttatctaataaaatgtggagagccattttatgcagtgattgacaagtaaaagacagttaaattccttttgattatagaaaaaaaacaggctgggcactgtagtagattaagttcaccctctggtttgttccattcagtagtgatgttgtcttctttgacacagaccaatttatatctgacttggaacaccagccatcaggttcagcagagaaatggcctaaccacagtgtgctctcatgtccagctcctttctggagaatctagagggtgagtgttgattgaaatgtgtcattgtttttgtgcccaagtctggtatttgcatgcagtggctggatttgcatgtgctacagaggagggggtatgcacgggcattttctggtaggcccactcattatctttggaactacactttgactaaaagactctgctttttaaacttaaccacactcaggctcttacacttgtgcttatgattttattcttgaatgaaagggaagtgtttacttagatttattagaccaaagcagaaagaggtttcgtatctatgaattctatatggtttgggttgctcagtaaatttggttgctgatcaggtatgtaagcctactcattcctggtcaagtactcttaacttttgatgtgaatgaaatcaggaaattttgtccgtttttcagaggcaacccagaatatttatccctagcctcccctgtgggcccatgtttgcacttccggtagtcctctggggctctacttggaagaaagctgtagtactagagccagtgtctgtgtctaggcttaggcttctagactcagcagccaaggaggaacgaagctgttccttgctgtcatgttggctcctttcttcaaatactatgaaagccacttaagaaaatatatgatagaaattataaatacacagattataccttcctaaatgccatttgaattttattttaaaatgaatctggatttggaaggggccttggaaatcatgttcactacccaaacctttatatttaggtttctgcagcttcctgatgacctatcagacaagataccaaaaccctaacttctcccagaactgggcctaccctggtctcacatcattcttgtccaaccatgagaggagtggtgacttaattcctgcattgaatgtatataaaactctcaggagagttataaccagaggatttaaaataatttcctcatattaggggtgagaaaataagttgcagaaggattagttaagtcacctgagtcacatcacagccaaaccaaggctaaagcttacttcttccagtgttaagcccagtgtgcttcccatgtgtgaagcaacaagttggtcactaatgatcttggtaagaaggaagtattatgtggagtgaagggatcgatggatgactgagtaaataagaggtgagaacatagaagaaacagcagtgtagacaactcctttaagatgttaagccatgaaagaaagaattagatacagaggggaacatggggttgagtgtttttatttgcttgcttgcttctttgagatagagagatttgcactttttttttttttttttttttttgagatggagtcttgctctgccacccaggctggagtgcagtggtgcgatctccgctcactgcacgctccgcctcccaggttgacgccattctcctgccttagcctcccgagtagctgggactacaaggcgcctgccaccacgcccggctaattttttgtatttttagtagagatggggtttcactgtgttagccaggatggtctcgatgtcctgacctcgtgatccgcccaccttggcctcccaaagtgctgggatgacaggcatgagccaccgcgctggcccagatttacacatattaagtgctgatgagaaggatctggggagacaagttgatagagacaaagaagtgaagaaaattgatgccgcaaggtgttgaagaggttccagagcacaggtagtggaatgggtcctgtggatttttgggtctggagctcaggtttggcccttagagatagatttgggagtcaacaatggacaagattattcagaggaaaatgtacaaaatgagcaaaatagggataaaggattcttctgataattttaaaatgcttctgagtctcacatcttaagccaaattgagagaagttgtttatttttttcacatttcagcttttgctgatagaaaagagtacatgctgatacttgaatatactttcaagtacctgtgtactgtttactcagctggagatttaatgtttgtctttgtagaatgttttcagttaaaaacatttcctagaggaaacattgttatgacgttgattatagcatcacacatagaagaggttttcttttttttttttctttttgagacagtctcgctctgttgcctaggctggagtgcattggcatcatactggctcactgcaacctccgcctcccaggttcaaacaattctccttcctcagcctcccaagtagctgaaattacaggcacctgccaccacacctggctaatattttgtatttttagtagagatgggatttcaccgtgttggccaggctggttttgaacgcctgacctcaagcgatccgccaaccttggcctctcaaagtgctaggattacaggtgtgagccactacacccggccaagaagaggtttcttaaaaaggaaggagtcttaagaggactgattttccccctcaatccgttgggtggggaaaaaaggtataataatttttctttactagtattagagctaatgttaaaagtgaatctctgatctattgctggtgaaatttttttatattaaaaaagtgaaggatatcttcaaatcgtgcatgtatttttaatctgttcaatggtaggaagctgtctggaattcagggtgaaatttgagataacttagttaaaaatctatcagtccaccccattgtataaggtaaaaagaagaaaaaaaataattaggcttggattcagtaggtcatgcctgtaatcccaacactttgggaggccgaggtaggcagattgcttgagcccaggagtttgagaccagcctgggcaacatggcgaaaccttgtctttacaaaaaatacaaaaattagctgggcatggtggctcatgcctatagtcccagctactcgggaggctgaggcaggaggctcccttgagcatgggaggtgaggttgcagtgagccaagatcacgccactgcactccagctttcaagatcatgccactgcactccagcctgggcaacagagcaagatctagtctctgtctcaaaaaaaaaaaaaaaaaaaaaaaaaatctggcatgaaagagctcaagctggttttcttgcttacagtacttaaatattcttcctgtgttataattatggtggtaagttttatttttgttaatagtattagctaagtgagtataatggagatcccagagacatttccacataggaaatttctctcacacctcatgataattcagagatcaagattcctttcaatttgttgttcctctttctccttaggttttgtcaaagcagagaaaccacttagtcatgactgagtcttagcccgaggaagggatgggaaaaagggaggaagaaggaggccaagcaagtgatgaggaagatacgtacatcgcttttgctcacatttcattgaagaaaacgaattgcatgggccatacctagctacactggggaagccaggaaatatactctgtagctgggtgtcagtgtgactaactaaacctcgattactgtggaagaatgaattaagataattagcagcctaccatagataccttctaaattttcaggaacttatttctgtctgtagcttgaaaaatcaaatgaatattttttggtttttcccttttttttgttttatttggagacagggtctcacactgttgcctaggctggagtgcagtggtgcacgatcatagcttactgcatcctggaactccctgggctcaagtgatcctcttgtctcaacctcccaaagtgctgggattacaagcatgacccaccacacctggccaaattaatcagattttgataaatccaaattaatttctcaactcatgccataaataggtgaattcaggccaggcatggtggctcatgcctgttatcccagcactttggaaggccgaggcagacagatcacttgagttcaggagtttgagaccagcctgggcaacatggcaaaccctgtttctaccaaaaatttaagaaaaaattggccaggtttggtgctgtgcaggttgcagtgagccaagatcgtgccactgcactccagcctgggcgacaggaatgagcagcctctcaaaaaaaaaaaaaaaaaaaggtgaattcagtattttttcctgtatttagtttagatggtgctttttttttttattttgnnnnnnnnnnnnnnnnnnnngggcccatgttgggcctgggccaggttccaagggacccaaggtcgggccactgcacttcaagctggggcgaccagaatgagagcctctcagaaaaactagaaaacaaaaaggtgaattcaagtattttttcctgtatttagttatagatggtgctttttttttttattttgagacagagtctcactctgtcacccaggctggagtgcagtgtgcgatcttggctcactgcaagctctgcctcatgggttcactccattctcctgcctcagcctcctgagtagctgggactacaggtgcctgccgccacgcccagctaattttttgtatttttaatagagacggggtttcaccatgttagccaggatggtcccaatctcctgacctcatgatccgcccgcctcggcctcccaaagtgctgggattacaggcgtgagccaccacgcccggcctagatggtgcttttataataattgcatacatgtaggcttcatttttaaaatacatttagtctttattttataaaaacaacatctcggctgggcacggtgattcatgcctgtaatgccagcgctttaggaggccgaggcgaggtagaaggatcaattgaggccagaagttcgagaccagcctgggcaacataataagaccctgtctctatcctccccaaaaataaatcagctggaccacggcgcggctggctcacgcctgtaatcccagcactttgggaggctgaagcgggcagatcacaaggtcaggagtttgagaccagcctgaacatggtgaaaccccgcctctactaaaatacaaaaaaaattagctgggcatggtggcaggtacctgtaatcccagctacttgggaggctggggcaggagaattgcttgaacccgggaggcggaggttgcggtgagctgagatcatgccactgcactccagcctaggtgacagagcaagactctgtctcaaaaaaaataaataaaaataaaaaaataaattagctggtcttggtggcacatgcctgtagtcccagctacttggggcagggctctgaagcgggaggatcgcttgagcctaggagttcacggctgtagtgagctatgatcacaccacttcactccagcctgggtggcagactaagacactgtctcctaaaataataatagtaataataataataataacaccttcataaaattgtttacccaggggatgaatacctttaatcttcaggttcaggaaaagaataacatgaccaaactttggtgaatgttcattgcagcttcaagaggaaataacatataaatggagtctaaaaataccccgaaatcctttacaaaattgcaaattagaaaggcccgttgggattttgtgtatatggcagtgtgtatctactcccttcaaagagggagcacactgggttaccctgcccctctctacctggttgtgaggttccatactatatacttgtcagttctaactttgaattcttaagcatgggaaatagctctaaataagagtcctattggtactcaagcacctcattcttgtgtgtagaaatagcattccagtggactgccaatttgaacatttcttgaatacgaactttttctcttacagcaaacattattgatagctgtgactctacttttgttgtggtggcacaggcaaattcaggtgttggggtagtggaagtcacagatggtggctgccaaaagtgtgccagatcctgtgacctacataacctgttagcacccttattgaggactgttcactcttgttctaggcttttaattcactttgctctttaaagggaggaaaatgagggctgggtgcggtgactcacgcctgtaatcccagcattttgagaggccgaggtggccagatcatgtgaggtcaggagtttgagaccaacctggccaacatggcagaaacctcgtttctaccaaaaatacaaaaattagctgggtgggaggcagcagttgcagtgagccaagaccacaccactgcactctagcctgggtgacagagtaagactctatctcaaaaaaattggggggaagaaaaatgataaaattgtacattaggggcataaacaattccttatactcttatcttaaattggtgaaaaaaataggaaaccacctcacatacttagtggactagagtttatttttccttttttttttttttaagagacaaattgtcccggccgggcagggtggctcacgcctgtaatcccggcactttgggaggtcgaggcaggtggatcacgaggtcaggagatcgacaccatcctggctaacacggtgaaaccccgtctctactaaaaaaaaaaatacaaaaaaaaaaaaatagccaggcattgtggcgggcgcctatagtcccagctactcgggaggctgagacaagagaatggcgtgaacttgggaggcggagcttgcagtgagctgagattgcgccaccgcactccagcctgggagacagagggagactctgtctcagaaaaaaaaaaaaaattgtcactttgtttgttggccaggctcttcttgaactcctggcctcaaacaatcttcctgccttggcttcccctagtgttgggataacaggcatgagccatggcacctggcctggattacagtttaaataaattagcaaattcatgcatatatccattcaagatgacttgaaaaattaaattgcaagcattagtatttttaacaacttaaaaattgtgcttatcaagattgctaatgacttacatttacattacatcatagatttgtttaccagtaataattttgacttgcttcagttgagacctacgttttggccagtcccagcaggaagatatctgaggaatctagaggtgagagcctgaacccagagcccccagcccgagggagaagtgagggagaaggaaagcagaggacttgcatgattaacactcggctcaagttattgctaaaggtctgtgaaagcactttgttgcagttctgactccctagcctaaaatttatattcagtgctcacctgtagcaattacttgagcatgatttttgttgtcattgttccaagtccccaaattgttttaaagattcagttggcaagtaattttatttagtactcaatatatgtaagcactagggattcaggggaaaacaagatagagaaagtctgccccgttggaacttaaatctcctgactgctggtgaattcataaataagtgaatcctgtagtataatgtatagttgagtatagtccgcttgagcactactttgtggaaaatcttctgactttaacatagtcttaaaatcctaaactgtcaggaactttccaggttccttcagctaagtaaggtgaggcacaccaggcaaaggaacagcagagctttggcaagggggagcagaaataacacagcattgagcaggcttccattataatcaataccacatatctactttagaaaatgatggtttcatccttatataagtgtacttggtaagtggatggacagtgccagatatggaccctcatcgtcaggaaaatagaagcattgacttcttataagatatagaagaacaacacctcggctgggtgcagtgggtcacgcctgtaatcctagtactttaggaggctgaggcaggaggatcacttgagtccaggagtttgagactagcttgggcaacatggtgagacctcatctctgcagaaagaaaaaaaaaatccaaaaattagaaaggcataggcgtagtagcacatgcctgtaggcccagctactcaggaggcttaggtgggaagatcaaggctgcagtgagccgtgattgtgccacctgcattccagcctgggcaacagagtgagaccccattgccaaaaaaaaaaaaaaaaaaaaaaaaaaaaaaaaaaaaatagaaaaaagaaaaaaaagagagaaaacacgtcatgtggtttttgatgataaaacaccatttaaaatccgtttgtagttttaaaacttgaacagtgaaatacaaattgttaaaagtgtttttcatagcagcctggaacatctttgaaattattgcctttggaagtgataaatgataagaaaagatgatttgattgtgagccaggtgcttgcttatatatttggctttttgccactgctgtaacgcctgcctaaaatacacactgtgaaaatcaaataacatgcattagtcttaacatactctggtccccttcctacctaccacctaatgaactttcactgtgcttgttctaaatagcttccaagtgattgtattgaattagggtccatttatttagtcatcaggaatgggtgtttcctcagtggcaaggttcttgccttttgggagttcatagcctatttgggagacataatgatgatgcctgatgataatctaatatgaagaggaggcatgttagaagtcacgcacagagatttgtgggccatccttgtgctccctcttagcacaagactagctcgtagaacccccagaacctgcacagaaaacactcttccttatattttttgtgacttgaaataacaggtgccaagggctgccttgcgttcttatgcccactttatattccctctctatgtactgtataagaggtatttctcttctccattgtactgatggggaaactgaagagaaaaatatattcttatgcaaagcatcctcacaacttttcatttacaaagaaactattccagtgagttatttttagaaagtcaggagtaagtttagtttatattccattattctttgcagcatccattatgaatggttaataaatcctagcctggcaaatttacttaaatatcatctgacaggtcaggcacaatggctcatgcctgtaatcccagcactgtgggaggattgcttgaggccaggagttagagatcagctttggcaacatagcaagaccctatctctacaaaaaaaattttaaaatcagccaggtgtggtagtgtgtgcctatagtcccagttattaggttggtgcagaagtaatcacggttcttgccattagaagtaatgccaaaaaccacaattacttttataccaaccaaatactttggaggctaaggtgggagaatggcttgagcccaggagttcaagtttgaaccatgattgcaccactgcactccggtctgggtaacagagcgagaccctgtctcttaaaaaacaaaacaccaggcgtggtggctcacacctgtaatcccagcactttgggaggctgaggcaggtggatcatgaggtcaggagttcaagaccagcctggccaagatggtgaaaccctgtctctactaaaaatacaaaaattagccgggcacgatggcgggcacctgtaatcctagctacttgggaggctgaggcaggagaaccacttgaacccgggagacggaggttgcagtgagccaagattgtgccgctgcactctagcctcggtgacagagcaagactccatctcaaaaaaaaaaaaaaaaaaaaatctgacaaagtactttattaatctataccttaaaaaattgcttatcactggccaggcgcgggggctcatgcctgtaatcccagcacttcaggaggccgaggtgggtggatcatgaggacaggagatcgagaccgtcctggctaacatggtgaaaccccgtctctactaaaaatacaaaaaattagccggacacggtggcatgcaccagtttaaaaaaaaaaaaaaaaaaaagcttatcacttagtagttattagctcaccagtattgattaatcttcactgttttgcagagtcctttggcttcaagtccctacttctttactattctatgttcagtactaaccacagctaagccaaatcttttttttttttttttttttgagacagagtctcactctgttgcccaggctggagtgcagtggcacgatcttggctcactgcaacctccacccgccgggttcaagcaattctcctgcctcagcctcctgagtagctgggattaccgttgcctgccaccgtgcctggctaatttttgtatttttagtagagacaggttttcaccatcttggccaggctggtcttgaactcctgaccttgtgatccacccgccttggcctcccagagtgctgggtttataggcatgagccaccgcgcctggcttttttttttttttttttttttgagatggagtcttgctctgtctccctggctgggctgcagtggcacaatctcggctcactgcaacctccacattccaggttcaagcaactgaattagtaaatattagttccttctccttatagccatatgagtttgagaaatttttgttccgaactgtgtaaaccagaaaaagattagatgttaatacttggaagatttttaaaatctttttgttttggtctgtttttgtttataacagctgtaatgagatataattcacataccataaaatttatccttaaaagtatacaactcagtggtttttagtatagtcagagttttgcaactattactagtatctatttttatattgattgattgattgattgattttttgagacagagtctcactcttgtttcccaggctggagtgcatggtgcaatctcggctcaccgcaacctccgcctcccaggttcaagtgattctcctgcctcaccctcccgagtagctgggattacaggcatgtgccaccatgcctggctaattttgtatttttagtagagatggtgtttctccatattggtcaggctggtctcaaactcccgacctcaggtgatccgcctgcctcagcctcccaaaatgctgagattacaggcatgagccactgcgcctggctactaatatctaattttataactccattactctgaaaagaaactccatactcattagtaattcctccctgtttctccctctctacaacctgtaatctattttctgtctctatggattggcctgttctggacatttcatataaatggaatcatatatgaccttttattgtctggcctatttcacttagcagactgttttcaaggctcatccatgttgtagcatgtatcagaacttcattacatctcaaggctgtatattccattttatggatagagacaacttacgtttatccattcatcacttggtagacatttggattgtttccactttttggctattattaataatgctgctgtgaacatttgaaagtttttcatgtggacatatgttttcacttctcttgtaaatatgcctaggagtggaattagcatagactctttagttgataaggcaaggaatgaaatgatgtgagaactaaaggttcttatttgggggatttgggatgttcccttctatgttagttctgtaagatggaaattctttgctctggacctcacagagcactgtacctccctgagatgcttaggacatcagagaaattaacagaaaagctagagcctccaatcagaaaagatcacaaacaacagaaatgcccccacataataaagagtgcttgtattaggatacagtagcaaaatcacccccacatcacagtggtttattctgaccaaagcatttattttcattccatttacataggaggtggcattgtagaaaataaaaactttctcaaagagatatgaattaaagaaaagttagagtaaggtgaatacttatttaaacatacctttagagtgagggtaagcccccttcccaacccaaaatgaactgaatgagagagaaaaagaggtccagagtagtttgtggagcgatgtttccatctctaatgccactcagctcaggagcaggcttcagacactgcctttatctttacagaaagccatgggaagggaaatgtctgaggtagagctcagcgttgggcatcatatggctaatcactcagaggtcactaatcactctcccttttcttgtttttcagtgaacgagataattgggagagacatgtcccagatttctgtttcccaaggagcaggggtgagcaggcaggctcccctcccgagtcctgagtccctggatttaggaagatctgatgggctctaacagtgcttactgcagccttgtgtccaccaccaacttctcagcatgtttctctccttggaccttgggtttccaactctgcagccttcaggtctggggccaggagtgggacccaccatttgtggggaaagtagcattcctccacctcaggccttgggtagatttggcaaaagaacaggagcagcataggctgtttgagctttggggaaatgaactttgctttttatatttaactaggatacttttatatgatgggtgctttgagtgtgaatgcagcaggctctcttgtttccgaggtgctgcttttgcaggtgacctggttacttagctaggattggtgatttgtactgctttatggtcatttgaagggccctttagtttttatgataatttttaaaataggaacttttgataagaccttctagaagccaaaaaaaaaaaaaaaaaaaaaaaagaaaaaaaaagaaaagaaaaaaagaaaaagaaaaaaatatcccaagcccacacctatgcctcagaaagtcagcatgtgtcctgaagacgttcatagatttataggaaataaagccaaatgtagctcatacctctttataaaactaaactgttgttagataaaatgagaagagaccattccatcattgaagtgttggaatataaaaagacattccagagcatagccttttggtaactttctaggtaatcttgcaatctctccatactggctccatgttgaaattgctttttccctcaggaccctgggtaagatggctacatttaaggtgactctgaatggtggggttctagcttggtcactttcatttcttgccatcataaaaactagtaggctgtggagtgcgcttcctgtttgtgtcatctggtcgtagaaccttttccaaacagaagcatctgcctttggctgttctgtgacctttgaagccagtctcagtggtttaggcagctttgcagttctaactctagctagaggccaggctgtgtgcagagctaaagcacaaatgagcagtacatcagcatgggcagagaaaatacaggactccagatgggaaggttttaagagtcacactggcatggaaggcttatctgccattctatttatagcctgaaatgattctggcctaccctgtcctgtctgtatgatctaaaaaccagccttttccccagaaggctctgagcacatccagaagtgataacctgaccctccacaccaaagacaccctggtgctgctgctggtgagactggtgtccaaggcagggcccagcagaaactgcagcctgctgtctaccaaaggaggtacccgagttgggtactttaaaaaaaaaaaaaacctgcccttacccctctccctaatgggattttttttacctgttcctgggcccattacagagcctctgaagtttgcagtatgctttcaaatgaaataatatacttccattgattcaggaagcagattttttgagtgcctatatgtgagacagtgtgctggttgaaggcctgatgctgttattccaggagactgcaggcccttgatgccaggactctctctactaaggccagttcaggtctgggaaagggagctggcctattgcccaccacctgttgtcagtaggttaggagctgttgactcaggatgaggaagtatggtctttaaaaaaaacaaaatatattttagatttctcccctaaagttagttagagaaaaaggtctattcttcagcagatcactgtggcccctcttggagctgggtgttttcaaattttcttgaaaagtgagttgtgtcacagaatgtggatagtgagatttgcttctgggcctgtggttggacgcccacagcttcctttggaggggcaagaagttggcctctcggttgacattccagagaaatggccagacttgcccctacccttttgcccctggtgtagctgcctcacatgaggttattgcaagagttccccttgcaataccctttgtgccctcaagaattaaaagcctctatgatccagagttgctatgcaccaaattttgatgccttctaaataccttgatgcctgtagcactagaaatgctttcctatttaaaataaacattaaattttaaaatagagctttgtatactatgtaagcagttttatatcagctttgtaaaagctttggtgttaagagtcaatattttttggctttgtagataaagacttaaatttttgtgcaacatagtggtgttaaagcacacatccattggactatgcaaatcaatttctactagcagcactgagcaactgggcacgtgctagtacgcaccccctcctactctaactgtgctagctcttgggttgaggaatggaatgggtagccttctgcttactggagatgcacagagaaacatggctgaaaacagctttaaaaagaacatgtctt

SEQ ID NO: 15445 - DNA, 8230 bp, Human
ccaaaccgcccacctggtcccttgcctcaggtctggaggaagtgccggatgcgcatcttcacagtggcccagatggatgacaacagcatccagatgaagaaggacctggctgtctttctgtaccatctgcgccttgaggccgaggtggaggtggtggagatggtgagccctctgccctgccctggccccgtggataccatgtcccgtgcagctgggtcctcacggccaaccctgtccccagcataacagtgacatctctgcatacacctacgagcggacgctgatgatggagcagcggtcgcagatgctgcggcagatgagactgaccaagactgagcgggagcgagaagtcagtgccctttgtggttcacgccagggcgggtggcagggtcaggcctttggagaccgcatcggtgggtgcggaggaatcagaatgactcaccgcagccctacccaagctagtgctcatttcccggaggcaaggtggtcacattgggccagacaggccccatcccccttttcctatgggaccaaggctatctcctgcaattgtcctcaggcccagctggtcaaggatcggcactcggccctgcggctggagagcctgtactcggacgaggaagatgagtctgcagtgggggctgacaagatccagatgacgtggaccagggacaagtacatgactgagacctgggaccccagccatgcccctgacaatttccgggagctggtgcacattaagccgtgagtgcagcaaaaacagccccagcggcactggaatctaggggtggaggtggggtggggcagacaagtagtgttagatgggccaggggtggggaccctccttgcaggatggctcatggcgacctgtgactggctacactacgtgtagggaccaatccaatgtgcggcgcatgcacactgctgtgaagctcaatgaagtcattgtcacgcgctcccacgacgcccgcctggttctcctaaacatgcctggcccacccaggaacagtgagggcgacgagaactgtatccctttgtggagaggcaggcagttgggaggtggatagcatgggaggtcaagccagcggcttctctcctgggcacccctgggtgggcatggcccaggtggcccgggttgcccgttgattctgttgttgcctccttgacttgaggccctgcagacatggagttcctcgaggtgctgaccgagggccttgagcgggtgctgttggtgcgcggtggtggccgtgaagtcatcaccatctactcctgagcccagtgtcatcttgtggcctggagtcgaggtcttggccaggacataacaagctgtggtctggggtaacagcctcttcccagcacccacctgccagccctgcttgcctggccctgtcctggacccagctttgctaggtctccttggaaaccaggcctgggcctcaaaatggagatggatcccaggtcttgtgggaccctgggatgtttggggactttactatctagcaccccagtaggcctgtcctggccagagaagactggtaggggccgagtggggtttgaaggcagccggcccggcccagcccaggagcgctatttattgcatatttattgtttggatgtcaccatcagagacgaagggaagggtagccagggagggagtccagcccagctgcctgcaggaagatctggctcagtctactatgggcagggccccccaccaagctgagccgaatggagacagctgagctgaggcctgactttttcaataaaacattgtgtagttctgggcctcctgctgccccggctctgtttcccctggcgccaagagaagaaggcggaactgaacccaggcccagagccggctccctgaggctgtgcccctttccggcaatctctggccacaacccccactggccaggccgtccctcccactggccctagggcccctcccactcccacaccagataaggacagcccagtgccgctttctctggcagtaggcaccagggctggaatggggccgcccggctccccatggcagtgggtgacgctgctgctggggctgctgctccctcctgccgcccccttctggctcctcaatgtgctcttccccccgcacaccacgcccaaggctgagctcagtaaccacacacggcccgtcatcctcggtaagcccccaccaggcccctgatgcaccacgccagaccctggggagcctgggccccagcccctggcagctgacctggccaaagcccttctgccctgcataagccccgacataagtacctgccctggtgtggggaggggccaaaagcttgtcccttagaggaatgacgtcccttctcccaccacactgtgactctcagttgtctaacccagggggggcggagtgggggacggggtgtgcctgaggtcttggctggggcatcacaagctgtggtcagtcacagccacaccagactctgggccaagccccaccactccttccttggcccccacccaccaaggacaagatgcccagcccaggatcggtgagcaggagaggcccatccatgcccggcccctattaggcccagcccccatgcccccagacctatctgttcccaccttggactttggcaataaaggagcgccagactgggtgtttgctctgcagaggcaggggtcagcggccttggcctcagcacctcagcgccttcccttcctcagggaagcctgggctttggctactggggggacagcagggagagggggtgtaagcaggggagggtaagtgtgctttgtacctgggggttgagggtatgggaggtggggggtgggtctggtcactgcagcatctggggtgacgggggtaagggtcacggggggaatccagagtccagagtgagggctgctgctcacagtgcccggctgcctggggaatcagctagaagccaagctggacaaaccagatgtggtgaactggatgtgctaccgcaagacagaggacttcttcaccatctggctggatctcaacatgttcctaccccttggggtagactgctggatcgataacaccaggtacagccatgtgctccaccctagccccaacacgctgccccttggctactggctgctgagtggcacccccgccccgcagggttgtctacaaccggagctctgggctcgtgtccaacgcccctggtgtccagatccgcgtccctggctttggcaagacctactctgtggagtacctggacagcagcaagctggcaggtttgtgtcagagggcagggctggggctccaggcctgggtgctggcccacagcaggcatggcccaagcccccggtgctgctggtccccccacagggtacctgcacacactggtgcagaacctggtcaacaatggctacgtgcgggacgagactgtgcgcgccgccccctatgactggcggctggagcccggtgagtgtctctgcggatgaccggcttggggtggggcaggtgccccagaccccagctgccctgaccccttccacccgctgcaggccagcaggaggagtactaccgcaagctcgcagggctggtggaggagatgcacgctgcctatgggaagcctgtcttcctcattggccacagcctcggctgtctacacttgctctatttcctgctgcgccagccccaggcctggaaggaccgctttattgatggcttcatctctcttggggctccctggggtggctccatcaagcccatgctggtcttggcctcaggtgagaaggcctcgaacacttaggtccagcgatgggtgagaccaagctgatcctgggcctgccttcattgcggctcctgctcacagtggcctctaggggtgctatctaccactcctgggctggcatgcttgctgtcactggcccccagagcagtgaccctggcctgagcaattagggtggctccttccagagtctgtgtcagtgatggcaaaggggcagtgaacacagaaagtgaatcccagctatctgctcccagggtttgttcttgtagccccagagcctgcctgcccagcccttgcctgccttccacttgctcgcaggagtgcctttgcccagggatgtgcttcactgaggatggatctgccagagctagggccagaccccccgaggccccacctgctcttccctagggagtggcaccagggcccagcactgacacagctaccacctactccccaccccctgtaccctgggagctggtctggagagagaaacacagtctggacaagagaaacgctcatcagacaccaccaataaacatcaaacagacaccatcttgtttccccctttctggagcacaactctgtggcccccattgctgcataagccacacaaggagcagaaagacacatgcccgagggaggacagccagcaccgcccccaccatccccacacatcctgggcctcacccaccatccccacacaccctggtcctcaggaagccccgcctacttttttttttctttttcagacagggtcattctgtcgcccaggctggagtgcagtggcgtgatcatagccgcagtctcaatctccctggcccaagcaatcctcctgcctcagcctcctggttagctgagactataggcacacaacaccacacctaatttatttttgttttttagtagagatgaggtcttgctatgttgcccaggctggtctcaaactcttcaccttaagtgatcttcctgcctcagcctcccgaagtgctgggattacaggcgtgagctactgtgctgggccttttaaaaaatgtttatttgtttatttatgtattttgagatggagtctcgctctgtttcccaggctggagtgcagtagtgcaatctccactcactgcaacctccatctccccagttcaagtgattcttctgcctcagcctccctagtagctaggatcacaggcatgtgccaccacgcctggctaatttttatatttttagtagagattaggtttccccatgttggccaggctggtctcgaactcctgaccttaagtcatctgcctgcctcggcctcccaaagtgctaggattacaggtgtgagccaccgtacccggccctatttatttattttttaagctggaatctcactgtgtcacccaggctacagtgcagtggtgcgatcatagtttactgtaacctcaaattcctaggctcaagcaatcttcctgcctttgcctcctgagtagctaggactagaggtgcactccactaagcccagctgattttttttttttttttttttgtagagacagggtctcactgcattgcctagtctggtcacggactcctggcctcaagtgatcctcctgcctcagcctcccaaagtgttgggattacaggggtgagccatggtgcctgtccctgccatccttttgaagccctacagctccacccaacagaggtcttatcagggcttctcattgagtaagctgacactgagcatcattgaatatcaggcctgctcaagcctgtggcttagagtctgtgtctagattgggcagggacaagattgagcatctggctgagcctacactcagcaggttgtgggccaggggtagccaggcctggctccctgtcccaccttgctccatatccacaggtgacaaccagggcatccccatcatgtccagcatcaagctgaaagaggagcagcgcataaccaccacctccccctggatgtttccctctcgcatggcgtggcctgaggaccacgtgttcatttccacacccagcttcaactacacaggccgtgacttccaacgcttctttgcagacctgcactttgaggaaggctggtacatgtggctgcagtcacgtgacctcctggcaggactcccagcacctggtgtggaagtatactgtctttacggcgtgggcctgcccacgccccgcacctacatctacgaccacggcttcccctacacggaccctgtgggtgtgctctatgaggatggtgatgacacggtggcgacccgcagcaccgagctctgtggcctgtggcagggccgccagccacagcctgtgcacctgctgcccctgcacgggatacagcatctcaacatggtcttcagcaacctgaccctggagcacatcaatgccatcctgctgggtgcctaccgccagggtccccctgcatccccgactgccagcccagagcccccgcctcctgaataaagaccttcctttgctaccgtaagccctgatggctatgtttcaggttgaagggaggcactagagtcccacactaggtttcactcctcaccagccacaggctcagtgctgtgtgcagtgaggcaagatgggctctgctgaggcctgggactgagctgggcaccctagatgtacagctgcccactctcctggtcgagctgttgaggcagtgtgcaccgtgcctgcctctgtgctgggcgcggggactggagctggctccacccacagccctgtcagaggagcacggggcggtgggggggcggtgacaatttgagctgtctctcccagctcccaaaagggcaggtgagacgaccttttgagtgctgggtgaatgacagggccacaagtgtttagaggccgggcacggtggctcacgcctgtaatcctggcactttgggagaccgaggcaggcggatcacctgaactcaggagtttgagaccagccaggccaacatggcagaaacccccgtctctactaaaatacaaaatatttgccaggcgtggtggcatgcatctgtcgtcccagctactcaggaggctgaggcacgagaatcatttgaacctgggaggtggaggtcactgtgagccgagatcacgtcgttgcactccagactgggcggcagaatgagactgtctcaaaaaaaaagagactgggtctcaaaaaaaaaaaaaaaaaaaaaagttagaattaaaatctgggagtgacaaccattaatcagatcatttcactaatggaagtttaattactaatgaagctaaatgctctgagaaaagcttaggaagcacaagaggctgagcctttcaggtcagcaaagacttcccagaggaggcagtgcctacactgaggtcagagtgacaagaagagtaatggaccactgtaaagacttgggttcggccgggcgcggtggctcacgcctgtaatcccagcactttgggaggccgaggcgggtggatcatgaggtcaggagatcgagaccatcctggctaacaaggtgaaaccccgtctctactaaaaatacagaaaattagccgggcgcggtggcgggcgcctgtggtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaagacttgggtttgacttgattgagcccaggagttcgagacaagcctgggcaatatagtgagacctcatctctacaaaaattttaaaaattagcctggtgcggtggctcatgcctgtaatcccagcactctgggaggccgaggtgggcggatcacttgaggtcagaagtttgagaccaccctgaccaacatggagaaaccccgtctctactaaaaatacaaaattagccgggcatggtggcgcatgcctgtaatcccagctactcgggaggctgaggcaggagaattgtttgaacctgggaggtggacgttgcggtgagccaagatcacactattgcactccagcctgggcaacaagagcaaaactccgtctcaaaaaaaaaaatttatttttaaattagccaggtgtagccacagctgtagtcaaatctactaggcaggctgaggtgggaggattgcttgaacctgggaggcagaggttgcagtgagccaagatggtgccacggcattccagcctgagcaacagcaagaccctgtgtccaaaaaaaaaaaaaaaaaaaaccgtaaaataggccaggcacagtggttcatggttataagcctagcactttggaaggctgaggagggtggatcgcctgagctcaggagttcaagaccagcctgggcaacacggtgaaaccccatctctaccaaaaaaaaaaaaaaaaaaaaaaattagccaggcatggtggtgtgtgcctgtggtcccagctactcaggaggctgaggtggaagagtgcttgtgcctgggaggc

SEQ ID NO: 15446 - DNA, 6289 bp, Human
ctgctgagtctcaggcctggctgctgggtgccagcaagagcatcctgtcctcagcgagaacggctgaactccgctggagcttcagaaatgtcagggagagtctacccagggcccagggagggtctatgccgggctgcacatccccaggccgctgagtgtgctccctgcaccccaacattctattaatgaacatttgtaaatgtaacagaaaagtagaaagagttgtatattgaatacccttatactgtcaggtcaccacagacctgacagtattttgttatatttgttttatcatctattcatccctctatccattaattcatcgctcctttttttttttttttttttttttttgagacggcgtctcgctctgtcacccaggctctggagtgcaaatattttgttatatttgttttatcatctattcatccctctatccattaattcatcgctccttttttttttttttttttttgagacggagtctcgctctgtcacccaggctctggagtgcagtggcgcaatctcagctcactggaagctccgcctcccaggttcacgccattctcctgcctcagcctcccgagtagctgggactacaggtgcccgccaccacgcccggctaattttttttttttttgtatttttagtagagacgaggtttctactgaacctgttagccaggatggtcttgatctcctgacctcatgatccgcccgcgtcggcctcccaaagtgctgggattacaggcgtgagccaccgtgcccagccaattcatctcattttttggctgatgctgtttctttgagatggggtctagctccatcgcccaggccggaatgcagtggtgcactcatggctcactgcagccttgaacttaagggctcaagtgatccctcctgcctcagccttctgagttgctgggactacaggtgtgtaccatcatacccagctcatttcttaatttaaaaaaattttttttgtagagacagggtttcatgatgttgctcaggctggtctcgaactcctggaatcaagcctcctacgtctgcctcccaaagttttgggattacaggtgtgagccaccacacccagccctgatctgttcttgaatcagttaaagccctcacactcccagaaggccgccagccaatgcacctgttggaactttgcacacagggtgtcttctcccttcaagcttggtctgcagctcagtaacaaatgggctacagacaccaggggcttgcccatgggagccccaaggcctaaagagggtggcagagatttgatgtctgtcactctccacctgcagcctcagtccacggtcggccaggcaccaagagctcacactttgccctcctaaatgccaggcccttcataagtatcatctcattgttaagagcggaggcttcagcgccagacaaatgcgagtttgtgtacaactcaaccacgtgctggtgggagagtcaccatctctgagcagacctgtgactcctgttccaaatggacgaggaaccactgcgatgatgtgttaggactcccagcctgccagaacctcacagcccctggcccttcacagcaaagttgaccgcagtgagcattccatccaccagtcagaacaccctggacgctgagcggccttctctgaaagcctggtgcctttgttagccctgggtgactcctgtgatcccagccaccaggttgtcactatagacctaatttaaccatctgtcctcagtaccgagggctcaacatttggaatgggaggtggttctgggagccaattagaggccaggctttgggaggtggcagaggtgagtctcacacctgggctctgtctgataagtctaggtctcggtcaggggaccttggcctaaagggcctgtcttgcctggagcgtgggagggggctgagtctacacagctggcctggcctcaggcctggagctttagctcaaggacgagaagacccataaagccagacccagctcccaacctcacatctgccacgatgttgctgctcagcctgaccctaagcctggttctcctcggctcctcctggggtgagtgggccaggaccagccctgattcagccctgggagcaactcagctcccagcaacagcccagggaaggagctaggctggctggaagggacgaaggtggacagagtgggcaaaagaaacaggatatgccagggcagtggagcagggaacaggcctgcagggctgggagggggcaagaggtggggtggtctcacaaataggaccagagattgagccaggccctggagcccgggagggtttaggaagctgagacaggaagacctgtccatgtcttttagaaagaaccttctggctgcatgaagggtatgaactgttcaggtcgggagggggcagagagaccaggggtagagatggggaacagcggggactaggctggagacagatgtaggagaacagcagggctgggggactgggtggatagggataaccaagatagctgtggggcccgaaggtgcttgcatgtaccctgttggggaaggggtagtgctgtaccctctcgacagacctctctggggtgcacagcctggggcacccaaaaggaggtggggaaagatgggctgaggcatgggaagcaggtcctcattagcccaatggccaggctgcggcattcctgccatcaaaccggcactgagcttcagccagaggattgtcaacggggagaatgcagtgttgggctcctggccctggcaggtgtccctgcaggtacaccaccagaggggtgggcagggtcctgggtacgtcatgcctaggggcagcctcagcagcccacccccactctgacctctgagccctgaccacaggacagcagcggcttccacttctgcggtggttctctcatcagccagtcctgggtggtcactgctgcccactgcaatgtcaggtgagtgcctgcattccacctgccccgcccctcgcctcttcctgcctcctcccctggctgtccccctctcgcgctggcctccctgcagctgcctaatcccacccccttgcagccctggccgccattttgttgtcctgggcgagtatgaccgatcatcaaacgcagagcccttgcaggttctgtccgtctctcgggtgagtgcctgggctgcagacacggaggaaaagtgggcagtgcaggtgggtgggtgctgggaacgaggaattcaggacatgccctggcctaccctgctcagcacccatcagaacatggactgtttctgaccccacaggccattacacaccctagctggaactctaccaccatgaacaatgacgtgacgctgctgaagctcgcctcgccagcccagtacacaacacgcatctcgccagtttgcctggcatcctcaaacgaggctctgactgaaggcctcacgtgtgtcaccaccggctggggtcgcctcagtggcgtgggtagggactcaggccaaagctcagggtgggaggactggggtggggaccagtgttctgggccccatgtgaccacccctcctggcccacaggcaatgtgacaccagcacatctgcagcaggtggctttgcccctggtcactgtgaatcagtgccggcagtactggggctcaagtatcactgactccatgatctgtgcaggtggcgcaggtgcctcctcgtgccaggtaagccccagcacccgctcctctgcgctgtcctgtggtatacctccccaaccccccctactcaattctccctccctcttccctctcagggtgactccggaggccctcttgtctgccagaagggaaacacatgggtgcttattggtattgtctcctggggcaccaaaaactgcaatgtgcgcgcacctgctgtgtatactcgagttagcaagttcagcacctggatcaaccaggtcatagcctacaactgagctcaccacaggccctccccagctcaacccattaaagacccaggccctgtcccatcatgcattcatgtctgtcttcctggctcaggagaaagaagaggctgttgagggtccgactccctacttggacttctggcacagaaggggctgagtgactccttgagtagcagtggctcttcctagagtagccatgccgaggccggggcccccacccctcctccagggcaaccccttggtcctacagcaagaagccagaactgttggaatgaatggcagccctccctggagaggcagcctgtttactgaatacagaggatacgtttacaaactgaatacgcataataaataactgcacattctccatccacaggccatggcatgaaggcccaagtgggtctatcaaaggcccacatctccaaaccccctgtcctgccctcaggaccaggcccaccctgggcaagagagaacgtaagccccagggcttcaggtccccagagacacttggggaactggggggaaattctgaggccatggggcttggttctccactgcctcctgcccagggggcattggggacggtaggaggatgtgtctaaggcatagtcgacttggcacagagtggtctctttagttttgtttcccactggaggtggcacatgcaggaaaagggcctggcccaggctgccgaccggcagaagctgagtgggaaccaaaccctcctgcaatggcaggggccctgccgtcaagctaaggccaaagctgggccctggccccattctacccactgaaggcagctgtggaggaaggggcttgggttccagcctggtttgtggtagggggagataccacaaaagaaatggggatggttctggctcaggcctctgggaaagcagccacccaaccccacccacctcccgcaggggctccttccagcttgaggctcagtgggacccagactggaaggttaatgctgtgaagggaagcagcacagggtggacggggcaaggccagctgtgagaaggcagtgcccctggcaccctggtttcagaggcaggtcacacagtatggctaagttccagggaggggtgcgcagaagctcagcagaaggggagaggtgagcagcccgggaccctcccccagggcggcaactcctaccttcccatgtcctcatggaggactacaggtgtgcaccatgggtgggtgtgcacgatgggcaggtgtgcacgatgggcgtgcagtgatcactcccaggctgccaacacccatgcagacaccagatggcgccttcgtgcagctgcagaggagggagcaacagagcctgaagggaaaaggcaatggggctgcaccaaaggatagaacccaggctgacactcgaccctaatcgggaggacccccttccctctgccttggcccccaggtgccccattccccaggtagcagcagtggggctccctttaaccacccccagttgggaaggaggcacctggggaatggaatggacatccaacggggagagggaggtagcggtgggctctacaaagaaggcaccaagggcggtgggctgagacccctcagaatctggagaggctggagcctgggcaagccgatgaccagcatggccacacagtccagaagggtgaaggtccacgccatggccctccaccagaggtcctgggaccaggaaggctccctggaggcaccatgaaggaagacagatcttggctgggaggtggagggctgtttcgacctagccaggggctacgggtccagtcaaggcacaagctttgtgcctaccagggtctcccactggagcataatcttaaggatcaggatgcatgggaatgtgtgaaaccagggagaagggctctgtggaggaaagggggtcccagaagtaactgtcccaaagggtcctgaggccacaggacactccacccagcactgcagttccctttgattggggaaaagtcaaagggcaagggagacagtgaaggccaggtcctatcccttcccaactccaccagagcagctgcccaccaagaggggtatcagtgccaggccaggctcccagttcagggggagtcacagccccctgtgctacctctactctgtcacacctggcccaggcccatggtgaggacaggggctgctgaaggcacagagaaagggctggagccagacattcttcacctactgtgggccacataggcctatctccagagagggcatcggacccagatggcaccacagtgtgtggccaggctgggtcgtgctgcatgtgtgcacagccaggcggctcagccattgtattgctgctggtagcgcaggttgagctcccgcagctcccgttcccgcacacggcgtga

SEQ ID NO: 15447 - DNA, 6333 bp, Human
cgggcgcggtggcgggcgcctgtggtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaagacttgggtttgacttgattgagcccaggagttcgagacaagcctgggcaatatagtgagacctcatctctacaaaaattttaaaaattagcctggtgcggtggctcatgcctgtaatcccagcactctgggaggccgaggtgggcggatcacttgaggtcagaagtttgagaccaccctgaccaacatggagaaaccccgtctctactaaaaatacaaaattagccgggcatggtggcgcatgcctgtaatcccagctactcgggaggctgaggcaggagaattgtttgaacctgggaggtggacgttgcggtgagccaagatcacactattgcactccagcctgggcaacaagagcaaaactccgtctcaaaaaaaaaaatttatttttaaattagccaggtgtagccacagctgtagtcaaatctactaggcaggctgaggtgggaggattgcttgaacctgggaggcagaggttgcagtgagccaagatggtgccacggcattccagcctgagcaacagcaagaccctgtgtccaaaaaaaaaaaaaaaaaaaaccgtaaaataggccaggcacagtggttcatggttataagcctagcactttggaaggctgaggagggtggatcgcctgagctcaggagttcaagaccagcctgggcaacacggtgaaaccccatctctaccaaaaaaaaaaaaaaaaaaaaaaattagccaggcatggtggtgtgtgcctgtggtcccagctactcaggaggctgaggtggaagagtgcttgtgcctgggaggcagaggttccagtgaaccgagatcacaccattgtactccagcctgggcaacagagtaagaccccatctcaaaaaaaaaaaaaaaaaattaagataaaccctttggcagctgcgtgctgctcttagcctcaaacccaagtcttttttttccccctttgagacggggtctattgcccaggctggagtgcaatggtatgatccatactcactgcagccccgaactcctgggcttccaaagtgctgggattacaggtgtgagccaccaggcccagactgctgaagggtttaaaccagagaaagaatgtgaccagatttccaatttagaaagacccgctctctgcagggtaaggagtagcctgggggtcggggggcggggggcaagaattgcaaggtaaccagggaggccagtgcaatgtccaggtgggagaggatgctagctgagactagaagtgctaggaaaaggatgtgtgcagacaagaggtcactggggaggtgaaataacaaggcttggccatgagtggaacccaacacccatggtgccctcttgagagagggaagatggcacctgagatggaagatggaaagaccagggtccctgtgactgaggactgagcctctgtttgaggtttttgcagaggagtaaaggcaacaaaagaggcaagagttggaagaaaggtgacaaggaacaaaagtcagctatgcctgatgctactgggtggccagcaacaatgctgacttggccaaggctctgagagctttactatgctgggactggaggtcagagttgaggctagggtaagagcaaggggctcagatggagggggaggaggacctgaacaagtccagaagggaagagatttgtccctctatccaacagagtacccagtgagcagcacagagggcacagcaagggacatcacccggttccccaaatgctcagagccacaagtgaagccaaaagtgaaagacaagatgcagaaaaccgccacgggcctttgaggaagggtaaaggcgaaagcgaaagcaggaagtacagacgtgaagcctagcagaggactttttagctgctcactggccccgcttgtctggccgactcatccgcccgcgacccctaatcccctctgcctgccccaagatgctgaagccagccctggagccccgagggggcttctccttcgagaactgccaaaggtgaagcgggggcgcggggggcggtcactcctgagccgcctctgcttgctcgtggccttttttcctggctgggggtgggggagggtgtgttggtcgacttgggttccaggcttaccccggaagatgagggagacggggaccaggttaggggaagcaacaggggtcttgaaagcagagccgaaacatgggcgccctcctccgtttccagaaatgcatcattggaacgcgtcctcccggggctcaaggtccctcacgcacgcaagaccgggaccaccatcgcgggcctggtgttccaagtgagcagcggggagggacggggagctggaggggagccgagagtatcgagcaggcactgaagctgcggtccctccctctcctcaggacggggtcattctgggcgccgatacgcgagccactaacgattcggtcgtggcggacaagagctgcgagaagatccacttcatcgcccccaaaatctagtgagactcccgagcccagttcccgtacgcaaaaaagaacggccccctcgttcccactccggtccccgcacgtcccagccctgcccacaccgatcctcccttttgcctcagctgctgtggggctggagtagccgcggacgccgagatgaccacacggatggtggcgtccaagatggagctacacgcgttatctacgggccgcgagccccgcgtggccacggtcactcgcatcctgcgccagacgctcttcaggtgcgggggcagggctaacaggaccccggcaggggtagttacggggttggggccattggaaggcgggacagaaagaagggcgggaccgcgacgggccaggtgaccggaagaggccggcccaagagaacctgggctacaggaaaaggcgatgtcagtcatcgggcgccagcccacaggaaggggcggggatagcacctaggagctgggcatagagaggtggggcctaggccccagcttgtggccgaccccgcccatcctcgagcaggtaccagggccacgtgggtgcatcgctgatcgtgggcggcgtagacctgactggaccgcagctctacggtgtgcatccccatggctcctacagccgtctgcccttcacagccctgggtgagcgcttctgtcccttctcctcgaactctgcccctgtgaccttggcctcactccaaacggcgtcgcagcggttgacttcagatgcttctcctgccttcaggctctggtcaggacgcggccctggcggtgctagaagaccggttccagccgaacatgacggtgagcggcctctgtccccgactttgtggtcgctggtgggatgtgcacccgggagctgggggagcacaggaccctggcccagtgcgggtggctaaggcttgtcggaggaggtgaccactgaagggtgagtggagtaagggcagagaagtgcggtcccgacataacaccgtccaataccaaagcctgcacggctgggagaagtcgaagctcacagaggatctttaggagccgagggcggagagaaggaccagtagggtcctacttatatcaacgtctggagcctagattttgtttggggtgggatggaagcaggtgatgttgcctcagaggtggctaaggctcagagggagaaacacagtgggggtttggagggcaagaccagattgggtaagtggacaggcaagtccccaggctgtagcctaagttaacagcagagagagcccgttaggtctcacacacccatcaccgcagctggaggctgctcaggggctgctggtggaagccgtcaccgccgggatcttgggtgacctgggctccgggggcaatgtggacgcatgtgtgatcacaaagactggcgccaagctgctgcggacactgagctcacccacagagcccgtgaagaggtgagagctggagatcggggaccacagggatgtgtggggctatagcaggggagatagggggctgcaaaaaggggatgggccacatgacaggcccatgttcagaggctgtccctcctccctcccaggtctggccgctaccactttgtgcctggaaccacagctgtcctgacccagacagtgaagccactaaccctggagctagtggaggaaactgtgcaggctatggaggtggagtaagctgaggcttagagcttggaacaagggggaataaacccagaaaatacagttaaacagatggctgtgtcattcttgagtggaatggggtgggcaggcagccagcagggctctgtagctaaggcgtccctgcaggggccattacctaccatagctctagtgtctggcctaagagatgcccttcacccataacctcaggcacctacaactccagaaccccagccctggccagcattgcaggcttggtctccacccaaaccttccttctgactccacacttgaaggctcccccaccactccactgtcttgctcttgccctctagtccactggagacttgtaaattatgaaataccccatgtactaccccctcctagagactttccatggctcctcagtggcccaggacaaagctcatacctttcaatcaggcccccacaggccccactgagggctaaagtgctgacaagaggagccgctccctgactccaaggcaagttctcaccaagcactcctcaacctcgcaacatctttacctgtgacaccccttagatgacgaggcatgcctgcactgctcacgtgaagctcgtcttctgtctgcacatgctgggcttgtgactccaagttttccaggctaataagggtcacaggactcacatggggagagatgacacgtttctccaacaaacctttgctgggcccctgctgagtctcaggcctggctgctgggtgccagcaagagcatcctgtcctcagcgagaacggctgaactccgctggagcttcagaaatgtcagggagagtctacccagggcccagggagggtctatgccgggctgcacatccccaggccgctgagtgtgctccctgcaccccaacattctattaatgaacatttgtaaatgtaacagaaaagtagaaagagttgtatattgaatacccttatactgtcaggtcaccacagacctgacagtattttgttatatttgttttatcatctattcatccctctatccattaattcatcgctcctttttttttttttttttttttttttgagacggcgtctcgctctgtcacccaggctctggagtgcaaatattttgttatatttgttttatcatctattcatccctctatccattaattcatcgctccttttttttttttttttttttgagacggagtctcgctctgtcacccaggctctggagtgcagtggcgcaatctcagctcactggaagctccgcctcccaggttcacgccattctcctgcctcagcctcccgagtagctgggactacaggtgcccgccaccacgcccggctaattttttttttttttgtatttttagtagagacgaggtttctactgaacctgttagccaggatggtcttgatctcctgacctcatgatccgcccgcgtcggcctcccaaagtgctgggattacaggcgtgagccaccgtgcccagccaattcatctcattttttggctgatgctgtttctttgagatggggtctagctccatcgcccaggccggaatgcagtggtgcactcatggctcactgcagccttgaacttaagggctcaagtgatccctcctgcctcagccttctgagttgctgggactacaggtgtgtaccatcatacccagctcatttcttaatttaaaaaaattttttttgtagagacagggtttcatgatgttgctcaggctggtctcgaactcctggaatcaagcctcctacgtctgcctcccaaagttttgggattacaggtgtgagccaccacacccagccctgatctgttcttgaatcagttaaagccctcacactcccagaaggccgccagccaatgcacctgttggaactttgcacacagggtgtcttctcccttcaagcttggtctgcagctcagtaacaaatgggctacagacaccaggggcttgcccatgggagccccaaggcctaaagagggtggcagagatttgatgtctgtcactctccacctgcagcctcagtccacggtcggccaggcaccaagagctcacactttgccct

SEQ ID NO: 15448 - DNA, 14967 bp, Human
aacctcccctcatcccccatgtcctgcatacctgctggtgcaagcctgggactctagggcgcccctgtgcagcctattctttcctgaagcttgcggtctgctgggcaggtggccatatcccagagcatttgtgatacagaactgcagagaccaggccacacgtggcggggatgagagccaccggtggagacacctaagccaccggggcaaggggtccaaaagtcttctaaggagggaatttctaagttgagtcttagaaagggtgagcgaggcgaggggcagaggatggggaatggcaggcagggacgggacacaagtgagaggcgggcgtccaggggagggggctgcagagacccgcaggcctgacagaggggctgagctccccactaagggctgagggagttccagtaggtgtgaggcagctgtgacacagcggactacatagagagcatccctgcagcccttgtggaggctgataaagttggggaaccgtgatgcagtcccaggccggtgcagggggtccagcaggagtggcagggactgatggggactgaggaaaggcagagtccagtgacacctaggtccctggcttgggtgaccagggattcaggaggaggagagggtgtggggccaggatggatggcaccgtgggctcagaccccccaaagtgccagggcaggagctgggctgagtcagcaagacagtgggtgggaaaagagtggcccaactgctccagtcatggaaagtctgggttacgcttctataggctccccgacggggtgatcacacgtgggtccccggagactgggcaaacactccagaagcttgtctttattgattttacattcagcacaatagatgcacctggcagccttgcctaggtggagctctgagtctgctctgagacccacttgtggctcccacaggggacccagggtgggcttattcagatggctgtgggtctcgactgggctgcatcttggagtacatgagggacagcggttaaagcttgggccagacccacacagccccagggagcttctccaaaagtcacagggactgtcaggggaactctgatggttctggaagttggtaagacgcaggctgcgcttggatcctcattgctggggggtttctcccgcggtcagtggagtggaagcaccaggcttggtgtgatcctgcaggctggggccacagtgacagcccggttgtgcatggagggggaccgccctcccctgcggccctgctggccacactgccctctgctccaggagtctctggcccctttgctctgctgttttttcctgctctgtccttagctggcaggcactccatgacaagtggccatgtttgtggctcctctgacccagggtcacctgccctctcattctaaaaactgccctggctcctgatgggcttccggcggcccccggtcagggtgggcccaggcatcctctaggatgccctgcctgctccctttgcacccacaaatctgtaagtctctgaaaaccaggaccatttttcaagcaattgggttacaaggtcaagatggttagttaggggcagtcatatcaccaagctattcgctccaagagaacagcatacatggaggaagcggtgtgcgggggctgtctcccagccacctgctgagcctgccagctccagcctggttctcagaactgtcccactcacaccaggggaagcaggagtgggatgagctggggcaaaggccccatatctgacccactcccctgaagatcactaaaaacagtccccctacttttgtctctgcagggtctgcagtaggcctccgcatggcccaccgaggtgaaccatgaccggctggccaacattcgccattgaccagccggagttgcatctcgccaggaggtgacccctcctccagctgcccccaactcgcccaccctcgcccaggaaagtgcccgcagctgccacggacaccatgtagtagggccggctgcggcgcccagtgagctgcgatggttttgtacacgaccccctttcctaacagctgtctgtccgccctgcactgtgtgtcctgggcccttatctttccatgctactggctggtggaccggctcgctgcctccttcatacccaccacctacgagaagcgccagcgggcagacgacccgtgctgcctgcagctgctctgcactgccctcttcacgcccatctacctggccctcctggtggcctcgctgccctttgcgtttctcggctttctcttctggtccccactgcagtcggcccgccggccctacatctattcacggctggaagacaagggcctggccggtggggcagccctgctcagtgaatggaagggcacggggcctggcaaaagcttctgctttgccactgccaacgtctgcctcctgcccgactcactcgccagggtcaacaacctttttaacacccaagcgcgggccaaggagatcgggcagagaatccgcaatggggccgcccggccccagatcaaaatttacatcgactcccccaccaatacctccatcagcgccgctagcttcagcagcctggtgtcaccacagggcggcgatggggtggcccgggccgtccccgggagcattaagaggacagcctctgtggagtacaagggtgacggtgggcggcaccccggtgacgaggctgccaacggcccagcctctggggaccctgtcgacagcagcagcccggaggatgcctgcatcgtgcgcatcggtggcgaggagggcggccggccacctgaagctgacgaccctgtgcctgggggccaggccaggaacggagctggcgggggcccaaggggccagacgcccaaccataatcagcaggacggggattcagggagcctgggcagcccctcggcctcccgggagtccctggtgaaggggcgagctgggccagacaccagtgccagcggggagccaggtgccaacagcaagctcctgtacaaggcctcggtggtgaagaaggcggctgcacgcaggaggcggcaccccgacgaggccttcgaccatgaggtctccgccttcttccccgccaacctggacttcctgtgcctgcaggaggtgtttgacaagcgagcagccaccaaattgaaagagcagctgcacggctacttcgagtacatcctgtacgacgtcggggtctacggctgccagggctgctgcagcttcaagtgtctcaacagcggcctcctctttgccagccgctaccccatcatggacgtggcctatcactgttaccccaacaagtgtaacgacgatgccctggcctctaagggagctctgtttctcaaggtaggagacctcggcccagcctgaggaccacgtgccagctggtcctagagccatgtaggcaggggggctgcagcggggagtcctcatcgtcatgggggctggagtgggaggttggagtgggaggcagacgcggtctttcctggagccaaacagcagggccctggctcggggacagggtcaagaccaatgcagggatgagcaccgaggctctgggctcagacagacccatctgggtgatcttgggcccgttcctcagatctctgagccaccatttccccaactgtaaagtggagagagggtgggagtggaacagagcagtaaggcctgggaagggttccgagctggcgcaagagtggcggtggtagccgtggagatggtggcagtgataaagtgaggaagaacaggaggtaggggccctgtcggttcataacgaggcagagagaccagcccagaccaagcgcatcaggcaagcagacgggaccctcaggtctccaggccgtgacaccgcctggctcactgaggccactagcttccctggcctggacacccctccctcctggctgtcgtgcagctgccctgccaggctgtctgcccaccagccatggtttcgcttccatagtcactaattaaagtgaatcataattatttctgctaatttggattcgattggaggagtttttaggctgtggtaatttggtcattacacattatcttctactgcgcctgagatgctcagagtgtcgacttttgttctctatccaaaagccgctcatggtgcttccacggttttctgaagcgtcatttggccagtggatgcggcacagggctttctgccctgagaggcagcagctgtttcagatgtgggttctgtccctttagggtgagacatgaaaaagtggtggctttgcagggagggctgcggttcagaggcctgcctagggcaggtttcctcacttcccagttcgccttcagaagcaaccacactccgcctgcccagggaaacactggtgcgcaacctggcgcctgccatgagtggcagagcttgtcttcaagccctatgggagccagggcaggcagcaagggccctggcccccacttctggttcgtcgatggctcttgtgtggctctgccaggcccagagtttgggtcctctgctcttcattcacagcaagggatgctgaaattgaagcaactcctgacagatagatccaaccttcccattttggcatatggtccgttggtgttctgttccctggatatatttttgtctcgacagctagagtgactttctggggaggaaggggatgtgttgccaggtccagggtgggaggatgtgccccttactcccacccctcactcccaccctactacaggtggctcagaggccgggccctcccccgccccctaccccagcccacttctgcacagatcaatccacacatcctgtccccacctccctcctctgtggggcaccctcactgttcccactgagctcaacagtgtctgcctgggacagcccctcctcccaggttctgtcctgaaagttcttttcatcttcctctacctcctgggtctcaaactgtaacctgatctatgacattcaaaaattttttgtattgaccaattttttttttttttttttgagacggagtttcactcttgttgtccaggctggagtgcagtggcacgatctcggctcaccacaacctctgcctcccgggttcaagcaattctcctgccatggcctcccaagtagctgggattacagacatgcaccaccacgcctggctaattttttatttttagtagagacggagtttcaccgtgttggtcagggtgatctcaaactcccgacctcaggtgatctgcccacctcggcctcccaaagtgctggaattacaggcgtgagccaccatacccagccttgaccaatatgttaaaatcaagatatttcacagaaaacccggtttgcaggttctctcagcagccccaggcctgccacattccgtaccccacgcggctgcagtgagctggagccgtggttggctgccccgcagtggggtttcccagcaaccaccatgacacctgcctgggagtgagactctgcagcttccatttctgccctttctgaggcccctctgctttgtcctggcccagacctctccccccagccctacatctggctgcctccaggacacatccccattcactcgcaaaccagactcagcctctgccccgggctgctcctcttctgtgttctgccatcctgaagccagaaggaccaccttggctgctctgtcctgtgcccgacccatccattccaggcccctagctcactttccagatggccctgggtgcaccccacatctccagctcccttggcccaggccccctcctctgcatcagccctgctgtggtttcagccaccctcctcgtctgaggccaggtgtgactcctcttatgccctccactgcctcaggaagtctgaacgtcaccttgtaccacctcccgcccccctgcccccgccacccttagctccagctctgccccagccacaaccccgatgaggggctcctgtacccctggcccctgcttgtcttggtcccacactgggtgtggccacaccacctcatggagctccctcagcggccagccacacaatcctctcttcccttcatgggctcctctgccctcgtgcccagggtcttgtctgtccatcagacagagcaccaggacagcagagctgtggtgtgcccagcacacgcggatcccagcgcggagaagtgaagtacgtggggctgccttggggacaggcccagccggagaggggccgggacgctggagggactcgctgcagaaatcagcggtcccctccttcccggaaggccctcatggtttcccgtatgggacttcagagccttcagggaaatgtggctctgtgaaggaagggactggaatccctttttcctcacctacaatagagccttattctggacacctcttccgttgacagtctttgcccgccaggactcaaaggcacagcctttcgtgtgattgcttgtttttgcaagagaaacacaaggctctgcggctcccaaggccacgagccaggaatcaatgaggcccagcaaataatcaagtggatcttggtgagatcacacggcagatgaggagggagaagcggggcgggagggagcaggacctcgtcactcctccggccagtgggttcttgtcgtgcagggcccagtctgaggcctccctgcgagtgtccaaccctgtccgggacacagcgcggggcaggtgacaccaagtgttggatgagtgagaggctgacgccttaagaccaacaaacaggcggccggggagaaaccgcaaagacaccagctcctcagaaagcagcgcagagcagcgcacgacaaacagatccgactggaagctgcctcttagaccatgtgagcctgtgaccccggcccacaactcaacttctggcctcagtgtgttcaacggtaaaagcagcatcactttatcatgtgcctgagccgttgtaaggacccagaaaagtaatgtccatgcgtcgccaccccaccccagcacgagcccactgggcctgagatgatcctcatggaggaggagcagttgttgcctgaagacggcgcccccgtgtggtcttttatttattttgagacagtctcattctgtcgcccaggccagagtggtgcaatggggcgatcttggctcactgcaacctccgccccccaggtccaagggattctcctgcctcagcctcctgaatagctggggttacaggcatgcacacccagctaatttttttttttttttttgagacagagtctcactctgttgcctaggctggagtgcagtggcatgatcttggctcactgtgacctccgcctccaaggttcaagcgattctcctgcctcaccctcctgaatagctgggattacaggcacataccaccacgcccggctaatttttgtatttttagtagagacagcgtttcaccatgttggtcaggctggtctcaaactcctgaccttgtgatctgcctgcctcaacctcccaaaatgctgggattacaggtgtgagccactgtgcccagcacacccggctaatttttgtattcttagtcgagatggggtttcatcatgttggccaggctggtctcgaactcctgaactcaggtgatccacttgcctcggcctcccaaagtactgggattacaggcgtgagccaccgtgctcagcctcatgtggccttttgagcatggcggcttcatcagtgttttgtttttgcagcagaaccatcaatgctgcgtgatctcacagagccattcggggggcggggatgctgttaggctaaggtttgggtctgtctgtgggcaagaagtgaatggtgaacctgtggggctgaacagccagacgttcgtacccccaggtgctggggaaggaaggctgtgcattagggctgggaaggggatgaagagctgtagaaagccaggggcacctgctgctgaggacgtccagatggaggagataataccagcctgaccgactgcagcagtgaaggaaggacggagcctgccgaggctgttggagcagatgggctgtgacgtttgggctgctgtgagctccacagatgtggggcacccaccctgcggccctctgccctcagccaacaactgggagaggcagtgtgtcctgcccagccacctccctggagtgctttttgggtctggggtctcctcatcttgggaaactcagtctggaatggatttgcatggcttggggagggtacagaggcacaggagggaaggaatcccaggggcaggggatgaggagctggtaagcggcctctctgtgcagggcatctctgtggccatccctcacctctcctgggctgagcactgacaagggctccatcttgcccccacctggggtagggcagttatgaattgcctgcagggtacagtggagatgctaatttgtattaagccagcctttgggatcctgccagggtcacctgctccgtcttgggtaaaggaggtaagcaggaggtcggggcagaggggagacctgaagaggatgctgccacagtgggctcaggatggagccaggggtgtgcaggggccagcctaggacacaggtcagggagctctcatccaagacgggtgacaacgggaccacggcctataaagcagatgactcaccatgcagccagaaggcgacgaggccaggaggggcagggtctgggcctcttgctgtgtggggtgggctctgaggccacgccatggcacaggggcaaccccctgagatttcagggggagaaagcaccagggtgtgaccaggtctagggtgtaactgagggagggaggaaagagccacagacaggactggacaaggaactgagagccgtggccacgctggtcactgggagatggcagggcctgggcctccggggagccttgctgcggttcggcacttcccccatgctttgcacagatggccgccagcactccccacgccacaggccaatagtttctttcagcacccgcctctggcccagatccgtaagtccctagaagcaggacacatcctgtccctactcggaccccagaatccagccaggagccaggcttgtgagggtctgacctcatgggtgggtgggcactgccagtgtcctgtgctctcagggccacagtgactggcaggtggcagcactgaccccctcctcccccaggtgcaggtgggaagcacacctcaggaccaaagaatcgtcgggtacatcgcctgcacacacctgcatgccccacaaggtagggttgccgcccacctgtgttttttctaggcatgggatcagtgcctggggcctagctggggtctggggcgaacttcatcatccagtctctgtacttctgccctgcagaggacagcgccatccggtgtgggcagctggacctgcttcaggactggctggctgatttccgaaaatctacctcctcgtccagcgcagccaaccccgaggagctggtggcatttgacgtcgtctgtggagatttcaactttgataactgctcctctggtgaggccgggctcctccccactcaggtctccagctctggggaggctgtgggctcagtcacagctagacagacttcgttaggcagctcaaagaattcctgctcctcgagagcatgtgggcggggtatttagcaagactgatttctctgccccctagaaatcctagaacaggaagagcccacgctctgcctagaaagctggagacagagatgccctaaaaacgaacctctgacaaggaaggctgggggcctctgaagcagacaaaggacgagtccactagtaacacccatcaacggggcgccgcgctcttgcttcgagccagctgccattctatcgctgtttcacttaagtgtcttaacaaccccgagagggaagcattgcatgtctccacgtggtgtggtggaggaagctgagactcagagaggctggagaaccagcccaaggtcacatagccaggcagtgattgcactgggatctgaaccctgggaattgcaccttaaaccattagggtgaaagactacaagctcgtcatcagtgaaacagcaaacacttgctgtaaataactgatctgtggatccgatgaccacatggaccttgtggggaccttccttcctctgtccgaggaccgtggtcactgtcactgtcctcagagggaatgctgaagatcagggcgtgtgctgggggaggtgttctcaaggacacagaaaagcagcgacaaatgaagcacggggcacctgaatgggactgagatcccacccaggggcagtggcctaagggatgggggcctggcagcacatggggagtaactgatgggaagcaggggcacaggccgtgtgggacagcaaagccccctggtgcctcagcgtttcctccctccccgcacagacgacaagctggagcagcaacactccctgttcacccactacagggacccctgccgcctggggcctggtgaggagaagccgtgggccatcggtgagctggggctgggggaggaggatgggagctgggctccccacagacttccctcaaagatcaccaggacctaccccacaagaccccactgctggggaagggccccattcagctgcccctggctagcagaagcccgtgtccacccacagaggccaccccctagaggctgcctgggccctgcctgcagcgaccactgtcaccccctcgtcccccccaggtactctgctggacacgaacggcctgtacgatgaggatgtgtgcacccccgacaacctgcagaagtaagcactgcgctcccaggccagggacgaggcacaccctgactaaggtggagacagggactgggcaggacccacatgggagagctcagctcgggctcatgagggcttttatttggcagaaacctgtccctcatctcacctttgagagcttttgagagctgggagctgggccaggcaggtagacctcacgccctcacgcccaggggtactggccttgctaaatctctaggggtatttcccaaacctgttttcaggagctagccctgccccgagcccctgcctgctgggtacaggaaagggcctggaatttccccgggccaggccacaggtcgacccccatgaaagagctgctgggtacggcgcctgctgaaggcagcctggcagcttgcagcaccaatcaggcaaatacagacaccagctgcaataacacagccgaccattttcaaagtagagacagttccatcccagccaaaattcattcttgagcccagtaagatgtccataaagaacacatctgagaggccaacagcagaaccaatttataattcacagcccgagactgcagtcacagcgatggttccttgcagctaatttgagccaattaattagattatagactaaatttgaaacatcatcctatgctgagaaaattctttttatgagatgatgatttaaaaatgactaccagtagctctcagatcattgatgctggaattaattatcaagggcaaaggacagtgatggattccatttctgagctgtaacaatgtcctgaatgtcattagtgtatttatcttaaggctgatgaaaaccttgtggaagcccatgtttgcaggccctgcctcgccgggtgccccttttgcatccgtccaggcactcactgacctggcggcctttgcagggtctctcaccactgcacttgccatcccaggccctggccccagcctgccctctgcaatgggggctcccaggagggggtcctaagcctctggcccagtggtgctgaggccccaggggacaggctggcaggaagcagacgggcatactgcttgtctcagggcaacagtgccagaaagggattccagatgtcacatccccctgctccagcgccctgccctccctgtggatcccctagcaccatcatgggtttcctcactcagaagcgggatgacagcctgttccctgaagcgtcttggggcccacagcaaccattcttgtttcagaggaggaaacagaggcttggaggcttggtaacataagcagagtcacacagccacgtagggacagccccatttgagactcctcggaggtgctctcctggctccctcagctcctgtcaacctgggaacagtcacaagggtccccgagactcatggcaaagaccaagctcctcaaaacaggcccctgttggctcagggcagaagcccattctggggaacgggtgggatcagttctgtccgagttcagaaagggaaagtgagtgctggccaggctggggcggacagaacacttcgacgggctccggagcccagattcagccaggaacccacaggcaactcggcctacccccagctgaggccctttttggacccgcaggggagagatcttaaacccagcgctttggtcccacccacccgctcccacactgggaggagaccatggctccacacacagcccctgccaggcccacaggggcgggcatgggggcccacctgcctcctgcatgtgtggacagggtcctggagagtgaggagggccgcagggagtacctggcgtttcccaccagcaagagctcgggccagaaggggcggaaggagctgctgaagggcaacggccggcgcatcgactacatgctgcatgcagaggaggggctgtgcccagactggaaggccgtgagtcaggagggcccagcagccagggccatgcaaagagagagcagggcccgggccctgcagctctcgacagccgctccctgaaaccccacgccccaggccactcttacaatgatacccatcactccctcagacccttagggccccaggtcctccaggccccatccctctgactgcaggaaggtcccagcccaccccagccccggggcctcactttggggatccccaggccgctccctgcaagatgcccttggaatctgaccaggctgtttctcccctctcccactcaccccaggaggtggaagaattcagttttatcacccagctgtccggcctgacggaccacctgccagtagccatgcgactgatggtgtcttcgggggaggaggaggcatagaccgtccggagcagtggggcctctgccagcccttgcagctgcagcccatccctgggccatgtcccctccatcgagtgcccggtgcttgggggaggagggcagggacagggagggagccacagtcagtgcccgggaacctggaagctgcgctgctctgcgcctctgggcctcactgtggacagaggagtcaggcccgccccaggagcctccagctgcctaaccagtgccattctttcacaacacgattttctacaaatctacagcacaaccgagtttgtaacccgtgggttagtatgaggaccgggttcgtgtactctctgtatctcctcttaagcttcgtccagggttctttatttttgtctgctgccaatgtcgtctcgcatgcctgcaccctcgcatgcacgctgcccgcatgccacgtgccacgctgtagccacagaccccttgctcgggcctcacccaaggccaaactccaaacacaatcagaaccagccaaagaagcacttcctgggcacggccaccagctctcccgcctccagtgtgggccggctcctgcagggtccgagggctgcatctctaccagccagcccagggctcttcccagggtctcgcattcaagggcaattacattttaaaaagaaaaacagaaaaaggttaatcacaaaaccaaccctcacttcacagggtctgtaagtcactcatagaactttgctcttcccgagacagggtcccttccccagctcaggcacaacagagtctggcaggctctggcaccctgggcctcctccgggagcctcccatttgggcagtggagccataaacggggatccgagaagagagtatccactttttttttacaggaagaagggactcacagcataaacgggggtgggggggatcctgattttgaaaataatctatttgtagcttctcttctatcaaaaccaacacatcctcttctttctgccaatcctctcccccacgggacacctctctggttcgggaccaatccctccctggggacgtgccccacctgcgtgccggctgagctcaggaacccctgcctgccccccgggtggggctgcggctctggcctcccaggcccatcctcaacagctaccccagccaacaccaaggccacaaggggaccccggcctaggaggcaggaagccaaggtgcagagagcagcctggccctcaccagtgcgcaagctggggcagcaaggctgacagttgctgcatgcccagggcagggtgtggtactggcacccaagttcagcatggcagagctggccaacagcttgtccccgatctgcctccagccccaagatgcctacagcccccaggccccttcggcagcactgcctctgcccacctgcctttaagagactccagggctgctcctgtcatgcagcgaaggttttgtctgtttcaaagttcgagactcaacttgagggactgtttttgacaatccccgctgacctccgctcctcgtggcgccctggccctacacccagcctggcccagggccggctttgcctggtgaggctggagggagcaccaggacctgctgtctgctgtcagcccctcctggtgctggtgccctgatgctgtgccttgtcacccattgagctgcaagagggaccaagagggggccacgcagccagccagatgcctggccctgtgctggggcagacaacgctgcagagcccagggagcctggcgctaggacgtgcgtccttgtgacactggcctgtctgaactcacctggcctgggaagcaccgtctgcccgggcccaagccctgcccctccagagtccagagccaggaaggggctgctgagggcgagcatcctgctgggctctctgcccggcccacccctccaaggggctggcctgtgagccttgactgggattcatgatgtggaggcccccaacttccagaagcagctggtactctgctcacacaagcgactgggccggccggccctggacccctagac

SEQ ID NO: 15449 - DNA, 14345 bp, Human
gaggcaggagaattgcttgaacctgggaggcagaggttgcagtgagccaagatcgcgccactgcactccagcctgggcaacagagcaagactgtatctcaaacaaacaaacaaacctggaactatgtcttgtgttaacaattttatgaaggcatgaacctcttctggtgggcactacacaccttctctggctgaatgccctcatccattattatttgttctctcccagaagcagtctacactacagattcaggagatattctctgaacccctcctcattctccaagagttgtaaacttgcatggccatttacaaggaggaaatagaaaccaccatgccaagccctaattgtattagccgtcagactgcagagcagatggtccactacattcattcaaaatgtatttgctaggcggtggtggctcacacctgtgatcccagcactgtgaggggccgagacgcaaggatatcgagtctgggagttccagaccagcctgcgcaacatagtgagaccccgttctctacaaaaaatttttaaaaaaattagccgggcgcggtggcctgtgcctgtagtcccagttactcccagctactcgggaggctgaggtaggggaatcacttgagcccgggaggcagaggttgcagtgagcagagatggcgccactgaactccagcctgggtgacagagtgagaccctgtcttaaaaaaaaaaatatatatatatatatatatatataaatatacatatattaaaattaaaaattacccgagtgtagtggcgcgtgcctgtagtcccagctactcggtaggccgaggtgaggatcgcttgagcccaggaggtcaaggctgcagtgcgcctcgatcacaccactgcactcagcctaggcagcagagtgagactctgtctcgaaaaaataaaataacaaaatttattaaataccttctatgtgccaggcactatattagggactggagccaccaccacaagctagagaagacccttgccctccaagagcttagactctaatgagagagtaatacaaattacagactacatgaatgcaagaaatacacagagcgttgtagaaagagaaaaccaaggttacagaaggactctgaggaaactagcatttgagatctacaagacagaccgggataaaagttggggaagagtttttacaggtcaggaatccttaccccaactttcccaagaaaaggccctaaggtagaaagaactaggttgcataagcaaaatgtgccaaaagcctgagcgaccgaagcacttttgcagaagccccccgctcctcatctcctatcacatcttctgctcaatcaagctgggccttgtcgacttcggaaaggcgtttggattttgttctaaaagcactgggagccactcaagagttttaagcagaagcgtatctacactaggcttacgcttttacaggaccactctggttggcgtgtagtgaatacacgactctccaattactcagaacagtgagtggcaaagacaacaggtctggcaatcagagaactcgtggcccagttaggggtgcgatggttggagctactgcggtctctgtggctgaggggaggcgccaggcacgagtactgcgacagagccccgcgagtggcaggcacccggctgcactgcagagccggggccagcctagaaccccgctctcctgcaggcccgggtgtcccgagctgccccacgcggaggagtccaagtaggcccacgctaggctcctctgccgaaaccctggtgccaaggacaccatgctcgctgcacacagaaccccaaagcgaccccaccttcccagcatacccagcgcctcacccgccgcgggaaaccctccgctcgcctccgctgctaccacttttaccgcggccagcacgcggggcgggacctcgcagcgtcgaggagcgtgctggggggcgggtcctaaagcagaactggaaagctatcccatcacaccccgcgagctcccacagtgctcagcggcagccactatggaggccgccaggaccgctgtactccgggtgaagcggaagcgcagtgcggagccggcggaggctcttgtgctcgcttgtaaacgcctccggagcgacgcggtcgagtcagcggcacagaagacgtcggagggtttggagagagcggcggagaataatgtcttccacttggtggccactgtgtgctcccaggtattgggcgtggtgcagctggtgtggagggcatcttcgggtgcagccggtacgaaacccgatccctgacccgctcgcgaactcctgcttacgctggcctccgtcccctgttgccccctaggaggaaccagtccagcctctcctgcgggaagttctgcgcccgtcacgggacagccagcagcgtgtccgccgtaatctccgcgcctcggctcgggaggtccggcaggagggccgctaccgggtgctttccagccgccgatccttggggaccacctcgagcggccaggagtccgagtacacgccggggaacccagaagccgccgggaactcgggctttcagttgttagaccttgtccacgaggagggagaacctgaagccgcctctgcaggctcctgcaaagtgagtatgcccctgaaggtggtcgctgggcttctcaggatggtaatgcaagaagactgggcccagtcgcagcacagtttcatcttaaggggatggatgatccatccggcgtgacggcctcattttacagatttggttgttcatccaacatgtgtttactacgtgcctacgatatgccaggtatttttttagattctgtggatacagcagtgaggacctaacatgcaggtagacagaaacagtaaacaagtctattcagtgtcagatgatgataagggatgtaaggaggcggggagacaaagcaggaagagtggtgccacttcagtgagagtgtcactgaggaaatgacatttgagtgaagacttgcagaaggtgaatggcagggtattccacatatcgagaggacttctaggcagagaacctgaaagtaaagaggcccttaagccgtttctttgctccttgcaaggtgcctggagcccggtgagctagaggagagcagtaaggaatttgaggggaggatgcctgctaggtacttgcaaggacattgcctttcaccctgactgagatggggatcactggagcaaaatagagatagagcaggtaggaaaattgatcaaagagaggttaaaggaatagtcctggatagcatatcaagtttgaggtagatttaggtctagaatgcaagttttctcacatttaatccagtgcttttctttatattacatttgctaacttcatttgcaatcacttccaaaaaaagtctactacatgcagcaaaactacagaaatggaaaattctccttgaggctgggcacagtagctgacgcctaatcctagcacgtagggaggcccaggcgggaggatcacttgagcctggggaggtcaaggctacagtgagccatgattgtgcggcagtggcatttcagcctaggtgacagagtgagaccctgtctcaaaaaaaaataaaatactccctgtaatcccagcgctttgggaggctgaggcaggagggttgcttgaggccagcctgggcaacaaagcaagaccttgtcactacaaaaaggaagaggaaattagctgggcattgtggcacgcgcttgtagtcctagctactggggaggctggggcaggaggatcacttaaactcaggaattagagattgcagtgagctgtgatcaagtcactgccctctggtttgagcaacagagcaagatactgtctctaaaaaaaaaaccagaaaattctcaacataaagtgtgccctctctttttttttttttttttgagtcagagtctcactctgttgcccaggctagagtgcattggcatgatgctggctcactgcaacctccaactcccgggttcaagcaattctcctacctcagcctcccaaatagctgggattacaagcgtgagccaccacacccagctaatttttgtatttttagtagagacggggtttcgctatgttggccagtctggttttgaactcctggcctcagtgatccgcccgcctcaacctcccaaagtgctgggattacaggcatgagccgctgcgcctagccaatatgccctctcttgataaacatttttatagaactcattttaattatttttgcaacttaaaacaattataattcaaaatgaatccacaagcaacaagcaaatggtactagtgtaattgtttattgttgtttttgttttgtttgagatggagtctcgcccttgtcgcccaggctgtagtgcagtggcgcgatctcggctcaccgcagcctctgcctcctggattcaagcagttctcatgcctcagcctcgcgagtagctgggattacaggcatgagccaccacacccggctaattttgtatttttagtagagacggggtttcgccaccttggccaggctggtcttgaactcctgacctcaggtgatccacccgcatcggcctcccaaagtgctgggattacaggcgtgagccaccacgtaccagctggtgctagtgtaagtggatagcaatttgtgtatgatgtccatagccacatctttcaccaaaacattccaactaatgcatgacttacaaaatgtgtaaagtaaaccaatgctccgtggaattgaatcaagtaaatagttcactaggccgggcacagtggctcatgcctgtaatcccagcactttgggaggctgaggcgggtggatcacttgaggtcaggagttcaagaccagcctggccaatatggcaaaaccccatttctactaaaaatacaaaaattagccgggcgtggtggcgggcgcctgtaatcccatctactcgggaggttgaggcaggagaatcgcctgaacgcgggaggcagaggttgcagtgagccaagattgcaccactgcactccagcctgggcgagaagagcaaaactccatctcaaaaaacaagagtaaatagctaatttaattttataaagaaaactaggagataaactgatgaccgatatgaacagagatttttccagtaaagcaataccgactctaaacataccaaaaatgtttgcacagagtaattataggggaaaaatgaatttaagcttaaagcatgcttgaggttttatgcatactagactagcaggaaaaaagtagttgatagcaatgctggcaaggcaatgattaaaagcgtacacaattgtaggaataaaattgatgcaagccttttggaaaacaggatggcatgggagccatgttttacatatgtaaatttattattgtttggatctaaagccatgcataatctaggaaaattttaaaattaaaaatttctaaggaaatttaaaaatgacagcatttctatgttatgttacaatgaatttctccttaaattgacacaatttacattttaagcaaataaattcctattagataaatttaataggaaatttaaaaattaaaggacttcagttccttttaactagtagtctcacctccaagatttatcctagggagataattcagcagaagcaaacagctaagctaagctatgatattaacaaatgctactgttgattgactaagtaattatgtcaaatagcgtgctaggtacttgttatattttcttttaatttaactcatttaatcctcacaaaaaccttatgagtgagatacttttcaaatgcaggaaatggcacattcattgcaacactatacatggaggttaaaaattatatccaagaggttgacacatacaactgtctggacccttagaactgataaccatgaaaactgattgtgggcgaaaatatatatgtttaacagtacaaaatgctgtgtgtagtgaaactgaaaatatgggctgggctcagtagttcacacctgtaatcccaatactttgggaggccaagaaaggagcacttgagcccgggagttaaagactgcagtgagccatgatcatactgctgccctccagcctgggcgacagagcaagaccctgattctgagtgaatgaatgaatgaatgaatgaatgaatacacatggacatagacttcaaaataattttcagcaagggtacggtgggttactcctataatcctagcactttgggaggctaaggcaggaggattgcttgaggcctgaagttcaagaccatcctgaacaacatagcaagactccatctctacagaaataataataattatttttcttctagctaggaggagtggtgcacacctttagtcccagctactcaggaggttgaaacagaaagatcatctaaggctaggagttcaaggccagtttgggcaacataatgaaaaccgcctctttaagcaataataggccgggcgcggtggctcatgcctgtgatgccagcactttgggaggccaaggtgggtggatcatgaggtcaggagtttgagaccagcctgaccaacatagtgaaacccggtctctactaaaaatacaaaaattggccaggcatggtggtgcgtacctgtaatcccagctactcaggaggctgaggcaggagaatcacttgaacccgggaggcagaggttgcagtgagctgagatcacgccattgcactcaagcctgggtgacaagagcgaaactccatctcaaaaaagaaaaaaaataatttatgctcattatgggaaatttgaaaaaatatagcaaaggaggaaaatctcccattttaccatcaacccaaaagtaggtagaatagaactggtttatttccttctgagtacaaaattctgtatctgtcatttttctgtattgctagtcttgtacctttttttgagacagcgtctcgctctgttgcccaggctggagtgcagtggcatgatcacggctcggtgcagcctccacctgggctcatgtgatcctcctgcctcagcctctcaagtagctggagccacaggcctgcgctaccacacccagctaatttttgtattttttgtagagacggttttgccatgttgcccaggctggtctcaaactcctgggctcaaacattcctccgaccttggcttcccaaagtgctgtgattacaggcatgagccactgtgcccagcaatcttatattttaatggctgcataatttgactgagtggagggacttaggggttggagccagaacttttgtcataggtaactttaagtttgctcaaggttctgcagaaaaactggcatctctagcttctttttgactttggagcaaggaagaattccttagtctgtaaattatagcattggtctccccttgtctgccttggccatgggatcttccccattttcctgcgtggtgtctgcttggagctgtgcagtgtcctgtgatgaacctatcaagaggagccatctgcagcatgtccctgtggttaataaactgacccatgctaccaggcccctggataatacagcctgtcagcactggagcacatcttacctgggccatttctattctggggcattgcatttcaaactgttctttccagtagaaagactataggtgagcccattcccaatttgtggttaaaagtaggatgtcaatatatggcaagccaaatgatgggcaatggtagaggtcaccaggaaacacctgttggcttctacaggaggccacacaaaatagagactcatttcaggttcagccataggggtgctacggtggacctactgatccccaaagagagaacattgtataataccaaaggatctcagaagacctatagaagcaggtctgactcagagcttggggtcaagactggccaggtcttctgtctttcccctctccttaggccagtcttcccatattttttttctttcattgttttgagataagtcttaatctgtcacccaggatagagtacagtggcatgatcacggctcactgcagcctcaacctcctgagtacctgggactacaggtgcacaccaccacacccagctaatttttgtatttctttgtagagacgggggttttgccatgtgggccaggctggtcttgagcttctgggctcaagcaagctgtccaccttggcttcccgaagcattgggattataggtgtgagagccaagcacaaaagagcaggagcctatcttgtacgtttctatcttaaagtaagaactacacattaattttacagagattcttgattttttaatgtaataattaattaaaagactaggaattcatggggataagaatcttgaccacaacactatggaactgtagctgagcaaggtggctcacacctgtaatcccagcactttgggaggctggggcgggcagattacttgaggtcaggagatcaaaaccatcctggctaacacagtgaaaccccatctctactaagaatacaaaaaattagccaggcatggtggcacgcacctgtagtcccagctacttgggaggctgaggtaggagaaacgcttgaacctgggaggcggaggttgcagtgagccaagaccacgccactgcactccagcctgggcgacagagtgagactccgtctcaaaaaaaactgtagggagccttccttcacccaactcataggttcctcctcttggaacatcatgttttgggtcatgcgtgtgtgtgtaatctgtggtttctttacagacatctgacccagatgtgatcctctgcaattctgtagagttgatccgtgagcgattgactgtgtctgaggatggaccaggagtcaggcgccaggaagaacaaaaacacgatgactatgtgtatgacatttactacttggagacggccactccaggctggattgagaacatcctctccgtgcagccctacagccaagaatgggagctggtaagggggcccatgagcagacggggcatgaggcatcctaagctcttaatctaatcagaatgctttgcttccctgggctccactcccgaacaacattgtccttagttcttttcctcctgaaaaggaagaatttattctaagtgccttttaggaacctgactttatagtacagggaatttggggaaagatcatcttagattgatcatttttacattaatgaatattttacaaggtttgcaacatcacctttattgtttatagctatccattcttaggggggaaatatgtatatggggcttatgataagataaagacgataaaatcagaaattcttaacatgagtgacaacaaaatctattttttaattcgtaccttagaagtagagaaacctcggatgaagaaagctaacgtcctgacattattcttttttttttttcttttttgagacaaggtctcacactgtcacccaggctggagtgcagtggtgctatctgagctcactgcagcctctatctcccaggctcaagcaatcctcctatctcagcctcccaagcagccagccaggagtacaggcatgcaccatgatgcccaatttttgttgatttttttgtagaggcagggtctcactatgttgtccaggctggtcttatggtcttgaactcctgggctcaagtgatccaccttggcctcccaaagtgttgggattacaggtgtgagccaccacacctagctgacaccattatcttttttttttttttttttgagatggagtctcgctctgtcacccaggctggagtgcaatggtgcaatcttggctcattgcaacctccgcctcctgggttcaagcgattctcctgcctcagcctcccaagtagctgggactacaggtgcatgccaccatgcctggctaatttttgtatttttagtagagacaaggttttaccatgttgcccaggctggtctcaaacttctgacctcaagtgatccacccacctcggcctcccaaagtgctgggattacaggcgtgagccaccgcgcccagcctattctcaaattctaaaatgcttaacaagaaaacttaaggtggcacctaatggtcatgctcagactataatcaagaagcactgcatcctgcacctgcattaggacagatttgcagtcaggtacccaccttggaccactgcatggcccttcctcctgcctttccgcacctcttacgcttgggttttggttttgacctttggaatttgaaggaatcgctcagagccatcactcctcttttccctgtgttcccttctcatggggtccagcatgtcctatcattgtggagctgggctctgagtggaagggggctattatctccctctcatagcctcttgtgcaatggagtcaaactactagtctgcagttttttcacagggcacttttacatgatatctcttcaagctggtatgctaacaacttcccccagagcataaccttagaggttttgacttggactcatgtttgtgttgagatgtgtaggtgaatgatgatcaagaaccagaggacatttacgacgatgaagatgacgagaacagtgagaataactggcgcaatgagtacccagaggaggagagcagtgatggagatgaggattccagaggtgggtggcagccccagaccgggagggactggtaggatctgagactgaggtgcaggcatagttgacaggtgcatcttaattgcctttccttctctgtcattgagcgccagcagcccagccgcaactgagccatgctgtaggagacccaaagaccagtgtttcccaggggcctcctgggggtgtaataatccatcaggcctggattcaaatctgtagttgtcattactttgctgtggctcttgggcagttacttcacctcactgagcctcattttctctccaaatgagatggttctgcatgaattttagtggttgagattatgtaaaatatgtagctcattgtctcttcccctgccccagtcaagaaaccaatgaagagagaggtttgccagtaggaataagcccagagttttcacaaatcagttatctaacttctcaaaaaactgctgcatgtacaactgttttgagaaagatgcaacacagacataatacctgggggaagaagaaagatgctctgacaacataattcccgtagtaactatattaaagaagagagaagaaggcccaacaaaaagaatttattggtgtctgataacagagaaatgaatcaaacaattgcatattcttttggggaggtttgtcaataacacgttaaaaggagaaaggtacaaaaatatttacaatatgactacaactcttacaacaacaaaaaatcctatacggaggggagaagtgacaaaatactccacggaggggagaagtgacaaaatactccagtgtgaaggaacttggtttagatgataggaaagtgattccttctttaaaaaaaaaagaattctatattcttttttatttattgagcaaggattttgcattacaatcgggaacaaaaacagacctttctgagaagagaaggggctcctgcagtagcctaggaaaatcacatttagaatccactcccgggatgtcattctaggctctgctgactacaacagcctgagtgaggaggaaagaggcagcagcagacagcggatgtggagcaagtaccctctggatgtgcagaaggagttcggctatgacagcccccacgacctggattcagactgatggtcttgtgatgtccatgaggttctgccacatgcccttgagggctctgagtccagagttaactgccctgctgacatcctgttaggtttcctagcttaacatgtggaaggaaaagcatatcaagcatatcgggcggcaccatcccaccacagtgaaaacttatgttaggggagtgagtcttttccacttacagtaggacccctttgcctcaatcaaaagtgaccctacagtttgaaagaaaaaaaaacgttgaaaaaaggaaggtttctttagctttagcttcttggcccaggaatttttcctggcattcaggttctgtgctgaaaccacaagggagggggaggttcccatttcattagcagtaagcttctgctgtgccataccaccaggctgcctgcctctaggaaaaccctgttccttttgatagaatctaaaaggggtaccagtgggtcccttgtagcaatacagactggatagtaatggccattagggcagaaagtagtctgagcagtgggagattttagttaacagctatttctgcttccaaactctgataacggttgtgaaattactgactgacttcctttggcagtggggccaagaaacaatatatatgaatgtgatacatgtgtttagtaaaatctagctttgaacatggaagaaagtaattctttgaaaaccttttaaatctgaatatctaaaacagggagcggtagtgaaatagaaggttcagcattgattataaataccaaggacttaaggcaagggaggaaaaacaaagtaccttctgaacttagctttccactgagtaatgtttactcttcacagcacccaccacaaaaacaaactactatcaacaggatcaattttattaacaacttgtatctcttctaagcagactctgtccgtatgcctttccaaaccatagctgccttaactgactgccttggtgtttattctagcgtaacattgtccagtagaactatctgcagtgatgatatgttctgtgtctgcactgtgtagtagtagacacgggtggctgctgagcacttgaaatgtgattagcgcaactgagaaactgagcttttaattttatttcattttaatgtaattagctacacgtggctagtagctgttgcagcggacaccacaggtctaaggaaacaacacagaacattcagctaggggtgtaccctcatagcctgtgagtgtctcttactcactgtcatgggggaaggtgagttacacagggaggtaccttcttgccgcctcttttaggatttcctaagtatctctccttcatcctacctgccatcattctttgactttatgtccattttctaaacctttgcctacacttgctcttatctacatggagttgttcaacctgccgaagtgattaaattctgtgtacacaggccgtatatattgcagctaattaaaacaacaaacatcctaggcatgcacaaaggtataattcaccgttataacaggcagcaacttgtatgtctaatattagacatcttgctttctgtctgtaggcatagaaacaaaggattgaaagccattctcatacagcaaccgggtgaaaaaaacaaaacactgtgctgttacaatgtgctccctgctatttatactcattaagtttccccaatattaaagggctgacaacttaataaactgtactcactgcaaaagggataataagcacaccaggaaaaggatttaaggagacagacaacaaagagctggcagaaattaattccaccatgaagcttgagtgctgtagggatcctctggcttcgctcccaaagagaggatcctgggagaagtctgtatccagcacagaggggaaaaatgctgtcaccatccaaaaatgaaaggaggatgacatggctcactaagcaagtactagggcacctggcatgtgaggtccttgctttccctagaagccactggtggggggcagcaaattcctgggattagctggttatctggtggagaaagctaaagctggggtcagggatctttaaaaggcaagcacattttgcttaaaggattagctccagaggagccctgggatgggtgccagcttagctcagacagaagtcatgttcttagcgttcaggcaagtcagcctttgcataagacaccctgtcgtcgggcaggaatttgccgttacaaatcccaaacccatgacagtaggaatgtcaccccatgcttcacatatgcattatgctctgaacccagggcaactatgaccatgcttccttcaatctttattgagcaaatatatggccaaggttattcccttatctgtgactgggtggagaagaatggtcaggaagggagactgcctcactgttgaccaattccaaaacctaaggataagcccatggggtatgtcaagctagcaggttcttctcggcccaggatgacagtgtctgggggcatcacaaaacagttgtacaatccaatgcagccgtcctgctcatacagtaagatccattaggccagagcaggcctaacttgggtggagagcccagcctgagcaccagaattagttgcttccacttgtgcagcctgctgaagagccggactcaggttgaagcagctttcctcccagtcttcactgatctccacagggagaaaacagaagtccccacaagtaccaagctcttc
